United States Patent 7,868,149 (PLANT GENOME SEQUENCE AND USES THEREOF) - sequence listing, part 79

SEQ ID NO: 42427 - DNA, 7646 bp, Oryza sativa
  unsure (1)..(7646): unsure at all n locations
nnnnnnnnnnnnnnnnnnnnnnnnnnnnnnnnnnnnnnnnnntttcactacgtggacttaacctgtcacacaatgccttcacaggacacattccatcgcagcttaattctctgactcagctggagtcattggatctctcttggaacaaactctcaggggaaatccctcctgagttagcttctctaacttctcttgcttggttgatctttcgtacaacaacttgaccagaagaataccgcagggtaaccagttcgggtcatttagcaacagctcctttgaaggtaatgtcaacctctgtggaaagccactctctaaacaatgtgatactccaggctcaacatctccaagtgcatcagctccttcaggtaccaacagtttctggcaggacagacttggcgtgatccttttgttcatcttttctggcctggggttcacagtgggcttcatattggcagtctggttcgaatcattgtgccacatagaacgatggaatcgcaaaaaacgatgattgttagtatacactatatgtatggtgtttatccacctacggacatgatatatgtgtatgtgtgtactcgtaattagtgagaatttaaattcattttctgttgataagaatgcagccttctgctttgcatagttttgtatatgtgattatcaggtctagtggcgccatctataagcaatgtgctctttgcgctaacctgtgcggtgggccggtggcgcattctcttgaacacctggtggccctcgtggtgtggtggtggaagaagagggcgatgacgaagcagacggacaggacgggacatcccagtagcgatccattgattgccgactgcaatatctgcttgaaaagtgcaacatctggaaccttggataccatctcaccttcctctccgcccccctcatcctcacccccttacaacctcatgccccattccggcgaggtccaagtggtggcggttatcacggattgggatgtgcgggaccgcctgaggtgggggagaaggacagcgaggggtggaagtctcgccgcagctggtggcggcgccgccgcaggccctccagggcggcatgcgcttcagccttcaggcagggcgtgcaccatgcaggagagggagatcgttccgagctcgccaggaggatggccgggagagatccccgcccttgtgcagacgctgccgcctctgacccgccgctgcacatcttcaatcgccggccgggtcgccgggaaagcagccggaggcgggacatggccgcggccccgtctggtgttcgccgcaacataacaggctttccgtgggcctccaaacatctcggcccgtacatgtcgaagtagttgacctagtaaacggcccactgcctagacagcacatggacacatggatgggccgacaacatcacggcctgttcagagaccgcaccatcggtctatcgcgctcacccgcccagtcacggtctcacggaggcgtagaagtgatcgaagtgttaaatcctagatttcacactgctaattgtatttcttttaatggtagatgtacacgttgacggcaaggcgcatgtaataattttattaatcttaagatataccgatccagtcttccggaggtgtttatagggataggatgagtatgtgcgcgttgtgagcgcttgtgtttgtgctgtgttttttaaaaatgaaaaatggttttgcgactaaactacatgttggtgacgtgacgctggcaaagtatgcacggcagctagctggccagctggtgctatcggatttgtatgtttcgtggtacttctgtgttcatcgtctgaccagggcacggccgcgacaacgacgcatgtacacttgttcacagccagttcaatctctaagtgcgattgacgtctcgcacgattacgatgccaagttgtcaatggcttcgtttcaacaaaaaaacatttgccttgacttgaataatctacctttctggccataggcagatagccagatatgtaggaagtttttaaaaatcgagcttacaaaagggcattttccctaagcataaagtccaatcgaagattgtaaatcttcttgtgctcaaacaaaggatctctgtctgagtcagacagtcataaaattagttgtttcaagcatacaacaatcaaaggcgccaaaatgtgtaccaggcaagctcgacgacggtactacgagacatcgttactcgtactgatgctcctcctcctcctacaagctaggctcgcgcaatcgcttcctccatgctcgccggaccaggccacggcgctgctccagctgaagcggtcgttcaccgtgaacaccgcgtcggccaccgccttccggtcatggcgcgctggcaccgactgctgccactgggcgggcgtccgctgcgacgacgacgacaacgacgccgccgcgagcgggagcaccggccgccgcgccacttccctcgatctcggcggccgcggcctgcagagcggcggccttgacgctgccgtcttcagcctcacgtcgctggggtatctcaacctcggcggcaacgacttcaacgcgtcacggctcccggccgtcgggttcgagcggctcaccgagctgacccatctcaacatctccccacccagcttcacaggccagataccggcaggtataggacgcctcaccaacttggtttctctcgatttatcaactcttttctatgtgatcaatcaagaagacgatcgtgccgatatcatggcaccttcgtttcccaactggggcttctggaaggtagattttctgaggttggttgcaaatcttgacaatctgagggagctctatcttggctttgtgtatatgtccaatggaggggaaggatggtgcaacgctctggttaattccactccaaaagatcaggttctgagcctaccattttgcaagatctcaggtcccatctgtcagtctctcttcagcttgccatatctctgttgttgacttgcaagaaaatgacttgtatgacctgagttcttcgccgatttgtcctcccttggtgttcttcaactctcaagaaacaagttggagggtttatttccagcaaggatcttccagaacagaaaattaacaaccgtagatattagctacaactacgaaatctatggcagttttcccaatttttcacccaatagtagtttgatcaatttgcatctcagtggtaccaagttctctggtcagataccaacctccatttctaatctcacaggtctgaaagagctgggtcttagtgccaatgatttccctacagagctaccatcttctctaggaatgcttaaatccttgaacttattagaggtttctgggcaaggcctagtaggatcaatgccagcttggataacaaatctaacatctctgacagagcttcagttttctaattgtggcttgtctggatcattaccatcttccataggcaatctcagaaatctcaggagactatctttattcaagtgcagtttttctggaaacataccattgcaaatatttaacttgacacaactgcggagcttggaacttccaatcaacaactttgtggggacagtggaacttacctcattctggagactaccatatttatcagaccttgctcttcaaataataaattatctgtggtggacggtttagtcaatgactcagtagtgcgttctcccaaagtagcagaattgagcctagcatcctgcaacatatcaaagtttcccaatgcagtaaagcatcaagatgagctacacgtaattgacctttcaaataaccaaatgcatgggccaatacctcgatgggcatgggaaacttggaaggaattgttcttcttggacctgtcaaataataagtttaccagtataggacacgactctttgctcccctgcttgtacacaagatacatcaatctcagttataacatgtttgaagggcccatacctatacctaaagagaattcagacttggagttagattactcaaataatcggttttcgtatatgccatttgatttaattccttatcttgccggtatactatctctaaaggcctctaggaacaatatctctggagaaatcccatcaacattctgcactgttaagagtcttcaaatccttgacctctcctacaatatcttaaatggttcaattccttcttgcttaatggagaattcttcaacaataaaagtactaaacttgaaggcgaaccaacttaacggagagttgccgcacaatatcaaggaagattgtgcatttgaggcattggatttcagctacaatcgatttgaagggcaactgcccacatcattagttgcttgcaaaaacttggtggtacttgatgttgggaacaatcaaattggaggctctttcccatgttggatgcatcttcttcctaaacttcaagtccttgtcctgaagtccaataagttctacggacagttggggcctactcttaccaaagatgatgactgtgaattacagcatctccgaattcttgatctagcttcaaacaatttctcgggcatattgcctgatgaatggtttaggaaattaaaagctatgatgtcagtctccagtaacgaaatattggtcatgaaagatggagatatgtatggcacatataaccatataacatatctttttactactacggttacatataaaggacttgacttgacatttactaagatcttaaagacctttgtactaattgatgtctcaaacaataggttccatggcagcattcctgaaactattgccacactaagcgtgctcagtggtctcaacatgtcacataatgctcttacaggaccaattcccaaccagcttgctagtctgcatcaacttgagtctttggacctctcttcaaataagctttctggggagatccctcaaaaattagcatccttggacttcctatcaacattgaacctatcaaataatatgctggagggaagaataccagagtcacctcatttcttgacactccacaatagttcatttataagaaatgctggtttgtgtgggcctccactgtcaaacgaatgcagcaacaaatcaacatcttctgaagagaaatctgtagacgttatgctatttctcttcgttggattgggttttggtgttgggttcgctattgcagttgtagtttcatggaaaccttgcattggcaaataatctttgaaggaatccaccctttttttatatttatctgttcaggagtctgccagtctgcttccccttgtaattttagctgtaattgtagctagcatgtatataatactatgtgcatggacaacacttttccatcatgcatgcatcctataagattagttgtttattaccttgaaaattttatacaagccaacaaacaattgttatgtctgaaacaagaaaggaattgaaatgcatgacctgtatgtggcattattagggtcagtttaacttgtagcatagatcagtgagctatatatcatgatcttgtgtttgaagtacatacttacgcagaacttactttgagtaccaaacaaccatactagaacaaaattttctgtgtgaagaactgaagtctgaagatcacataattacgcgttggaatgaaactttctgtgaaaagatcacttgcaatacaattgtaatcagagttatatgctgttattcttactagttgtgtaatactagcccgaatcttgtatgtggaccaaattaggtaaacatataggaactaaaactaaatgatgtcatccgagaacaatgcacaagcaaagcttaaaataaactgaaataagaaaacgaaattcattaataaaaactaaaactacacgattctttattaagtatcagctctacatctatatctaaaactaaaacggcgtcatatatcaggtcgcacattgaactgctagtctcctaataggccaataccacagcagagcaggaaaatcaacaccggaacactaagctgcattcgtaatttggtactagaatcgtagtaattccaaaatgggttcataatattcgagaaatcctagatttcacacactaacctgtgcaatgcagctgatggcaggaccattccatcaaacacctggcgtgcagagctcctgaggacatcgccatatggtgaccacattggttggtccaattggttgggatttcggtgtacgggctgcggtggtgggaatgggataggggagttcgccgagtactccaactccaaagtgggatgaagcggaggaggggacgacgaggggaagggctcgcaagtggtggccgctcctctctctctctctctctcgggtagttaactcatcatatcttcctatatagttgtacccactaaggagcatttacttgtataaagcaaagcatataagaaaccacatcatcaataattctaagccatcgagttgtattagtacatagttatcagccgttggataaagaagctactcatccatttaatttaatcattgattactcatccagtcacctccatttaactcataatcacgcgtgacattgttatccattttgcgcataatactatgttttcttctcccaagtcatccgagataatgcaaacttatctttttctaatataacttaaattattgtataagatgcgatttttgttttgttataaacaattggataacataaggtaattagacatcattaacataaacctatttttgaaacaagcttgatataaagcaaagaggtgcaggatactctaatagacgacatccagattgtgcatgaaaataactttcgtgcatcataagaaatcacaataacgtttaaaaaaataaaagatgaatggtattgtaatagcataggctatatattaagccacattatcatttattttgtatatatacagagttacatctaatcatttaaaatattgattttatttgacgataaaactagcaaatcccgcggcaagacgtggggtgccaactagttcatcatatgacaaaaccaatgaacatgcaaccaataagtactaaaatgatttcttgggttccgataaaaaaaattaatatagcacatagtgactacaaataaaatgacttcttgggtttcgatcaaaaatttaatatagcacagtgactacaaataggacttagacttttggaaaaaccaaataatgaaataggactttggcttttagaaggagggagtacatcgtaggcgtacagccgtacacggcgaccggctacatcctgtgcatatgtgggtactatgaagtgtcatgtagaacgaaactgctcccgaaataatggaaggagtcgattttcagtcctttttgtttcgggttaaaattattataatctagattattaagtcagataataagctggattataataagggactatcatatatctgttgacagaaaatcccatcttctatctttcgaattttggaccattggatatgctttcagattcgtgcagaacccttaaccataactcctctcctcctcccccgttcagatcgcgccgccaccactcctcatcccgtccctcgcgcgattccccgccaccaccccaccgcacctttgcccgcctcgccgactggccggaaagagtcaacggcgccggcgaggacccctggtgagccctctccccttcccctctcccctctcc

SEQ ID NO: 42428 - DNA, 73005 bp, Oryza sativa
  unsure (1)..(73005): unsure at all n locations
tggctccccgccactagatccgcaaccatcgtccacggcctgctaaccgcacgcttgctttcccctgccaccaatgccagcccaccgtcatcctccatccccgcggctctggcactgccgccggcgcctcgccgcccgcccgatccgccacccaccgccaggctgccgcctcccacggccctccctctaaagccagtgagctccccctcttctccctccccctcccacccctcccacctccaccacgtcctaggaccctaacccgtagggtcctttgctggagtctagggtgtcgccagcgctggagaagaggaggaggtcaccagagtcagaggagaaggcctggagcacgaatcgcgcagctcatccgatggtccaaaatctgtaagatttggggatatattttttgtcgacagaaggttagcaattccgttataattaactaaagtagaataatctaaaagattgtgagggtatatctgattttgcaattaagtgagataaaataaacttaaattatggaaggagtcggtttccactagttttaaaaggagttttttttagaaatagtacaactttaatggaaaattagagtgaattgcactttgggccatgttttattaccaaagtttcactttggaccaccctgtacgtaatcttttcgctttggactaggtaactttgcctttgttgcacagtgaactaccctaactcttttcgcttgtgatgtctagcgtctctttagacaaaagtatgtcatgcatataggtatgaaagtttgctggcatgccgttaacaatttgctcgaagttatcgaagaaatgaaaatgtgttttggggtggtccattgtgcactagtccaaagtgaaaagattagataaagggtggtacaaagtgaaactttggcaataaaatatggcccaaagtgaaattatctcggaaaattataaaagtaaatgctggttgataaaattacaaatttagcatcttgtcaaacaagcattgttcaataagcatacctgtcaaacaacagcttgggccgttcgacaggttagttagcttgatttacccccctaaactcgaaaatcggacatttgacaccctaaactcttaagaccggacaaattaccaccctaacatggttcgaagcggttttcagcctacgtggcacacacgtggcgatacagtcagcaaagataaataaaaaacaagtgggacccacttgtcagcgtttttttcccttcccttctctgcctctctctctcgattcgcagagaagagagcacacggctacggcgaacgtgacgcgctctgcctccgcctccaccaccgaccgcccgaactcgccgcctccatcgccggttgcccgagcttgctctgtgttcgccggcggatgtggttggacggccacgatgccaacgaccaggacgacggaccgttcgccgcctccacctcgtgaacaagagaagcagagaagggaaggggaaaaattgccggcttccccgacgacctctgcctcgccggcccgcatggcgtgttttgtgacgacgacgacgatgatggcaacgcgtcccatgttgtcagcatctcgctcggctacgtctctgacttctctgccaacccgagctgcgcgggcgccctccgcctccgtcaccgccacactcctcacgtccggcctcctcgccgcctccttcccgcgcctatgcagcctcttcgtctacgactgcttcgttggcgacgataacacgcgaccgctcccgccgctcaagtggcagctccctcccacgcttcagtccaggacctcgtgctcgtcaataaccccacgctctccggccgcctcgccatctccaccgctagcctcccgctcctccgccgaacgcggaggcggagggcggagctgggaggcgagtggcggtgcgcatggctaggtcgctccggccggcggcgagcagctgaagcatctaggcccccgttgtgaattttggtaattaatgacaagcgctaattgtggactaaccgttatctttgagatattcattgtgagttaggttcacttattatgtacgcatggatgatcaccgaaggattaaaattgacggcgcaaagcgaaggaaaagaagacggtaaaactagtgctttagttttaaattgatcgaggtgtaaggcgatcaaatttgctagtttatctttagcttcgccgtactattaagaggggtaatgacctagcaaagagatgattttaattgccacattaggtcatttgcatgtagacttgtgctcacattttatcacacacacacacacatatgtattcactgtgtctcggcctgaccaggggcggtcagaccggccacatagtggcggtctgaccagagtgccctggccggtctgaccggccccaagtgcgcggtctgaccggtgcataaggccagtctgaccggaggcacttgtgcggtcagaccggccccctggaggccgggatggtgttgctcggggtggccgatacaaagccgacggagtggtattcggtcagaccgagctaacggcggtctgaccgagccgaggccggtctgaccggccactcaacgtcggtctaaccggccaggccgatggggccctctgatagggctacaacagctagttttctagccgttgcagagtagcacggtctgaccggccacatacctccggtcagaccggcggcacacagagttgggggatttcgcccccaacggttagttttggttggtgggagtataaatactccccctccagcatcaagggggctttcttggcacccaattcaattgcatacaccccttgcatctctcatacacccacttgagctttgtgttcttccatctaagtgtttgagggttgttctagccaagagtcaagtgcatttgcttccattgtagagctagtgtggcacttgatcatctccgagccgcgtcattgcttgttactcttggaggttgccgcctcctagacggcttgtgaaggagttgcccggtgacctctccgagaagattgtggaggaggcccggcgccggtttgtgagtggtttggagttcaccaccttcggagtgaaggaagaactaccccgagtgatcgaggcttgggtagtcctctccgtgggccggctcccgccttacccaccccttgacgaagggggcgtgcggtggctttgtggttgagcggtggagttgggctcgcctcaacggggagtaggaaactggcgagtttccgaacctcggtgaaaaatctcttgtctccttgtgtcatttgattgtcgtatttacatttgtgcaattacattcctagagacatacttgagatcatatcaccctaggattgcaaaacattgacataggagtgtaatttactttcctagagaattaattgagccactatcaccataggtttgcaaaacataacctagttgcttagttagacttaaccctcaccgagcctagaaacttaggttagttttgattaagtgtcatttaggtttttaaatcgcctattcacccccccctctagtcgacatctcgatcctacagcagcggcgggcgcgacggccggggagaggaaatcgttggcgcggctgtgtggctccggttgacggcgacgacggttgatggggatgacatggatggacggcgaactcgtcgccgtagcgcaccgcctccgatgccctcctcggcgcctcccaccatgccctccacgctacgcgcgccactcgccgcgccaccccgaggatgattcatcgccggccgcctgcctgagcagagagagagagagagagagagagagtgggagggagggagggaggccgtgcatcccgctgactccccgtcggaaccgagaagaggctccgcacctctctccgccgcctccaacaccctcctggcctcctcggcatcgcccgttgcctgccacgtcctccctgcgttctgccgccagcccgcgcgcgccgaccacccgtccgccccagcacgccgccgcccgccgctcatcaccggcccccgcgcaccgactacccgtccgcctccacgcgcctccactcaccgtgctgcacgctctgagcccgagagaggggaaaaggatgaggaagaggggaagataaggtatgataggcgggtcccactattttttaaaaaataaaatgctgactggattgccacgtgtacgccacgtaggacaaaaccgctctagattcggtcgaagggggtaatttgtccggtattgaaagttcagggtgagcaatgtctggttttcgagtttaggggggtaaatcatacaaccgcgatagttcagggaggtaattcgtactttttactttttaaaaaagaaaatagtacatgtgcatgtgcagcctaccgaactccacaacccactcgatgcatgtgcatgcatacacatcccaaattcccaatattttaagcccaatcgaacaatctgttcttcgacagtgtgctaaatttgtaattttagacaaccaatatctaattttacaattttcgttaaatttgtattatttctaaaaaagttcttttaaaagattgtgagggcacatccaattttgcgattaagggagataaaacagacttattccttctcaaataacagtatttccaacggtaaatctaattggagaggcctctccaattagtcttaaccagagacacccacgtgctagtactttaggagttttggttgctattagtatatccaatagtgcatatcttgttttcttcttatagaattttctcttaaactaattatccaatctacaatctgattacaccattactttcgttgcaattaaatatttacaacaagatcttacatgattatattacgatgaaaaatatttatatttataaattacttttattatatacgtaagttacttttatcatatatatataagttacttttatatttgactaaattacttctatacattcataatactctaagttgattatttttattattgtttttagttaattctatattttgtggactttataaatcttctctactttactcgtgaatttactctacatagtttcttatttcagttcactcacaatataattatttctactatagagagttacttcctccgtttcataatgtaagtcattttagcattgcccatattcatatagatgttaatgaatctagacatagttctaaattaaagttactttcttttttgttataaattacttctataatatatgtaaattacttttaagctttactaaatttacttttatatgtctaagaagtaacttagtgaaatctaaaagtaatttagacatatcataaaagtaatttatgatttttcatcaaaatataatcatgtgagatcttgttgtaaagatttaattgttacgaacacaacgatgtaatcggattataaatcgtttgagtaatttaagagaaacttctttaagaagaaaaaatatatagatattgagtgtattagtagctttttttgaaaagaagggtgtctctgtttagtactatccagctagcactctcggtctcagtgtagttgtgtactatttccaaacgtagcacgattagtgtccgaggtgaattggcggatctacggctacgcgacgtgtcacgtgtgcggcactacagccatctgcaaggagcggatatgctctcggattaatctgttttcgtccgtaagtgctacagtttgtgatttgtctgatcatgacaaaggtctacacgcatgtacacctgttcacataatgacacgatcaaaacatgttaagtacgtcccatgtacgatacgactacgatgccaacggcatctttgattgatttgatattagtatatatcaccatcacactatcacaattcacagtcacacaagtcaggcttggagtattgaacaggctctctctagctctacatgtatacaatagtcattcactcattctcactcagccgccacccgccaagatgtcccctcgggtagcccaacgagagaacgagccattgttacttgtactcgtcctcctcatacaaaccttgatcgcgagctcgcttccatgcttgccggaccaggcctacctgaccatcttgcaccgtcttcatctcattttagatctggtctacttcctaactttttcttcaaactttcaactttttcatcatatcaaaactttcatacacacataaactttcaacttttctgtcatatcgtttcaattttaatcaaacttctaattttagcgtgagctaaatacaccctaaagcttagcgtacatggcaggacacgtcctcgaatcttttctgcatcttcgtcaggccaacaaacaagagccacagagaagatgctcctttttccttgacccggagagcaagtttaatagtatagctaactactagctccaattcacctatagtcaatctaatagcttatttatacaatatttatatattacactattaataattggtcccacctgttatgcaaacaccgcgttttgaagtccgtgctacagctggctataaatctgtagcgtgctactcttctctcttcttatttatcttcttaaaatatgtttaaagctaactttgatcctgcaattgtacctgctcggataaattgataatgcggtttaaactttctatgccattgcactctctctgccctaaaatgatcgaccaatgaatttcaacagagacatatccagattcgttgatataggatgaatcatatctcatctaagttaagttattttagggcagagggagtacatctcaagtctaaataatctaagtatagaaaactcatggctacacttattttacgatgaagataactcatggctatacttattttacgatggaggtagtaggtccgtttcgttccagatattcaaacagtctgtacgcaaaaagccattcaacggccgcgacagtacatgggttgaacgttaagcttacgctaccacaccgcgacacgggctcatatttcattttctaaagactagccatgcagtcatcgacaacgacaggactaaaacagaggcgtcatttcacaacagaaaaattcacatgtaaggatcaacggttcaacaccatcttcagaagaaaagaatatgataaaaattaagtttttttatgtaaaataagatgatattaacgtataattaatttaagttttaattattataaacttaaaagatcaactttcatactgaaagttttcgcacaaaacacaccgtttagtagtttaaaaaacgtgccataaaaatcttaatcttcatctaacttttattggagaaaaatgaaggggttccaacactgcatgaacagtgtcattggtttttcttcttgactttaaatgaatgagcttaccttgacttcgcccgccattcccacggagacggagtgaactccacgtccattgatgggttgctttaccagatcgtaggaagcaagatgttatgtaatctcactagccaacatagggtgcgtttagttcacgttaaaattagaagtttgattaaaattgaaatgatgtgacgaaaaagttaaaagtttgtatgtgtaggaaagttttaatatgatagaaaagttaaaagtttgaagaaaaaattgggaactaaatcaggccataggccatagattgtacagaaacaggcctggatgacacgggatgtcaagttttcacacggagaggaatgaaattcgcgatatatatgcatggtcaggagccaggatgtcaagttttcacatgattcagtaagcaagcaccaagtgaactcgcaagatgaactacacgcatagatgcctccacagccacaaactccctcttctcatcctcctcattgccatcgtcgtcatactcatacagccatactccatccatgctgctgccaacagcagcaacaccaccatcagatgcctgacatctcagtcatccgccctcctccagctgaagagctccttccacgacgcgagccgcctctcgtcctggcaaccggacaccgactgctgccgatgggagggcgtcacctgccgcatggcttctgggcatgtcgttgtgctggacctcagtgatggttatcttcagagcaatgggctgcaccctgcactgttcaacctcaccttgctcacaaacctcgccctcagtggcaatgacttcatgggagcacaactcccagattctgggtttgagcggctttcgaaacttgtcagccttgacctctctgcgaccaactttgctggccagatccccattggcattggaaatctgagcaacatgcttgctcttgacttgtctcataaccccaatttgtacctcacggagccaagttttcagaccttcatagcaaacctgagcaatctgagagagctctaccttgatgagatggacctctctagcagcggggcaacttggtcaagcgatgtagcagcttctgctccacagattcagatacttagcttcatgtcatgtggcttgtctggtttcattgatccctccttctcacgactccgttcactgacaatgatcaacgtcagactcaatgtcatcagtggcatggttcctgagttctttgccaacttctctttcttaacaattctggagctatctggcaatgcttttgagggtcagttccccacaaagatcttccaactaaaaaggctgcagtttattgatttatactggaacaataagctttgtgtgcagttgccagaattcctacctggtagtcgtctggaagtgttggatctcatattgaccaaccgttctaacgccataccagcatcagtggtcaatctcaagtatctaaagcatttgggccttacaacagtagaggcttcaatgaattctgatatccttttgatcagagaactccactggctggaagttctccggctctatggaggatcaggacaagggaagctggtgtcgttctcttggataggcagccttaaacatttgacatacctggagcttggcaattacaacttctctggattgatgccctcttcgattatcaatcttacaaatctgacaagtttaacgctctacaattgcagcatgtctgggcccataccttcttggattgggaacttgatccaactcaataatttgaacttcagaaacaacaacctcaatggtgagatccctacaagaatttgaaatctcaatcatagctcaacagtttctaatggtacagtagtacagtacaggtggtaatactgaatagaacctactccttactttaaaaggttattgatgttttagtattttgccgcattgactaggaaatgccctagatcacaagtaacttaaaaattagcttctactccagtgagtccagtccatttgcactgctacttttatttatatttataagagagcctacaaattatagcttgttgactataactagatgtgtatgcaggaacaattccaaagtccatcttcgcacttcctgcgttgcaatcactatatctagattctaatcaactttctggtcatttagaagacatccctgttccattatcttcatctgtgtatgacattgatttaagcaacaattggcttcatggccccattcccaaatcatttttctgtcttccaaatcttgagtatctcaatcttgagtcaaatcacttgaccggcatagtggaacttaggcctttctggagactaagaagcctttattttctgggtttctctaacaataagctgtcggtgattgatggagaagattctccatctcaatatctccctaagattcagcacctaggactagcatgttgcaacctcacaaaacttccaagaattctgagacatctatatgacattcttgagctagacctttcaagtaataagattggtggagttataccaggatggatatgggagatttggaaggacacccttggatcattggacctctcgaacaatgcatttactagcctggagaactctccctctcttgttacatttacacatctaagccatctaaatctcagtttcaatagacttcaaggagaaatacccataccagccatatcattgccttatggtgtagttgtattggattactcaaacaatgggttctcttccatactacgtacatttggtaggtatcttaacaaagtagcctatattaacttgtccaaaaacaaactaaaaggctatgtacccatttccatttgtagtatgaagaaactccaattcctgtacttatctgataacaactttagtggtttcgttccatcttgtctggtagaaggcagaagcttaagggtactgaatttgagggggaataaattcaacgggatgttgcctaagggcattaaagaaggatgtaagcttgagactatagatttgaacagcaaccaaattgaagggaggctgcccagaacactatcaaactgcaaaagtctggaactcctcgatgttagtaacaatcacatcctcgatctgttccctttgtggctggggaatcttcccaagcttcgagttcttgtactgagatcaaaccaattatatggcacaattaagggtctccataatagtgatctaacaagggatcacttctcaagcttgcaaatacttgatttagccaataacactctatctggtcagttgcccccaaaatggtttgagaaactgaaatcaatgatggcaaatgtcgatgatggacaagttttggagcaccaaacaaacttttcacaaggatttatctatcgagacatcatcactatcacatacaaagggtttgatatgacattcaatagaatgctaactacctttaaagcaattgatttctcaaataactcatttgttggagttattcctggaacgatagggagtcttgtttcacttcatggacttaacatgtcacataataatttcactggagcaatcccgcaacagcttggtaacttggctcagctagagtccttggatctctcttggaaccagctctcaggggtaataccacatgagttaacatttctaacttctctttcttggctgaatctttcgaataacaacttgactggaagaataccacagagcaaccagttcttgtcgttttccaacagttcatttgaaggtaatttgggcctctgtggaaggccactatccaaagattgtgatagttctggttcaataactccaaatacagaagcttcttcagaagacagcagtttgtggcaagataaagtaggggtcatcctaatgtttgtctttgctggcttggggtttgtggttggctttatgctgacaatcatatttcaactggtttgccaggtcaaagggggaacctactgtatttgttagaaatatcactgaatctactttgctttggctttggaaaatagtgtagttattacttaaaagcagtttgccccgtcactgtgtgtccttacctaaaataatagcgtgaacttagaaatgaccttatttcccaggtatcacttatgagtgctatataaaatgcttgttgaaattaaggtctgggtttcttgtagatgttacttattaaaagaatgttatggttttcttaattggtaaatgagtccaacaaagaattagaacttatgaaaacagtaaactgttactgggtaccaatcagagcagccagttaaattttgtaatgtccaaactacaacaatttttttaagaaatagcacaatctccaagtgagctctcatacaccttgcatactgtttttctacagagcaaactagtcagctaaacttttatagttttatctcacatccacagaagctattagtttccagtttcttattttccctttttatggcttcatagaagaaattaacaggcattctaaatatgatccagtgttatgaattccatttaataaaaacagaagccaaaagtccaagctgggctcgtctaagaacaatgcaaaatcaaggccgaaaataggctgaaaaacaaaaggatctaccaagcaccaagtactccctttgtccaaagaaaaggtgtatcttgccttgtacatgacaattgagacattgaaaatgactagaatagctacaattattatctctagtgactatatctattgcattcatgaatggaaaaggtaaagctggatggttactaggggaataattggaatatgaaatacatcctatatctttgtgcatggtcattggaaagtatgcctgatattttggaggaatggtataactctaaaaatattgattttattgtatgatcaataaaagagctatatgtcatatttgtccgtgaagttccttatgatttctcagaaagattgacaatgacctaatagaagacaacattttcagtattagagataaactattttcttataggccaaatgcagtgagaattgaaatagacatgtgcgtgttagcatgtaggcgatgataccaacagaaagtgacccaagagttcgtcattgtaggtgctgaacaatcacatatgcaagtaaactgccattcctaataccacggcatcaaacatccagtaagagctcgttttcgatagatgctaagcacaatcaacaatggaagagtattctaggaatcctaaacccaaatactgcaccgcatacaccaaatttggaaaatgaaacgcttcaggtgctctcacctgtacattgcagccgctgagaggcgcatttcctcgaacacgtggtggtaggagaggacgacgagaccgatggcaataggatgaactgcgcgcatttccttggacatgtccatggccatggagaccccgttaattgccgactgcgacgatctggaaccttggataccatctctctccctcgtcgcctcctcaatctcacccctctaccaccacacgcccccattccgccgagtacttcgagtgggatgaggtggagtagaaggatgacgaggagtggaagtactccagggcgcggcatgcgcttcagccacggcgtacaggagagggagatcgccccgagctcgccacgaggatggccgggagagaccccgcccgcctgcagccaataccgcctccaaccgccgctgcacatcttcactttctctcaattcggaggcgtcgcagagaggcaaagcaaccggaggcgtacatggccgcctcgcgtctggtcatctggtgttgtaaacggcggcgccggccatcctcgtcgtcgccgggcaacatcctgccctacgcctccccgtcgaagtagttttttttttcaagggcttttgaggccccaatttccattgacagagatgagatagtatcatagtaaagctagtactcccttcgtaaaaaaaaaaaaaaaaagaaaaatcctgggtttctgtgtgcaacgtttgaccgtccgtttcattttaaaaaattatgaaaaaaattaaaaagataagtcaagcataaagtattaatcatgttttatcatctaacaataatgaaaatactagttataaaaaaaattcatatgagacggacagtcaaacgttggacacaaaaatctaagatttgtctttttttaagacggagggagtacaagattcttaaaggaaacaaaaggactaagcgcctgttcaccattttcaaccatactaattttttttaattaagttgtcaaaaaaatatctacgtttaattgttaccatatttggtaaatacataagaaatcatgtcaaaattttggcaatattaccatcttgcctttggtaaggtttactttggctacaatctaaacaggctctaaagaaaacaaaagatccagaatttcaacgcagcaacctcaagaaaaaaggggaactcggtctaagggcaacctcaagaataaaggagaactcggtctaagggcatctacaatcagaacactctaagactaccctcactaactgagagtactctctgggaaaccccccctcacaatgaaagataccctagtagcctaacgagtgcccctagcccaaaaagcccacgtaggtattttactatactacccctctgttctccccccccccctctctcttctcatttaccggcgcgcctcctcccctccgccgctcacctctctctccttctccctctcgttgccgccgctcgccggagactcgaggcgtgctcggcgatggcgcggtccttggccgcggcggcctcgtcggaccgggagcggcgtcatggtgcgtcacaggagcagcgggagcgacggcgaggacgacgaggagggccgcctctcctgttgccggcgtccaccaccgcccctctctcttcctctctctcccgtcggcgtcctccccggcatcctccgcctcgcgtcgtggtcagtcgggagcgccagatccggcgccgtagtgggtggatctaggccccccgtggcgccggcggtggcgggcaaggcaccggcggaggaggccgggcaaggcgcgcgaggcggcgagcacaggcgcctcaagccatctccgcccgtcgctagctggtggtcgatggctaccgcggcgcgcggtggccggatccggtcgtcgccgatccatcgtcatcaccgtcgcctctctcttctctctctctctaaggccgacggtggcggtcccggcggtggtaggcgcggcgccagcggtgtcgggcgcggcgcgacgagaccaaggggagagcgagagagacaagggtgtaaggggaaatttggggggacgacgccgtgcccacgagctccacacgcgcacaacgcggcgcctggctgcgtcttcccacgaaaagctagtgaggcacagagagagccgcatcccccagcagagggacgcgttccatcgcaggggacgacaccgatgaaaaaggggatgtccgtcgctaggggcacgggctgaagcaccgcattggtgatggcctaaggcaacacaaaaaatctgcagactttcgacaaaactatgttgccatcggaactaaggctgtgttcgggaaccctcattccccgtcatgcaaaacgaagcagcatttagcatgattaattaagttttagctaattttttttcaaaactgaattaatatgatttttaagcaactttcgtatggaaactttttgcaaaaaacacaccatttagtagtttgaaaaacgtgcacgcggaaaacgaggaggagaagttgggaacatgtcccaccgaacgcagcctctacatcccaccctaaaatttttcaccctgtcacatcgaacgtttaaacacctgcatgaagtattaaatataggctaaaaaataactaattgcacagattatgactaatttgcaagatgaatcttttaagcctaattgctctgtgatttgacaatatagtgctacagtaaacatttgctaataacggattaattaggcttaataaattcgtctcgcggtttactaacggattttgtaattagtttttttttattgcccgaataccccatgcgacaccctatataacacctgatgtgacatgccaaaactttacacctcttaatctaaacaccccctaacttgcaacaaaagcctaaaaccaaaaggatccagtcatccagaacatcagcaaccgtcgtctttaagcaaagaaccaaggagcatttacaatgcagtgcaaaagtagtttataagcaataaaacattacatttagccacctacaaccattgtgcaactggtccatataaaaaaaataacaaaagatacttgtatgcatatggactacccatatggaataaataatattatctatctcgacttctctctcttctcttaatgatatcttgtatttatacattatgaggattgctatatgtaaagtttatttatatagatctcagctatacagatattggttgataaaaatcacaaatttagcattatatcaaacaaccattgtttgacagacataaatttatacctgacgaacaacagccattcgacaggttaggtggcttgattataaaaaaagagagcaagcaagtactatgctgcaggtctatattgatggaaaacacgaggcctaggagatctgcttaactccagtgcaggtctaaaactcgccttcgggtatgctagcgtgccagttgatttgatcctgcaatcaacaagaaatagaaacaaagaagccgtggttaaacccataaatgatagccgatcggctaagtgccgatgacatatcatttatctttgagccgatgtcatataagcattgatcggcagtcattgataagtaaaaaagaactaaatctacccgatcggctgtagatattaacaatatataatccttatgtcgatatatacttaaatcaagtgattgggatagatcggtcgccatgccgatacagtataaatcacttaaatcgaaatatatattaacaacaaaattatatatgttcatagcatagccgatcagatagatctagcatgcatcggctaatactccaataccgctcaatattaagatattaaagcaagtagaacataccaagcagaagcctaatatacttaaaagcaacaagatcttaacataaagggcagatttaacatgtcgatcaagcatatagaataactatagttaaatcaggtaagatcggctgaaaccccgatgctatcctaatcggcaaccggaagacaggctagagattgaaattctaagcacgatttaatagatcaaactcaactgttgcaacattaagtatgaaaaaaagaacaatatctagacaatcaagtcgttggatgtttcatagagtggtggatatcttatataatccaagctaacgtcgctatttaacctaatcggccgccttctattaacagatgttagccgattgtaggttagatgacgatattaccgaagattatgtaagatatatgataactcgataaattacataaacaagattagagtgtcataaagatggaagcactaatcccgagaacgcaagccgtcataacaagttttacctcttgttgaagatcgaaaccgatacagctcaacccgaaagcaagaactcgtcgaaataaaacgaaagcaaaaagagtggcgatgtgccgagattgtattgaacgtatgttgtttgattacatggggttcgggtctatttatacccgagaattacaaaatatgtccataccggacacgactcttatctctaacaaactctaagatatcataagtctttgcggcagacttttgcccaaatatatctctaaggaaattacataaaatatcctaattaatagatacaattgccttctcaggactctatccatgcgtggcaatcatcttgaagcatatcaacccaacctgatgttgtacaccaagtcgtattatcgaaatcggctgcattacctaaccaagtctgactcgaacttagccgatccaatcgtagccgatccggactccagccaattcttgctctgttcccgcgacaatcctcatcttagattccgcttcgatctaatctccctttccgatgctgatattatcaaatttggtcgttaacaatctcacaacccactcacatgtatgcacacacatcccaaattcccaattttttaagcttggtcgaacaacctggtgttctataaggtgctaaatttgtgatttcagacaaccacttacaattttcattaaatttgtattatttctaaaaaaagttcttttaaaagattgtgagggcacatccattttgcgattaagggagataaaagtagactattccttctcaaataacagtatttccaaacgtagcacgattagtgtccgaggtgaattgacgaatctacggatacgcgacgtgtcacgtgtgcggcactacagccatctgcaaggagcggatatgctctcggattaatctgttttcgtccataagtgctacagtttgtgatttgtctgatcatgacaaaggtctacacgcatgtacacctgttcacataatgacacgatcaaaatctgttaagtacgtcccacgtacgatacgactacgatgccaacggcatctttgattatttgcatttgcattgacttgatatagtatgtcaccatcacactatcacaattcagtcatacaagtcaggcttggagtactgaacaggctctctctagctctacatgtataaaaaaaaatcagtttcaagcatcatacaatatagtcattcattcagctgccacccgccaagatgtcacctcgggtagcccaacgagagtacgagccgttgttacttgtactcctcctcctactacaaaccttgatcgcgagctcgcttccatgcttgccggaccaggcggcggcgctgctccagctgaagcgatcgttctcggcgaccaccgcgtccgccaccgcgttccggtcatggcgcgccggcaccgactgctgccgctgggcgggcgtccgctgcgacggcggccgcgtcactttcctcgatctaggcggccgacgcctgcagagcggcggccttgacgccgccgtcttcagcctcacgtcgctgaggtatctcaacctcggcggcaacgacttcaacgcgtcacagctcccggccaccggattcgagaggctcactgagctcacccatctcaacatctccccacccagcttcgcaggccagataccagcaggtattggaagcctcaccaacttggtttctcttgatctgtcatctagcatctacatcgtcaatcaaggagatgacgatgtcagtatcatgtcaaatttgttacccccctggggcttctcgagggtaaacttcgagaagttgattgcaaatcttggtaatctgagggagctctatcttggattggtgtacatgtccaacggaggcgaagggtggtgcaatgctctggctaattccactcctaagattcaggttctgagcctaccattatgccagatctctggtcccatttgccaatctctgtttagtttgcgatccctttctgttgttgacttgcaaggaaatgacctgtctggtgccatacctgaattcttcgctgatttgtcatcccttagtgttcttcagctttcaagaaataagtttgagggtttgtttccacaaaggatcttccagaacagaaaactgacagctattgatattagctacaactatgaagtttatggtgatttgcccaattttccacctaatagcagtttgatcaaattgcatgtcagtggcaccagttctcaggttacataccaagctctatttctaatctcacggatctgaaggagctgagtctgagtgcaaataatttccctacagaactgccgtcttctctaggaatgcttaaatccttgaacttatttgaggtttcggggctcggcctagtaggatcaatgccagcttggataacaaatctaacatctttgacagatctccaaatttctcattgtggtttgtctggatctttaccatcttccataggcaatctcaagaatctcagaagaatgtctttattcaagagcaacttcactggaaacataccattgcaaatctttaacttgacacaactgcatagcttgcatcttccactaaacaacttcgtggggacagtggaacttacctcattctggagactaccatacttatcacaccttgatctttcaaataataaattatctgtggtggacgggttagtcaatgattcagcagtgtcctctcccaaagtaaaattcttgagcctagcttcctgcaacatatcaaagtttcccaatgcattaagacatcaagataagataatcttccttgacctttcaaataaccaaatgaatggggcaatacctccatgggcatgggaaacttggaaagaatcgttcttcttggacctatcaaataacaaatttaccagtcttggacatgacacgttgctccccctgtacacaagatatatcaatctcagttataatatgtttgaaggacccatacctatacctaaagagagtacagactctcagttggattactcgaataatcggttttcttctatgccgtttgatctaattccatatcttgctggtacactatctctaaaggtctctatgaacaatgtctctggagaagtcccatcaacattttgtactgttaagagtctccaaatccttgacctttcctacaatatcttaaatggctcaattccttcctgtctgatggagaattcatcaacactaaaaatattaaatttgaggggaaatgaacttcgcggagagttgccacataatatgaaggaagactgtgcatttgaggcattggatgtcagctataattggattgaagggacactacctaaatcattagtaacttgcaaaaacttggtggtacttaatgttgcgaacaatcaaattggaggctcttttccatgttggatgcatcttcttcctaaactccaagtccttgtcctgaagtccaataagttctacgggccgttggggcctactcttgctaaagatgatgaatgtgaactacagtatctccgaattcttgatctagcttcaaacaacttctcgggagtattgccttatgaatggtttaggaaactaaaatccatgatgtcagtctccattaacgaaacattggtcatgaaagatggagatatgtacagcacatttaaccatataacatatctttttactgctagatttacatataaaggactggacatgatgtttcctaagatcttaaagacctttgtactaattgatgtctcaaataatagattccatggcagcattcctgaaactattgccacactaagcatgctcaatggtctcaacatgtcacataatgctcttacaggaccaattcccaaccagcttgctagtctgcatcaacttgagtctttggacctctcatcaaataagctttctggggagatccctcaaaaattagcatccttggacttcctatcaacattgaacctatccgataatatgctggagggaagaataccggagtcacctcatttcttgacactccccaatagttcatttatacgaaatgctggtttgtgtgggcctccattgtcgaaagaatgcagcaacaaatcaacatcaaatgtgatgccacacctttccgaagagaaatctgcagacattatactatttctctttgttggattgggttttggtgttgggtttgctattgcaattgtagtgaggaaaccttgcattggcaaataatcttcatcaaatccacccatttttatatttatatgttcaggagtttgccagtctgcttccccttgtaaatttagctgtcattatagttagcctgtatgatttatagtactatgtgcacgtacaacatttttttccatcatcatgcatcctataagattagtattgaaaattttatacaagccaacagaaaattgttatgtctgaaccaagaaaggaatagaaatgcatgaccacaaatgtggcattattagggtcagtttaacttgtagcatagatcagtgagctatatgccgtgattttgtgtttgaaatgtatacttacacagaacttacttaagtaccaaacaaccatactggaacacaaaatttctgtgtgaagaactgaagatcacttaattatgtgttggaataaaactttctgtgaaaagatcacttgcaatacaattgtaatcagcgttatactgataatgttactagtagtagtcacactaatactaacctgaatcttgtatatgcaccaaattaggtagtaagaaatatatatatgaactaactaaatgaggtcatccaagaacaatgcacaagcaaggcttaaaataaatggaaacaagaaagcaatgttaaatttacccgactgtttattaagtatcacctctacatctatacctaaaattaaaacggtgtcatatatcaggtcgcacattgaactgctagattcctaataggctaataccacagcagcagcagcagcagcagcaataagctgcatacgtaattccgtagaatcgtagtaattccaaaatcggttcataatattcgagaaatactggatttcacacacaaacctgtgcaattcagccgatgaacacggaaggaccattccatcaaacacctggcggacgacaagagcccgccgatgcaaacctcctgggagtgggacatggacatccccattgtgaccgcattggttgtcagctggtcacccaccccacttgggctcccaaatcccatgacggccaccttgtgctcaacgcctcaacccggtgcccgtgcccccattccggtggcggtggttggggattccggtgtacagcctgcggtggggatgggattgggagttcgccgagtcctccgagtgggatgcacgcggaggagaggacgacgtgaggaggggctcgcaagtggcggcggcggcggcgcaacccctccacgacggcgtgcgggcgcctgcgccgcatatggacatatggtgtacatcgaaattacagattttgtatgggcctcagacatctggcccaacaagggtccgactcattcgctaatttctgaaatacgtactccgtcggaccaataatacctgtcgtttgggcaatggtaaggttaaactttagaatctttaattatgtatcatttttaaaatatttgtctcttaaatatgatgactacattatagattcgtcttaaaaagtattttaataagatcatatatttgttaacacctttttacatattataatagaaaataatgatcaaagttgtttttttataccgtgtccttattcaaaacgacaagtattatcaatcgtagggagtaacctctattatctgaacaagcaaattgttacgtacgtattcaaaatttaaaatttaatgcatggttaaatttatcatggtgttctaaactagttagtggtttttaatttctcgtatatattacgatgcttgtaacaacaaatccataattatagaaaattacattcaaatgatcagttcaacggtattacttttatcaaacaaaatttaaattatattagatttatggtttgtcagatattactagggttgaattaatatgtgtgcacacattgtattttttttttgggaaagatggtacaaatgattgactgagaaaccacaacaagttttcttaatcgaaaattacatcaagtttcatttgcggcaaactaataaaatcataagaaatatgaaaaactatcacacgagcaacagcaattaaaacagaaacacaaaagaaccacgtatacactgtccaagtagaattccatgcctcccgaattgatgaaacgcgcaagctcgcaagtgtaagtgtcacaaatgcacgcacatttatcgggtgcctagtgcttaggagggcacatcaccggccggaaagcgagcgggccagtggcatacatgacattatagtagtcatggtcggaccaccgcttgccctcgtcacggagtggcgcaccctcaatgctagagtagttgatgtttgtggggttgttgcattcgaaatccggcgaggcatgaagacgcacatagcacgccttacgcggatcacccatgtagaagtcggagactttagtctcatcgagctccgcgcggaagtagccattatcgtcggcgacggcctgatggcacctcaccattgcgcgattcttggcgtcgtggcatatgacagacacctccgccttagacagcggcttcgcgtcttcgaggctgtgtgtttctttgcacgcagctctggcagtacaccataccctccaacctcaccaacagcttgtcgctgtgggccggaggggtgtactgctgcggcggcggtggcggcgatggtgatggtgtggtgtaaccataatttgcggtggcgccggcggccaggagggacacgaacacgaggatcgcgagaggatgcagggcagccattgctctgagctagcttgctgtgctccgtgctcgactgatgagatgttttgttttgaagctttggctatgtcgaaacgaagaggcgtgtgggttatatactgcatgccatgtactaacgtgcggacatgtagatggaaattaactgtcttgattttggatgaagatcacattttattttttgttattcgattctgacaatatataatgattagcccgcgaaagaaatgctagcatgtaatcattgatctgtaaggcaatttgaatagaagaaatcgcatgctcatgatctgcctggtgattagttaagagttcgtagtattcaggaggaagatacgcaggtttgtcggaacgtgcagcccttaacggcactgaaataccaggttctccaccctggcagatgatttttgccgatagagctacaatatttatgtcagtactctgaaaaggagtagggcatgtcatttcctactcctaccgtcccataaaaaacgaatttaggacgggatgttacatattctattatgatgaatctggacatatatatatatatatatatatatatatatatatatatatatatatatatataagattcatagtactagaaagtgtcatatccggtactagattggttttttatgggatggagggagtatgtaaaatatatgcaaattttgctacaggacattgcgactttgtggttttagctataggacaccacgtaaagtgacttttgggagaagacactatgtaaatatggttatttaccacgagacaccgtatccattaaattagtatttttgtgctgacgaggctagaaggggcccactttgttaaacatcatgaccgaattgcccctcttcatcttcctcttcctctcctctcttcccctctctctccctcctttctctcttctctcttctccggcgaggcattcaacccgcaagcggcggcgcgaccaccagagctgcagcggcgcggggaaccactcctcacggcgccacccaaacgtgaactgcaggtacgccgcgagcagcagccatgccacagcgcgcaccgccccgacaacggcctctagtggtatgttcccggtggcgaggaacaccgcgatgtcgctgagctcaacatggaggtacgagaatgagccaccggcggatgggatctccgtggtgagcggaggaccgagggcaccagatccaacgcccccgttgagctcagaccatggagagaggggcatgcgacgatggtgggggagggggagcagcggagagaaggcaacagaggaggagcggcatcgccagtcatgagagtggaggggagggggagaggcgccgccgggagggagggggaggtggagctcgtggtggggggtgggaggggaaagtgtgattagggttagggttataggcagcaacggttttgatggatttagaatcgatccgagtcatccatcaaaacgagtggcttagatcgatcctgtgtcgggccggcctccatctcgggccacaacactgttgggccacgcgctcttcatgggccggacgcgcaatagcaggccgatagggtccaatgggttttttttttccttttttagaacctttttatttgtaagcaatatattttttatgggctcgtaatatgaaaaactaaaacctaattaatcatctaatattttatatttgctataattttagtttactcgtagcaacgcactggcatcttttctaacaaaatttaatttatattagatttatggttcgtcagatattactaggattgaattaatatgtatgcacaccttgtattttttttttggaaagagggtacaaatgattgattgaaaaccacaacaagtttatttaatcgaaaattacatcaaatttgatttgcagcaaactaataaaatcataaaaaatttaaaaaattatcacaccagcaacaacaattaaaacagaaacacaaaagaaccacgtatccaccgtccaattataattccttgcctcccgaattgatgaaacgcgcaagcgtgcaagtgtaagtgtcacaaatgcagacacatttatagggtgcctagtgcttaggagggcagattgccggccgaaaagcgagcgggccggcagcgtacataatattataatattatagtagtcatggtcggcccactgcttgccctcgtcacgtagcggtgctccctcgatgctagagtagttgatgtttgtggggttgttgcattcggagtctggtgaggcccgaagccgcacatagcacgccttgcgtggatcacccatgtagaagtcggagacattggtttcatcgagctccgcacggaagtagccgttatcgtcggcgacggcccgacgacacctcacgatggcgcgattcttggcgtcgtggcagatgacggacacctccgccttaggcagcgatttcgcgccttcgaggctgtgtgtgttcctttgcgcgcagctctggcagtacaccataccctccaccttcaccagcagcttgtcgctgtgggccggcggggtgtactgctgccgcggcggtggtggcggcgatggtgatggtgtggtgtagccatagtttgccgtggcgccggtggccatgagggacacgaacacgaggatcgcgagaggaaggaagtcagccattgctctgagctagcttgctgtgctccgtactcgactgatgagatgttttgttttgaagctttggctgtgtcgaaacgtagagaggcgtgtgggttatatactgcatgccatggactaaatgtgaggacatgtagatggaaattaaacttgattttggattaagatcacattttattttttgttattcgattctgacaatatataatgattagcccggcgaaagaaatgatagcatgtaacgattgatctgcatggcacttttaagagaagaaatcacatgctcatgatccgcttggtgattagttaagaatttgtagactataaagtatattcaggatgaagatatatatgcagatttgccagaacgtgctgcccgtgtctgtacctaacggcactgcaataccatgttgggcagatgatttttttgccgatagggctacccctactacgaaagtgatttttgcacacggcccaaaagagattttcgtgtgcagtagggtagcccgctcgcactaaaagatctacgaaaatagctatttttgcgtgcaggagtttgagagaaagtgagagagtagtatgtggagaagaggaggtgagagagaggagagatgataaggatgacttagaaaaaaaattaagtgctaggagggaaaagagaaggtaactcgaacttccgggcggacctttaagatggccgtctgcgaaaatatattttcccgtgcagccccttaagaggtccatatggaaaaataatcttattttcctgtgcagctacttaatagggtcgtctgcgaaaatgttagtcgatttttgtagacacggatacttatggtccgtctgcaatatattgaggagctcatccagaaaaatcattttttatggtgattatttatatcagtagctacattattctccatacagataggttttgctattttacatgtgatagatttttgggcttctatttttcgatatgttgttcataggattttgcatcaagattcgtgtttatgtagttataacttgcaattacacttatttatgtagtacgtttcatgtagtattaaagtaccatgacgtcttttttcttagcgcctgaaactaacggaaagaaaacgagtgtatttttctcattgttttgtagaaaggagttacataggcgctatgccagctaaaattggaaacaataccaccaagaaatttcgtttgcacttgttttggaagttggaggatgtgttctatctggttttcggtcaagggacgattttgtaattcggtgataagacgagggatctccactgtactttttccacattgaaattacagattttgtatgggcctcaaacttttggcccaacaagggtccgactcattcgccaatttttgaaatacgtaacctctggtatctattttttagataatggattttcattaatccggcctctatatccacgatggatatagacagctaaaatgatataagagcacttaaactcaaatctcaataaagaggagaacacacaaccaaaaaacaaaaaacctacaacctcgacacatccctgcatcccgacattctctcctgaaatagtcaaaatcgatgagtggaagtcgtttagtcacaaccgcccctagtacgttgtcgctgcgaatctccactggtgccttcttcatctgcttcaagtgaaccgatgccacgcaccaccgagtagtccaccttcatccatcgtcgtctagtcagaactagccaactagacacgggctgaaaggatctgcttcaccggattcctaagcctctgccgcccatagggccgctgccaacgtcggaatccttctccgcctctccgattcccagcccactaccacctctgccaacgtcctttgccgtggtcagagaggacatcatcttccgcccggactccaaggcctccgccgccccaagggctgccatcgccgattggatccaccttcacctgaaccatctgcatcggtgattacgccgccactgcctctagggctgcagctgccgcaaccgaggaggtcattgcttggactcgcacaccgccgctgcccctagggtcgcccgctagctacgaaaccaccttcgccggaaccgccttctccttgccgaggaccggacatcaacgcttacgtcgccgttctccacagcatccaccgtcgcccaaagaatcgtgtcgccgacgtcttgccgacccgccgccgcactgcctcccgacccctccactgctgcgcgcaaggtgcggttcggccaacgccgctcgccaactcgcgcgcctccgtacctccggaccacctccgcagccgcgctcggcccggccggccaccgccgcccacggccccgtcaccttccacgccaccagattttgggggccggaaccccagactcggtacagccctcagccgcgtcgtggtctccgccgaaaggccccgctgtcgccttcctcactgccgctcggcacgccggcggcctgctcgggcggcggcaaggcgaggagacaaggaagcgagaaggagacgaggaaacgctgtgaggcgagataatctaactaagcaaattacctacgtactcaaaattcaaaatttaaggtatagttaaatttagcatggttttccaaaatatttagtgattttaatttgtcctatatattacgatgcttgtaacaacaaagccataattatagaaaattacattcaaatatcagttcaacagtattatttttatcacataaaatttaatttatattagatttatggttcgtgagttattactagggttgaattaatatgtatgcacaccttgtattttttcgaaagagggtacaaatgattaactgaaaatcacatcaagttttcttaataaaaaattacatcaagtttgatttgcagcaaactaataaaatcataaaaaattacaacacaatcacacaagagcaacaacaattaaaacataacacaaaagaatcacgtatccaccgtccaattagaactccatgcctcctaaattgatgaaacgcgcaagtgtgcaagtgtaagtgtcataaatgcagacacattcatagtgagcctagtgcttaggagggcagatcgctggccgcaaagcaagcgggccggtggcgtacatgaagttatagtagccatggtcggcccaccgcttgccctcgtcacggagcggcgcaccgtcacggagcggcgcaccctcaatgctagagtagttgatgtttgtggggttattgcattcgaagtccggcaacaaccgaagccgcacatagcacgccttgcgcggatcgcccatgtagaagtcggagactttggtctcatcgagctccacgaggaagtagccattatcgttggcgacggcccgacggcacctcaccatgacgcgattgttggcgtcgtggcaaatgacggacacttccgccttaggcagcggcttcacgccttcgaggctgtgtgttcctttgcgcgcagctctggcagtacaccataccctccaccttcaccagcagcttgtcgctgtgggccggcggggtttactgctgctgcggcggcggtggcggtgatggtgatggtgtggtgtagccatagtttgcagtggcgccggcggccaggagggacacgaacatgaggatcgcgagaggatggaaggcagccattgctctgagctagctcgctgtgctcgactgatgagatgttttgttttgaagctttggctgtgtcgaaacgtagagacgtgtgggttatatactgcatgccatggactaaacatgcggacatgtagatggaaattaagcttgattttgattaagatcacagtttattttttgttattcgattctgacaatatataatgattagcccggcgaaagaaatgataacatgtaacgattgatctgtaaggcacttttaagagaagaaatcacatactcatgatctgcttggtgattagttaagaatttgtagactataaagaatattcaggatgaagatatatatgcagatttgtcagaacgtgctgcccgtatatgtccctaacggcactgcaatatggtagggcagcctgctcgcgctaaaaaatctacgaaaatagctatttttgcgtgcaggagtttgagagaaagtgagagagtagtatgtggaggagaggaggtgaaagataggagagatgataaggatgacttgaaaaaaaaaattaagtgctaagagagaaagatgaggtaactcaaacttctgggcgggcctttaatatggccgtctgcgaaaatatattttcccgtgcagccccttaagaaattcgtatagaaaaataatcttattttcctgtgcagcagattaatagggtcgtctgcgaaaatacaagtcaattttcacagacacggatacttatggtccgtctgcaatatattgaggtgctcatccatgaaaatcatttttatagtgattatttatgtcagtagctacattattctccatagagaggcgtgtgggttatatagtgcatgccatggactaacgtgcagacatgtaaatggaaattaagcttgattttggattaagatcacattttatttcttgttattcgattctgacaatgtatgatgattagcccagcgaaagaaatgataacatgtaacgattgatctgtaaggcacttttaagagaagaaatcacatgctcatgatctgcttggtgattagttaagaatttgtagactataattctataaagaatattcaggatgaagatatatatgcagatttgtcagaacgtgctgctcgtgtctgtccctaacggcgcttcaatatcttgttgggcagatgatttccctaatggcctagccgcatgtgaaaataattgctggccgtatgtaaaaacctattatgtagtagtggcagtatgtggagaagaagaggtgagagagaggagagaaggtgaggatggcttgaaaaaaaattgaaatgctaggagggaaaagaggagataacttaaactactggacggacctttaagatgatcgtctgcgaaaatatatttttactactggacggacctttaagatggccgtctgtgaaaatatatttttcctgtgcggcctcttaagatgtccatctataaaaataaccttattttttcgtgcggctgcttaatagaatcatctataaagatatgagtcgatttttgcaaacacggatacttagtccacctgctatctattcaggtggtcatccatgaaaatcatttttaagtagtgattatttatgttggtagctacattactctccatacagataggttttgctattttactcgtgacagatttttgggcttctgtttttttatattttgtttataggattttgcatcaagattcgtgtttatgtaattctaacttccaattacactcatttatttagtacgtttcatgtagtattaaagtaccacgacgtattttttctttgggcctgaaactgacgaaaagaaaacgggtatatttttctcattgtttgcagaaaggagccatataggcgctatgtcggctaaaattgggaacaataccaccgaggaactttgtttgcacttattttgaaagttggaagatgcattgtggatgtgtttagttgaaagttggaagttggcctgtctctggttttttatcgagggatgattttctaattcggtgataaaatgagggatctccgctgtactttttccacatcaaaattacaaattttctatgggcctcagacatctggcccaacaagggtccgactcattcttcaattttcgaaaatacgtaacctctggtatcggactaagcaaattacgtacgtactcaaaattaaaatttaaggtatagttaaatttagcaaggttttccaaatagcaagtgatttttaatttgtcctatatattacgatgcttgtaacaacaaagcctaattatagaaaattacattcaaatctcagttcaacggtattatttttatcaaataaaatttaatttatattagatttattggtcgtgagatataccagggttgaattaatatttatgcataccttgtatttttttggaaagagggtacaaatggttgactgaaaaccacaacaagttttcttaatcgaaaattacatcaactttgatttgcagcaaactaatataatcataaaaaaaattacaacacaatcacacaagggcaacagcaattaaaaaatagaaacacagaagaaccatgtatccaccgtccaattagaactccatgcctcccaaattgatgaagcttcataggaagcctagtgcttaggcgggcagatcgccggccggaaagcgagcgggccggtggcgtacatgacgttatagtagtcatggtcggcccaccgcttgccctcgtcacggagcggcgcaccctcaatgctagagtagttgatgtttgtggggttgttacattcgaagtcctgcgaggcccgaagccgcacatagcacgccttgcgcggatcgcccatgtagaagtcggagactttggtctcatcgagctccgcgagaaagtagccgttatcgttggcgactgcccgatgacacctcaccatgacacgattcttggcgtcgtggcagatgacagacacatccgccttaggcagtggcttcgcgccttcgaggctgtgtgtgtttctttgagcgcagctctggcagtacaccataccctccaccttcaccagcagctttttgctgtgggccggcggggtgtactgctgcggcggcggtggtgatggtgtggtgtagccatagtttgcggtggcgccggcggccaggagggacacaaacacgataaccgcgagaggatggaaggcagccattgctgtgagctagcttgctgtgttccgtactcgactgagatgttctgttttgtagctttggctgtgtccaaacgtagagatgcgtgtggattatatactgtatgccatggactaaacgtgggtacatgtagatggaaattaactgtcttgattttggatgaagatcacattttatttttttttgttatcgattctaagaaatatataatgattagcccgcgtagaaatgctaacatgtaatcattgatctgtaaggcactttgaatagaagaaatcgtatgctcatgatctgccaggtgattagttaaaaattcgtaggcgataaagaatattcaggaggaagatatgcagatttgtcggaacgtgcagcccttaacggcactgaaataccaggttctccacccaggcagatgatttttgccgatagagctacagtatttatgtcagtactctgaaaaggagtatggcatgtcatttcctactcccaccgtcccatctagaacgggacgtgacatattatagacaatgaatgtggatatatgcatgtccagattcgtagtacatactaggatatgtcatatctaatactaagttggttttttatgggatggagggactatgtaaaatataggcaaattttgctacaggacattgcgactttatggttttagctgtaggacaccgcgcaaagtaacttttgagagaagacactatgtaaatgtagttatttgccaccaaacaccacatccattaaattagtatttttgtgctgacgagcctagaaggggcctactttgttaaacatcgtgaccgaattgcccctcttcctcttcctcctcctcctctcctctttcttccttacctctcttcatctctctccctactttctctcttctctcttctccggcgaagcatacgacccacaagcggcggcgtgaccaccagagccgcagcggcacagggaaccactcctcacggcgccacccaagcgtgaactgcaggtacgccgcgagcagcagccatgccattgcgcgcaccaccctgacgacggcctccaacggtatgttcccggcggcgaggaacaccgcgatgtcgctgagctcaacgtggaggtatgagaatgagccaccggcagaggggatctccgtggcgagcagaggactgggggcaccagatccagcgcccccgctgagctcggaccaaggagagagggggcatgcaacgacggtgggggagggggagcagcggagagggggcaacggaggacgagcggtgccgccagtcgtgagagtggatgggagggggaggaggagctcgtggtggggggtgggagaggaaagtgtgattagggttagggttttaggcaccaacggttttgatggatttagaatcgatccgagccgtccatcaaaatgagtggcttagatcgatcctgtgtcgggccggcctccatctcgggccatagcactgttgggccacacgctctttatgggccggacgcgcaatagcaggccgatagggtccaatggggcctttttttctttttttagaacctttttatttgtaagcaacatattttttttatgggctcatatcacgaaaaactaaaccctaatcatctaatatttttatatttgctataattttagtttacccgttggccgttgcaacgcacgggcatcttttctaataaaatttaatttatattagatttatggttcatcagatattactagggttgaattaatatgtatgcacaccttgtttttttttggaaagagggtacaaatgattgactgaaaaccacaacaagttttcttaatcgaaaattatatcaaatttgatttgcagcaagctaataaaaacataaaaaatttacaacacaatcacacaagagcaacagcaattaaaacagaaacacaaaagaaccacgtatccaccgtccaattataattccatgcctcctgaattgatgaaatgcgcaactgtgcaagtgtaagtgttacaaatgcaggcatttttatagggtgcctagtgcttaggagggcagattgccggccggaaagcgagcaggccggcagcgtacatgacgttatagtagtcatggtcggcccaccgcttgccctcgtcacgtagcggtgctccctggatgctagagttgttgatgtttgtggggttattgcattcgaagtccagtgaggtccgaagccgcacatagcacgccttgcgtggatcgcccatgtagaagtcggagactttggtctcatcgagctccgcgcggaagtagccgttttcgtcggtgactgtccgacggcacctcaccatgacgcgattcttggcatcgtggcagatgacggacacctccgccttaggcagcggcttcgcgccttcgaagctgtgtgttcctttgcacgcagctctagtagtacaccatactctccaccctcaccagcagcttgtcgctgtgggccggcggggtatacctgtggcggcagcgggggcggcgatggcgatggtgtggtgtaaccatagtttgcggtggcgccggcggccaggagggacacgaacacgaggatcgcgagaggatggaaggcagccattgctctgagctagcttgctgtgctccgtactcgactgagatgttctgttttgaagcttttgctgtgtccaaacgaattaaattttaaaatatactgtttatccaatttttttcaggaatattcgggataaatttttttttttacaaatataccatcaatctcgcgcaatcgttttacgaaaatgacgtggacatgacgtcaccagcggtatcgcgtgacgaaagcgcgagaccgtgcggtatcacgcggcagtggcgcgagaccgcgcggtctcgcggaagcaaagagcgagtccgctcggtatcgcttgttcaagcagcaacaccggcatggcagtcccggccgtcaatggttaattacctaattaactattaactaataataattagtaattaattatcctgattagtgattaattaattgctaatcaggataattaatcaacaggcatgtcagtgcggtatcgctatttcaatcagcgagaccctttggttccacgagaccgtgcggtctcgcgcagttgttgcgcgagactgtgcgctctcgcgctttcatcgcgcgataccgtccgtgatattacgtccgtgtcattttcgcgtaacgattacgcgagatcgacggtatatttctgtaaaaaagtttgcatctcaactattctttaaaaaaaatgaggaacaatatatttttaaatttaattcatgtccaaacgtagagaggcgtgtgggttatatactgcatggcatggactaaacgtgcggacatgttaaattaagcttgattttggattaagatcacagtttatttttgttattcgattctgacaatatataatataatgattagcccggcggaagaaatgataacatgtaacgattgatctgtaaggcacttttaagagaagaaatcacatgctcatgatctgcttggtgattaattaagaatttgtagactataaagaatattcaggatgaagatatatatatctatatatatctatatatatatatatatatgcagatttgtcagaacgtgctgcccgtgtatgtccctaacggcactgcaataccatgttgagcagatgatttttttgcctatagggctaccactactaagaaagagatttttgcacatgggccaaaagagattttcgcgtacggttggacagcccgctcgcactaaaagatctacgaaaatagctatttttttgtctgggagtttgagagaaagtgagagagtagtatatggaggagaggaggtgagagagagatgataaggatgacatgaaaaaaaaattgaagtgctaggagggaaaagaggaggtaactcaaacttctgggcgaacatttaagatggctgcctgcgaaaatatattttcctgtgcacctgcttaatagggtcgtctgcgaaaatgtaagtcgattttcgtagacatggatacttattgtccgtctgcaatatattgaggtgctcatccagaaaaattatttttatagtgattatttatgtcagtagctacattattctccatacatataggttttgctatttttcgatatgttgttcatatgattttgcatcaagattcgtgtttacgtagttctaacttgcaattacacttatttatgcagtacgtttcatgtagttttaaagtaccatgacgtcttttttcttagggcctggaactaacagaaagaaaacgagtgtatttttctcattgtttgtagaaaggagttgcataggcgctatgtcagctaaaattggaaacaacaccaccgagaaacttcgtttgcacttgttttgaaagttggaggatgcgtgggacgattttgtaattcggtgataagatgagggacctccactgtactttttccacatcgaaattacagattttgtatgggcctcagacatctggcccaacaagggtccgactctttcgccaattttcgaaattacgtacgtactcaaaattcaaattacgactcattcgctaagggtatctgactaagcaaattacgtaagtactcaaaattcaaaatttaaggtatagttaaaattggttttccaaaatatttagtgctttttactttgtcctatatattacgatgcttgtaccacaaaagccataattataaaaaaattacatccaaatctcagttcaacggtattatttttatcacgtaaaatttaatttatattagatttatggttcgtgagttattactagggttgaatcaaaatgtatgcacaccttgtatttttttcgaaagagggtacaaatgattaactgaaaatcacatcaagttttcttaatcaaaaattacatcaagtttgagttgcagaaaactaataaaatcataaaaaaattacaacacaatcacacaagagcaacagcaattaaaacagaaacacaaaagaaccacgtatccaccatcaaactagtttctcccaaattgatgaaacacgcaagtgtgcaagtgcaagtgtcataaatgtaggcacattcatagggagcctagtgcttaggagggcagatcgccggccggaaagcgagcgggccggtggcgtacataatgttatagtagccatggtcggcccaccgcttgccctcgtcacggagcggcgcaccctcgatgctagagtagttgatgtttgtggggttatgcattcgatgtccggcgacgcccgaagccgcacatagcacgccttgcgtggatcgcccatgtagaagtcggtgactttggtctcatcgagctccgcaaggaagtagccgttatcgttggagacggcctgacgacacctcaccatggcacgattcttggcgtcgtggcagatgatagacacttccgccttaggcagcggcttcgcgccttcgaggctgtgtgtgttcctttgcgcgcagctctggcagtacaccataccctccaccttcaccagcagcttgtcgctgtgggccggcggggtgtactgctgtggcggaggtggtggcggcgatggtgatggtgtggtgtagccatagtttgctgtggcgccggcggccatgagggacgcgaacaggatcgcgagaggaaggaagtcagccattgctctgagcacagctccgtactcgactgatgagatgttttgttttgaagctttggctgtgtcgaaacgtagagaagcgtgtgggttatatactgcatgccatagactaaatgtgcggacatgtagatggaaattaaacttgattttggattaagatcacagtttattttttgttattcgattctgacaatatatgatgatttgcccggcgaaagaaatgataacatgtaacgattgatctgtaaggcacttttaagagaagaaatgacatgctcatgatctgcttggtgattagttttgaatttgtagactataattctataaagaatattcaggatgaagatatatatgcagatttgtcagaacgtgctgctcgtgtctgtccctaacgacactgcaataccatgttgggcagatgattttttgccaatagggctaccactaggacaaaagtgatttttctcatggctcaagagaaattttcgcgtacggtaggacaacccacacgtactaaaatgtctacgaaaatagctatttttgtgtacgggagtttgagagagtgagagagtagtatgtggagaagaggaggtgagagagagaagagaagatgaggatggcttgaaaaaaaatagaagtgctatgagggaaaagaggagataatttaaactactgggcggacgtttaagatggccgtctgcgaaaatatatttttcccgtttggcctcttaagatgtccatctagaaaaataaccttatttttttttgcggctgcttaacaggatcgtctgtaaaaatgtgagtcgatttttacagacacagatacttggtccacctgcaatctattgatgtggtcgtccaggaaaattatttttaagtagtgattatttatgttggtagctatattattctccatacagataggttttgctattttacttgtgacaggttttggggcttctttttttatattttgtttataggattttgcattaagattcgtgtttatgtaattctaacttgcaattacactcatttatttaatacgtttcatgtagtattaaagtaccatgacgtcttttttctttgggcctgaaactgaacgaaagaaaatggatgtatttttctcattctttgtagaaaggagccatataaacgctatgtcagctaaaattgggaagctgaggaattttgtttgcacttgttttgaatgttggaagatgcattgtggctgtgcttagttcccttcaaacttccaaatattccgtcacatcaaatatttggacacatggataaaaaaaataccaattgtacagtttccatgtaaattgtgagacgaatcttttgagcctaattacgccatgatttgataatatggtgctacaataaacatttgataatgacggattaattagatttaataaattcgtttcgtagcttacaggcggaatctgtaatttgttttgttattagtctacgtttaatacttcaaatatatgtgtccgtatactttaaaaaagttttggctgtggaactaaacatggcctgtctctggttttcgatcgagggatgattttctaattcggtgataagatgagggatcttcgcagtactttttccacatcaaaattacagattttgtatgggcctcagacatctggcccaacaagggtccgactcattcttcaattttcgaaaatacgtaacctctggtatctgactaagcaaattatgtacgtactcaaaattctaaacttacagtatagttaaatttagcacggttttccaaatagtaagtgatttttaatttgtcctatatatttcgatgtttgtaacaacaaagactaattatagaaaattacattcaaatctcagttcaacggtattaattttatcaaataaaatttaatttatattagatttattggtcgtgagatattaccagggttgaattaatatttatgcataccttgtattttttttggaaaagagggtacaaatggttgactgaaaaccacaacaagttttcttaatcgaaaattacatcaagtttgatttgcagcaaactaataaaatcataaaaaaattacaacacaagcacacaagggcaacaacaattaaaaaatagaaacacaaaagaaccacgtatccaccgtccaattagaactccatgccttccaaattgatgaaactgtaagtgtcgcaaatgcaggcacattcatagggagcctagcccttaggagggcagatcgccggccggaaagcgagtgggccggtggcgtacatgacgttatagtagtcatggtcagcccaccgcttgccctcgtcatggagcggcgcaccctcaatgctagagtagttgatgtttgtggggttgttgcattcgaagtccggcgaggcccgaagccgcacatagcacgccttgcgcggatcgcccatgtagaagtcggagactttggtctcatcgagctccgcgcggaagtagccgttatcatcggtgacggcccgacggcacctcaccatgacacgattcttggcgtcatggcagatgacggacacctccgccttaggcagcggcttcgcgccttcgaggctgtgtgtgttcctttgcgcgcagctctggcagtacaccataccctccacccttaccagcagcttgtcgctgtgggccggcggggtgtactgctgctgtggcggcggcgggggcggcgatggcgatggtgtggtgtagccatagtttgcggttgcaccggcggccaggagggacacgaacacgatgatcgcgagaggatggaaggcagccattgctctgagcctctgagctagcttgctgtgctccgtggtcgactgagatattctgttttgaagctttggctgtgccgaaacgtagagaggcatgtgggttatatactgcataccatggactaaatgtgcggacatgtagatggaaattaattgtgctgattttggattaacagatcaaactttatttattgttagtcgattttgacaatatatataatgattagcctggcgaaataaatgatctgtaacgattgatctgtaaggcacttttaagagaagaaatcacatgctcatgatctgcttggtgattagttaagaatttgtagactaccgaaaatattcaggatgaagatatatattgagatttgtcagaacgtgctgcccgtgtctgtccttaacggcactgcaataccaggttgtctacacaagcagatgatatatatggagattatttagtagctacattattctccataaagacaggtttgctattttacttgcgatagatttttgggcttctatctttttatactttgtccataagattttgcgtcaagatttgattttgcgtcaagatttgtgtttatgtagttctaacttgcagttagactcatttatatagtatgtttcatgtagtattcaagtaccatggcgtcttttttctttgggtctgaaactgacagaaagaaaacaggtgcatttttctcactgtttgtagaaacaagagctttacagccaaattactggatccaaagcaagtctgctttttacatgcagcggatcgatctagccaacaccacatgatgcacggcgctatcacccttgtcaccgtgaggctgatgcatctactagcaaggagcccaaggccaccggatctagtgacctcggcctctgcgcgcaacagatccgagtagctggaggtgaagatacaagccactcctgctaccgtcctctttgatcatcttcgtcttgttgagttgtttcgcggaggcccatcgtcgggaggcttgggccggagcgtggcggagactgaagctgacccattgggccgtgcacctggggacgcctggaggtgcgggggcggagcccccgcgaaacggatcgtcatccattttagggttccaccatatatatacctcatgtaagccgccgtgcggcgttgtaacctctccccagatatagtgaagatattttgctggctagcgtccgtggttttttctctcctactttggaagggttttccacgttaaaatctcgtgtcttctgtgattgatctattgttctttatcgtttgtttgcctatcgtttcctaatacgtctcactctacaccgccctatcgatgtttggttaagggtgggcaaaatcgaactaaccaagatagaaataaaaaagatatgatcactgaatctgactaactaaatttagtctatcgattcggtaagtaggctcagttaaccaaaattccaaaaacagcccaataacaaccatcaagaaaaaaacaaaccatactcacttttctctctattccctaactacccttctccgccccaacatcccaatcatcactcgtcacgataccacatcgacggcatcaacaacacctacatcgtcttgccacttcgttgtgtcgttccccacgtagtccgtgcgctgtaccaccattctttcgtccatggccgagctaggaattttagaaagggaaaagtccaaattacccccctgaactattgagtgagtacgaattatcctctggacccgaaaatcagacatcattcacccttgactattaataacagacaaagatcaccctgagcactattttggagcggttttgacctaaaattgtacatgtgcatcaacgtgacaatccagtcagtaaaaaaatagaaaaaaaatccttggacccacatgtcatctctctccctcccctgccctctctctctccacagcacccaacatcacttgttacaaaaaccacttcactcctccattaatcagaagcagaagacaacgacgaaggatcgtgcgttgcaggcatcgggagagggagaggaaggcaaggtggacggggatgtgcctcgcatatatgtgtttcacaccgtcgcatggctagtgttgctcacgctcgcgtcgtgccccacttttgcctctgtccccacccccgcccgccgctaccgtgcttggctccccatccgccagctgagagagacggaggtgaggggagggacaagagagaggattggggaaagagggagatagagaggtgaggggaaagaaatacagaggatgagactgacaggtggggcccatccatttaaaaaagaagaattgctgactggactgccatgtaggaccaaaaccactccggttcgagttagtggtaattcgtctgatattaataattgagggtgaaacatgtatggttttcgagtctgagggggtaattcatacttaggggtgtaattcggacttttccctttagaaaatttaggtgatggacaaagcctaactaaaaccactacatatttcgctcaaattgttcttagattagaaaaaatacctgtgcgttgcaacgggtaaaggcgtttttcagtgatacaacggctattaagagccaaggaataaattgaaacattagtatcgctatacattataattgaaaaggcgttgcctcctacctccttttaaattccagaaaacaagttccccatcaaatcaaactgaatctttctcgatctcccaaaattgattaaggattttttatccacttgatctcttcttttagttttttccaaaatcggaacgaatccacgaaactcgggataaaaacagttgggggaagatcactggcagaccatcattcacaaccgttaaacaaatattaaatctagttaattaaatccgaattgaaaggggaaattatggggaaaggatgagggacgagtagagaatcgatttttgcaattaattagagaagaaaacgcacaggaaggtatagatcgatgtggcggcggcgttagggttcggcctgggcagcgcggcggcggtggctggaggcacgtggcaacggatcggacttatacggacgacgtacaaaatcaaatacacgggatgcttgcttattttttttattagatgtacagatagatttgcgataaagagaaatattagtaaaccaactccaacacggatgacatactaaaattttggcagaaacatctttaatttttataatagtagagatttaaatcagagtaattttgttataaaattgcgatctaacacttatataaatgtggaagattttctcttaataaaatataatggtcccttgttatgtctttcctggactatggtgtagtatacatgagttgatagtcagcaatatcaacatgattaagtatttaagcatacacaattaggcaaggtgattagcctggcattggttcaggtttcaagttgctcagtggaaattgcatgggcagccctaatgggcgattgatcgcccgccaatgggggtagcgatcatattcgctacccccctcccctctccctccctccacctggtttcctttttggcaccgtattactttcttattttagtaaatttatacacctaaagtttacacatctaaagtttagagacccaaagtttataagtcaaaagtttatatatccgattcaaatttgaatttgaattcaaatattttttatatatagtatttctatacatctaaagtttatacacctaaagttagtttatagacctaaagtttatacacctcaagtttacacatctaaagtttagatacatgtttcaaatttatatttgaattatatctgattcaaatttacttgtttcatatttgaatttgaattatatccgattcaaatttgaatttgaattcaaatattttctatatatagtatttctatgcatctaaagtttatacacctaaagtttatagaaccaaagtttataaacccaaagtttataagtcaaaagtttacatacccgattcaaatttgaatttgaattatatctgattcaaatttgaatttgaattcaaattttttctatatatagtatttctatacatctaaagtttatacacctaaaatttatagacccaaagtttataagtcaaaaagtttacatacccgattcaaatttgaatttaaatttaaattttttatatatatagtatttctatacataaatttttctaactttttgttttttaaaaaaaatttgtgtggtgtactgtagtaggggaggagggaggagtgtatctagtagtatagggagggggcgggcgggtgatcgctgggcgggcgggggagcgatcacccgcccattagcatttccgagattgcatgcattagcaaacattgatgtgtgggtcctgttgacagaaaacacgaggcctgggagatctgcttaacttcagtgcaggtccaaaactcgccttcgggtgtatgagcgtggtcgttaacaggtctgtacccataaatcagccactgctactgaatcagcagtactgtagaggatctgcattcaggctggtgccttcatgcagtaggacacaaccgcacacatttgttgccatgcgcccgcaactaacttgcatggtaatacatcgattggagtcaacccttacatggcgtgaagcccgagcagccgcccgatctgcccgataggtgaatcggctactgcttccgtgctccatattgtgccgccttcttctccatagcggcaccccctcagtggagatctagtggcacccgcaagatgaaggtctagcggcagcagtcttaatagagaagggcatggccgcgggcaaaaggcagaggagagaaacacgcggacgccggcgataggtagatgatatttttttctgatttctttgattattgtgatcttcttgtctgaaatatttcgtgatttttgtgactcttttgtatatctaaaaatattgattactttcagtcatgatagagaccaaggccgcattgcttagcgttggccatttttcgattgcatgttggttttcatttttagattgtaggaatattagcaaaccaccaatattttcatcacaaaatataaatcaacttcttgattttacatagatgaccaaaatttcttaaaagaccggaaatcgagaccgaccttactgccacccccgcgtaaggtagccaatatattagggaagttggtgttcggcagcagggttatccaaatgtgatcactctaatctcacttattcacgtagagatttacccaggtttgggcctcctgaaaaatagctacgacatcttggcctaataaggaggaaagtgcaagtgaggtgatttgtgtaagtgggcatgcctgttggatggattggactgcacggttttggagcgcgggtttttacaatagcagacctacacctgctttgatgtgttttgcaagtatgacaatggtgctacaatggagcggtagagggtgagtgtgtgaatggtcggtggtccagagatcccttctctacagagatatcaaagttttcttgatcaaaaatcacatcaagtttgatttatagcaaattaataaaatcataatagatttacaacaaatgtcacacaagagcaccaataattaagatagaaacacaaaagaaatacatatccaccatccaaattgaattccacacatcccaaatttatgaaaagcacgcgcatgtaaacgtcgcaaatatagacaccacatttacatggggtgcctagttttagtgcttgggagggcatatcgccggccggaaggcgagaggaccggcggcataaacaacgttatcgtagccctgaccagtccatcgcttaccctcgtcacggagtggcgcacccttgatgtcagagtagttgatgtttgtggggttgttgcacttgaaatccggcgacgcctgaagtcgtacgtggcacgccttgctcggatcacccatgaagaagtcagagactttggtcacgccgagctctgtctggaagtagccgctctcatcggcgatggcccgcttgcactccatgacacgattcttggtgtcgtggcaggtaacggacacctccgccttgggcagcggcatcgcgccattgaggctatgcgtgttccggtacgcgcagctctggcagtacaccatgccctccaccctcaccagcaacttgtcactgtgggccggcggcggcggcggcgatggtgtggtgtagccgttgttggcagtggcgccggcggccaggagggacacgaggatcgcgagaggaaggaaggcaaccattgctcggagtcggagctagcttggtgctcaacttaagatggtttatcttaacctgaagttttggtgtgagaaaatggagagaagcatggggtttatatactgccatggactaattaaacgtgcagacatgtaggaaatcactaactgtcttgattttggattaagattgcattttatttttgtgaagataacatgtcatgattgatttgcaaggcacttctaagagaagagatcgcgtgttcatgatctgctgtgattagttaagatcagtctgtagacgataaagaatgttcggtgtgaagatatgcagatttgtcagagaacgtgctgcccgtgtgtgttcccatctgcactgaaataccacaggttctcggcacaggcaaatgatttttggcgatatagagctacattatttccgttagtactctgaaaattaaggaacagcatatcatcttctgtgtaaaatatacggttcatgtagtatctatttcctttgggtctgaaactaactgaaagaaaacggggtgcagttttctgattgattgtacgcagagcaagtctgtttttttttacatgcggcagatcaatcgtgcgaagttttgtcatggtaaggctgcaacatctgttcgcgaggaggcccgggccaccggatctgacaacctcgacctccccgcacaacacggaaccgggtagcttaaggacacaagccactcccgccgccacctttttctatcactcttcgtctcgccatgcactactcctatcaacgttaagttaggagtgggcaaaatagaccagaatcgaaccaaactaaccaaaacaataatgaaaaaaattatggtcattagatctgactagccaaatttaattgatcaattcgataagtaggctcggtaaaccgaaataccctaaaaacaaaaatttaagaaaaagcacaacataagccgatcaaaccaacaaaagcaaaaccctatccacttttttctttgttccgtaactaccctttcccacccccaccaccctcggcatcgacaacaccacaacgcatcatcctaccgcatcaccgtgccgctccccacgctatcctgtcgcgcatcctaccactcttctgtactgctacgttgtgtcgtgccgccctgcttctccgcaacgatgcctcctcaagtggagatctagcggcactcatgatatggagatctagcggcaataatcgtgatagaggaaagcgcaggtgtaggaaaaaggtgaaggagagaaacatgcggacgccggcgaaaagcaaatgttttttttgttttacagtactgcgattttttggtttgaaattattgatgactattgttattcttttgcttctcaaaatttgttgattatcttcagtcatgacagatacggaggccgcattgctcggtgttggccactttttgaatgcatgtagaccaaggaaactttgatgtggttttcttgatctactcatttgacaatggctagaaagtatgtgattttcattgtacttgtgtaactcagtaaattatttattatataaacacatacaatgtaggagactctccttaaaaaagttttctagatcgaaaatcacaccaagtttattttgcagcaaactaataaaatcagaacaaatttaccacaaatatcacacaagagcaacaataattaaaacagaaacacaaaagaaacattatccacaatccaaattgagaattcagtgcctcccatattaacgaaaagcgcacgtgtaaacgccacagacgtaggcacatgcacggggcgcctcttaatgcttgggagggcagatcgctggccggaaggcgagcgggccagcggcatacatgacgttatcgtagccctcgccagtccaccgtttgccctcatcacggagcgacgcgccctcgatgctggagtaattgatgtttgtggggttgttgcacttgaactccggcgacgcctgaagtcgcacgtggcatgccttgctcggatcgcccatgaagaagtcagagactttggtcacgccgagctccgtctggaagtagccgctctcgtcggcgatggcccgcttgcactccatgacatgattcttgacgtcgtggcaggtaacggacacctccgccttgggcagcggcatcgcgccgttgaggctatgcgtgttccggtacgcgcagctctggcagtacaccatgccctccaccctcaccagcaacttgtcactgtgggccggcggcggcggggtgtactgctgctgcggcggcggcggtgatggtgttgtgtagccgttgttggcagtggcgccgacggccaggagggacacgaggatcgcgagaggaagctggaaggcagccattgcttggagctagcttggtgctcgattacctgaagttttggtgtgagaaaatggagagaagcgtggggtttatatactgccatggactaattaaacatgcagacatgtagatggaaatcactaactgtcttgattttttattaagattgcgttttattgtgtgggctatttaattctgacaaaatataatgattggcctggaggagaaaaaaaagaagataacatgtaatgattgatctgcaaggcagttttaagagaagaaaacacatgttcatgatctgcttggtgattagttaagatcagtctgtagacgataaagaacgttcggtatatgaagatatgcagatttgtcagagaacgtgctgcccgtgtgtgtcctcaactccactgcaataccaggttctccagagagacaaatgatttttgccgatagcgctacattatttccgttagtactctgaatagtactctgaaaaggaacaagcatctcatcttctgtgtaaaatatacagttcatgcagtattgtcgtaccatgctgttccttttcttttggtctgaaactacctgaaagaaaacggagtgcagtttcctgattgtttatacaaacaagagatgtaaagccaaattactggacgcaaagcaactatgtttttttacatgcggcggatcgatcaagagctaacactgcatgattcatggcgctatcgccattgccagtttgtcacggtgaggttgccagatctgctggcaaggaggcctaagccaatacaaccccgacctccctgcacaacggatccgggtagctagaagtaagaacacaagccactcccaccgccaacctcttctaccactctccattttaccatgcaccgtccctatcgacgttcggtttgggtggtagtggtacaaatagaccgaaatcgaaccgaactaagcaagacacaaacaaaaaaaaaaaggtcacttgaatctgtctagccaaatttaatcgattaattcggtaagtaggctcaataaactgaaataacttaaaaaccaaaattccagaaaaaaaacccaagaacagaaaaccaaactaacaaaaacaagccctacgtactcacttttctctctattacatttccctaaacccaacagcagtccaccaaatcaacaaaagcaagccctactcacttttctctcttttccatttccctaactaatctttcccaccccacgctagttggaaaccgccacactagcatcacggcattgagaacaacacaacgcatcgtcctgccgtgtcaccatgccattccccatgctatcccgtcacgtatcccaccacccttttgtgctaccactccgtgtcgtgccaccctgcttctccgcggcgataccttctcaagtggagatctagcggcggtagtcctgacagaggagggcacgggcataggtaaagggtagaggatagtaacatgcggacatcggtgatagaaagttgatttctttgtgattactatgatattattttgtatgaaattgttgatgactatattgtgattcttttgcatctcaaaaattgttgattcttttcggaccgaggccacattgttcggtgttggccaaatggccacttttcggatgcatgtagattaagaaaactttgatgatctacttatttcacagtggctaaaaaatttgtaattttcattgtacatacataactcaataaattatttattacataaatatatacacggtaggagactctccttaaaaagcgttttcttgatggaaaatcacatcaagtttgatgtgtatagtaaattaataaaatcataatagatttacaacaaatatcacacaagagcaacagtatttaagatagaaacaaataaaatgcatatccaacatccaaattgaattccacgcctcccaaatttatgaaaagcgtgcgtgtaaacgtcacaaatatagacaccgcacttgtgtggggtacctagttttagtgcttgagagggcagattgccggccggaaggcgagagggccggcggcgtaaacaacgttatcgtagccctgatcagtccatcgcttgtcctcgtcacggagcggcgcgccctcaatatcggaggagttgatgtttgtggggttgttgcacttgaagtccggcgacgcctgaagtcgcacgtggcatgccttgcgtggatcacccataaagaagtcagagactttggtcacgccgagctccgtcaggaagtagccgctctcatcggcgatggcccgcttgcactccatgacgcgattcttggtgtcgtggcaggtaatggacacctccgccttgggcagcggcaccgcgccgtcgaggctatgcgtgttccggtacgcgcagctctggcagtacaccatgccctccaccctcaccagcaacttgtcactgtgggccggcggggtgtactgctgcggcggcggcggcgacggtgttggtgtggtgtagccattgttggcggtggcgccaactgccaggagggacacgaggatcgcaataggaaggaaggtagccattgctgggagcttgcttgctgtgcttgaccgagatgttcttttctaaaactttggctgtgtcgaaacgtagagaggtgtgtggcttatatacttgcaatgcatggaccaaacgtgcggacatgtagatggaaattaactgtcttgattgattttggagtaagatcacattttattatgtgttattcgattctgacaatatatgtaatgatcgattcatctgtgatatgcagttttaagataagaaatcgcatgttcatgatctgcttggtgattagtcaagagtctgtagaccataaagaatgttcagtatcaagatattcagatttgttagaacgtgctgcccgtatctgtcgttaactggactgcagtttcaggttctccagacagaccgaaatagactgaaaccgagagaccgaaccaaactactggagtagtaaccaatactggccgaaaaaaaaaacatttctgtatctgacgaaccaaaatttaactctgtcagtaggcgcggttatctgcaatttcaaaaatgaccaacaacaacctgccaacccaacaagagcaaatcccactcccttccccagtacccccaccacctctctcatcacccgttagtccgtcacacttgcatcggcggcatcgatcccattcctcgcgttgtcctactgcgctgtgccatcctgcttctctgcggtggcacctccgcgtctcctccactagagattgagaatttggtggagcggtctctcctatgttttttttaaaaattttgagattgtttattgttttggtatgaccgaaactaaatcagtatcgactatttttatatacatgtcggtcccaaaatttctctaaagatcgaaggttgagatcgaattgtttgtttttacataatggccacccctacatccggtaaccaatgtggggaacccgatgtacggtagcaagtttttacagttaaaatcactctaatcttaggggcggacacccattagataagatgggtcaaccagctccgctatggtacactccacccctcacccccagacctccctcctagtcgtggatctaacacattagccactattccaccatcaacccatcaaataaatcaagtatttcaaaaagggatgaaaatgatatggaaattcccgaccaactaagtattgttttctataagtggttctattttttatcatatccgattggccatatataaatcatttcctaaatagttaaattggtaaaataaaaatttgcaacagaccataaatcatttctgaataaatgatcgttttcagtcatttttatccctagctaactctaggcattaggcatccattgtcgtgtcattttcatgactatgctcaccgtctcaattctaatatctatctgaccatgttcatcttcgttgttaactgttcatcttcgttgttaacttgtgtaatgtttgtgtggtgtgtcgccataccggtgcgttgagccggtgactataatttatgtgcacagtaccacacgcccctagccagcagctagctaggactagctccttgttagaggccgctctatcctaccactgatctcactaattcacataagggtttacggtttaccatccttaagaaattattgggagtttttcttgtgtaaattaagcttggtatctccatgtatcttgactcttgaggtaccaaaatatatttttatttaggtacttgaggtactttttcatggatcataaaatttcacttcacgtagagagttactcagctcgtgtgggccgtcaaaatcacgacctagtgccccgcagcattatccacaaggcccattagcctgatatctgaagcaaattatcggcatcattttttcgcttatgcttatacttatcagtcaaattttaaattttaaaccttaaatttataattgattttaggatattttttttcgtcgaagtttattttccagcctttgcttttagatcgctaagaacacatatgtaaaaattttattcatattcttttttgttgtaaatatgacctttcgcttataagcgaaacgatggagccgaaaattatatactcgcggggttatctttttttcccaacaaaaatgacatcaagtttgattaatttgccgtaaaactggtagaaccacaacaatatcaacttacaaaagaatcacataataacaccaccaattcaattagaacagaatcacaaaataaaccaggatatattctccgtccaaattaaatttcgcacacccaacgacgacctctcccaattcaaaagcacgagagtgcgcgcgcgccacacgcatgggggcggccgcggcgggcgcatctagtagtgcttgggcgggcagttcgccggccggaaggcgagcgggccggcggcgtagacgacgttgtcgtagccctgccccggccaccgcttgccctcgtcgcggagcggcgcgcccaccatgccggcgttgatgttggtgaggccgtcgcacttgcggtccggcgacgacagcagccgcgcgtagcacgccccccgcgggtcggcgccgaggaagtcggacgccctggtgacgccgaactccgcgaggaagtagccgctctcgtcggcgacggccagcctccaccacgccgcccggttcttggcgtcgcggcaggtgaccgacacctccgccccgcgcagcggcctcgcgccgtcgaggctccacgagttgcggtgctcgcagctctggcagtacaccttcccctccaccctcactagcaccttgtcgctgctttggtgcgccgctggcgccggtggcggtggcgatggcggcggcgtgtgctgcggtggtggcggtggcgatggtgtggtgtagccgttgttggcggtggcgccggcggccaggagggagacgaggatggcgaggtggaggaaggcagccattgatgcggagcttggtgtaagctcgactgagatggtttgtgtgaagcttttttttggctgtgtcgagatggagagaggcttggggttttatatactgccatggatcaaacgtgcggacatgtagatggccgaagcccgagtggtggccatgtttgtcctggaaaatgtcttggttttgattaagattacgttttattatacattattgtaaaattgtgacaatattatacgtacaatgattgacctgtcgaaatgaaaagaaagacaatatgtaatgattggtcaccatgggcatttttaagagaagaaatcgcatgcttgtaatctgtttggcgattggtcagtctgacatagataacgaatgttcagaaggatgatatgcagatttgtcagagaacgtgctgcccgcgtgtgtcctcaagacttcaactgcaatatctggttctccgtgtaggcagagagatgttccccaacgcaatgccgcgcaaaataatcaattttgccggcagagcgacaacttgttttataatctgaaaacgaactgacatcttattttatctgtaaaatgtgcagttcatgtaggagcatgatgtgcgtccatgttttgtctgaaaccgactgaaagataaacagagagcactggagtaagagaattttctgattgtttctacataggagtaggagagtttaaggcgaaagttactggatggaaaggaagtctgactaatcgagcttacccaaaaattcacaaaacgtagcatctccatcccatcaagagcaatatgtgctctagttcttgtttttcatcttgagggagaaattatccgattaagtttacatgtctgaagagcctaatcatttttgtatatcacttatatgtgctgtcctaaagatttgatttatggaagagtagaagacaattctcacttcacattccaaacaggtcataaatcgacaatatcgcttgttattgtgcggtttccgcggtaaccggacttacctttggatacactaatagtaacttatcccgtcaaattcaaataaatttacataataatatgaacttctaatagcatcgtctagtttttcatggtttaccgtgtgattaccgtgcttacgattgggtgcggtaactcaacccctgatggtaaggttagccctgctctaactaggaaaaaacaataacaaacagatatataagacacaggtttaacatcagtactcttaactattccctccgctcaaaaatatactacctccattctagaatattcgtcgttttgagttttttatttgtaatgtttgaccattcgtcttatttaaaagattatgttattattatttattttgtttgtgacttgttttattatcaaaataccttaagtatgacttatcctttttaggtttgcattattttttaaataagacgaatggtcgaatattgcaagcaaaaagtcaaaacgatatctaatttgggatggaggtagtaataaattttgacactttcatttgtccacaaaaggctagtgaatattattaatgggctgggccaaacacccaccaaagaaaattcccaatgggccttgagtgatccccaatatacagcccattacatgtacaccccagcaatccaggcccacacgcagcgagagaattcgactcccgtttaattccggcccaaatccatctctttcgactgcttacttctgccctaatccacacacgtatcagaaattcggaatactctgttcgcacttgcccttccggaacgctcccaaaccctaggcgcgtgaccatgtcggggtcgtacggatccgacgactaccgcggcggctacggcggccgaggtcgcgtcgggatcctgcgggttgtgtgcgtgcttgcttctggatctgctcctgactggcttgtggttttttttgtaggtggcggcggaggcggccgtgggaggggaggtggcggaggaggagggggaggatatggtggtggtggtgtgggaggtggatatggtggtggtggcggaggatatggcggcggtggcggaggggacggcggcggtggtagaggtggcggtggaggaggaggatacggcggcggtggcggcggcggcagaggtggtggtgggggtggcggtggccgaggtggcggcgggaggggtggaggacgtgacggtgactgggtttgcccagacccgaggtttgtttcgtttactcatttgacgttgtctcgtttgattcgactgtgactgatgaaatcgtggttgtcccgattgtcttgtaaattatgctacttggccatgaaatctagggtttttaggttgttaaattataaattattgggttatttgataatttggtttaggattttgcatggggcatgtgtgaagtgtcctactaaatttttgtttcatcgtagtattgtgagcatcagaactgccaacaaatagttaactgcataattcattctctatgagagctccctataatcttaggtcacaagtgctaaatttatgttgaacctctagatacataaatattatgttatacttgtctcccatgatttcttcccctcccctatgttctattttccttggtatagcagagtggcagagaagaaatttcatatatgtttttgaaatgagttcatggtgttattggaagcattacaaaatacagtaaataagcactacaaaatacagtaaatactttcttttatgaatatgtttctttcaatatggcattagttgtcttgctgagttggttatattttgcagaatattcggttgcaatttcattggttctcttccaatattcctaatatatttgtttatcattcttgttccagttgtggcaatgtgaactttgcaaggaggactgaatgcaacaagtgtggagcaccttctcctgctggaggtggaggtggaggtggaggtggagggtataataaatctggtggagggggtggaggctacaatcgtggtggtggcgattttagttctggaggtggcggtggctacaacagaggtggaggagattacaactctggtggccgtggtggtggcactggagggggaggaagaggaggaggttacaatagaggtggtggcgatgatcgtggatttgatgaccaccgtggtggcaggggtggttatgggggaagagaccaagggaacaaccaaaggggagacgaaagtggttatgacgctggtagctatggacaagttcctcctcaaggtcctccttcctatggtgggcctggtggtgactatgcagcacctccaagctcctatggaggcaataatgcatacaattcagattctgcagtgccacctcctagtagctatggtggtggtccaggttcatatccaccaagttatggtgcaccacctccgaacccgccatatagcggtggtgctccaggtggccaaggtagcctacctccttcatatgatggtgggtatggtggtcggcctatgcctgggggtggaggccctggtgcacctccaccctatcatggtggtggtggtggtggtggtggcggcggcggtggcggcggatacactggcagtgctgctccagagccagctgcaaaggttaagcagtgtgatgcaaactgtgatgagacttgtgataatgcaagaatttacatctccaacttacctcctgatgtgactgttgaggaactgcaagaactatttggaggaatcggccaggtatactttgacctcctcttgagctcccacatatttagtgtttatgaactgtgcatttcacgattcgctcactgaaatattttgtgcattttatgtcttttttctaacctcatgtttttcattttatgtgtttcgccataatatctttttccagtgttactgatattacttgttggaatttaagtaaatttacaaatcagtattcagatgatgtttataatctgtagttgggcttgttaacatttttttccccttttgctttcactactgctagcacattgcaagtcatagttttgcacaaaatctgctccatctgttgtatacagcgcagttagagcgagcttattacatattgtttttttccttgctagtggagaagtacacccttgtgtttcaatgtgcataattaaatttggatatttgttttgatgtaacataatcatctcgcagtaatgatgctctttttttttgtagaagtagtagtactgtaattttagttataaccaagccattcaatgattttgtagtaattttgctttactcccatattggtattttatgccaaataattcgtggcatatcaccccatgatgttaatgtaaaatctttgataataaagtaaagttggttttacagattacttagtgttcctagctaaatttattgcaagaaattaatttctttagttttgggggtggtaactgcttgtgtttcatggctgtgttttgagtttttgcaactgcttttttcttaaggttggaaggatcaagcagaaacgtggctacaaagaccagtggccctggaacataaagatctatactgatgactctggaaagaataaaggagatgcctgccttgcctatgaagatccttctgctgctcattcagctggtggattctataacagtaagttcagcatcgagattatattatgtgtgtataaatacagtgttctgcaatttttaatgcatgttttctattgatattccagattatgaaatgagaggctataaaattagtgttgcgatggctgagaaatcagctcctagagctcctgcatatggtcatgggtaagtacttttcagttctgtagatgctaaatgcagattgtggaatgctgtgtgcctatgtccaagcaagacagcttctattatgggcaaagcatgccccttttagttgcaatttgatagcctagatgtttgaatctattcttcaaagtgctcgtaggttgcccccttaagaaactgtgatattaggagtatatgacacgtaccatctgtttatgttattttggtgtagcttttttttcttcaactacaaaaactgtgtaaaaccaagcacttaagctagaaatgtgatgtaagccacaattacattgattggattctggtggaacataatctggggacttttcttatcatatttttttgtatagcgtgtaaggtagttttacctgatacttcaattatgtgttcttaatttgcatatgcattctgtcacaaagggcttataataacacattcatggtgtagaaataagttgaatgtgggagcagtagaatgccaagtatgtatcagtcaatgtacacttgtactacttccgggttaagatcttaaacattgttcactgaacctctttgtgtaatttttagcctagctagaaaagaatgtcactaacatgccacgattcgaagttgtttggtattattttagaaactggataattgtaaatatctatttattctcacttgacaaggtgggtcctaaccacttgtcttaagtcaatgtgtagtgtatgactgtgtaagggacaatgtgttggttgaaatctttagcatacctcgatttaacacaatatttgtgaacactacttgttattttatgtatgtgcttgggcatatacatcatggtgtaaaacaagtaatatatggcaactgaatgatttttgtttaatttttatcagttgtgccttttaggtatttaatatctgtccacaccacttttagctcatatataacttaagttattactcatgtcgagttgtatatgtataatcaactgcattacatggcatgcagaggtggacgtggtggctatggtggaggtcgcagggataacttcagagatggaggaggccatgggcctaacaggcatcaaggtggtggttcgcgttcaaggccatactgaaagcaactaatatagttactaagattgtcatctgtgagaaaccatttctattcctgttcatcggacttgtactcaaaacaagagcgtaaggtaggttgcctgcttttctcggaattatattccattgtcatactccaatgttggtcggatgtttgtttgtctcatccaaaaagtgattgatccatgttatgtgaatttttccatagaggcagatggataagctccaaatgctggtagttttgagatgttatttcaggtgagtgccgatctgttatgattctgcaatgctttgctatcccgtgattgcttacctttttatttctgcgattgcaaattttgctataacgcttacattccacatggtaactcagccggtggatcactagcttggattttggcgaggagaaacaggtagggcatttttgttcttcgataggtttactagatctagaatccattagttacggatatctctgtggatattagatgtatatgaaccaccttttctggtacacattcattgacttattcatgtggtttgcgtcaaataaagcatggatatgttactatttagatactatttccagacgaaaacatctgcgcatttgttggcttattcatgtggtttgtgactcaaatgtagcatgcttagaaactacaatttccaaaaggaaaaatattctaacatagtagaaaaaatcttgtgggagactcctaaaatcaccccccttagcattagtagtagcactcttgtatgaggttttccctactgttgnnaggttacnnngcttgcaggcattgctnngctgtacaanntgtgtgcagccaacaccgctgctgcacatcgatgctgcctgctcttctatcactgcagcgtattgtgaaacctcgaagccatccttgtatctgccctccggatccagttccttgtgctgattggcaaattgacctgttggctggatacctccagttcatctggtttctttgtatggtttgtcacagttgcggtggatacctccagttcatctggtttctttgtatggtttctatcacagttgcggaagatagacgtcaggcttctttccgttgattgctttttccgactctttcatttctttctgaagtttctcctcgctgttccatatgggtttggtatttggatctgttttaggaggcttgatctggagccctggacttgcagatgggcgaagctccaagccgttcacgtcgtttttgtttgacatttacgtgccgtatgtatcttgcaatagtttggttgtatgacatttgctgaatacttaaatttttcacttcatttgggattgtaataatgcactgagaaacgtacctgtggcttcgcattaaggataaaaaaatgatcggtgttgcttcactacttgcggggtgtgctgagcggaaacgagcgaacgtgttataagtgaattgtgcaacgtttagataaacgatgtattacttcaaagttcaaacgatgtccggcatctttgccacgtagtagaacataaaccgtaggttgtgtagtcgcatttagctagaccctagaggtagctctatactaccagcattcttggttaaaaggtgaactagggcattgttacagtgattcagctggctttaactgacgaaaaatagagatggcactatcttctatgaatgatgctcatgctcattcaccgtccttgtcacaaatcacaaaatcgaacatacaatagccagggcaaaacttgcaacctacactggttaaagaaaaaaaaaagcaaaattgctaagaacaagatatacttttcatcttctcctagtcttctgtttgctcctcccttcaaatctcctagacccttttgccttccctttctgcttgattttcttgagcaccttgttgcccctctcctttctctcgtccaggtcagaatcgccgccatccgaggaatcgtcatcgtcagattccccgaatccggtgagcttctcgtactcgtcctcgtcgatcaccccccgcttcagcttcttcaggagccggtactcattcgcgagctcatccatgtcctccttggtttggactgcttgacgctgtttacctgtcttcttccgctttggcttttcaggcttctccggggctttcctcctcttctctatctctggccttagagctagttcttctgctttccttttcaatgtcttctgccgttgtttttctcgagctttatccctgcagttaaccatgatggagtgttgatccctttctcatagttgcatttgaagcaaaaaatacggatagctctcaagtgaaaaattgctgaataattgttcgattagtttagacatagctctttagccctacaagggtcttacacaacaagattatggtttgtgtcatctacgttttgaatatgggctttccttttaatataaaatataccaatataaatttgtcaaattagtagtgcgttgatgcaatagtacaattggcaacagagtgaaatgttaggtttgcaggcttacttgtacttgatttttgtaacatcgacatctttaacaggagtaaacccttccaatgaaagagaatggtgcttaacttctggcatagatggaatttggagtaagccgtactccatacccaaccttccaatttcaaggtctttccaactgaaaatgtaagaacagtggtgctccttgtatgcccgaacaaacgaaacaaaagctgtaagccctttctccatgacatttcggtcttccaatgcagcacttctgatctgtgacagacaagtgggtaattggttattttaaacactaaatttttctctcaagaaaaaaaatcatttctggattcagatgccttcacaggcagacaacctaagatgatctataacaataagaaactcacctgtggtacaatatctacagcatttgtggaacactccctttcagtgaggggtacacctctcctcttcaagaactcaacataagtatcttcctacagaacaattatagcgctaagcattttactaacaaggcaatccattgtatcaaatcactactgcatgtgcatggtatgcatagccaaatatgtctttgaaattcaactactgacttccacttagataatgtcaaagcagagcaagtaccttcggtaagaggaatacaatagcatctccttcttgatcataacgtgcagtacggccagctctatgtatgaacacattgggatcttgaggtggatcatactggggaagaaacaaatgttttatatcaactaatgacaagcacaaggaaacaatttagggagttatgttcaaagcattacctgcacaatcagatcaacatgtggtatgtcaagaccccttgctgcaacatcagtgcaaactagaataccacttgagagagctgaaaatgatgccaaagctttctcacgagggccctacataccaggaaaatagcgcggtagcaatcagtatgaaggaaagcttttggaagcgccatgtacaacaaatcatgcatgtattagctctgtaacctgcttcatcttcccatgataaggaattattggagaacctttaagtgagtccaacagcgggagaacaatagcccagtaatctacacaagcacatgttgcgaagtacctgcattcaagtaagatcagaaagcccacaagctaacacaatgctacacaactaggcacttaaggtaagtgtgtgaaaacaaattttagttcgctgtctacttacaccattattttctttccattgttctgcacaaggaaatcaacaagttgcgatgacttatttgatgcttcacatatcatatactgcaaagaacaaagaaattttgtggtttacattaaattgacaagtacataaggcaatcaacaggcatagtcactagtaaaacaaaataagtatatgttacaaccagcccatgtaatcattggcagccacgaataactatccaaatgcttgtacaaaagttcctcaccatacctccaatcgaagacccaacggtgttttggatggaccaagctcttgttgagcaccatctttacctgtgggcttcacctctgtcttaacttcaaccctcacaggattcctcaaccctgctttcgccagctccttaacagcctccgtctgagttgccgaaaaaagccctgttctcctcagctttggcaacttcgaaataatcgacgtaatctgcttctggaatcctaaatccaacagcctatcagcttcatccaggatcaaaatctgcttcgaaaacacatacacaacaacaatttatgtcagatttgcatttcaagcacaaaagaacaacacatgaattttcaattgcttccaaaaccacctcaagattcttgtagttcagagtgtctaagcgctccattacgtcgaacagcttccccggggtgccgaccagtatgtttgcaccctcttcttccagtttctttagctccgccttgatgtcgaacccaccaaccagtagcatggatgagacgcccttcagcgtcgcgaagaagggctgagccacattgtatatctgcgaagacagctctctcgtcggggagatgatgattccaagaaccttgcaaaattccatacatttttctgatcagaagtgaacaagagatgcaatgcaatccagcaactttgcaagcaacgcatgaacagaacaagagaggatgggtggagccgtgagcactgagcagacctcgtggggcttgggaggcgaggggcggcggcggaggatctcgacgacggggacgacgaaggcgagcgtcttgccggagccggtggcggcgtcgacggccacgtccttgtgcgaaagcagcagcgggatggccgccgcctgcaccggcgtgcaccgccggaacccgccgcccttcagggccttcaccacctccggggacagcgcgggcgacagctccgagaacctctgctccgtcagcgcgcgcttccgcgccgccgccgccgccaacgaggaggaggaagacgacatggcgtcgcgccgccgcgtctgctactcgcgtcgcgccgcttgagcaggagagacttcctcttgctgttggtttagggattccggggggttcatcgattgggccgtgatggtgggccgcgtagtcttctccagggttgcatttaccgcggtaaaccgcgcggttaccgcggttatcgcgcttaccgcgggggtacggtaaggggtaaaccgcggtaaccgcgtcaaattcaaataaatttaaaaaataatttgaatttttgataaattttgtacggtttgtcgcggtttgtcacggttaccgcggttaccgtgcggtaaccgtgcttaccgccggggcgcggtaaccgcggccccggcggtaaatgaaaccctggtcttctcccgaaggccactgcccaacagcctgttcaattaattttttttttaccgattccatccaattcacttctactctgcacaagttctctcaagtagggatggcaatttaaaccgtttgcccgtttacccgtgggtaaaaaccctaataaagttgggtttgttctccatttagtaccagtgggttttttattgggtcaaaacctatacccaatgggcatacgggcactggcccgcttcgcccatttacccgcaaaaaccaactgatatgtggtccctcggtcaaattagtataaatgccaccatctagtattgatgaacttgtaatgcttgtattgttgaacttgatacaactgtaccctttctttaaattgcgataatgtctctctgcttgtggagatttgtggttgaaatgttgaactgtgagtttgtgacgggtaaacgggcatacccgcgggcacatagcacccgcgggtaacgggcatgagtagtgttccttgctcatcatgtagtaacgggtatgcccgcgagcataaattacctcgtgggcatgggtatgggtagtcactactcgtgcccgtcgtgcccgactgccattctcaacaataatacagacaatttctcaaaaaataaaagacaaaggagggaaaaaaagagatagaatgcatatgtaaatgggtgacttgtataaaaggaaagtcacaattttcagcaataaatgaaagagaggtgtattcgtagcgactcaattctgcagggaattcggctgtacatgagtattttgattgagttgtattccctccagtagaaacttacaaatgtacatccttagagaaaagataaggaggaagacataaaatagaaaatggcggcgcacgaagaacgtcgctttgaagaatcagtagttacattgtgattgcggtatcattgattttactgtttatgtggtaattgagtcttccttctgttcagaggatgcaacggcaacagcactgccttgctcatccccttgacccttttcttcatcaacaccctgtaaatttcactcaacagtaagaatcccaaggtgaaactgccttatctgcatatcaagattggaagattttgtaggttcacctcatcatctgggatcatcactgccttcacctgtgcaacaataaccgtaatgtcatccatcttaccacctgcatagatgaaatttaggcatcatgagattactttgcgttctgcatagagtagagcatgatagtatgtgtatgagttcatgcgtacctattagtttccctccaatgaactttttccacgaggggacatcaaaaccctgcattcaagtgatcagaatgaagaaatttctgtcatccctttttggctgtaacaatctgaacagaaaagattgttgaggggtatatgtttcgcacccgactccgagcctccattgagtagggtgaatcaaaggtgacatccactgaatgcttccttgcaagctctgctagtgcttttgctgtggaaaaaacatcaaactttcagaaggattggaatttgggaggactggaacatgtgtttggtggcccccaattcaaaactgagatatttaccacttaccagcttcatctacccctggagactcggaaatgacagaaacgatctcttgatcgaatatattgtcaaaaaatccatctgagccactgacaatcatatcaccctccataagatttactgtgcaaacctggtagacaactggatcaaaatcagaaggttctacaaataatgcttaaatcttgtacgactatcttgattactgtagtgaagcacttggtattatgtttccactgcattagtggtatcttttatggatagatttgcgcatgcatgcgtgtcccttgtaagatcttccccataattttgatttgtccacacatgcaaaatatctgcatgacttgagatcatatagagttttcaaattaagaaataattaatgtgcatgtcttggactcgttgtaacatatgggcaaccacctagaactgagtatgctaataaaacaatcgtcacacacacagctctattattctgacctacaataaggcacataccagtgcatccagatacgtttgaccaattgcttcagagcttaactggtatgggcagtcaaagtaatgttcttgaggacatgtagagaacattacttggcctaggaagaagagaacagataagtatgctaataaactttaagaaatctataaatttgttcatgctaaccttttctaattactttcaaaccacaatctcccacacttgcaatttttagaatccctgtcttctcaagcattgcaatgattctgttagcgttccaaagaagtcattaggttttgacctgtaaagttgtactaacataacaatgtagatatatgcttacacagttgcagatccaacagaagttgttgcagcatgagccttcattagaagaagctgaggatcatgattgacctgtgatggatagaaactcctatttgatatgcaaattgacgtatagtgtacgtgactttatatcagtactgatgtcaattaagaaatacctcctcatccttgagaaaagtagaagtgtgtgccatgagctctcgagaaaacagagccggattgacatccttttctgcccatctgtcagtagacaagagaatgactagcaggataaaaaccttgtgttaatgcgaattgctgaaaacaccatgtatttttttgagaagtgctgaaatcaacccaaaattaaaaggaaggaaacaaaagcacaatctacaatttattgaagcagttcttttcagggacaaaagtacaaaacaattcattgcagcgaagatggtgtaccctgaaactccatctgcgacggcaaacactccaccatcatcgccgttcacaaagaaagcatcttctccgccagtctcagccttcagaatttgaagaacattcaaatatcaaacaatggttgcttctgttgtataattgagtatgaaggggaaaaaaacactaccagaagagtaatatattaatatgtttatctaaaaaatgactaacctttcttgggtgtggtattagatgagttccaatagttaacacagcttccaacctacaattacaggctcacattaccaaacactgacagatgaagcacactagaaataactaaagactgaaattatcagtgagactgaaatatatattagcagctgtgtttgtttgtagtctaaatcgctgagacgattttctgtagcctaagccattcctggcttagggtgttcttgttgtaaaactctctctccttcttaatacaaaacttggccggttcttttgccggcccggtgaaaaaataaactatcagtgagaacattgctccattacaacttaagatttgcaccttgacccaagtactactgataatcaaacgcatgtcttaggaacccgagaattcgataaaaccgaacatttcgtggactgaaacttatcgtaagggcaaagataagaggatcgaacaggtgtaagcagggaggcatacttggcggcgcgaagaggggagaagcgcgagcggcgaagcgggagatggggagaaggggtagtgggtgcgtggaggcgaggcggcgagaggcgggtagcagtggaggaggccgccatggctggcttgctgctgctctatctcctcctcgcctcgcctccgtcgcccgcggccaccgtgaatcgctcgctcgctcgctagtggtggaggcaggcaagacacgtcactagcacggcactttttcaaatacaccccttacgtattatctattctcgtaaggaccaaagtgaaaaagtttactacataaggactaatcgcagaataagtggatttccaagggggttcgagtaagaatccgggtcagaaacgggggaactgctttaagattcgcgcgagcacgatcgacgcgcacccagccacccacccgcgccccaaatcacgaggaggcgaagccgcccatctcatcgccggagctcgcgaattcgccgccgcgattccgaccaccgccgcgccggcgcccgcgcccgctacggtactccgccgccgtgctgagatcgccgggggagccatgtcgcggtccctgagcatgaggtcgtcgatgagcatgaggtcgcgccgcgacctgcctcctccccagcaggtgagggatccctcctctccccgtgccttgggtattgcgagtgtaacatttgcgcgaggtgcgcgggattcgctgttgcgtgcgcgatgcgctagtttgatctcggtgtttttcgaccttggggcgtagaggggcgagggggtcgattacccgactcttcgtggcgaatttgaggaaactagggttctagtaccgaatcatgtccaattgcgaatctcgccattttattgtgtggaactactagctggaaaaatcaatcgtaatatttctaagaaaaattaagattacttattgtggtttgatgatgataaaaaaaggcatcaatgatttactctccgcagtccgcaccacctggttgtgcgcataatcactagggccttgtccggttaggcccggattgaatccagacgtaaccgaacaaggcctagctgtgggtatacctggtttggatcctctttgaagtgttcccagtcccagcatggttcctcatacccatctttgacaacattgagtatatttccctttggattgatgtttgtaaccgtgaggtgtttgttttcagacaatcgaaaagcttgagaatatggtggctgaaggaaattattatgaagcccaacaaatgtacaagtcaaccggtgcaaggtactctgtgaataatttaactgaagccacaatgattgattcccctttaacttgcatttgaccatcttgcttatggttgtctatttcagaactgcttagcatatgatagaaatcaaccattcactttttataacttaaattggatctgctaaataatatgagttgattgaatttagaatctttgttatacaatcttccgtctattatcatagttatttggctaatgcagcatcttaaaaatagttaatgtcaggattgttaggacattaaacaaattcaaagtaaaacaatgaccagaatgtttacatttgcatagaagcagtattactggatcctacaagtatgtttcatatgatcacaatgaaaaatgttattcatgcacaaaatggctattttctttgactagatttattgatttcttaataaaggaaaggggcatgagctttgtctgaaagatattgtagacaaaaagtgccaattcaggaatacaattttgattaattgtgtctcatatcttgcaggtatattgctgctcagaagtatttggaagccttggacatccttcagtcaggagctttagttcaactgaagcatgggcaggttctatcaaagctaaatttcatagatctaagtaaaaaaaaaatattcgctacatttgatggcaaagtaacacccctcccaaaagaaaagagaagagagagccaaccaaaagctcattgctcccttcgtaacgatttgttgcaaccagccaatggaccttgacgtgttcatttgaagttgttttttaatgtgtgtattgtcgatgtggtggtagtgattcacatcttattatgggatgtttttattgggtgctatgctgtagttacatacatgtgttatcctagattggtggtttatatcattt

SEQ ID NO: 42429 - DNA, 9758 bp, Oryza sativa
tcacttgtaaagttttgtagaatcaaagttgtttaaaatgttagtggaagcagtgtttactagtcctaattgtggctctagctttactttgtcttctctttgtttgtttaccttcagaagatcacttttcccttagattttaattgaattgaataagatacttactttattatgaatgagaacatgtttctagtttgatttgttagtatcacattttgtgattgaaactatatgtaaaccttagatcgtatcagaaagatgtacgacgccttccccaggatatctgttccacacttccttggagatgattatgatgacgacgggcagaaattatccgaagctatttctgcagcaaaagtgcgttctgagagttgttcatcattcctgagagctgctatcaggtaaggttgtactaattttcattaatccaagtaaattgagtagaaaaactaaatatccttcatgcaagcatcaaacatcttcatctaaacatggcagtttgtttaagtggatcttaaggcaaatacatcaaactgttgaatagcatctatactatgaccaggacttgttaactgtagtgcttgaccagtagttcattactgacaaaagtagaacagacaattgagcttatcatgatggtaaaaacaaatgatctgttctcgttgctcacttgcatataaaaatccagatgttgattgtgtaagtttgtttattacaataatgctctcagaaaaaaatgaaaaaggagatggtcacgaatttgtgattttaagatgaactcaaggtgtgcaacatataagaatcatttccatgggatctttgaatctttatgtttaactctgttaatggacaatgtggtcatctagttgactcttctcaattttctgcctgctatatttatatgccactaatagcatatcaatcctttattaaggtggtctgctgaggttggggcatcaagaagtggatctcctgagctgcatgttatgttggcggaatacatatattctgaatctccagaaacggtactgtttataaattatagaactatttttctgacatgaatatattgtgtttgttttagagctgaaattttatgtcttttcaactgttactctttaatgcctttgtggtttgctaaggttcgtgttgactgccgttggatgcaggacatgactaaagtgtcaagtcattttgtgaggggaaatgatcctaaaaagtttgcctctatgctggcgaactttatgggaaaggtaatggtttttagaaaataattgataatagacttgcagctgatgattgtctaatgccaaattctattgaactgttacattcttctgttctctgagcaatgattaaaatgtcttatctgaatatgatcagtaggttcacattctttacaacaattttcattttacaacgggtctcttgcttatagtttttatttgagttggaggtcatccttctccgaaaatagaaacacggtgccagcaagtgattgttcaatcagttatctatatccatttttgggttggattatttcaagaccaacataatcttcgtgtaaagcagtattcatagatgttttttctcaatcaaaaaaatatttttattaatatttttcttactgcacagtgctaccctggtgaagatgatactgcaatagcacgtggtgtcctaatgtaagatataatttctttcttttttttttcctttcaaagagtgcattgttttgacactggcaaaatttctaaaagccatggaagatgtttgcatcttgcaatgcagaaaccgaatttcatagggagttctctatttcatgttctgtttacaatgagtaaacaatatacatatttaggaatgtgctagcaaatcatgcattaggatatatttcctcaatatgcatcaatacaatatcctgctaagttatatacaaatctcctttggatacttaagcacatacaggagcacactataaagtgctccatccaaggtaaaatattagaatttgatcgaacttcggaaatagttacataatatattattttattatgtttatagtactatagtatgttaaaaggaagtgtcaaaattcttgcactggggaccagaaaaatcaaagctaacttcagaaaaatcaaagttaagaaagtgtttcgttataggatgaataaataagaaatttttggggaaaaagacgtgctcagatgcttgtttttctgatatactgcatttttatttaaggtatctatcacaagggaatcttagggatgcaaatttgctcatggacgagctgaaggatcaactaaaatctgctgacttggaaatccccaaaacagatttaattcagttcatcaagtatctcttaccgacgtaagtctttcctgtctttcagtttgcattatttttatgtttcttttccacatttttgttctgcaatgttctcatgtatttgtgtgcattcatgctgcaatttgccatgataacttagaggacacctgcagagtagtttcatccttacatgtttctactaaaaaatactgatcgcaggaacaattcttttttttttgaaagaaccaccagttatgggaaaatctttcatggcctaggtacattacctgggtattagactattttccacctttgagatatgttcatagtttatgtaggatttgttttcagtacagatcatgaatgcatataaaaatattaaatatttctttgatggttattgaaaaattctgataaccttatataacttagccatgtttaagttctcactgatggttaaagttcaaactgttagatttggttgatgctttgctgttagattgcatgctatgcaggataatgattatatttgactgtattgatgatgtgataattttaacactgtaaatctaggatctattgtgtgcttgttgtgtatcactgcgcaatatgttgatctaggttgcctaggtagctttctgttcactgtaaacaaactgatcctacagtttcaattatccaagtttccatgcatctttcgaataattgatgagatagttttgcattttgttacttgtacgtgtataccaagcccagacgttattttatacaagcaacaagtttttttttctcattgtttcctctggtcgtggttatattactgactgcatgctatgtttacaggctcgaaagagatgcttaccctcttttcaggacactgcggcagaagtacaagacaagtacagatcacgaccctgtatttgaggaggtagctatttcatcaaatatagtgttagcttgctaaacagctgtaaaacatgcaccaaaacatcttattctttcaaagattaacttaacaagaactgggaaaaattatatttttcatgttccctgcatagttgtcataaaacaatgtgttcacaagagttatattagatcatgtaggaaactctacaatttaatccaccaacaaccttgttatcatgtgctgtccatagggaaatgtaaacagtgttgataaaggaccatctgcacttataatgtgcttaatatttaactctactagcagagtaatatgtggatagaacttccattacattaactagcagagtaacttgaagaaggtagttaatgctttctatcatatatgaaaaacaagctgaaacagagctcacgtgatattatggttgggtttcagttattagatgaaatagccgcaaaattttatggaatacggagccagagcgctttggaaggactttttggtgatatgttcagggtaagatttacatctttcatctatcattcattcatgccgattgctagtacattgcattgattacttttgaagttgagtacacaccagttgcttttcacaataactaccgtcgtatgcctttagttccatatcagtcatgccgaaattacgtttcatgaagtgcatatcatgtttagaggaaagaatatatatttctataatttgaaattgcagttgatctaagcattcaggaattgaagtgcaaattttatgtagcttatgaagtcacggatgtccacctgttacgtggtaaacaaacaagaaaaaaaatttgagttctttctttcagttataaatattgccatcttcattttgttttgttcaattcaccttttctgtacgttcatgtaatttcacgtatagtttcccaagtacaatgaagcaaacagataatcaatactaaaccattagtgtagccaatattattacaatgactagaagtcggcaacctagttccgatacaagccattattgatcttgttctttgtattctgcaggtataatgatgagaaaaggatttcgtcataaatattccagcacaaagctcccgacgcgcatttcgttcgctaatacaaattgctgctggaagatgaacacccggcccggcccgaaaagagcataagaaaaagttctgttgctgccttcctcagccttgattatcctgaggccatacatttagctccaaactgcatatgatgatatatgctccagttaccactgatctcttgtaaaaccattcaactgttttgctcgtatcatggtcgtgttctaatgatattactattctttaacattttttgtagttccagttttgcagttttaaaacggcatttatcctgactggtctcatgttcccttcatcttcgcgtacacgattgtttggttagacagtgcggcccgtcaaaatatgtgggctgaaagttagggcaatggcctaacgttaaggtccatatataacagcttgaaacgggccgtgaattcaggccattactgggtaatgaccgagagatttggcccatgccactggccaaatgaggatggaagagttgcagacagtaggctaaaaaagctgtaatatactccaattgcacattaaacatatctgggaagtctaaaatatcatagaaatttaaacaacagacattttccccaattggatattggagtgagaaatacaaccatataattgcgtcagggctgttctccaatttgagaattgagtatcaataacttagctatagcacgtattactattttttttccctaaacgcatgtaaaatggctgtagaaatatcaaaatgatcaaactaagcctccatacacaactttatacaccggataattacaagtcaggataggcagcagacaccagatgctcgtaatctataattcataggctcatagcgaacgacgagcagatgtgcgtgttcaatgggattgggagggcagcatgacgctccatgttgaaacttgggacgctcaaacgccagcaggatgatgtcgtggtgggagtctaaccatttcctcgccagcaggatatctcgtgtccaaatccgctgatctgtccctccacgtgccaatcacgtcctgctcgcacaaaatcacataaaccatgcattgctttattaataaacatatgatgcagcgtgcgaattgccacctatggtctatgctatctactggtaaacactggcacaggtgactattatgcttcctctatttcaggttataaaacattttgactttagtcaaaatcaaactgcttaaaatttgattaagtttgtaaaaaaagtagtaatattttaaacacaagacaaatttattatgaaaatatattcaattattgatttgatgaaattaatttagtattatagctattatactacatttgtctataaacttataaacttagtcaaacttgaaacagttgactttaaccaaagtcaaaacatcttataacctgaaatgtaaggagcagtcagcaattcacgaatttgagcatagaaagtacaatatactccctctgtcccaaactatatggcctatatttttttacacggtcttcaataacatactttgatcattattttatttcattctataatcccaacaaatatgaaattagcatcacataaatgtacttcaaaatataaatctagtgatataacatgcataatacatagtatagatatagttagtatgattattggtcaaaagctaccgaatatgttttttcttaaaaagggacgccctatcatttgggacggagggagtagtggtattatgcagtgcgcaacatgtttcattatacataatcttctgatgttacatgttaaatatgcagataatgttcaataagatggttgtgaagctaattcatcatgaagtgtacccgtgtttcttaacgtgcctcgccctaatgaacacacatgctatttattacagtccaagttttgtttaagaaagatgattgtaggcttatagttatagcccagttatttacaataaaaaatcaagatatttagttatgactagaaaaccatatgacaaagtgagtttcataccgtcgtatccatccatcattcgtatgccatgcagcatttatcaagactgtcagttgtctagtcgacaacgagcatccactgccataggcttcattctggtcgagtcctgaaacaaactacttccaatcaacgttatctcaagtgaagcactggaacgacaaagaaaaacatgtccgaaaaaataatatagttgtgcttgatagaactccgagagattccttacactgttctacgagcagcaccattcagagtacttcagccaccactgtcaccaactatttgcagaactctttccttcagatgctgaatcatctgcaagagatcaacagaaagtgacaataagactgtccatcttatcagaacaggatctctgtggtgtgaagaaacttacaggatgagaatttgaagcccatttttcagcagaagtggcagcctctttgagatgtgattttttaggtatctcgtgggagagactataggtggagctctctgtcgcctcagctacccacacgtgcctcatctggtctttatctcgcttgaccagattactaaaaccaacctgagaaacaaacgtaacagtgagttaaaattgcacttgcactacaaaggggtaaatctgaagaattatgtgaagggcctgcagaaaagaaactgggatatagctcgtctacacagaaaattacacgaggcactgtttaattcataactactcgcatttcatatgggactcatgaatttcggacttcaaagattagtcaacttgagatatagtcagtgcaatggaagatcacatactatatgtccagaaagggcataattgaagaatgcagaatcctcgccagtggttttggaagaaaagctaactgccagaagacagtcatcttgctcttcatacttttctccagagataaatttagatccatctgtcaaaaagagccactgcctattctggttgttcaataaataaacattcccaacatacaaaataacacctgcaatgtcaaattcgctgaaacaaaaaggaacggctcattataaaaggttcataatacaacaggagattcagcaagtcagcttgagacagggctgaccttgtaagtggcacttcaccaaaatgtgacaattcaactgctttacgaggggtgaaaaatggtctgcatcatgaaaaagggacatggttaagttttctaaatgcagtgcaaccatcatgtccaatgaggtctcttactcaaaatttgtagtctgtgcggttgctaaaggcgtccatgctgtagatgatcctctaccactcaagtaggatacttctgtaaagtagcttgaagccaacagtcctgtgacagaataaatttgtccctccaccaggtcggatttctgccagtggcaatacagaaatgaaaattgttttaggtatatttgctcattagcacataactatgggaatattgcaaagaaaataggcatgtgcatcttgttgtcctaaagacatatagcaggtaacgctacacacaaaaatatatgacaatcactggcttgttttcttgatgacataacaccaaatcttttgttctttttttctgttcataagaaagaataaagatgatttctgacacttatatgctgtagaattattgtaccgtacttgcttctcggtagggttccaaattgttattaacccttccctgcagccagattttgtggcggagtgtttgctgataaggcccgtcaccctcactttcaaaaatggtgtaacatctcttgaactaagcccagcaactttaagagcattttcaaccttcttagctacttcattttgcctgacaatctgcaacataatggtgtagtttaaaaaacataaaatattagcagacagatgagatgctatagttatgcgtccagaccttttgcttttcttgataatatgagaaagacagcagctgctctgaactcatgctggacataagaatttcaggctcagctgccctctctagcattttgcatatttttgccccttcatcgttatcatcagtgttgtcgcagtgttctccatgttctgactgaatgtcttctgcaatcttagacactctgcataaggtaattattattattataattataatttataatggcataaaaagggaagtattggtgcaaatacacagtttgtgctactcatgaatattactacgtccacatttaaatatatgacgctattaactttattcggtctttgatgtgcaattttgaccactgtttttttctattataatattgtaaaagtacttataaattaaaaaatctacccatatgacatattttcaaactaaatattttgagagctattgacaaagtttcaaaaatttgagcaaataaagtcaaaagtgtcacatcacatttcagtgaactagactgatgatgaaccccaaaacatattgagaaagttttggacagaaaaaaaaaaggcaaacaggaagtatgcttcaagaaactggatgtatccatgcatgattgcttgtcttctattggaggtgtgataagcatccattgcacttaattgtgttaagtttactccaataggagaaataaatacctctggtgatacagctgtagtgcttttctttccatcctttcagacctcaccacaaaacgaccgtcagaaaacctgaaacaaacaattcagtgtgtgcaactgagagagagtttagtaatggatttatgtccagtagtacacctctccctgtacataacaggataaatccttgtaactccaaccagtgtcctaggaactctgccacctgaagcttttatgcacttgaatgccagtgggactccagcatgcttgcctgagatgcgcacaataggttataaaagacaacccagctgtataaaaataatagaacagaagtgtccagttttgtgctcaaattacatacataaccccaaagtctcatcccatcttgcacgataggtgccatttatgtggatcattaatttgacggtacccgatgcctgtaaagtgagatcaacaaaaaattgattatatggttcaatggtagtcaatgttcacagctaatgaggttaaaagacttagaagattagtcaaacctcatgaaatgacacaggcccagcccacccacatagtgaagctccccatatctgccaagatgaaatacatattaggtgctatgagtaaattatagtcatgtctcatgactagttgaaatagcacagtacccgaagcttctgtcctataaaaagttttcttttctctagttgctccaaaagtgccagatctaatgacgcatctagagaatacctgcgaaaaggaaaaggttctaacatctttcagcttcaactcgtgcaatacagagaaagcaaccacataccat

SEQ ID NO: 42430 - DNA, 762 bp, Oryza sativa
ggtgaaaatatagccccattgtggttgacggaggcggggacggtgaaattttatcaccgcggtgacggggacgccgaggtgacccccgacggtgaattcaccggtaccatctctactctcactgctagtacaaaatacaacacgacgcatgaatcgcggaaccgatcggacggcggatgcgctaggtgccgttgcactgtacctaggtctagaaagcgagaccggggagagaagctgccgccgccgccgccgccgccgcgctcatgctcgaggaggaacaggttgctaacgggcgacgacgacgacctgaacgccgtcgaacgtacgcggcggcggcatttgctcgatcgagttaagagagacatcagtggagactggagagagacccggtcgcatacgtcatacgtctatgcttcctttttgaatgggctcatttgagaatcgaagcccatttctgtactcgacaatgttgggccaactatcttccggcctatgtggtataagttcactttaggtccctctatttgtcggtcagtccgattttcgtcccttcaccacgaaaccggtacgacccatcccccaacttgtgaaaccgggcaaacgaggtccctcggcagtatggagggtggtttttgccgacgtggcatctacatggcgcctacgtggttcctttcactagttcttcgttccacgtggcaatgacgtggcgtttacgtggcaattttatctccaaaaaataataaaaatagtgggacccatatg

SEQ ID NO: 42431 - DNA, 2198 bp, Oryza sativa
gacaaggtatcacccgtataggaatatgagaaagaatttcaatggacacagagatacttgccggacccccgacagagctaacagggacagaggtgcacaacttagtgatgggaataaccaacgaatttggaaaaaagaggaaagttcgaaagcgaaaagagaagagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacccgatccagcggttgtgttccttcttccatgcaatcggccagaagatcattgatcccgagggactagataaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatataaaagttgacaatgaaggtttcaccactgtcaacttggctaacaacgcgtacaaggatgaaccgttcgttctcgccaaacaagttgttcaagtgttctacatagttgacccgtgtaacaagaaagtacatgttgttcgtgaagggaaaaggagaattgttggattggacaatattgcagacgaggatgattacaaccagcacgtcacgcataggtcaagaaatacctctagaagaggaggaggaagaagatgaagttcaatatgcacgtgtcaaccatgaggaaggattatttttgtaatttatgtacgtagtttatgtctacatgtctgttatctgtatgactctaatatgttcgcaatgatcaatagtatattgcttatgaaatagtcaaataaaataattaagtgaagcacccactagaagtgaaataaaataattaagcaagtataagcattggaaataatataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgta

SEQ ID NO: 42432 - DNA, 36676 bp, Oryza sativa
cctgtgacggcccagagggttgggcccgtcacaggtggtcttacctgtgacggctccacggttggcgcccgtcacaggtgaggccacctgtgacggccacatagttggagcccgtcacaggtgagtttgactagggttgacctagggttggacatcttctagatcgatccagatccggcgcccactctcactcactcactctctcgaccgccgcctcgcctctctcgacctctctgccgccctctacgccctcctctccaccgccgcctcgacctctccaccgccgtcctcgccgccgccaaatccgccgccctctccgccaccctctacgccctcctctccactgcctcgacctcgacctctccgccaccatctctgccgccgccctctacgccgccctccccaccgccgcctcgacctctctgccgccctctccaccgccgccgcctctcgaccgccgccgtccatctccatcgacctctccgccgccatctccgccgccctctctaccgccatctccgccctctacgccgccctccccaccgccgactagacctctccaccgctgccgcctcactcactctctcgacggccgcgggacctcctctcagtcgccacgccaggaccgtcgtcaccgccaccgggatctcctctccgccgcctcctcctctcgaccgggactcgtcgtcgccgtgtgccgcctcctctgctagtcgtctcctctccaggtacccctctctctctgatgcccatgaatggaagaattgattctttgataattaaggaactttattaggtttagggtttgaaatttagttcaaatggaagaattgattgattggccgcagatttaatgttgttccgaggttatcaaaccatcacagaatacaaaatgcatgggaaattttggtggattggtcagtgtagtccatggacggaaccgacctagacaccaaaattctccatgcattttgttttctgtcattctttgatgattaaggaactttgcagattatctaaacttgtggatttatataccctttttgtctatgaataggtgaattgcatgaattgttgtttatatacatgatttatatacccttgctgctgctgccacataaatgattgtgggctgttttattatctacacttgattgaattgaatggatgaattgctgtttacatgaagttagtagtactgtctcctttttttgatgaaatatatgcatatttgagatgtgaaatatatgaggtgatgaatttggactatttgtggatgaaatatatgcagtattagatgaattagtctttttgtattagatgattttaggattaattttgctgcattggttgaattttgcatgattttaactagataaatggccagtgatgttttatgttaatacacccctgccactgctgttattgtgggctacttgttaatacacccctattgttgctgcccctgtggagtatctttgcccctgttgctgctgcccaatgtgttccttgttaaatggccagtgatgaattgctcaataagaacaaattatctacacttgttctttttttatgcataagaacagattttctgtacttgctcttttttctggattgataagaggagactatatacacttgttttctgtcattctttgatgatttatatacccttgctgctgctgcccaatgtgttccttattaaatggccagtgatgaattgctcaataagaacatattatctacacttgttcatttttttgcccctacacttgttcatttatatacccatgctgttgatacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcaaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcaaaattgccgcatgaacaacatacgtcgatgtcgggcgggacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaagatcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtttgtcaacccgcccggcaatcatacgccgttcgatgaataccctcaaataaccgaagcggtttgggaggaattctgctctctcaagaccacccaagagtttagggaatcaagcgaggcacatcgcctactgcaacagcggaatgagcacccgcatcggctaggcaccgcagggtacatcggcaaggaggcaatatgggcccaagaagatgcagccgctgcagcagcgaatgtccctaccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaattttcgttcgtataaagtacaagttcgtataaacgactatcttcttttctagttgggcttggttactgaacaagcttcacaaagcgaggttgagtccgcgccgaagaggcgcaaagatgacatcctcacaaaggcgctcggaaccaaagaacatcctggccgaacttggggaattggtagcgatgtgccctggaagcatggactccctcagtacagatcccaatacaggaaacggaaagtctccaaggaagagagggacgctcgtttgaaggacgaacttaaggttgaggtcattcaagaactagaagctagcatgaatgcaagggtggaagaaagggttaacaaggtcctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatgtacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgtagacctgctagctgggtatgccaaggtgtccatcgatacagtaaaggacacctggtcaggctatccgctgcccgtgcccccaaatgatgaaatcatgactttgggcgatgcacgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggctgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtacatattttaaggttgtgttggatcgagagtcgtcgccatggtaatcaggttggattccttgatccatccatggtgaatgaggttaatttacgacagagcttcactgaggtggttgactatgtcaaccggtgtttatgggcccatcaagacaaggagtacatcatgtgcgcacagaaccaagaataagaggacaatacccttcgtgtatattgtttttgaagttaaggttcttagtactaacgctacataaccactgcgcaggcgacattggattctcctagtcatcgtacctaagtggagtcgggttacctaccttaactccaataagtccaaagattatgatttcagtgaaatcaccaaggccttaaatatggcttggggcccatatgtggaaaagggtggtaggcacaaggagggcaagaatgaactttatcatgacaccaagtttgcatgcgcacaacagatcggagaccaatgtggttttcacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttccttattgacaggttgtgcaggtcgatgacattatggctttaatccatttggtaagtatatatgtggttctatgagcaacgaccgaaattgtggctttcaaggggtgtgaatttgctgtgcaaaattgtggcatttgaactgcatatatgtgttgttggggatctgtgatgttatattgggggggtgatgtatctgtgatggatctgtgactagaatatatctgtgatgtttctatttttcagagggcatggctagcaaatcctgaggctagccaatatttagcatttatttttttctggaattaactcatcagtgacgggtcggaacaaaaatccgtcaaaggtaacataacctgtgacggactagcaaataaaggcccgtcagaggtgacctacctgtgacgggcctttacttttgggaccgtcacaggtagatcacctgtgacagcttctaactacggagacctcaacctctgacggcctttatttcaagggccgtcagagatgagtcacctgtgacgggtcctaacttgctcaaggctagcggagaccaacacctctgacggccttctagtaacttgcccgtcagaggtgggtgtcacctgtgacggccggccacccgtcaaaggtgactggactcaccagtgaccactgatcactgaccatgcgcgaagccgtcaaagatgagggtttgggcccgtcacaggtgaccttggccagtgtagtgtgcgtagcatagatgagagaagagcattaggagacaacacattggcagccatgatcatgccatgctgggatgtgctaggtgcattcctccctcgattaattaatgtctcagaaccaagccgaatggctctgatggactgcagtgcgcatgcatctgagttgagcccaacaattcactaacagtctttgtgcatttgaacggcagaaggaggaagtaatataagcacggctgcacatcaagcacatgctgcagtgcttattacggagtaaaaattaacagagaacgatgcatacaaaagcatcggttttatcgcatattgcatggtaggctctatgatcatggccatcttccatcgttaattaggtgtccggaaattaatattattactgccagccgccagcgtgttaattgcacaaactacatggtgcctgcgcgcaagcacaacgagcccacatatgtgtatatatattgaaccggccatccatacattgatgccatttcatgattttaatgagcaccatccaattagtgagcaaatttgaataatttaacgacgaccatcgtagcgtagcatagatgggaggagaatcaggtccgctgggcgtgccattttgtttgatgaaaacaaaataacgaacacacaaaaaatagggaaaccttgtattttattaatcacgattcattaatatgaatgtttacaaatacatcagggctcccacaggagttcgtcttttgccttcgcgaggaatacttaatggaaatgtatgctgactggagattgcatgcagtccgctgattccccgcgcctagcaatgaggctaccggttaattatatccataggacgagcctatggaacacctccgattaagatgcgctttgtgatcgtcgtcttcaaaattaattgctcgccgaaggttgaggttggtgcagaaatttaatgataactgtgatataggtggctttgttttgccgaaacctggtcacaatatattatcaccacgtccatacatgaatcaggtatcataataaaggggatgacttttgcctcgtcggtgcccagtcatatatgccggcctttattagatatagatatatcgttacttttgcctcgttggaacctagtaacgtgtatccgttcctatatgtttggacatgttaataatatcgtgactccggcctcgtaaatgctcggccataatttttatcttccaaagatcatgaatagctcccatgcgtgtgcatggtagcaaaatatattttgtaaaacaccgcttagattgttcaatcaccaatgaaagttggacatatctagcaccgttgttattggcatcatagtaacaaatagatgatccaatctccaataagggtcggacatctaattttgagcatagaaaatatcaaatagtattcggataatccgatcgccaatgaggaccggaccagccttataccattgattgtataaatggagtttgatgataaacgtgtttcggctctcattgatctggctttaatcatcaagatcaagatagattaagaacacgcagatgttccgatcgccaataaggaccgaacatctattgtgtttaatctagaaaattaatatttattcaatgtgctcaccatccagcgcaaatatcttgaatggcggcatgttgtcgataaatgactcgacttgacgaaggacgccggctgcggtgtttaattttctccgcagtggcagcggcaccggtttgctatcaccaggcgacttcaatctcctctcctgattttcctaatctactaagaagaatgggatgaatgaaaatgggcagatgggtgtctcctgtggcgtcctcggcgtcccccgctctagatgggttctgctccttatataggcagcggtgacggaaacagcctccgaatttccagcgccccgtgctaatcctcctgataaaccgatgcagggacgagccaatgcgtcgccgtgtactggagataattatgtgattaacatgcctaatgacggtgggcccatgtgtttaatcgcctgtcaatttccaaattggagataatgatcctcacgtagcaaagcaagtaacgatagcacttgcttatttcttttcttttaatagctccaatcttttgaatcgtacatcggatttaaaattcatttgaaccattactttctattcgaattatacatcaaaacgagtccaatatcgaatatattcggacaccgtgatatttaaaatttctgggcccatatgtcatatagacacgtctcgtatatatttaataaaattgggtggcagataatattttcgtacaaaattaaatgcccaataatttattatatcttatatgaatttttttgcacaaaaactcatcaaagaaatgccccccaccgagtatagtctgtacgcgaagtaggacaggctaatactcggtgaacaaatcatctattcagataaacctctccataaacgattaattttgctggtaactatcaccagtatatctccaacaagtccgagacgtatcaaaactgattagtgattaatccggcatggactccatatcgccgggcatatatattctcagcagccacgcctgcctagggtttcgaatttgtcgtccttctattctgaagtaattttctctaatctttgttcgtctcactagtcgggacaaacgaaccgatctacgtgataaagaccaggtttgctctacttgactatttcttgctttacatatcttgctaataccttgaaaccctcacgatcaggcatgtacttttcaataatcttgtcagctatttttgcctcccacttttgatagtactttaagatggggagagagagcaaagaaaacgttcaaatccgtttcagggcgagcgagccaaaaagaaacaaatcaccggagatcaacacgatcgtgatcctgaattgattaatacggaggagcaatgcgcccctactgatcaccagcgaaactccatggaatctggcagttcagaaggttctcgtgacatgcgcacaggataccttaaaacaactgctcacaatgtatgatcaaccttgaaccactttattgttttaaaacataagcgtgaccatactacttgcttgatgagcttcctgaacttcctttattatttctcttttattcttacagaaaatgccaatctcaatgtacatattatttagcgggtatgaaagagaagcaccgccgcaagaagaaaacggagaagcgttattgtggtgagaggattttgatttttttaaggatgcagagccaaccggtaatttacccgaggatgcacaatcaaccaacaatggtgaagcaaagaaaacagatgatttcatgagtcaggttgcttcatgtttgaatattaagtggggtcaacaacttatacgtgaagcagagtggatgtcgctcacgcagagtcgtgactgggcagcattccgtgtcccgacaccatttcaaaaattacttgccaattgcaaggatgtccttgtaggtcatcaagatcaaccagggacacagccaagagggaggcctggcagcatgtgtctcttgaagccggttttatttaatgactccgggacttttgatgtgccacgtcatactgctacattggcacaaaagttcattacctcaagaaccaagcgatggttggaagatcagccaatgcagttaaggctagaaatttctcccaatgacaagctaatgctatgggctcgtatgctaatggtgaatccgtacgaccgtacatatctcaagaaggccggcgtactccgaggcataatggcgtctatttataaatgcaagatagatccttcattagtggccgcctttttaacttattggaatgtggatggacacactttagtcaccagccagggagagatgggttatcctctccatacaatgtacgatgccatgggcataccaatttcagggcgcctttatgaagaatttatccctttaccatccacagctcgtgggcatgtgcagactctgcacaatatatatgttgaggagtgtcccctacaactaaatgagggtcctggaatagtaaccatcgcgacatgggtcaatcacttcttcggcgaccaccctgtgccttttcagtcatttttacccaatggttttgctgatccaaaaaaacctttatatgagggcccaaattttcgtgttgagattcggaatggccgacccactgctatcatgtgtggtctcgaaatgacttacgtacacacctacccattggtggtgtaccgggcagcttttatcgccgcatggttatgcacatattgcgttccagtggaggaaggcaactttattcgccccgaggtttttactatggcaatggaaatcgctcaaggcagccgctgggccattggtgttacaagcatggcatttttatatcgtgccctggacaatgtctaccaccaagtagctgcacgtcaggcttctgcgagtgactgttcttcatttgtgccaggccattttattatgggctggtttgcatctttttggagagggttcctacgtcggcaactttatcttgcccggtgatgaacccgccctttattatagacttcagagactatgagtctatggatattaagagcgcacatagcttattttgggattttaatgatgctggaacggctttacgttcactggacttcttgggacggtccagcatccgttttcccacatccgaccaggaggtcgagttatttgatgaccgttctcccaaggcacacagggcaatttccatggcagccgtggatttcttggtcagctgcactgttggcggcgtcacctataggagaggtgaagtttttgacaatttggtttactgtcctcatcgattcgctcgcatgttcaactatgaccagcatgtccccaatttccttatgatcaccattaacaggacacgtagccttgattttccaagttacctaaatggcaattctagggatgaatcgctgcaacttttgcaacggcgccacctagcttttcataggccgaggggtcactcaatatttattcaacctttcgcccgggacaccatacgttcacttgattacatcaacgggtgctctcaagctttcaattttctaaagcatccgagcctattctgttcacggtcaaaacactccaccaaagctgcaactacgaaaaatgcacccggggcagaaacatcaggcatgcagtttaccaaattttttttaaagaaaaatatatactctgttatcaatatgaatggtcattggttactgtttcctctaatttattttcgtcccccttcttttttttaggaggttcaggaggtagggtgggcacacctaagcaaagaacagccaagtctgtctcgatctctcctgagcaccaggaggagagcgctcaaaccgagatcaagacaacgttgccattacccgcctcgagtgcgaaccctacagagattgtgagggtaggacccgaccggtctggaaaagacatcaagaaaatcagaacatgcattgccaacccagacaatgtcacaactcatgtgtctgcccaagcctcacaacaggagttattagtgttacctcctcgaaatgagactgtactcaactcgtcagccatgacgcatatcgacccctacagtgaagggttggctattccacatgatgatataggcactctgcccacagatcttcttacaggcgatttttctgatctagccactcttttggatggaggggcaaaccctgaaaccagtctctgtttagattcgcccatttttccgggtgctactcagaaggacaacgttaattcgcatctcctagaggacgacgagacgcgtaccgaggcttgtgctgatacagtaaaagggggcacctctcatcacggtacaactcatttattttattttatagacatttctgtttgttcctttttttatacaaataaccaatttcatgcactcccttccttcttatgtgtttcagcttcactgactggagttgaagagttgtccaatgaatccaagaagttatctatggatgttgagcaaatcgtcgcacaaattctaaaggcaccgaacgtagaccctggtgcaggggaaaactcctagttcaagggatttcatgggaacaactcggtgaccctgccgaaactttcagatgatgtttcagctcgtggtcttaaacatgtctggtctgagatcaaagcgtttcaagaattactcaaacaacgcccgatacagaaggatattgtgcttaaagagataagcatcaatctggatttgtggagtaacttcttctcaaaaccacctcctgaaataattaggctaatggaagggttacgtgtgcaaaagggagcgctatcagaggaagcgccactgccaaccactaagattgaccatcatattgatatgctccgcactgctcaagacaaggtggagtcatcgtgcgtcgctttggcagcactaacgagtcaatataacgtagaacgggctgtagaagaaggcaataagagggagtgctctcgacaagcccagaaaatcaaagcagagatagcaatgttgcaagcaaaacttcaacaggtggaagatgattattcccgtgctcaatgccaccaagatgttgtaatagagaacttgaactcccatcttgagcgacatcgacaagctaaggatcgaggatatgagattgcggcacagttagagcaggcgagcgtacaccaaaagtctctccaaaatattgaagactttactaagccagacgagtttggtctgtcccaatatgtctacaatatatttgattttttcataggctgctcattagatgagtagacgctgttttaaaatcttgtttcaggcttgtaatagctcttcagatattttatttgtttctgatataacagagtgaactcctttatttgctattatatactttgatttgcaccagaacaacggagtgaactccttcaaatttaataggagcgttgcattgttaccaaccgtctttgtgcactggcttcttccttttttttctttatatatatacatttcctcacataaaagatgctcacgttcagattttttagtggctttactactgtagcagtaacagtaacgccactaattcttcacgattctggttcagccatagattttttttattcaattttttttactggcttttaaaagaccagcctccccgctatagaaattatagcgaaattcatgcaacaatgcaaatgtcgataaatataccatagcgaagattcatgctatgacataaaattccttgtggcgaagaatcatgccgcggcgtgagaacaaaaaaaaatttaaggaagaaaacgtagcgaaaaattcgtgccacacactgatgattatatggcgaagtaatcataccatcttataaaattctattgcgaccaaaataaatcggtgccaaccaatagaaaattaatcaagctagacgcgaccgttaaaatggttacggtactaggcgtctaaactcgaagggtttcacagtcctgcattgaccgtactggcatgctttactgctcccaaatattgactgaccatcatccgaaaatcatagatgctggttcagtgcaactgtacgtaattgactgggccactgtgagaacgcgtcccagtataaacttgataggattaattgccgtccgaaaatcatagacgttggcataatccaattgttcatgaaataataagatcactgtagaaaaattcgttacagtgcagaattgttggaattaatcgtcgtccgaaaatcttggacacgggtgaaacccaattaaataataaaatcactgtagaaagcacattacactgtacaacttataatattaattgtcgtccgaaaatcatggacattggtatgatccaaccatatattaagtaatcatatcactgtaataagaacaccacagtaaacttagtaggaataatttccgtccggaaatcatagacgttgtcatccttcttttcttttgccacgtgttttttttgccacgcgtcataaaggccttcttcacacacatcttgtaaattcaggcttcaaatattattagcatatgagacggatgcccccgccgagtagagttcatgtgcaaagcaacagggactcgactcggggaaacaataaatgagttgtcttgtttccaaggaggagagagaaaaaaaatatgtgggatttttttttgtgtgttggcttttcttccggtcgccaagctatgaggtaacgaatggcaaactgctggaggatgtaatatgccctcaatttctgaataacgacgggatctcgcttaatgcttcaactccctcgtgtaacttgtgataatgagctcacgtttcatcaggatctcttgaaaacaaaggggtcttttctgagttttccttcaattatgtgcctcatattttttacctttatcccaggaaggaggataggataaggctatatttcaaaggtggtttgggtcaataggctatgaaattgccattacttttgctgagggtgggagatgactacttcccgctttcagattgaagaagagcaaccaacccggctacaggctgctgccaagacattgccatactttcgctcattttcttgacgatgtcgctcgagatgggagttcaagttctctgttacaacatcttgtcggtgttgtgcactggagtgggcatcttccacttgttgaagtcttgcttgcaacactgctatctctgctctaactttccgtgcttgtcgtgagcactctctcttgttgccctcctctactgcttgctctacattatattgactcgtcagtgcctccaaagcgacacacgatgactccaccttgtcttgagcagtgcggagcagatcgacgtgttggttaatctggtcctgttgtgcgagaacaagattagtagttggcagtggcgcttcctccgatagcgctcccttaagcacgcgtaacccttccattagcctaattatttcaggaggtggctttgagaagaagttactccacagatccaggttgatgcttatctctttaagtataatatctctctgtaccgggcgttgcttgagtaattcttgaaacgctttgatctcagaccagacatgtttaagaccacgggctgaaacaacatctgaaagtttcggcagggtcacggggttgttcccatcaaattctttgagcagggagttttcctctgcgccacagttcatgttcaccgcttgtgaaacttgggcgattatatgctcaacattgatagacaacttcttggattcactgaacaagtgttgaatcctagctggagcacatgagaagaagggtagtgtgtgaaattgattacataaaaaaaaggaaaacagagtggacagagaagtataaaatgaaagaaaccagttgtaccttgcagagtggtttctcctgcccgcatgacagaattatccccattacaatgcttactagtggcttcggggcccactgccttgttagaaactccatctggtcgtcatcaagaagcttactagtaggttgagttgggggcatggtgcagatagtatcacacggcgtgtttgatcctccgccggaaaaatcaacatatgttgcggtatgatagatatgttatgtttccctgtgaggaagctgtgatgatccacatgaaaaaataagtcggtggccctgtttgatgttcaaacaagaggctactttagacaaccacatccacttcttcgctgtcccgattgccgttacatcttcgggtgagatattttgctggtcaatgtgatagaaaaatttgaagtcatcacaccaaagaaacatctcgccattatcttctcttggcgccttcttggctagtccactgtataatgtgtagattgaggacgcctcaacataggggttccccttttaaaaaaaagaggcacttataagatggatcaattcacggaagagtttaacgattcagaacctaacttctgtcccttttttttattatgatcttttcgccgtgagatttttgcatgccaaggcccctcccttgctgggaagtttccttgataccttcatcactatcatggccaggcaatggtgggtcatctgggatctcctgccaagtataagtggggttgcacacgctggtatgatcggcacgatcactagccttctgcattttcttgtcttgaacagtagcaaagaaattcgatcgactgctttccccagtcgatcaccgttaatttgcagtagctctgatcgaagattttaacgatctaacatgagctctgttttaattactcgattaagaagctgtacagactttatttatatatataggacatacggccatgagcccgtatgatacatgaactcggcttcaatatatatcagatcatgcacgtcatttgccgattggcagccagcttgtgaatcaagccatgtaccacacggagatggattaatccttcgtaacaatatactactgagtatttcaccgagtgaagtctgtcctgcttcgcgtacaaactacactcggtggggggcatttgtttgatgaatttttgtgctaaaaattcatagaagaaataataaattattgggcatttaattttatatgagaatattatttgtagcacaattttactgaatatatacgagacgtgtctatatgacatgtgggtctagaaattttaaatattatggtgtccgaatatattcgatattggactcgttttgttgtataattgaatagaaagtgatggttcaaatggattttaaatccgatatacgattcaaaagattggaactattaaaacaaaagaaataagaagtgctatcgttactacgtgagcatgcatggtcattggctgtggcgattaaacatatggggcccactgtcattagacatgttaatcacataattatctccagactgcagtacacgttgacggattggctcgtctctgcgtcggcttatcacgaagattagcacagggcgctggaaattcggaggccgcttccgtcgccgctgcctatataagaagcagaacccatctagagcgggggacgccgaggacgccacaggagacacccatctgcccattttcattcatcccattcttctcagtagattaggaaaatcaggagaggagattgaagccggccggtgatagcaaaccggcgccgctgcggagagaattaaacaccgcagccggcgtccttcatcaagtcgagtcatttatcgacaacaagccgccatttaggatatttgcgctggatggtgagcacattgaataaatattaattttctagattaaacacaatagatgttcggttcttattggcgatcggaacatctgcgtgtttttaatctatcttgatcttgatgattaaagccagatcaatgagagccgaagcacggttatcatcaaactccatttatacaatcgatggtataaggctggttcggtcctcattggcgatcggattatccgaacactatttgatatattttctatgctcaaaattagatgtccggccctcattggagattggatcatctatttgttactatgataccgataacaacggcgctagatatgtccaactttcattggtgattggacaatctaaccgatgttttacaaaatatattttgataccatgcacacacatgggagctattcgtgatctttggaagttaaaaattatggccgagtatttatgaggtcggtgtcacgatattattaacatgtccaaacagataggaacggatacatgttactaggttccgacgaggcaaaagtaacgatatatccacatctaataaaagctggcatatatgactgggcaccgacgaggcaaaagtcatcccctttgttatgatacctgactcatgtatggacatggtgataatatattgtgaacaggtttcggcaaaacaaagccacctatatcacagttatcattaaatctctgcaccaacttcaaccttcggcgagcaatcaattttgaagacgacgatcacaagcgcagcttaatcggaggtgttccataggctctttcctgtggatgtaattaaccggccgcctcattgctaggcgccgggaatcagcggactacacgcaatctccagtcagcatacctttccattaagtattcctcgcgaaggcaaaaggcgaactcctgtgggagccctcatgtatttgtaaacattcatgttaatgaatcgtgattaataaaatacagggtttccctattttctgtgtgttcgttgttttgttttcatcaaacatctggcttggagtgagattgcattgcatgtgacttagcttctttttaatattccggtgcagtctgcaacacagaaatgacgcagaaggaaaatcaagagagggcaacgcaactgaatggatccaaggctgaatcgaataagttgtctttgtttccttcttttcctgtacctgggagttggttgtataccccctctgactttgcttctttttatgcagttttgtacaaaacaaactcaagcagaaagcgaaacaaggggtggaatctcaaaagagagaaacgaaggctcacttgagcaagatgcttgctggattgaagattgttgaatttcttcatgctgaagggtggattggagggattatctaagaggttttttttttcattttaaagctattctaatgcctacattgtcaactacattccccatatttagtatgcttgtccacatgtcaatggcaccgttggagcaaatccataatgtgcatccttattccttaaatagtgcggacatccttaaataatcctttgagaagaagtatcctaacctttacaatctagttagaaataaaaatgaggtagtggccaaggtaatgagtagaatcccgttaaatgtgtctttcagaagatcaatactgggaagaaacttgaagcctggtatgagctagtgtcgaaggtattaagctagtgtcgaaggttgttaatactgttttgacagattagaaagatcgcttcttttggaaaaacaataaagatggcctttccacagtaaaatctatgtacaagttgctcatgtatgaaggggtggttcctaagaagaatttcatttggaagctcaagattccacttaaaatcaaaattttcttgtggtaccttaaggaaggggtaattctcactaaggataatctagcaaagagaaggtggaagggtagtctaagttgtttttgtaactcaaaggtaacaatataacaccttttgtttgattgctcaatggctaggtatatttggagtgcgctcctttttacatttgagattaggcaactgtgtagcatgtctcaaatgtttgggaattggctgaattgtgttgaaccaggctcaagagaatattgtttgtgggcatagctgcatttctttaggcaatttggttatatagcaatgatgtggtctttaattgctccaatcctacatctttcttgcaggtcattttcataggaacgcattgggcaatgacttgatctttgcttcttaagggaggcgatgaagaaatagttgagagcagcaaactgctggagaagcgtgtgttggagttcttctccgtgtatggctggaaccttacaagaagattggaagcctagtctttttcttcgtttgttgttcttaaaactctttgtgctgtcatctcttatgcaaaatcattttatatttaaactgacaaatagaacctggaatcatatatttctccccatcgaagaaaaaaaatgtacagatgatggccacgaaatatcaaaatccaaatgagcagattgatcgactcaaacaaatccagcaaactcggcaaaggaaacgaagacattttaattaatttatagaaatcagtcaaatgagatataggagtaattgatatgaccaagtccttatgtgtaactattttcttccaacgggaaggtgacaggttgtgcatctgccgattgatgacttttaatgcatatgatcgcctgacagccgtgaatattgcaacagaattttagttgtccagcaaaaagagatttgcagcttgcaggttcatctagaaaacctacaccagtaaaaaaaatgccgagatagaaaaaaaaaccatctagaaacgaactaggctggctcaagaacggagtgtggagctattccaccgtatcccagtcatagtagaaaaagccgggttgtcccggtggagtgctggcttcaccggtctatcggtccaacagttgggtcactggatgaaccgcggtttattccctatattttgtgttgccttccagtcacagcggctaagttatagtataacttagcctagcggttggcaaggtttgcatctatcctagcagcctgggtcgaatctcatccctgcaccattttttctcccataaaaatcaagttgggctcataagaaagatgctatcaagtggcccaactagctttgctcgaaaaccgcagccggttcacaccgggtcgattgtgtgagcgatcctttgagggaaccgagccatgcgatcctttgagggaaccgagccggtcagggagctggttccggttttttctactatgatcccagtagatcttttttttttcggggatgatcccagtagatcttattatatacttcttctgttttatactatataagtcttattatatacttcttctgttttatactatgtaagtcatttgcttttttttcctaacttcaaactttttaagtttgaccaactttataaaaaaatatattatcattttcaatacaaaacaaacatattatcaaattatatttaatattgaatttaatgaaactaattttgtattgtagatactattttttttaaacttggtcaaatctaaagaactttgattaagaaaaaaagtaaaacgacttataatatgaaacgaagggagtattgaaaagaaaagtttggtcaggtcgttatccgtcatacatggcacatttgcggcccagcatatacatacataaatctgtttccaacacacagcatattctctactctctacttatactatactactattgtaatggcaaaatctaaaccgagaagcctcttagtttagtgtaaactagcgaccaaccggttgtgagaataagtactactacacgtgcatgctttttttcctcttagacatgcatgtctttttcttccttcttataaagttttctcaaattacttatccaatctacaatccgattacaccattgtattcgttacaattaaatcttcacaacaagatcttacatgattatattacgatgaaaaatatttatatttgcaaattacttttattatatacgtaagttacttttatcatatatataagttacttttaaatttgactaaattacttcttagatatataaaagtaaattcaataaagtctaaaagtaatttacatatattataaagtatctttaaacaaaactaaagtaactttgtcacaacattagaagtaaattcgttgtagggataaaaatatgactttatctagaaattaaatttaatcagcacagatcaacacacgtaagtttaacaatttttaaaagtaacttcaatgttaattggaagtaatttttgcatggttcagaagtaactctctataaatcttcaatgttaattagaagtaacttttggatcaatgaaaaaaggcatgcattaaagttactttttttttcgttataagttacttctataatatatctaaattacttttaggctttattgaatttacttttatatgtctaagaagtaatttagtgaaatctaaaagtaatttagatatattataaaagtaatttattatttttcatcaaaatataatcatgtgagattctgttataaagatttaatttttacgaacatgatggtgtaatcggatcgtagatcggatgagtagtttaagagaaaattttatttaaagtataggtggatagagtctctcatagatagagtggtagttggtttagacaaaccagctaccattagtagctatatatatatatatatatatatatatatatatatatatatatatatatatatatatatatatatatatatatatatatatatatatatatatagtcacgtcctactataatataatataattaaataaaaacgatcgtaatgggggtcgtgatttctacaactattatttctgaccattagatccgcaacaatcaatggatgagattcatcttgcgatccttccacgcccacgcgcgatccttcccttggcgtagaaaaagaaccgttgccccttttccttggcaagtccgcacatcgtgccgcccctccgccgtcctcgccttccccaccacgccgtcgtcgctcccccgtcatccactcatccactgcgctgccgcaaaaagcgatcctcctgcatgcatgccgcttcccgccggagccgctcgcctcccgccagagccgctctgcctccctgctcgcgccgcgacggagaggaaggatagctggggtctgctcacaccgccaccaacggagaggaagtattttggtgtgtggtttaaggattgttgatataacgatttcattttgcctaatagtgtttgatgaaattttgttcacgttttattaattatttttcactaatgtgtctgcaaatacttgagtcaggataagagggaggatgccatattcagcctgggtgctctctgaagatgcataaccgtgtgatgtctataaatttcttctagtgcctgttgttgcagggtttatttctctatctgtttagttctgcttattcatcaatataatcaaagcttctgcttattactatagttttgtcatgactgaattctttactaatcatgaggcgctacactttatactacctaaattgattggaagaatatgccttcaatggaataagtgggactatacttaatcatccagttgtattactgccaaaaccctattccttaatcatccagttgtacataaatgttagatgcacaggttgcatatataaccctattccataatcacccagttgtacatctatatgttcgtgcttcataccagccttctgccttcaataccattaacaatatgtatacttatgattttttccccgctaaccatggctgctaggagatcttccctgttgtgcttcctaaggccgtgcccaccatgcaaggagcagagcaatgattactgcgttgataagattgactgattgagagggtcatggtgagcctaattgcaacattcattagataaaatggttgtttgattgctttagtactcttgtcgatatgtgacaatgttttgcactactaatattgtaaatctcccgggattgtcctcaatttcttttcactttgtctacccaataggagaaacctatgggatgtgctccgtgacaacatctgctcactggatgctactaaaattatgtcatttaatatccattttttactgtgatttttaattgaagtaagtaaatatatactacagatattttactgcctacctgcaaatatttggtttaatttgtattttctaacacatgcattttgatattcttacattggattatattttcattccattttgagctgaaaaagtggtattcagatattatgtttgacataactatttggacctttttccctaaactatacttatgtgtttcttaaattttaactgaagatggttctcttaggcaaaagttttttcctccttctgttagacaaagaaaagaaaaatgataagcactggataatgcatacatgtgtgcttgattataccgtatactaattgcgcggtgtgatatttgttttcagctgaagtgatagatataactgtgattgcaaggatgctaagagaccatggcaagcccaagggatgtaaggatgccaacgcgaaaccatggcaagcccaagggcacagctatcacggcagaagggggtgggcagtgttgatgttagaatagagcagagctatcagggatgtggagcaggtaatctcagcgtacaatagactaataatttttggggcaagagaaatgcaaatctcagattgattataatggaatgggagcaaaagcaaagatagtaccagatccaactctcctttccaggtttattacactattctcagcattttagttggtttccctgttagttgagtgacttagagattatcagattaggcttaaatagtctctaacaacctaataactcagattggatgaccattactactatattagcaatttcactgcatcaattgagtgttaatttatatctttgaattacgcgccattttcacaaattcaagatatcagaaattacgtggaagtgtaaatgaggtcttcaatgcattgtcttatgttacatctttcctgctcccctgttttcgttggtatatgcctcttacatccagtgttatgatgccataggaaggtcagaaggtgaatgatgaactgatgatgctatctgaaggtgagtgacgatgctgtctgaaggtcagaaggtgagtgattgcaattcttgcaagggaaaatacattgctccatgagtgtgactcctctagaggtatatgatggaatctcatttctacggcaaccttaagtgctatgtgtctgttggaggagagggaatgctgatgaaacctgaagttattaggtagtacaaggttgttagattcttacaagtttttagaagacatgaaagtactattcttaacgacctaattcttttggcacagacgacaggtccatcaaacatatatatcaagcaagacaaatgattcaagtgataattcaagatttatgctggtatcatttttgtggaatttgtattggttgagataggaataattttagctccattggcttttgtgggtcaatatttggattttttttttgcgttggacaatttatttctcactaatacagttgttagtttctacctatgcataatttagataaattttgaaagtgattatatatccctgtgggaggtgtgttgagaaaaacgtgcaatgtaggtgtacgttgaagagctagacaaataggttcgccacttcgctggctggtggatgataacttgaacctcaagatcacatcactaattaattctgataataaattattactttcgaaatgttgtgatttgatcattcatggatgaccacttgttctgcttggacagctgaaacaggaggtagctgcactggtgatgcctacaagagagctcactgcgacaagcttcatcaatccaattctgaaggttgaccagaacaagcacaagattgatgaaaaaaggtatatgccagtataaaggctgtctgtttcagtgggagaaacagagaatggttaggatgtccatcgatgagtgcaatggttatgtttactttttgctaaacatagagatgtgcaacattagcaattcctgggtcatacttttttcccacaatagaccaaattgttaatatagcatgacagattaatttgttttgagttctaatcagtgaagtgtatgcttgaatagtttatatactactaaaaacaaaagtaggggctgaatgataattagttgtgagttctgactataataagaggtgaagtggatagcatcagatttattctggtcctttatacatgctagctctgattgaagattcaaggaatagttacctagaattggaggacaaggaatccaagtatagactgattatatggtggagatcatcttttaagtttttaaggcccatatgctcagtaatacttcatagacttaatattcctcgagttgcaaatgtaggcgatgtgcaaatctgtgttggcccagagagcaccaatcatactagagagcaccttggacataaaaatatccatcttgattatctgaatagttttcctttgaaaaaaaatatagctctaaacatgtcctcacagtcacactagagagcaccaaaaggtgcacagcagctcagacatcacttgattcagctaccattgctacatatgtagtgttactgaaatagattcaaatcttttggtggtgatttataaagttttatctgatcaccagttttactattttgattacaacttgcaaccttttcttttggcacaggagtgcttacattaaaaatagggaacaaagtaactgcatatattttcaaatggctggagttctatatttttaccagtgtcagtgatattcatgataaatattggcttgcaaacatcatcaaccgtgcatatcttttggctatcttttcctccaatttttgtgcagtaatattcttgagcatggaagctgtaagcttccctgaaaaaaacagatataatttactctagattttctcatcatgtgcctatggtcaacagtactgagatttttccttgattttagtatagcatagctctgcactctcccggaatgcttcggggggtgtgtgggaattgaaagctttggggggatgggggggataaggcttattttgttcatgtgaatagcccttcacatacttcagaaaaatggctacgatcttgtgttcaacaacttgactgaaatcttattagtttttttgcaagtttgctgtaatttgccaattttgtgttcatcatttcaacaagagccactgaatgaaattaaaagctgaatttgctgctgctttcagatgcaagagcagcattcgaagcgttccattctaggaacggaagcagcagaggatgactcgttgatgaagtcatacatgctgctgttgtcagcgaacgccgactccggcaacttgacaaggtgagaggaagtgatggcgcagctgcacaagtttagcctgtcgtaacaattgattatgctatgcatatatggccgtctaaggggcatcgatttgcacatatttggttgtctggcaagagtgtacaatgacaagacttctccgaagattatgtttggtcaaaaaatgtgattgcttgtttggttgtatcttaggtgtagatatctatgaatgatttttgtgttttccatacaatctgattattttctaattgtaagatttctataattcgctctccaaaagagcctattattagtctttaatccatgattattttctaattgtaagatttctataattcgctccccaaaaggagcctattattagtctttaatccattgttatggtttgctttgcaattagattgtccaattcatagtgttatagttgattgacatcatttggtgttcatcggagtaactattgttgtattcagagatagattaacagcacaacaatgcacatttttgtaggatcgtaaagggcttttcctaccccaaaacctagccattgaggtgaggggctcccccacttatatcttaggtcatttgcccttccacaaccaatgtgggactattcaacaatctcccccttcacacattggtgtccctccctcaacccttcaccgccccttcaacaatctcccccatcttaggtcatttgcccttccacaaccaatgtgggactattcaacaatctcccccttcacacattggtgtccctccctcaacccttcaccgccccttcaacaatctcccccttcacacattggtgtccctcagcccttcactgccccttcaccgtgtatagaccccacagaacaggcccacggtccatcaggtatacgggccccgaaggcacccacggtccatcaggccttcacatactgtgtctccatcgggctagagatgttaacctagccaggctctgataccaattgtaggatcgtaaagggcctttcccacctcaaaacctagccatttaggtgaggggctcccctacttatatcttaggtcctttgccctttcacaaccaatgtgggactattcaacaattttattgtgttttcttccatgttatattattatgtatttaaaactcgttgcagcgcgcacggtcatccaactagatgatgttgcacgcttcagaaatcagaggcaatacaattcgtcacaaagttatatgctgatcaaagatggatggaaattgcaatcccattttctgatgcttattatagattgcaggctgcaagcatctctcttggaaggactgtcaagttgccagggtaatagatgtgaaagtgcatgaaatttgagatgaataggtgactcgaattacaattactaacttagcctgcctctctaggtaaattaatcacattcctcgttctgtgttttgtgatcttgtctttcagaattggaaaagataggctggaatgcaatgtcaagtaaaaggttcatggagaaattagtgatgggcggacatccgttaggaaaaacacaaaaataaatttcattgttctgtagactgatacttaggctgctttttaatgacttagagtagcttatgactatagatatacatgacaagttcattttcaatgtgcttgttgagttttgaatggctctatttgatgcattgatctgtcagtctgatgtagctgtttttttttaaaaaaaaaattcagcttatgagtgttgaatttctgttggcaatcaattctgtatgctctgtaaatgaggaaatccaatttgttgcaagccaatatgacaatggctctgtaaatgagaaagttacaatagattcagattgtggactgcaatttggaaccattaggttgtaaagaactggataagcctatttatgaaaaaaaaatatatgtcaaaaacccaattctctttgttgtcatgctattttcgaataggcctgtaacagtagccataagcgtaggtctgtaacttgagaattagtagccgctgaaaaatcgaaatgatattcaatatttgctttccaccaaactaattgttataactcgagtacaaagctttgggaggcaactctaaaatttcatatatgtacttttcactactgtcactttgcatatacatatttacatgagctgtgtgagttttaaaatgcatgcactctgtcttgtctcttgtacaatgatgaccgaaggttaactttatgtgttaagtccccacagattctgggtaattaattaactttgcaaaagtttatatccccaactgcaaatgatcaattaatatagtagctcaattagagagcagattttcatggatgccaaattttgtggactcaaagtaaagttgtaatcacctacatctataagcattgctgaagtgtaaacaatagtttcaggactgatcattttaggagcatagtgacaaagtgaacttaatagccaggttagaaacaacttctaaaataagagagaagcatcttcatggcttattgaactctggtgccttgcatgtgaataaatctcaagatacaaaagggtgataattttcttacacctaggaattttaattttaatttacaacatgtatacttatcgctttgaaattgtatgcctgccggagacctgtgcaactaggggcaaattgtcaaattgtagaatttaagtgtttgtcaattgcaaaatttctttaaaaagttatattgttcctgttgcaacgcacaggcacccagctagcatacatatatgtcgagagaacgttttggttctaggatctatatacatattatatattatacatattatacatgggtaacaatctagcatgctactcaaaggacgaagcttttgaacattggggtttccaagctcaaggttcttctgcttgtaaaatcaaatgtgtttttgattattattatgtgatgaacaattggcattggagattattggttttgatatttggaatttatttgcgaagtggttttggagatacttggatttcacatgtgatctacaggatactgttggatttgggtccggtcagaccgggctgtgtatgccggtcagaccggcggtgatcgagcggtcagaccggccagtccacggtctgaccggccgactatgtgtcggtttcggtttcgggttgtttatttggatatccgtgattgtgtcattgttatgacttctagatagatactatgcgtatgtaatactgttgtttgctactaataagttaagttggggatagcttggtctcggaatatggtttctttgtttgttctatgtgtaggtgactcgagatgccggaagagtatttgcggtgatggaccgggagtcggcttggggataagacgacgtccgtggtggtcagagatcatgcgggatactaaggctagagttcaatgcacgtggttgataaagattccatatggcatacgatggaggtattgtgttcgtatgagatacggagtcgaatttggaaggagtccaaatttggtatgattggttatgtatagtttgtttcttgtactagagggtttcctagggtgattaggacttctagtatgagtttggttcgtggctttaggctgcctaccttgggtataaatagagagggagcgtgaggcttctcggtatcgcttttgagaacaattgagttgatagttgagttagggtttcgagtttagtcgaaatttttgtaaggagttctgttggtgcactttgtaaacacagagagaatcaataaagtcgtcatccactttaagagttcttcgatttgtgtttcatcgggtctcggcggtctaaccggctacacaccggtggtcagaccggcgactgctacagggagcggtaggtgatctcggcggttcgaccgatcaatctacatcggtcagaccgatgttcatcaggcggtcggaccggcacaacatcttcggtcagaccacgatccgtcgaatttgacggtaacttttatttccgctaaaagttttggttttttggtataccaaccattcacctccccccctctggttggcttagttgttgtgattcgatcctacactactaatcaatgctttaaactccattgcaaaaagtagcaccactacatatcatgcatattttcttaatttaaaataccccacaaaagttattcgttttttatttttccgtgtgtcatcctagaacatgaacaacaacaagaaaagtttactctcacccgttgtaattacatgcattttgctagttacctattataaaaattaaggatgattatgcaatggacactgctgtctgatgatctgatgcagagaggaggagttggtttggacgttcatccgccatgatagatcatactactacatggttatgctgctcttttctttgcttcattgcatgcatgcttcatccggcatcaggatacacaaaggtgcaccaaagcttacaaaagtcagaatcgacttggcaggattgctatactgtgctagagtatgtagctacagctacagaattacagagtatatgcactgtagagtttacaatgctttcgacattcttaattaattggccaacgatttattaacttgcatgtgttaccattttatatattttaggaattatatggtttttgctctgttatgttttttggcacacatctcggcatctgtatgtctcttgtagtcatagaatcataaagtcacaaaatcgtatggcaatagagatttcgataacctttttattattgcaaacttagtaatctatacaacgtaattttatttcaaatcggtaataatatcttcgatgtaatcatacatgggactggatttaacatctacaattaaaattgccattgtcatttttacccgttgcaatgcatgggtaatatgctagttagaccaaaaagtataatattgctgagccatgatttttgcggaacagggaagacaccctactccatttttttttcatttaggaaatacggaaaataatagtcttacatccaacacataatcatggttcaaattagataagtagcaaactaagcttagcaagtcgataaaactaattgcggaacagagtagcacgagctttaagggtacttaggcaatacaaattaatagcacaaataatcgcgcgataattgagtaacataagcacggggaggaattaggttcttgcttcttatgcagagtcgtagcggccggttgtcgagattactgcaggtaagaaacaatcgccctgtccaaaagttcaatagcacacagatataaaacttgaagacacaggcaaatgcatgcatgcatatgcaagaaaaaaaaactgtaagtcctagaatggcacattaattggtactccatatatggcatcgatcgagcatgcaattggacattcgaaaaggatatatatgtacaagcatcagaacgagttcatcaaaagaacagtacaaacatttctttttcataccatgccaattaatttattgaataatattatctagctaggataatattttattgaatattattgaataatattatctaaaatctagctagtgactaggatatggaattaaaaaaagacgtggatattaggatatggaattattgtcgactaagtacttgttgagattatagacatataatgatttaatctattccataaataaatcatgacattacagatgaaaactagcatgaacgcatcattagatctacacatgtaaactacacagtataacatgaacagattaagtatgcgcaacatattgaacacgtaccgaggtgacggaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcgaaggcagaggttccggagacctgctctcccgattgccggtgcacgccggcgagcgggatggagtagtctacgagcgacggcgcagtacagagtaggaagcaaaccctagttgatttttttttgtatgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggccaggcgaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttccttcaagaatgctctgcaggacaacatctttgctaattaaagccaacagaactcattaaggcatagccaacctgccttgcagctcacaagagtatatgcatcttcacttggatagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagttctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagtcccaattccacagtacctttcagatagcgcattactcgctcaagcgcacgccagtgatcatctcccggattagaagtaaatcggctcaacttgctcacagcaaaggagatatcaggcctagttgcactagccaggtacatcaacgagccatgatttgggagtattccagttgattcctagcaattctcttgttcttgcgaagcaacaagctaggatcataaggtgttggagaaggcttactatcaatgtagccaaagcgattcaagatcttctccacataatgggactgcaagagagtaatcccattctcacctctaattagcttaatgtttaagataacatcagctactcccaaatctttcatatcaaaaatttgagacaagaatgatttaacctcatttatcacgctcaaggtttgtcccaaatatcagtatgtcgtcaacatacaagcacaaaataactccctcacccccaccatggcgatagtacacacatttatctgcctcattgactgcaaagcctgcagatgtcaatgttttgttaaatttctcatgccattgcttaggagcttgtttcagaccatacaaagacttcaacaatttgcacactttgccttcttgaccttcaactacaaacccatcaggttgatccatatagatctcctcatccagctctccattaagaaaagttgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattggaaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttctt

SEQ ID NO: 42433 - DNA, 15390 bp, Oryza sativa
  unsure (1)..(15390): unsure at all n locations
agattgaccagaccagcagagccattgtattgttgtgtgcatgcggccggccggcaagtgcacggcctcataatgctcctcgccgctcccaactctctccagcaagctgcacccaccacatgtgtacatagtagcattcatcaccattcccctgataataacaagtccacgtgtcgcgtttttatggtgattcatccatgctgtgctttgggtacaactttggatataaactctccttattttctcctaggggcggagttgaatgaaatgaaggaggatgtcactggcttactttactttactttggattaagtttagactaatacaaggatctgaatttggactgaagggatgcacatatggtgaaaattgatgaactatatagttaaatagtttttggaccggatttatgaaccccccctccctctatgtagctctgcccttgctccctccggctgggaaagagaaaaacagaactctcttatcttgatctcacgtgaggtaaggagctccgtaaagggtagtgagtgccggttgatggtttctcgggcgttggagcagaaggctggagagtggttgtgtcggcggtgatgacagcctcagtatggtctctgcgcaacaaggctcagcaagcaataatcgattctaacatcaaggtttctaagtagatgaataaagtgacggattattgctgtatatgataaaagcaaggttcggcggcgcttcctctgggctggaacaggggacatcacaggcggcaagtgcaaggtcaattgggcaaagacgtgtatgctgaccatgcagcgagacctaggagtcttgaacttagagaaatttacaagggccctacgcatgcgatggctatggcacaaatagaaagacccgagcaagccttgggtgggcctcgagacgccttgtgacgagattgacaagatcctattcgtggcggctacaaatttatcgatcggcgatagaaacatagcacacttttgggactcgccgtgggctgatgggcgcaggccgaaggacgctatgccacttgtctacgcaatctccaaaaggaaaggaaagtccttgcgtcaaggaaaggagaacaatgcatgggttggagacctagatttggaagcgaacccgctggtctcgctcgagctaatcgactagcttgtggccttatggacagcagtccgcaatgttcacctgaacgatgagcagcccaaccagatcgactggaagttcactagtcatgggcaatactctgcatcctcagcttatcaagctcaatgtattggagcccccagcacaaccttcgactcgctgatttggaaggtctgggcgccgaggaagtgcaagctccatgcctggcttattatccaaaacagagtgtggacctctgatagattgcgactaggggctagcagaacaatagatgatgtcctctttgcgaagaactgttgaaacagccatacatctcgttttcgaatgtcgcttctcaaaaaggatatggacctctgtggccagatgggtgggtaatcatcttcttgaaccagggcactgggagcctacgcagtcggtccaggaatggtgggagaaactggccaatacggtaggagttcccaaaaaaggatggcacactctcatcctccttgttgtgtgtgagatctggaaagagaggaatcaacggattttcgagaataaggagtccacaacgacgtatctgcttgctaaaatcaaagaggaggctaagctctggatgctagccggcgtctgaaggttgcgtgagcttctgccacaccttgtatagtgtacaactagccccttgagttttttcccttttcatctctaggggttgtattttttttccttgctatgcgcagtctgtgcctttttcccttaaaaaaatagtttttcccttaaaaaataataaaaacaaggttgaagtaaggaatcgctacattaccagtttaccacatactagctgctactggtacttattcacacggtcacacacatgcatgtgctctcctatacttttagttaaccaccaactttcttaactaatcacgcgcatcaattgtttaacttgtcctctgcaggtgatatacgactttgttgtgtattttgtcttgtctaggtataataattaatgtaacatgtatataatatatccatgcttcggttagactaatccacctttaattagtgttttctttcattgtggcaattaattgctttatatgatatatgcatgcttgctgcaatgcagtttaatgcaagctctatgatcagcttaagtgaaatcaatgtatcgggggattgattttagggttttagaattgagacttcacacgtccctgtctctcctcatctttcctttatagagatgtcggtgggactcgaggattaatctcctactagaatatgaactcgtttgtaccgatctcacaaaaacaaaatttatctctaagtttctttcttgatttggaagtaaaccggtgattttatctcctcctaattcttatcggcagttaaccaataatatcaaccaacaatgctatcgctatgttgccgtttgagtggatttgatattttaaaatagtcaaattatcagcaaggcgattttaatttgaaggccgagaattggattcagaataattcaaaatacaagtgaacggcaattcattgcaaatgaaagtcctgtttgcaatacggattataggatttgaattattatccaatgaaattcctattccaaaatggccaacatttttcaaattactgtaaaatttgcacacttcatttaggctgagttcgacatcatgggttgggaattctccctacatggcacgcaaaacgaagcagcagattatcatacaattaaataattattagctaaaatacctgaaaaacgagatttctatagttataattattagctaaaatacctgaaaaacgagatttctatagttttgaagcagcagattaacatgattttttaaacaacttttctatagttttttttttgcataaaaatacatcgtttaacatttagggaagcacacgtacgaaaaaatgagagtagaagttaggaagagggagtatagaacacagatttagactgagttactaaaacacttcaattaagcctatttgaacaaaattcacttgaatcggccaaaatgaaaagagtaattagacagattacaaccagtttaacatcaatctaggcctagggtgcggtgagattgagaccacacagtagacagtacatcagagaattaccccatctctgcaaatgccatacatactacaggactaaattcctcaggggacagatcatcacatttcaccagcaaagagcccagcataagaaaccaaaacaagcaatagaaaacaaagccatatgagtgagttcctttgaccagatcaggatatgtgttgttattgcctgtgttgcagctgctactgtgtgttgtgtgatgcatgggaagatatctttgtgttggcttctttgtctttgtgcaggtttgtagtctttagaccacacatccactccaaatacatggtctgcttctgcagtagagagagtgcaatgcttgtgatgctagcttgtagctagatagggccacacctgtgcctgcctgcctgccattgatgcaagcagaccatctttgtttcaggctttcagttgaggactcacagctgtacacattccaactgccattccctcatccttctccttacactttgcaaagacttcctcttttttttttgcatgtaacattgatcagtgattttcgtactagtagcacataaacacattttgtcagatgttaaaaagaaaatgcaagaaatcttagggctctctaccctttgtgtaagctttcctttttcattttttacatgtagcattcagtgatttccatactactagtacatatgcacattgtgaaaaatggtaacaaaaatgcaagaaatattatggctctgttggaatataggaagcatttcgctgacgataagtcgctgttttcgtttgtataaaattactgaaatatggagtttttattgttattataattcttgctcttaaaaaaattgtttgtgctttgatagggccaggcagccggccaagccagtgaggtgcccactcacttctaggtggtactcctttgaaccaacaaaattttaaccaagctttgtctccaagcctgtttttgactgcattggtgactgagaagctatgcagggtttttttaacctttctggattctgatttctattcacccaacagcaaccatatgatctctatctctattcatgaacaatctagattcagaaggagagaggataatagtatattatcatgtaacactttagatacaagctatcagatgcatcgattggttgaaccatgtattatagtttatcttttgtttggtcatcttaacattgtacagttgattagttcgagaaaatcttctaaacatgttgatttgatctacttcagttggacttgcaaatatattttttttctccggtcttcttgaccagctcgatctgaggtttcataagatggatgtagattggagcaggggcgaagctacatacaactatgggggttcctaggcatccggctaagagaaaagttttagctatggttaccccatctccaccatatatgcaccctctcatcccaacaatgtgtaccctcaagcagaccatcaggccgagcaaaggtaacaaggccaacagagaagtgcacagccatgaggattttcttgtggtgcagcatgttttgttgacaaatttgccctgcataacagcgttgttaactacttcacggtgaaacagaatgcactcggtggccagccgcagcctatggtcttatcacctattaatcgtagcaggcaaggggtgacgtcaaaagaaagttttgcaatttgctttcatagtttcattccattttttcgataatttcaaacgaaaaattaagctgttttgtcttttttttcttgagatgctgatgttggacgagtagttctccagttttggcaacctattggttgtgattttaatcttaacttcttcagtacactgcgctgataactatcgtcattgggaattcctattttggcaagtagttttataatttaccgctaagttttcgttcttatatcactcgttcatgttaatgtagatactgaaatcaatggttttagtattgtttaccataatgttctttgataaaacatggtaggtcgtacgtatatcattttcgaacatggtagtatatcgctactatagtggtgcaccaccctctattttgctctagcttcgccactggattggagaggatgaaaaccaatgcatttttctctctcttttggtatcaaggaatcaggtcttgatatgtgtgcaaaactttagtaatagcctaactactgtcacatatgaaggttctcatggctgtgatcttaggttttaatgacactctggatcagcatttgtatctatctagccacaaaacttgattttgagcataataagcaccacatagtcaaatttgtttcaaattatgtgcttatggaaaatactaattgaaatatcttcttatttaattaaatattgggtgactaggaaatgacaagagctaattaattttgatctttttgagatggcaccaaattaaattcttttgtcaatcgatgcctcgatttcaagtttgaccagacctgacccaagatgttctaaaagtctagacccaattcctctcgatcttgggaccctcatggcacaaacatgacacattgattaaacatatccaatttgaaccagccagacatgcctaaaacctctcaatttttgtactaattttgagttcagctttccatgcacctgccagcacaaaaactactcaacacacaaaaagaacagtgcttgagagcagcatcagcattagtgaccatgcttcaatgcaactaagcaaggaatccttttttttttcattttatcagctaagcaacatctgtccatcgaagcaagaaaactaagccatgaggccacatgaatgagagagaaagatgaggagctgcaatgcaagctagcatagagcaagcatgcattgatcaggttcagagattcagaagatggtggtggtgtggcttcagaaagtcactccattgcattgcccatgggggcattttcattgcctgagtgcatgcagctgcagtttgcagggcaggcaggagaaagagaaaagctctttttaccagctgtaaggcagtgtgcagcaatgtaagacctgcattagttagtggatgaacccagaagacccaactttagagggttagggcttaagggcacctctctgtgcatgtaaaggataatcattattattgtatccaagaaagtaataatatttcagcatgtgtgttgcttcatcttttctgctagggcatgtggcacatttcaagcctcctgttccttggtttgcattgtcatcaactgagagtgtagttttagtgttaaaaaaaacctccgaaaaggaggagggagttcctggttttttattatagaagaaaagaattgacccggtttattaagggaaaccagccctaaaaccttaccgctgcacggttaattaaaagaaaactgacgaaaaacctctacgaagagattagttttaatatagttagagttatcttaattgaagaacaggtgggctatcttattgtgttaaccatctcatcccagaaactgaagtctttcaatggaaagtactatactatatacatctaagtactcttattttagttagatgttgcagtgacattagcttggtttctaattaacacttgcctcgtgttgtctcttcatttgaactctcctttgtcctgtgcttcaactagtaagtgccagaaatatcaagctcaagtagttccccagactaaacacagtggttaggagttacatcacccaaatgctaatcttcatgcaattattgttgtaaagtaatctcatgtatcttgtactctaataccctcataagcaacatttgtcaccccttccaacaacagcaaacacagctgatacacaattattaccagaaggagacagtgtacttatcaatcatgtttgacaaaagagctttcttttctttacagatcatctcttcatttaaattactgtgaaaaaatttttttgcaatgaaaactatgccatgttcttgtttggacatttataatggaagtactgtaacagtggggattacccatgcctttgtggaatcaagcaagtgcaagctggttgtgcaatgtaacagggaaaagtttgcattggattctcacttctgacagggagaggaagaggagaaaaacagtggaccagaaactgaatgaatgaatgaatggcactggaaattttcagctgcagctgcagaacagaacagaactgatcaagaaacccacagggagctaggtcacagacatgcatgcatatacaccaaatgaaatcagatttcatttctcaagaacagggagagggttactggttacagaagcttacagtgacaaccaatccaatatggcatagcttgtaacaaaaaccaatgtggtatagtaaccccatgcaagtgcagtgcagctgagtgaaaccccacactctctcacacatcatccacttgcaagaagagagggaaaaaaataacagagaggctgtataaacaatggccaacctttttctgaacactgctgctggttttgcaacttctgcatgcaacagcatcttcaccatatgcagacatgcagtgcaatgaaacatggcatccacaatggcatttcaaattgtgcagctttggactaaagttttcagaggaaatgtgctccatttgggcactggaatttggggcttcaagtaactcaagctctcctctccttaggagagctcactcagccccttttttcctttgttcattatctcttctccttctcacaaaccaaaccaatccaatccaacaacatttgccaaatgccaaccaatggcaatggctcaaagaacctaataaatattttggaaacttatgtcaaaaaaagggagaaaaaaagaaggggaaaaggagaagatccaaaccaagcgccccctagacatctgactaaaaattgtgtgtccctggtggtgctagcttcctcaacggattcgcggcggctctggcctgagccgcttattcatcgccgtcgcagcgaaggcggcggtgtcggtaacatcatcaacaagaacagaatcatatgtactggtggtggtaatctcattggagtctgaacattgcaatggtcgcttgctgctcctcctgttgttgttcatgtccccaaccatcatactgtagcaggcatgtacattctcctgatcaaagaaacataaatcacaccacataccaaagtcaattacatatctaatttataacgacattttcataatcaaatgttgctcaactactactttgaattagtttttttctgttctatctgaaattattcaagtgactgtctgactgacattctcaatgttgagaaacacatcaaagttaattacatctaattttcatcatcaaatgatgctcaaatcctactgatgtatgttgggaattattattagtttgcttctaaaatgtattgaagtgagtgagtgaatgagtgactgaccttgtcaataagacaagatggagaaaggttgctcatcttggactccaatgcttcttttgtcagtggagctccataggatgcagccaagattgcagctgcagcaacagttgatggcctgtaatctagcacacttccagctgcatcaaacacaaatcaaaatcaaaatcaaatcaaatcaaatcagaacaatgcaacaaacaaagaacacaaatcaatcagatgccagatattttttagagagagagagagagagagagaatattctgatttttgtgtgtaccttcagctgtggcaaagatgaagccgacggcgttgagggcaacgcgggcggcggcggcggcgccatggccggcggcgccggcgccgccgtggtggtggcggtggaggcgggaggagaagcaggggaggaagtcgaatggcgtgacggcgcccatgcgccaccccagcgtggacagcacgagcagctccatccggcggatggagtccgagcagaacacgcggccgccgccggcgtcgaactccgacagcgccggcgactggtactcctccatcttcgccgccacggacacgcacgcgatagacagcagccgcgccgcccacggcatcgcctccctctgaacacacacagataccacgtcaccggcgagctcccaagaaacaaaaatggcggcggcggcggcgccgccgcggcgggaagggatggatggattagctagattacatcgacgcgtcgccggaggcagaagcggtcgaagtaggcgatggcgaggtacgccgtccggtggccgaacccgaagtaccccctcgtctgcaacgcaaaccaaaccatggcgtgtcaggtgttcgaccctgttctcgcatcaacaagagctaatcgagcttagctaagctagtggtatcgagctcacttcgaggatccacttgacagcggcgaggcgggcttgccggaaccagtccccgtcgccgtcgccgtcgccgtagccgtcgccggcggcggcgtcgaagagggaggaagaagaggagcagcagaagctagcctccttggagaccatctgctccacgtactcctcctcctcctcctcgtcgtccgccgccgcaacggcattgtagaacaagaatacgtcgccgtcgtcgtcgtcgtcgaccacgccgtcgccgaggtcggcgccgtcttcttggcacgtcagcgagaagccgcacgccgccgagcactcctccgcctcctccatcgacatcacccctactgtttattcaggtcagtcaagcaagaaccatgctacggccggcggcgatggcggcggcggccggagaaggaggagagtgggcagcgagagtgagaacctctcctcctcaatttaagtgggctcacgtttcattaactttttttttactgccgtgttttttttttaccatttgtgttgttgttgaccattgacagttctggtaaattcaggtttgtactaacagtacgtctctggggtatgaaagcgcagtccgtgaaaaacgtaatcatcatggatctggtttaagatccaaagaatttaatgtgccatttactctgcaaatgataagagtttatgcttacgcttattagccaaaatttgaatttttaactttaaatatggagatgattttgggttttttttttcatcgaatcttatttttcagtctttacttttagatcgttaagaacatgtatataaaagttttattcacaaattacttttcgtttgcaaatatgttgtttggcttatttcacgaataagcgaaacgatgaggcctttaatcacattgacatctatctcctcaagaactgtattttggatggatgcaaaactttgagcagaagcatggaatgtagctgcaatgtgattaagatcttccgtgtaaaatgacacctgatagtatggtgaagaaatctcaaattatattggtaaaatgatatacaaaagtgaaaatgttttaaagtaaccacatattggttggcttcagctcataaaccctaaaaaataaagagggccgggtagtaacgcatccccgtcccccctccctccccgcgtcgctctagcgcaggtggctcgggggttgtgcggcaggcggcgcgatgacggtggcctaggggccctcagctgcgactcaagaggtggcgttgccggtggtggcgcggcttggctgcgcggcggcagggtggcaactcgccactacgtcgctggaatggtgtggtgcagctagggcggctgggtgcggcggtagtagagcggcctgcacggaggcacgaccaagcagaggggcagctaggtgcggtgatggtggtgccagtgttggcgcggcagccggtcggctcaaaaggtggcgcaagcgtcggtgcagtgatcgagaggccgggaacggcagtggtgatgccagcgcagacttggctggagcaggcagcgatggcagtgccccttcttggagctcctcctcttctccttggggagtttctaggttggattaaggcggtagctggttaacgggggaagctctgaccgccgacacgacgccatccaggccgggttctcctttggccaaatatggcgaggaggccagcgagtggcgggacggaggaagcctgggccagcttccaagggtggcggcagggaacaacaacaagtgtgaaagtaggccggtggtggggtggaggcctcatgctgccactgtctgtgcggtggtttctgagctgatgggcaatgaatttcaagcaaggttgcagagttctaggcgaaaaccacgcctctctctcccttggcgagtttctctaggtgaaaaccacatctcccatagatggacgatggcggcgtccttgatgtcgtgacctccgtgggggcatcgttttcagagtctcgtcttctggtgttgtcgtaggctcagcggcaatcagccacgcatagctaagatcattttggttggttcctctctcagtgggttgtgcttatgtggttggcatgtggttcttggtcgtgcactttggtgcacttccgacctcaatagttttctatcgctttttcttaatatattcggatggcctcctttggccttctccgcgaaaaagaaaaataaacgagccagagaaacataatttagggcaggacatttatatttctactcataacggtttaaaaaccatgtctggaaataagaaaacaattaaaaaggcctagaataatgtaaaattaagtttgaaaatttaaattttggccgtgtcttataagccacaaaacaaacattgacggtaatagcatgcattatgcatccagcatccatatttgagatactactctaaactgacaaggcatgctagaatggtcctaacattttcacacaaaaagtggtattttagtctgtgggcaaaccctagaatctaggaaaaattggctaatgatctgaaaaaaagtaggttgaagcctctgcaggctacatataaaataaggattttgttgagagtgtaatctcaactaccacctagcatcatcttctccccaaaattctaaatgcagccaagaaaatgccacatttcctcttcagaatgtactcagggttgagacaaaaacactcggtttaatttggctactaatgaatcaatgtgggccccacccccatcagggaaaaacaagcaaattctgtgggtgatcagagacataatacagccacaaccatggtatctaatcaataataatgcagctactctatagcatctcacaacctaatcctccctagctactgacaaaatttgacagatttttaaccttgacaatttttttcagagttactgtatgatttctttttcccctacccatgtccatggaattttagccttcctcgtgaactaggacaagctgtctgcaatgtcccaatcttgctactacatccagatgctaattaatagtggggacatggcaaatttatatacacatatatatttacacgaaatttatttacacacttgaatatttggggtcacatgacatgagatggtgctgaaaatgttgggagagtgaacaaaaacccaggattcaagggccaatgttttggagtaccaaaacagtgccaattcaacacgcatcgtcccatgccaagatgcaaatttcagtagtacccccaggtcccccaattgcttgctgcccatttgaaaacaagggaagatgccaagatttggcctgaactcacactaagatcaaggagagcaatatggaccacttcttatccttgctgctcctgcatttggtgattcagacaacatgacgagcaaacggtccgcatctgaaatcaaaggatgaaatataatggagtgcagaagttaatataatcaggcatgtcaaatttacatatttgtttttagataatgtcaaactttcagatggagtgaaaacaaatggcaatctgaaagtttttatatatatatatggagcctgagtttgttgacagttcttgtgatggactgagacataaagaaatcttcgaatacaagcaaataacagattatggagtttgtaatttgcagaatttgtacaatcgaatatcataaagaaatctcaaattcagaattgtactttgcagagagagcttcagtacctcttatggagttttgctgatacagtgctcttcaaacaaacatcagcatgaacacgcaatgatgatagcatctagtaacactgatcatcaggtttcaactttcacctgtaagaacaaaacaagaaccatgaacaataacttctcaaggaaattattaaaacgattcacagttggtcatgttgaaatgtactgtgaccgacggtcctggatgtggatggagccggtatactgcatttaaggttgtgcaagccattctgtccaacatttcctgcaatggacaatcgtacacagtaaaaaaacctgtcctcctacctgaattataggtttcttcgacattcatttatggattgcaagcaagcagatgtgtgacacagatcaaacaacctcaggacacatcatatcatcaagtttgctacaggaccctgcataaaccagccttgaattcaggttcctcagtcccacatgagaaaaaaaaaaggaaaataaaacaaagtgaagaaagaggaggacataatatgtatcctagccaacattgaagttgcagcattcaaggatcaagccacaagtattgacttaacactcatcagcatttcagactagtaggcaaacctaatgcacacaaggtgatcagaaatatattcagaaaagcaactagcaagtaaacaatagtaatcagcatttgagagaagactatatattaagaggtagagtgttcttccaagctgcccccactttggtgaagcaaggggttcagagactatagtgatgctatctactctgccacttaagaccactcagtgatgtcttctttgaccaatgcttctacaccttcacagaagcaagatgataaataaatgaagcctaagtttggtcatgtcaatgtctcaatgcaaggggcccttcaccatctctccctatttcaatgaaagcagtgaactgtgccaatcactaggggacacaatgggcctttgcttgtgagatgaagcaaagcattaggaggagatcttgtccactaatccactaaagccacacagtggctaaactctactagtgccaaacttgggcatgctagttctagcactaacttagcttacccttttttgaatcaccaaaacaccaatgatattatatatagagtatgaaatgaactagattatggagctaagtacaaaagggggcacaaaatcttgtagacctatttgtttaccttttgttttccaggcctatttgggggtcaagtctttctgtccaaagaataagcaatttcttctgaatcaaccaaggaaccaactctactgcttctagcagtagacatagtaccattgcagtgtaatggacaacaatacctcaaggacaggttgattggatagctcaggacagatattgtgccactatgttacaaacattttgaacaagaccttcaacaggaatttgagtgcaattgaaactattttgtaactactaactgcatgtgatttaattccctcataattaaaaatgtacttccatgtttcatttactcgaacccaaacctaacagcgatttatagttgatcacgaataattttccttgattattaattgatattcccgcaatttatccgtataactttaacaaagaaaattgtctgaaatttgatgattttgccaagtttctgtcaaaatccatccacatcagctgcttgacacttcgacagtacagtatggtatttatataaaataaacaaaaccttgctccaaccatctaaaatgaaagctgtgtaggcccttgggaggctttaagtcatgcacttatgttgccatcattgatgaaaagctggataagtccctgcacgtcggctaagattatcagccaggctttatgccaacccaatcagattaaagtggctaatcaaaaagtctaaccttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42434 - DNA, 792 bp, Oryza sativa
atgattaaagcaggatcaatgagagccaaagcacggggatcatcaaactccatttatacaatcgatggtataaggctggttcggtcctcattggtgatcggattatctgaacactatttgatatattttctatgctcaaaattagatgtccggccctcattggagattggatcatctatttgttactatgataccgataacaacagctttagatatttccaactttcattggtgattggataatctaaccgatgttttacaaaatatattttgataccatgcacacacatgggagctattcgtgatctttggaagttaaaaattatggccgagtatttacgaggccggtgtcacgatattattaacatgtccaaacatataggaacggatacatgttactaggttccgacgaggcaaaagtaacgatatatccacatctaataaaggctggcatatatgactgggcaccgacgaggcaaaagtcatcccctttgttatgatacctgactcatgtatggacatggtgataatatattgtgaccaggtttcggcaaaacaaagccacctatatcacagttatcattaaatctctgcaccaacttcaaccttcggcgagcaatcaattttgaagacgacgatcacaagcgcagcttaaaataaaacaaaagaaataagcaagtgctatcgttaccacgggagcatgcatggtcctcggcgtcccccgctctagatgggttctgcttcttatataggcagcggcgacggaagcggcctccgaattatcagcgccct

SEQ ID NO: 42435 - DNA, 14860 bp, Oryza sativa
  unsure (1)..(14860): unsure at all n locations
cgccacagccaatgaccatgcatgctcacgtagtaacgatagcacttgcttatttcttttgttttaatagttacaatcttttgaatcgtatatcggatttaaaatccatttgaaccatcactttctattcaaattatacaacaaaacgagtccaatatcgaatatattcggacaccgtgatatttaaaatttctggacccacatgtcatatagacacgtctcgtatatattcagtaaaattgtgctacaaataatattctcatataaaattaaatatccaataatttattatttcttctatgaagttttagcacaaaaattcatcaaacaccagatgaaaagaaccaaatgctgataacttgttcaattgtgcttacctggaatctcttgcattacattcacttgtttcttttgcattacgctctcttgctttgccttctgcatcatttgactccgtagccgactacaccaaaataaatggtaaagcagcaaaaacacaagatgattaatgcaactagctccagattgtgataaaagaagcatatgtacataagacacactagtcaaataaagtgtgaacttgttcagttggctgtcttaatgcccagtattaaattttgcttttcagcagagcaaacggtcatcagactgagctgtagtttttgacactgcaatcatcattttcttttatatcaagctgtgatgtttataattggtaattcgtaccaagactaacttaggaccaaatttattaaggtcatgtgctggcaaatcagtacaacgttcacgaaatgacaagctctactagttgaactgcacagaaaatagagaatgtaatgcaatttactgaagaggcaatgacaacgtattatagaagagtacaaaaggataacaccaagttagttactgcttgaatcatcgttaacaggaaaatagcatggcgttcagacaaatatgttcatgtctcgacacagcaaagcaatcgccgaagtactattagttagtcatttagctcataaagacatgctatgtttcaatacagccaatttgctagccatttaaccaacgtgttccctttatgttggaaaacaaacacaaagtagccagtgctaacctaaagaatataaccaaacagaagggacacatatcgaacctttggatgggattctttctcagatacgaggtgaagtggctggggaagaagtattcgccgtgaaagactctcttataggccttgcaacgggagggtccttgtacctcttgcactttctttatttcatcatcatcttcttcttcttcttccacctggatgtagagggtgggcagtgaccgcagcaccttatttgtcatgtccaactcaacgatccaaaacaggaactcatcatcgatcttttccatgagcaggaaggaaacgacacctggatcaaccaagctcaggtgagaaaaagtcggcacagcacgcggaagagcacaggtgtgacctacggaattagcacaaagatcccagaactcggcggcttccattgtaaaatccagttcccaggtcttttggtcgatgctgaccagagtccatgccgtgatggtgaaagcaggagggtatacatccttgtctgcggtggcggcaatggtgacgcagaccagcttgatgaagaagccactgtcactactacctctaacacaaacacagcgaactgggtcggcgcagtaggactggctgaacaagcgggtgctgccatctctcaccggtttggggagcgggatgaagctgaattgatgtggctcgtccccagggttgaggacgtcgatgagcaggatgccctggtagtagtcgacccagcacaggaagcggtcgtggagggggagcacggcgtcggtcctccactcgccgaggttgaggccgagcatgctcatggcgcgacggacacgcaggggagtgatgctccactcctccgcttcccctgattgcacaacacagagctccacctccttgctcccactggatgtgaggtgcgccacagtgaagagcgaccggccgtcctcgccgtcgccgtcgccgtcgcggcacaggaggccgacgtctcggctgcacatgtagcgctgccgctgctggtggtacggctggtacaactcgtcctcctcctggtcggtgaagccgccgacgaagcaaggcggcagccgcgtgagcaacggctgcgaggagggggaggcggagtagatgaagtagtcgagggggtagtgcccatcgacgttgaacccgggttcctcgaaggggacggcggcgacgaagaggatgcagccgcggtgggcggcgatgacgtcggggtagcggacctcggggaggtcggccggccactggggagggcagtggaggtagaggcgggagacggcgggcgggtcggcgacgcggagggaggcgcggacggggaagccggtgcaggtccggccgaccttggacgccgtgatgtcctcctcctcgtacttgtgcctcctccgccagctgcagcggacgtacgggtcgaggacaatccagtccgccgcccccgccggctccggcgatccccggccttcttccatgtcgccgcgccgcagttcggtgttcggttcggatcggatctagctagggttttacctcccactcccagatgtctcgccgccggctggagtgggattggaacaagggaaaggggaactgaatggggatatttcctcgggaacgggaaggaacgaaacggatcccctcctgttgaattttttttatttatacatttttttattaaaatatttacaaaaataattttttgtttcgaaaatttacaaatctaattgcctgccgcctttaaaaatcaccctctcaaagggcggcaagggacctaaatacaaaatttttatttgtgttcaaacccttcccaccggttttaattgcttaaaaactaataatgcttattcgatactccaaatgattttaaatggaaaagtgataaactacaaagttagatctcatcaagatctacaactttatataaagtttatctccatccaatgtcgtttgaaatgtagatctgagattttttaaaatgtgttttatattttgtaacgaatatttggatatctaaaacatcttaaatgaaaaagttattaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgccctcccaaagggcggcaggcgattagatttgtaaattttcgaaacaacaaattattttttaaatattttaataaaaaaaagtataaataaaaaaaattcctcctgactttggggggtggaaagttacggtgtcgctgcacttggtttcatccctgccgaccagttcatccaacggcacacatccatcttccctcctgcataccctattcatattgggctacccagttcggcctgcaactgtggccatcggcttgcccatcaggccacattgactttgttgcctgctaccacatgcgcgaatgcagattttctttatttttaattttatatttattaaaatattttgaaaaataattttctattcgaaaaatttatacagaactagtagcccatcgccccgacgattttatcgacgtggcagacgaccattagccctcgcctaacgaccggccaccgagagcaccgaaaatttacaggcggtcccattgccaccctcccagagggtggtttttggctctaggtgcccgcctataaaagggctaggagggcggcttggagtcagcaaaccggcatggcttcgccgcttcccttttgctctctctctctcgcccttccctccttttggattttgagtgaatataatgtaaaatcggagaggtacaaggggttttataccccgagggcataaaatcaccctcccagagagtggcaagggggccacctacaagtgccatgccatcctcgccacccttttgcaggcgacctcccgcacataaaaaaaaaccctctggaacgggacaaggggtccacctacaaaaatgctgggccgagcacctgcacattaaaaaatcgtataatcgaccgcgttgaataattcaaaataagacaagtttcaagtaacatcattcatgcactgtaaatcgacaactaagttttggacaacactataaggcaaatggctattgtgactaaaacaagaataattaactatttaccacgtttacaagtggtgataaagaatttgtcactggacccatatatcatagacacatgaggacccacatgttatagacagtgtcagattatgaataccgcgtacctaatagtagttgactaaatctcggcatgagccaccacataccatgtcctatatggaaacaacctgcggatataggaggagttccgggtaaggaaagacaaccagagttctacatggaaacaacaaggactactcggattgtatccatattggtttcccctagttctacttgaacaagagaacacctataggtataaatacaaggccccctatgaggagaggggatacgaccacctcaatcaacacccaccatagaagacaagaacaatagatcaagacacaagatcaacatataagccaacatacgccaagacaagacgtcggatatcgacttcaaggataagcacggctagtcccctacctggcacgccactgttgacgtttgatgtcgcgattctctcgaactagtacgtagcaatctcccgcaccgtaacctccattggtattcgagagatgattctactcgctcgctagttctcgaaccagtacatagcaatctcccgcaccgcaacctccattgatgttcgagagatgattctactcgctcgctggttctcgaaccagtacgtagcaatctcccgcaccgcaagcttccattggtgttcgagagatgattctactcgctcgctggttctcgaaccagtacgtagcaatctcccgcaccgcaagctccctggttctcgaaccagtgcgtagcaatctcccgcaccgcaagattccattggtgttcgagagatgattctactcgctcgctgggtctcgaacaagtgcgtagcaatctcccgcaccgcaagtttccattggtgttcgagagatgattctactcgctcgctggttctcgaaccagtgcgtagcaatctcccgcaccgcaactttcattggtgttcgagagatgattctacttgctcgctgggtctcgaacaagtgcgtagcaatctcccgtaccgcaagccttcattggtgttcgagagatgattctactcactcgctggttcgcgaaccagtgcgtagcaatctcccgcaccgcaacttccattggtgttcaagagatcattctactcgctcgctggttctcaaaccagtacgtagcaatctctcgcaccgcaacttccattggtgttttgttttataagagaggagaggtggctacatggccctatatgttttgttttattttttttcctgatgaggataccacgttagcgaaaccaaccatcgatccatactaccataagacttagtttaacccaattttataagttgtagggtcatactttctccatcccaaattataggatgcctcttcttaaaaagttaaactcgataattttaactaataatcatactaaccctatcttccaatcactaaccatatcttgcagtaaatgttgaataggggatgcatcggttcgtgctcctccatgtatagccgcttcccaagttcccaacctcctcctcagtcctcacgttcacatctcccaagaacgatacgcgtgggacccaccatccccacgccccaattcaccacccaagccgactgacagcgaggccccacacctccaaccccaccatccgaccccacacgtcagccacataacccaaaccacccctcgtacgcaaagaaaataatctccgccgcggcagcgcgctgtcccctctgcctctgacacgcgcagcgccaataacgagacaaacccgaggaggaggaaaaggatcgctggccccacctggcaggtgacacagccgaggaggggggaggaaggttggcccccacctggcagtgattcatcaggggccacgtggcgtgagggatttcaaacctggtggtggtttttgtccatggggtcagccatgatcgctgcggcctgagctagcccgaaacggcaaaagaccaaagctgcaaaactttttccctctcgctcggtctctcctctctcgaggagagtgcagcggcaggagtgggggtagtcgcagcagcggatcagacacacgaacagagagagagagagagagcagacaacgagtacttcgctttggtttgatttgtctccttcccgtggtgtgttggtggaggaggagaggaggagcatttgagattggagagggggagggggaggaggaggaggttggtgcagtactgctgggtgcggttcgggggagaagcgcggatgtgagaggtgaggcgcgcagcgtccagcgatcgaggagatcgttttgatgttgattcggtttggggggttttggttgccttgtttctcagattcgtgtgttttagttgggtttctcgtttttttcgaggattttcgccgggatccgtgtggttttggcccccctctttttgcgcgtttcgtttcctcgaagctctcgtcgcgagcatggcgtacgtcgcctctgttgctcgccgaagcgacgagagggggaggaaatggtgctctgtttccggtggtttcgtcgtgagatgttggggtttgacaagcgccgggttctcgctggcttccatttgcctggagttctcgtggattaaatatgccgttatgtatattgcgatgatgcggttttttttcgcttgtgctttttgcgttttgtgtgggtttgggaaaatttttaactaccttgcggtgctttcatttgatttctggattttggattgatttgcctcatttgacaaggatttttgaggattttaatcattccccgtgcaaagtaggggaatgcttgattattctcttttcctttttcagaatctccgttcggatttgtccgatgcacaagtcatccatgcgtactgctaatatgcgtcgtctagtgtctcggcgcttctggattgaccagtgctagggttttaggtgctgttcgttgatggcttcatgccttgttttcctttttttttttttggagatttgggcttttcgatgatttacgttcgtgtgtattccacctatttgtggtgccacgattcgaccaatttcagccgccgtgcgaaattttccttgtcgtgcctgcttaaaagcagaggcgactgatggattcgtggaattccatttttgtgaatctgtctgcagtttcagtcccatctcctggttcttccgcttgctgcttttgtttgaaaatgtttagcgtacagtgcggcgatggctcgagtttcgtgggtttctttctgtacagagatgatattttgtttcttgatttcgtttatgtgaggctatgggttttcggttgatgtaaacttgagcgaaatttatttatgtgttcgttgtgttcatctgtgtttcaagtgtttgaagagttcgttttgtggtttgattttggcaggacgcgagtgaagagacgaccgggagcatggatcgcgccaaggcagcagcgcgcaaggacaaggcggcggcggcggggaaggagaccgccgtgtcccgcgccgtcgcgttggacgacaccgcgctgctgctcgcggcggtgggaagcttcaggaaggagggctccgacgcgtcgcggatgctggaccaggagatgtccacgaggctgctccacctcgcctgcaagcacgacgccgtgcagtgcgccaggctcctcctcgagggcggtcacggtatcaccgcgtcacccgtggatgccagggaccagctcacgcggacgccgctccaggtggccgccgaggcgcactcggccaggtgcatcgagctgctgctctccaagaacgcgcgcaccgacctcaagctggtcgatggccggcctcttctcgcgctcgagatcgctctcttgagcagaaggtatgcacgctagctagtgtcgtccattgcttgtgatggtgatcactgagctcacttctcaaattctctccctgcaatggctgtttccctgtactgactgatgttcttatccagagctcaagttaaatggtcactggacaactccattgaggatcttctgtcttctctgcaggaaaaggtctgtatggttactaccaatgttcattcgctgtctcatcatagctggtccatacatcttctcacacagaaatgccaccttgttccatgtgtaggatctgaatgtagtgaggctctggcagagaaaaccagagaggttggggaggtggcctacagatatgccatggagggtcgtgttactgtgttggcaatgctgcttctggtggctgaagagaagatatcggcaccagtcagtgtagtaatagagggcgtcaggacaaagaaatcaatctactactctattgtggatgaggctctgtccattggggatgctccagcccgggacagcaatgagaggagaaaggccctgctcagtgagattcagctacttaaccaatttggggcagcgttatggagagatcgcaacattgacaagagaagcctgccccctctgcttaaagctgccaaggtacctctgttcatactgctgttcttgttgacagttcacagagctatttcagaatttccttgcttgacactttatgtggtatgcatactgatgagttacaattaataccatgtaagctgagcttttgagtcattttcatgccctgcccaatttcaaaactaaaatttctccaattatggtccatgcaagatgcttaaaatgtgctatgcataacaaggtgaagtttttagtgttacaactgtatacaccataagactttcttctgactgacctctcctgtaggttggagatgtaattacctgacaattcaggggcccgaatctgtataaaataccggcttcggccaacaggatgtagggttattacctgacaattcaggggcccgaacctgtataaaataccgctttctgtgaggaaaccaacgaaaaccaagctacaaccccttttcgatcgcatgtccaagaaggtggccggttggaaaccgaagtttctctctccggatggtcgtctttgtttgatcaaatcagttttgatggccattcctgtccatcttctttcggtcatgcagctcccgaagtgggccattaaagatattgaacgctgctgcaggggttttctatggaaagggcaagaagaagttagtgggggtcactgcctcgttgcttggcgagtggtctgcaggccggttgagtgtggcggcctgggcatcagggacatcgatcgcttcggaaaggctttaaggttgaaatgggaattcaacagactagagcaagaagacagaccttggacaatggtgcggtggaaatctgataaggatgttcgcgacatcttcaattcagtggcacagcacattgttggagatggcaatcgcactgatttttggagaggtaagtggctgccccgtggaggaagcattgcaaacaactggcctattcttttctcctttgtgggtcgcacgaagatcaccgttgcacaaggcctgctaaacaacagatgggtgagggatttgcaggggtctctctctaatagagctcttgttgattacctggcgctttgggatgagctgcagctcgtctcgcttcagagtggtgaggcagattcagttttatggcggttctcagctaacggggtcttttcggcttcttcggcttatgagtttctcttctccacctcaatcaaatgcccccacggggagctgatttggaagaccaaagcgccagcaagagtgaggttcttcctctggttggcggtgaaggggcgttgcctcacggccgacaacctcagcaaaagaggttggccacatgatcccacttgtctgctatgtcaatcggcgccggaggactgcaatcacttgctcgtcaaatgccctttcactaacagagtgtggcagcaattgaaggcttgggtgaatgtcacttttcctctccctgctcagcttggcatggaactggcagattggtggcattgtgcccgccgctgttttcagatgaggttcaggactgcttttgattcacttttcatgctggtttgctggagagtttggaaagaaaggaatgccagggtttttgagaataaatcggttgtggctgatcgcttagttgcagacattaaggaggaagtcctgatctggagagcagccggccttttctcttgcgaggagtagccttaagctctttggtgcttgtaaatagtctttctcagttttcttaatttttcttcttttattcggggttcttccccggctcgacagtctaatgtcgtgtaatactggtaactcttctttcatcttaatgaaatttggtcggcgtccttccgccgacccggcaaaaaggttggagatgtaaatgtcacaaagatgctcctgatgggggatgttgatgtcaatgaagccgatcctgaaggaaacacagcacttcactggtgccttagtggtagttcaagcacacaggagccaaggtatgctatcagaattttgttctatcaactgttaaaaacttaaaatacaacatactagttcttactgctctttgcattctctttacttagttgtcttatgtatttgtgcaggattgtgtggctcctgctgaagaatggtgccagagttttccaggggaacaaacttggtcttacaccagtacacagtgctgcagctaagggaaattataaagctcttcaggtagccttttgttgcttctactcacacgatggcattttttgagcttataactaattgatagtatgtttgtttgctctgtaagtcacttctgcttcacgctcaagattgcgttgatacaccttccaagaccaaagaaaccccattgttcttagcagtgaagaatggttctttggactgtgtaaagcttctcctgcgttctggggctagcaccaaagtacagaacctaaggtggtaatatttggatttaagaagaatattgcttctgtttgatggcttgatgcacttaccatcctgtgatcctttgacattgaacagaaagcaaagaccaatagatgtggcaacgtcccaagatatgcgtttcattcttacctctgcaaatgtggctccatgtaagatattttctgacatttaaagatatttatcaactgaaatcacaaaaatgtttgtagtagtgcatacaattagcagtgttcgattcaatgaaaaagatttgaagattggtttcctgttggttttactgcataatgatcaatacgcagcaaataccttttcaacggaaatatattctgtttgtagggaaccgtagctcacatccggaaaaaagtgtgatgagcaaggaatttctagatgacaattttgttgattatgacagcaatgatttaaatgaaaggtttgtctggtgaatggtgcatgatttatatcagatcttccattcttttgaatactagaagcattgcttctcaccctatgtttcaaactaataatatatttattttgataatgtggcagctttactgggcttaaaacatcagcaagccatcgggatttccggtctagtaatggttctgcccagggggggcaagagtaagagccattgtgctcccaagcaaggttccaagtttgtgcctcgggtaaacaaacatgctctgcctatattaaccaattccctttttcttcacatggtctgcctcttataagattttcttttagcctaatcattggctgaagcacgactacactcggaaaatttttgttgggggcctcccaccttctgtgggcgctggtaaacttcagaatcctgaactacttgtacttaataaagttagaactaatgtgtttcgaagttttaacacttgccttgttttgttcttcctggcagagtacctcactgagttcttcactgctgaatttggacctatggaggaagcagtagtcattgggataaggatgggtgatcgggtgcaatccagaggattcggttttgtaaagttcaaaagagaagaggatgtgataagtgcaaaggaaactcatcatgtgtacatgcttgggaagagagtggaggtaaaggatgctgttgctagaggatccttgccttcagaaatccagaaaacttcttcattcaggcaccacaaccaggaggttccaaaggtaactcatcatctgttgggtggtgagctaaaggaggaacattacattaggaagcggaggcccttgccagagaagtgtcttccatcttggttctttatattcaggaagtggctgccaggatttcttgcagatgctactgaacgacttggagataggtacccattgagctccctgaagggtgatttcagagcaatttgcagaatggagcttgatcatagcacacttggttatcctaagctcagtgatttcatgcgctcccttcctggtatctgcagaatgtgtgtagtccctgtaggaagcggtcctgcaacacacaaggtcctccttccaccggtctcgcgaccgaagtatgtacccttgctagtaccattctcctttgatcatgatgagctcccagaatcagtgtcagatcatcagttcccgatgtctccacttaccactaatatcaccgaggactcccctcgtaacacagacagtcagcacggtgatacttgcagcgagagcaatgcggagagccagcaggatagtgcttccactgacaatggtagccaattgtacacttcaattgagcctgtatctacaagaaagcttgatgtagttgagcctctacctgcaagaacacctgatcgagttgaacctcagaagattggttctgatcctgcgagaaagactatttcccttgaatctggacttggtgtgcagattttcataggcaatggtagtgcaaatttgtcactacaggtcgacgtcaagaaagacgttgaatacatgctgatgttatatcaaaagagaactggaatcagcagtagaaatatctattttgtatacagagggaagaggctcaggttaaaccgcagcttactatcatatggtgtacagaaagacagtactgtgaatgttcgcagtagaattctggggggtgctggtacatcactggaggaatatttacacaagcacaagaatagtcttgtgaaaaaaaccgccttgtatgatggaagattcttcccagagttgacacccagaagcagtattcttttgagaacatgggtcttatgttttacaaaggcattcaaggagcgacattgctgggagcccaaatgtgaactctctcatttcaaggttatcaatggtcatgtcaaggttagcacaccagcaaaagggaacctcacaacgcattttctgcaagaaaatttatcttttctggcaaagacattaaaggatttcttcagaacaattggaacaaatcttgtctcagaatacccaccgtactttgaatattttatgaagtttatattgaaaatagatctaccatgcgtaccacatttgcagaaagttataattgaattgaacctatgctttatggattcatacatgagaggggtgctgacagtgagattgaagcaaaaatttgatagcctacctccaaaacaaagagccactttgatagataagatcaatcatatcacatgggatacatctcgaatgccaaatctttctacaattcctgtctttgataaaatcatcaaaaaagcaaaggatgatggagagccttacttcattgagaattcagtgaacttcgagtttaaggcgttcaatggatttaggttgagccgtgatgctcctatacatgctcctcaacacagatttgtaagtatctaacttgcttcagttttatttaattgtgaattgtttttattatgcttaatataatcatatccttgtcttattgcttttgtttgcttatccactaagtatcagtagtagtttagttgctcttttcttgttagtttactataaatatatgccatatgcttcgaataaaagatatagcttcaaaaaaaaatcaatcctctgttctgcttgctctctcaccctctactcacctccttcagttcattctcaacatattataggtatcacagtgctatttgtacttttcaggacaaaacatcggtaccttggaaggaaaattttccagataatacaatagaattgatgacacctgcttatctgggtgatttgcttcccgaaattatctggtgctttattctaaataaggtggacatcacagaggagtaagtatactgaactttttgtgagcttcttttacataatactttaattctaatccttatttgttgctactaatagattatcacaaagtcagactccatgctgtactatgtgccatcctataaaaacaggtaatatttacatcttgtctcatttatcttgatgttgcactctttgtaactgtgtaatagtttttgtgttagatgtgggtgaatatcccacgacacagcaaactactgtgcaggataaacagcctacaatggaagatgttggatcctcctcatcaatgcagcaaaatgtatggaagaaaatctggtaaggcgaatgagctgnnnnnnnnnnnnnnnnnnnnnnnnnnnnnnnnnnnnnnnnnnnnnnnnnnnn

SEQ ID NO: 42436 - DNA, 7073 bp, Oryza sativa
  unsure (1)..(7073): unsure at all n locations
ccatcccatgaggtgggcttttgtaattttccaaagaattaatcttcgagtgggctaaggcccattcattaattccaacagtattaaccaaagaaaagaatgtttacttatattcatgttgatctatacgctacgctcccgatcttatattattaattaattgtaaagatgatctatactacattgctaattgcttcgcttgtatgatcccattgggcctacatctcataaattaaaagaactccaagtgaagttatagctagccaagggtgatctccattatcatcgcattaaccaaggagcatgcaggcaaacgagaagaaagatagccactccaaacatgttaccagtgaccgttcaaggaaaaaaaatgtttccagtctaattacaagttcctataccattaatcccagcatacacacttacatcacccactatcccttatattataggacgaaggaagtatatactaggaggcatatatacattgtaggatcgaacacaagcaaccaaacctaccggggggtgaatagtagggaaaaccaaaaacccaaaaacttttagcggaaataaaagttaccctcaaatcgatggaaatctcaacatagtcctgtcgccgccggtcggattgctcacacgctgccgcctgaatccgaagaaacacaaatcgaaaaacgctcaaagtagatgacaactttattgcttctctctgtgtttacaaagtgcaacaacagcactccttacaaaaatctcgactaaactcgaaaccctaactaaactatcaactcaattgctctcaaaacgataaaaaagcgataccgggaggctacctctccctctctatttataccgaaaacctcctacttaaagtagtagaacaactcctagtcacagtagaactctatcctcaattaccaaaccaaactacaattctctcaaactacagccgcacgcatctcctgtaccggctcggtctcggtctccatcgcacgggacgacaccaactcggcctctctaccttgccctccaggccgacacggtctgtatccaaccgagccactgcattgctacctgtttgcacagaacgcacacacacatgcatgctacagtaccgcccgtactgtagcaccatatgccagccaatcacagacacgatcaatcacacatatatgcatgctacagtaccatgccgtactatagcaccatatactcttctccaataccttcgcgaacaccgacgcttgcacgcacacctcgtgaagcccgttacgaagatctctcctacacgatgtccatccaccgtatgccatgttgtatccaacttcgtcacccggtatccttgatcgtctggacctcaactcctccctgagtttagtcccgatccccaccgttgaccgaagttgtcctccaagaatccagactctagtaaccttctcacatggtatcccgaccgcactagacctctactcctccctgagcatagccccggtcctcaccattgactaaggctgacctcaagtcacctgcacaaaatcagacaaaacaaccgtttctaggcacagatatcacaatctgacccacattaatcacacgcagctcacaccaacatccacacatcttttcaaaccaattcattgataaaatcatttgcacagccaattgttcatcacaaatattaatcatgacgttgatttcacatacatctcctcgacagaaattaaatcagatcgaccgaccgattatatgtttaatttagggagcaagaagctaagctagccagtcagtttgcttatactactatgttttagtgcactgatagaaggcagagatatttgcctcagtacgtatacatatgtgcgtgcagggctagctgttttataagtactactccagttaagaatataaatgcagacggcaagtataatatcttcaacacatagtactaatagcttgtggacactgatgcatagatgaaattaaaagacagggagaacgaaacagagtgtcatgcatgggtcgttgaatgaaaaggtaaaactccctaaattgtgtttatgcatgggtcgttgaacaaaacagagtgtcatgcatccattcagtaaacattgccaaaaaatgattatctaaaaataactattttggaacattataaatatctgatgttaatcatgggcacacatgtagttattcaacaaatatttgctgaatccactaaaaacacaaatatatgatgaaaaatgcagtacgtagtaatactcgtagatgatacgtaccctatgattgttcttgagcaagtaacgcacatgtggggcaaccagtgcacacagcaaaagccgacaagctacaagttatgacatgtcactatgtcaggacttgaatttataagattgactaaaaatactatttctactactaagtttattaattatatcatactcctgagtgatgtcaactccctccttgattatgtttgcaacaatgtggggaataaattcttcgaagtgacaaggtatcataagttcaattccactatcatttggaaacctctcaactattgcattccttctaccctgcaagaaaagaaaaaaaaaagagaagcaaacaaacaacgtcaaacaaagaaagaaatcttaactactactccctccagtttgaaattagtttgaagcattgtgtgatatttcttgacgttttagcttttttggtgcatcttggacctgcttgtccctgcatgcatgcagccggccattactactcccattatttccaacgtcatgtatgctttgccttctcgtttcctgttcaaccattgctctcccacgcgctgagtaatttcctttttctatgtctgcttgtggctctttgccttctactcgcctccttgtactactttcgccattttcgccatggagcaggtcatggctccatgttcaagttcatgttaaacagatggaatatgtagggacttggagcgtcaaactagctagtattgcacagcataaatagatggagatggcaaaggggattctgttgcaaaccagcgccaaaatctgagttattggcggcaaacgcacctggcaaaattttgttagcagcgcgcgagtgaaaattttccgggagcacnnnnnnnnnnnnnnnnnnnnnncatgcatgccaacagtcatgcatccacagtgccatgcaaaaaaatgtggccaccaagaatcgaactcaggactggtagcttcactttcgcatgagatggccactcaaaccaagagcaggttatgatttggtatgccttaaaaccgtatttattaggggtaaaacatgaagtaggtacactaattaatcactcattggtatgtgtaatcctgtctaaaacgtcaacaaattaggaactggagggagtactgtactctgtttaattgtatcatgcacagcaaattaaccagaaagttagcaagagaataataataaaaacactaatcgatcaattgcacagtaatatatataaccagtacttacatcgaatcgatattctgcagcatgcatggctgcatttctaacaagcctgaaggcttcaaaccttgtcgatccatatggtgattcagctttgtcagctctaacaataaggtccttaaagatgatcactcgagacacggttgagcgccattcacttgaactacgagcatcttgtattgcagtcgcccacttgggttcatcagattcattggcaccttcgtacttgcagtagagtttaattatgaatgataccctggagctagaagtcataaagcacatgtgtgactcgatgagtagcttatgccgaggcgatagggcatcagagatgatttccatgttcctgagacgatagatgaagtctctgaagtagggtgggtgctttgagatgagtcgactgtcatcgtttctgaagatacgctctatctcttccacaaacttgctcacatcgtcctgcatctcctccctgcagcaagaccgcttgggcttcttgatcctccgaacgtggccatccacgatcttgaaatcatccagcgtgaaatctcccttccagctcatgccccttgagaatgcgtccgtgaaacaacggatccatgttgaaaggaagaggcaccccacagtggtcatctcaagagaatgctgcttatcaggaagagcaaccacttgcataaaagatgcccgtgcagcaaccaggtattgttttaaagtgaggatcctgtaaaaatgtgtaaataatcatcatatatatatatatatatatatatatatatatatatatatagggatgcactaaaccgcgtatggggtgcgctataactaaaacactctcctcacagtatgcacccccacccacccccaggcgccccaccccacaccccaatccctgtttcaaaatcatatatagtaaaacgattactaccgccttatcaatagtacaatacactatcagtaacatatttattattcgtgaaaattggataatgaatccataccgcacctttttttgacaggtaaacatattagtatgttatttactgaatggtagtcatcttagtaatttatttacttaagtgcttgtggggcaaccattccaatatgcttgtgagtaacaattttacgaagagttccttaccgttattaatgacaagttaacaatttaatattcatgtaaaagcccccacacaaaaccactctgggtcgcacgaacaccacgtggagaaatgataggagtgattgagtaactcagttactatcattatctgtatattcaattagtaacaaagttacttgcggttttattgtaccataaagtttgactttttagtaattgttttactgaaagataaaactaccagtaaactttaattagtaacatagttacttaagatttgattgctccaaccttctatcagtaaagaaattattctcaagttagaagtataaacttttgatttagcaacaaaaattaccctagtcttatcttagtaaataaattattttatgtttttcttgatccaccttccttgagtaaatgagtaaattgattgttcttagtcccagactgcttgagtaaaagatgtatgaacatccgagaaatgtttgaacaagatttagtattacaacaactatctaatcaacatacacaatgcgatatattggtagaatacacaaaaacaaataaaagattacaacaacaccaacaatgtagatcaggcctaacgatgtgggtcgacccttgcccgaatcccgcgagtaggacgactccggcgccacatatcgaatcaagctgacaaagtgctgcagattctctaggcctccccatcaacagatatccatcacccacggccatcatctagggaggcatcccatggccacctggatatttgcaaaaaaagattaaatcatctaagtgatttacactcataaatgactctaagtgagatacaattatctaaagaagaaataaaatgcttcataagaacctcactttattatgcctattgttagccaacagttataagtgaggggtgtcatatttaagcatatcaatgaggcatagaaatatacaaacttgaaaataacgggtttaatccaaatatcaagtctacaaaatttattcagagcattcctgcagtagaacaaaattcagctaacctatttggagcaatccactcttaactaatctgctcaacccaaaaagttcagaacatgaacatttaaagcagagcattgtgaactgctgtgccatcaagctatgcctccaacgcaagttctcgcatcaagtaaaattcagagcattcactagttaattatctaagtattccaaaaaaaacatgcagatatagcagttaggtagtcaggcagcggcagatgtgaaggttgccatccccgcctcattggcaaaaacagccgatgcggagaaacaacagagtatgtgcatgttgcaggtgttgttctacagcaagggcgccaactcctgataactgaacaaatgaaaatttagatgtgagcagatttctaacaatactgcacacacaaattcatgtctggccacataaaaattcatatgagtatgaaaattaggtgattaatgcatcgcaaaaacaacatccaggccgcaggactataagtagcaatccaaaaaagaaattgtatatgaccaccaccactcgcaatcattagggcctcaatctaataatggtacacagaagctcacctggtcttgttccaatttcctgaacgttgcatagacgaattcagtactaaagttaaaattaagatcggagcaaggaacgaggtgttgaatgcatcatgaagacaacagtctaggagcaggcctaccacaatgatccattgtattcatccctgaaaaacaatgagcatgtgaaagattaaaacaaagacaaatgaccaatgcagaattcggtcctcctcaatggtccatggccaaggcggacatcaagggcggtggtgactcggggatcctaaggagcgggaggcggccaccgtgtcgaagatggcgagggggtcgcagagtgacggggccggcggtggagagctgaacgccagtgaagccggtggagcggcgtcacggtggcttgggtggagtaggtcggcaagggttggcgaggagggtggtggcgtctgaagggatcccggtggagaccgtgggcggagaacagcggtcacccgtcatcgtggagctggcttccattgacgccgctgcaagaaaacgctaccgtcattgttaccgtcaatgaacacacacaaaagaaaatcaaatcgaatcgaatcgcgcggaacctcgcctccggctcaagccacgaagttggcggccgcctccgccgctgagctgctccttcgaaccagggccaccgccttgacgtttctagccagggccgccgccgctccaagccggggctgccgttgctgccgtcgctgagcggctccaccaagccgccatcgtggccaatcaactgctcccctgagcaccgcagccatcagcccatcacctctctccagatccgaaaaatggggaaaactgaatgggtggtggttcgtttctgttggat

SEQ ID NO: 42437 - DNA, 12493 bp, Oryza sativa
tgtatatatatatatatatatatatatatatatatatatatatatatatatatatatatatatatatatatatatatatatatatatatatatatatatatatatatatatatatatatatatatatatatatatatatatatatatatacatatataatgaacgtagaatgtttattcgcttttcaattgagccacgtctatccttctaaagctggcatggaagatgcaagatgattgggccacttggcatggctaaaatttaagataaattaggagaacatatgataaaaaaaattccaagaaaaacaagctttaaacattctatctatattccataggcttccaaactttaaacattatagctagattctagagacttccaaagagaatttgtcatgcattttaatatagaaaaagaaagaaaatgaagtaattaaaaaggcaagatagagaagatggaaaaaaatatgagtttgaacctttcataatgaaaagaatcggctaaatgttagatgaaaatcgaacaaagtaacatcatgatgataatatcatatgtttaaatgcaaaaacaaatcgtagcaaggattacattacaatcactgattcttttttggataaatacagtacaatatgtgtataataaaaaaaagtaagcaatacatataactaaatgaaaacgataaacaggaaaactagatttatagaaatgattagttacagaaaagtgctaggatcgttgggaatatttgcataaattaaaaaggtagtccaaagttttttccgtgcaattttaatgcaaaatgacgaatagaaatcgacattctaagatacagttattttaggacatatggtttctactattatgttactcacatgtggaactatctattctattactcacacatgaaactatctattttatagaaatatccatcactttttttttcctcaaagttaacaagtgtatattgcaaaataaacccactaatcaggatatattattaatcgtttgagctaatactggtaaaccatagaaaaatgaactaagaaaacaaaaataatttatgataatatatctatgttggtaatggttgtaaaaagaaagtgctggaaaataatctgtgatgaaaggaaaactaaaatcactctaaatggatttggaaaggacagttagaaatgtagagggcaggagaagattcatgacacttccaatggaaggattggaagaaaacatggagtaataaaaacacgatgtgtacctccgattagaaaagggaatacataaacaaaatctagagttaagatcgaaaaaatattaaaagaaactaatgctttttgaagcgtggtttcaacggtacagaacaaggttcttcaaatgttcagaaattaaagctttaaaataaatgttaaaaattacttggactaattaataattaaaatataatacatgctaataatatatatagagttgagaacatatgctaatataaatatttacgataaattttacacgctaggcatgttaattattttttcacgaaaatattgtttattacagaaaaaaactgtaactgcacttcctataaactttgttcattaagaacttaacatttaacatgtgagagaatatagtggtgcgaatgcacgactctctacttgctagtaataatgaaatgaaaatcacaaaacccagtcacagaaagaaagaacgaacgaaagaaagaaaagcccaagatcgatcatacatacatacatactgtatgatttcgtactagagagcatgaacgaatgaatgaatgaatagtattgcatcacacataggaaagacagagaaaacaattaaaatgctactctagctagcaagtgagtttccgatggagagagaaatccaacatcacatctggagttagctagctaagaaatactacaacactatacatcctatgtatgcaaactcactgtgtgtgctgccatggcgatcgaacgtcctctccgatccgattcgctgctgctgcctgcctgcctctctcgatccaccgcctgcttgctcctggcgacgatcgacaacttgtgttgttggtctctgaacaaaacaacaaacaaaaacactatactagtattagatcagtttgtgtcgatcggtgcgtgtggatcaacacattatattgtgatcagagagtgatatgtgtgtagttaagtagaactactactagactagaagacattatggtagattactcctaccagtacgagcctcgcttgctccggacctccgctgctccgtgagccacagcgaggagaaagaagctgaggttttcaaaaggattctactcatctttatgtatgtgagcgcctgcctcccccctgtgaccctctcccaactcccattcattggttctgcactgcagctgcaggagtagctggaatttttcacagttggatccttttgaaaaatattattctataaatagaccctaaaaaacttattttaggagtgttatctttttcgcttcgctaacgttattgacgatgtggtctaacatgacttaggtcttgtctagttcaaaaaaattttgcccaaaaacgtcacatcgaatctttggactcatgcatagagcattaaatataaataaaaaataattgcacagtttgcatggaaatcgagagacgaatcttttgagcctaattagtccatgattagccataagtgctacagtaatcacatgtgctaatgacagattaattagtcttaataaattcatctcgcggtttccaggcaagttatgaaattagttttttcattcgtgccctaaaacctcttccgacatctggtcaaatgtccgatgtgacaccaaaaaattttcttttcacgaactaaacacaccgttagtttttgcattagtgactaaagttattctataaatagtccctcttcacattagttacttgtcttccacgatgggcgaaggagatgacgctaacgttattgacgatatcatgttgaaccacggcgccaataacattggccctgcgaaaaggatccattattagaataagggcccatttgaatcgcgggaatgaaaaaataaaggaatagaaaaaacacaagattctaataggaattgaagtgtaaaatagagaattgtaaaacacatgaaaaacatagaaatgactgtttgattgaacagtaggaaaaaatatgaaacaaaatagagagatatactcaaaggaaaatttctaagagctttgaactcttgctaagttttctccaaaatctctgtagaattgtccatacaataggagtttcaaagaatcggataaaattcaatcttttgattcaaatgcactcataggaatttttctataggattgaaaattttcaaaattcctatgttttttctccaaattaaaggggccctaagttttttaagggtctatttgtataataagttttctaaaaggatgaaaaaggtgaaaatcccaatcaggggtactatgttgcaaaagggtcaggacgtggtaaaagtgatgcaacagtaaaagcgagatgaaaaagtgactggtgcgagtatttactgctgctactcctattcctactcctactcccatggggctagtagtagtagctatagcctacagctagtacaacacccacgcgtctactactcgtgagggcacttacagtgcgtcaccaatttttgaggggcaacactgccacctactaagaactttacaagcgacaacctccacagtgcatgtggtcttctttttccttcacagtgggtcccacccttctctctcctcactttttacctcctctcctctctctccctgccttccccaaccaggccacaaaactgctccgtctagtgcgccgccggcgcctcccacacaccgccgtcgcccctctccccctccggatctggcggcccgccggcggcgacacggcgcgggagccggaggcggacgaccctgaggcgatctcggcgaagggcgctagcggcggacgaccccgaggcgggctcagcggagcgcgccagcggcgacgcggcggagacggcggcgcgggtggcgacggtgccgaggcagccaccctctcctcccccgaagcggcggcggcgccgccgcgctgcttcggcttcgccttgggcttcttcgacgaggaggacgccgcggcgccgcccttcggcctccccatggcacgggcgcgtctctctctctctctccttccgggcagcgcttgctgacgagacggcggcggcaggcggctagatccagcccgggcagagaggcggcgccgggagttggtttggtttgcttcttctctgcttcaacggttggtcgacttcaatgcaagaaagcatcggcagcaattgctcctcccgtttagttagtgtcgtccatggcctccaacgaaggtattcttctcttctttctcaaatattctgtttctcgcatatatgtttgctccttttttttccttcttctgctcgcttctctcttcttctgttcgtcttggtgatgacgaaactgaaggagtatttggtgattgaatctgcagaggccggattcccttctctcctgtgggatgaactcaacgacgacgcggggcaggatgaactcgacgacgacgcggggcaggatgaactcgacgacgacgcgagcgcgggagaacgacgaaacgaggtcacgacctccacaatgcgcgcaagtgcccgttcctcacgccgctcgccctggatttggccgaggaacacgtgaccaaagttggacgcgcggacttgagaaaagtgtgccagaagctaacgtggcaaggaatctatgcgctggcgcagtgaggctgaacgccacctcaccgcattgtaaatggcctcaggtcagttggcatcagctcatcatcactttgctgagcaaaaagagacctttctcttttccctaactaaagaaaacataaatccaatgttttgatcgttcatcttatataaaaattattttaaaaaattaataacacatataactactaattatgtttaatcatttaatagtaataaaaatattaattataaaataattttaaataagacaaacgatcatatattaattataactttcctccataaaaaaactcaacccaggagggaaagggatatgactctcctgtaagtccatattgtttgttttaagaagggttacatctcctcatttataggccggagggagggagcactcatctataggccggtaggctaacaaaatgtgaaattcaattgtaatggcctgtttagttcgtgaaaagaaattatttgggtgtcacatcgaacgtttgaccggatatcagaatagtttttcggacacgaatgaaaaaactaattttataactcgtctggaaatcgcgagatgaatcttttgagcctaattaatctgtcattagcaaatgtgggttactataacacttatggctaatcatgaactaattagactcaaaagattcgtctcgcgatttccctcctaagtgtacaattatttttttaatttatctatatttaatactctatgtatgcgttcaaaaattcgatgtgatgtttttggaaactaaacagggcctaaggctgtgtttagttccctttaaactttcaacaaatccgtcacatcaaatgtttagacacatacatggagcattaaatgtggacggaaaaaaaataattgcacagttttcatgtaaattgcaagatgaatcttttgagcctaattacgctatgatttaacaatgtagtgctacagtaaacatttgctaatgacggattaattaggttaatagattcgtctcacagtttatatgcgaaatctgtaatttgttttgttattagactacgtttaatacttcaaatgtgtgtccgtatacgcaaaaatttttacacctaaactactaaacacagccatagttgatattgcaacgtaggccctgtttagctcgcgaaaagaaaatttttggatgtcacattggatgtttgaccagatatcggaaggggtttttggacacgaatgaaaaaactaatttcataacccacttagaaaccacgatacgaatttattaagcttaattaatttatcattagtacatgtgggttactgtagctcttatggctaatcatggattaattaggctcaaaagattcgtctcgcgattttcatgcaaactgtgcaattagtttttccttttatccatgtatatgtccaaagattcgatgttacgtttttgggaaaaaaaattagaaagccgtgctcaaaactaaaacacgttaaaagaccatcacgtaaaatcagatcaggaggattcttaaatttaattatctcatttctcctaatcttctcctgatttccatgcaaactgtgcaattagttttttcttttatccatgtatatgtccaaagattcgatgttacgtttttgggaaaaaaaatttggaaagccgtactcaaaactaaaacacgttaaaagaccatcacgtaaaatcagatcaggaggattcttaaatttaattatctcatttctcctaatcttctcctgataccttcttcgcttccttcctgtaagcacaagaagctagaaagggacgaagggttttgcaaggtgttcctagggtcggaccgtcggactgcctctcgattctttcatgcatttttcaagtaaatatatttaaagtttatagtagttactccagtacttaattgatcataagctaataacctacatcgtttggaacactatcttagatcttccaagttagtacattgaacttgaacccatgaatttcagatggaataattaatgtcaaaagtccttaagaaaaaaaagtttagcctgaaaatcaaaatcctagtgtaagttgtcacatccaaacagatactgaaaatcaaaaaaaaaaaacaagttgaatcatacagtattcaaagacgatttacttatggaattttccattatcatctagaaaagcttatcgaaaacagacactatgggccttgctttagggtttaaccactgaacagcactatcacgaattccactacgtactctcttgcagcgaccaaggaatcttgtcgttttgtgatgttcaaaaaccgaggaaaaggggttatctcatccctggaagaatctcacagagtcatgtgcaactgtgctcttgggtcttgacgacgcagctacagtctactcctatactccctccattcaaaaaaacaaaccctggtttccgtgtccaatgtttgaccgtccgttttatttaaaaaaattatgaaaaaaattaaaaagacaagtcacgtataaaatattaatcatgttttatcatctaacaataataaaaatataaattatataaaaaaatcatataaaacggatagtcaaagatagacattaaaactcagagtttaacttttttttcacggagggagtacgtagtataccatgtcagcaggctcaaactccacccagaagaaaatgaatgcactgtgttgagtgctgggtgatactactacagtagttctttattactgtacagaactacgggtactggagtaaaagatgaggccaaacacacagtgtcatcttgtgaaaaagttactactatgacatatacacccttcgtccgaacgtataaacatttttgaatttcaatataggcccagtttagcttttaaaataaaatttttcacactatcatatcgaatatttggatacatgaataaaatattaaatgtagaaaaaaaccaattacacagattatgtgtaaattgcgagacgaatctttaagcctaatcgcgccatgttttaacaatgtggtattacaataaacatttgttaacgacagattaattaggcttaatattttaactcgtagttccttggtgggtctataatttgttttgttattagagtacgtttaatacttcaaatgtgtgtccgtatattcgatgtgataaccaaacccaaaaattttcccgaactaaacaaggccgcacagttttcgagatgctattttgacttacagtatctataaaagtaagatattttaaatgaaaagagttacattacatattatgatagtttgttgaatgataaatctaataacatcaattttacatgattgatgtttttcttttttatttgctattaatagccaaagtaaaaaaatgtttgattcgacactattttgaaagtgcttatattttgggaccgatggagtaggatagagctagctacgcatatactccatctgttccgaaatataataatctaaatcggatgggagattttcttatactacgaatctagacatataatttatctagattcgtaattatagaaaatatcatagatttatggatctggacagataacctatacagattcgtagttatagaaaatatcatagatttttatattttaggacgaatgtagtatgatgcaactctttactgtgcatgtatatagctttcaatatgggttttgtgatcagcccttacactttttttctataattttctaattcgtttgtagtcttaattttgtactcttcatttgtacacctaccccacggtcccaccttgacctctccgcctaacccctctcgcttctcccccaggccccagcgtcgtcgatcagcaagcatttgctgttgcgccgttgaggacctctttgcctcctctcctcttatccggccaccgccaccaccactgcctctccaccacattggtcctctcttcagcacggctccgccgtggatttcatcgccatgacacgagacccccgccctccgcccatgcacggcggtggtggctgggagagaaaaaatagaatggacgaagaagagaaggagaattgtcactaacatgtggacctcacctttttttaattttttttaatttgtcacttacatgtgggacacacttatattttcaattcctttgatgactaggctaccctcacaatagaagaaaagagatgcaaaacgaagagtaaagaaaagaagagaatatataacgattatagccgtgcatgtagtaggaagaggaaagaaagtagtacatcgcatttatacatttacaatctatgtggttgtagtaatactttttaaaggtattatatttgctcacagttccggcccgtttgatacccgataaagcaaatcttggtttcggttcccttgcgatgggcctgggcgagggggaacatgttaagtatccgcctgggatcatgttttcttaggtctattctagatgtacaatttcatttcggtagtcattttccattttagttggaaaatgcagttggatgtttagggtactataagtgaccaagggggtggtaactcatatcacagaggaaaactttgcatagagttcattacgattaatgggtggctccgagatttcttgtgagcacaggcctaacttattctttgagagtggagcctatcaaagtactcttgagagtaagatccttgactcctcttcattctccacaggggtctctgccaatttggaagcagggcaatgatggataagatcattttaaattccttttttcatcattttgatatagggggatgggggataaagtgggcaaaacatactcacatttttcaactgaaaagactttttcgtctcgacaaagaaagaatcatcttgaaaacgcttctaacctcttcgtagggacgtcacgacacttggaccaaatcgacttgtcacgtcagtagaaagcgctttccataccacataaagagttaatttgtaatagtttttaaagttggaggagatgttatacccggttttatagctgagggatacaaattgtccaaagacaagagataagagggacaaaatagactaattccaaagaaaaatggactctttaattaatgtaggccataaaagtccactgtactcatccctcgattgcaaaaccaaccgagtatagagtatcccttactatcaaaatttagtcccttagcagttggggtggtgattttgtctttcgtggctttagaaggcgacagtacggacgagccatgggcccttcacgttctattaatcctattaagccacaagttacaacttcttttccggaaaccaatctctaaagaactccagggttaagcgtgcttggcctgaagcaatttgggatgggtgactgaccggaaagaatgtcagggtgcgcacgagtgaggacaaagtgtgtagaaaagtctatgacctatgaaagctaccagatataagcgggcccggcctcgatgcgcacgagtgaggacaaagtgtgcagaaaagacttgtgttggtctgtgagggcagtctatgacctatgaaagctaccagatgtaagcgagcccggcctcggtgcgcacgagtgaggacaacaaagtgtgtgagggcagtctatgacctatgaaagctaccagatgtaagcgagcccggcctcggtgcgcacgagtgaggacaacaaagtgtgtagaaaagacttttgttggtatgtgagggcagtctatgacctatgaaagctaccagatttaagcgggcccggcctgggagaggtgggagggcagtctatgacctatgaaagctaccagatttaagcgggcccggcctgggagaggcggtctcccagagatggccagagggcagcgccggcggtagtgaggcgatttttttgttttttattggatttttacaagcgggctggatgattttcaccgtcgttggtctgcaggcggtccttccctccgcccgtaaaaattgcttttggccgcatgcaaaagtgatttttctagtagtggtggatggaactctactcaattcatagttataaggggtgtgtaaactgaactatttccagttttgtatccaaaggacgcgcatgcaaagaggcccaaaaaattagacccaacaataactcattaacgtggaacaatggttgccttttctttgcgtgtggtggggtggggtctttgtgtgaccagaagaggcgaataggaaaataaaatgggaaaattgacctagtggcgacaattttttttaaaaaaacccgacctctacatccaactataaattttgcctattaaacagagaactaaggctacgttcgtttccagggttcctaacttcccctctcatttttcacgcgcacgctttttaaactgttaaacggtgcgttttctgaaaaaaaaattctatacgaaagttgtttaaaaaattatattgatccattttttttaaaaaaagctaatacttaattaatcacgtgctaatggaccgctctattttctgtgaggaaggaattaattcccattctaatgaaacgaacacagtctaagcccttaaataactgatccgaaattcgctcctataaaaatttgaacttagagaactttgtggtgctactcaggtggcgacatggatggccagagaccgccggcgccgggccggatgatgtgccgcccgcccgcccggctggctagttcttgatcacttcgtccactgcatggtcaacgcgacgcagggcacgaagctgaaggcgatgtcacgacgccagagagctagcccttgcttcctccgtaccaaagtgtaagtaatttttaaggttgatataagtattaagaaagtagataagaataattaaaaaaaatatgtgattggttgagaatataaaattgataaaatataatagttgtaattggttgacagaagaaggtcggtggagaaataacttttatttagaacaagataccgtgtaaaaaatagctatatttttggaactgaggttgtacatgtacctgcaatcaaggttattaggatcgggatactaggtagtatcgttttgctcaaagtaatatcgtatcgtaggatcgtatcgtagtatcgggatactatgagattttctttttttaagtttaattaatatttatattaattatatatagccattctatataaaaaaatatagtaatgatatatgtcatgcaaatagagacatttatcaagagaaactatgttggttttgatatatttaactgattttcatataaatttgagcatatttatttacattattttcaaaccatgttattttaaataatattttgtagtatcatagggatcgtagaatcgggatatcacttaagatttcgattttataggatggtgtagtaatgaatagtaggatcgagatactatgaaaattaggatactaagtgggatcggtatcatttcggcttggtaggatcgtattatcgtaagatactaggatacgaatcaggatactgacaaccttgcccgcaatccgcgttgctgacacccccgcttctcactcagagatggcaatggggcccgttcaccgtttcacccgcggtgaattcacctattaggtgacggggatggttaatatctatccaccatggtgaatgaaattgttccaaagttatcaccatcggggatgacgggggc

SEQ ID NO: 42438 - DNA, 8106 bp, Oryza sativa
ctattcaacggcccgtcactggtatccgctcacctgtgacgggccagaaatgaaagccgtcacaggtggcggcccatcacctctgacggcttctaatgtatcggcccgtcacaggtgaggggataccagtgacgggttggaagaaaaactcgtcactggtatacctctgacgggttttctttcggcccgtcacaggtgaggggatacctgtgacgggccgcggccagatgcctgaccggtgacggcatcccgtataacccgtcaaaggtaatggtcaatactgaccaattcgtttgcccgtcacaggtatcccgtcagaagtgtgaggatctggcgtagtggcagcacccaaggatcaaacatccatatacacatttccaaatactgaaataccgggggcaattgcatcctcctagtttttatttatttgactgctccacgccgggcattgctgccgtcttccctttcctgctgatccgtaattctctgcatcaagaagagttagctatcatatactaatatatatacttttgaaactggctactgacaaatgtcgctggttaaaaaaaaagtttgaaaagtgcaagatatatgcacttatatggctgttgttcaagtatttccaattcagtttattgaatgacattttctataaaagtatagtaactgtgcactgctttgctgtcgcacttgcttgagagagagagtcacctcacagacattaattcaggctgttctgaaaacaaattattgggaacgtctatatgcggcagttttcaggaggtatcgatctatttcctgtaaaaacaaaaataatccagtgatctataaaaaaattaattaatttctttaaaaataacaagaggctcacaaaagcctgccgtgcagtatgcatatatgggaacgatgcttttgtaagcattgcttttctattaatttttatatgtggctgctgcatatatatcctatgcagtcaagcacatcctattcctctctttctcaaattaaacattcaaaagattttttttatctgtggcatcaaattaaatatatgcaaggttattcgacttggcttcagtaagttatgtaatgaagcaatgcaacctgtttcaagtgatgtgtcgatctactgatccaaatctacttggtactcattgtaccattcatgagtatccctacacttttctcctctaccggctatgttctgcggtgagactggctaactaagatatcaacggagtaattccagactcattcatgagttaacatcaaatacaaagctaagccttgcaattgagcaagccaggcagtgtcgctcatgcgctgcttgcatgcctttgaagaagaaatctgattgaaaatagtcgaggctgcaaaaactcttctcagataacaaaatattaatcaaaggactactatgcgtgtgagttcttttcacatgattctcattacttttaagagagatattcgttatatctcttgtttatttatcatacggttcgggtcatctctcctgatgcttgaacattggcctaaaaaaatgtgagctgcacatgccagttacatagaaagtttccaaatgtgactatgcaataaaaaaacattttaaattcagcaccggtcaccctagtgagggaacaaacacttcagatctttgtttatttatatgttctcctagtttgctgaacaacatgctgtttcgtcaaacgattatcttcaacgctgtcaaacctcaagttgaggtgacaaatccagaggccgtcgaatgccaggggcatatcaacatttaataccggttcgctctaataatattttcttggacagccctgatgtcctatagaaatatacatatagaggttgggactacctctattattgttaatcatactccatgagacagcaggggtcttgtttctcatgtgtaagcccttgggctaatgcgtcaaaatttctcaaaccaagatgagagcttgctaatctaagcaataagactcaattaactaaccaacatgatgatagtcaccaaaataaatcatcaagtgttccaccacaagcaagcgcagggggcaattttttgacccctcaatgataaattccgaagctgattccataggctcgattgccttcagtgagcctacaaaacaatgccaattgacaacttgagctcgacagcggcaaacacgatgtcaacgtgtgttttaaatctgcaagagatttgttccaaaatttattgtgcaacaaattcaatcccttgaagcaccactctgcaaatccagatgcataatttcctacacaacatctctgccattgctgagcttgagttgaatagatcacttatcacggactatgcaggaacaccgatcaacagctctaagttagagtgctatgcaaaatggctggggcagtaaattagatgtgcattgcttccactatgtctcctcatatgacattggtgataaaatgttatgagggtgactaaaatatcttcaaaatattatattctccaatgacgagttattctacttgatgtagttctactctcgctttcacacgtttgcagcgagtgtcccacatggccaaggtggtcaacactgggagtaacattgtcttgatccaatatcaaataaacgatattttttccctcctctatctttcaataccttaccaccatgcatggtgttaaccgaactatgtgtggtactaccaagtatcatgcccaacgcttatctatcaaagatttagccatttaaatactatggttagcctaattatgttggctaccttccctttctgttctctccctctctttcaatggaatcctagtcgattaccaagagtagaacaatgccaattcaaacacatattggagttgaaatctcaccatgagattcctcattggaataaatgaaaaatgttattttaatatgtatgtgcaaacatctcccctgttatctttaaagagtacattcctctctaaaaacaatctccttcatggatcatagagtccaaataagaaggaagcattacctttggtgggttgtcactagtggatgtgtacttagtacagactatgctccaactgattgatctcgcgatgaagcgaagtcaacacttagcacttggctcgcaccaacaatggatgaagagggcggttgaatcttgatccaagttaaaccctgatgtggtgggtttttatcatgtctttcgcttttgcccaggttaagggggcaagcttctggggaaaactataggaaaaagagcttgaaagggctacctattctgacaaaagtcaagttctagtgtggagccacatgccaccccatgaagtattaacaagggcaaataaaaaaaaagaagaaaatactaaatgccagtgaggaattcttagtttacactaaaggtgtggtgactactttccaagttctaaagggggagagtgatcaagccgatgaaatgtatgatcaaaatatgtgtgcaaaaaaaaacaatctggaagaaagagaagaagagaaaaaaataaaggaaggctcttgaatcaatgggtcactcttccctgatctgaaggcggaatgtagtcacttcccatcctcagcaaaagtaatggcacaatttccaaagcctatcacccataaaccatctcaatgattagccatatcccatacccctactgggacaaaggtggaagacatgaggcacataactgaagggaggcttggagagagttcttcggcccatcagagatcctgacaaagtgtgatgcccttacacaaaactcacgagtaagctgaatcgcaagtgaaaatcatggtggcgaatacttgtactagggaataccgtctctagtagtaccaccatcgactattgcgttgatttaaagaaggtaataaaaaagagagatctgtttctccttggatctccttccagatcattacaatctcttattctgccacataaacattactctcataattggcattgttccactacttgggtaaaatgtatttcctgagcgagtcagccgtgtaatatggttgaacctctacattttcatgacatttttgacaataacctgctctaatcatgatattggatcaaaccagtttttattcaagtccatgattattcggacaaatctcaattattagatggggaagtgacgtgcaccagcgtgtatagcatgaagctgtcaatttttgactccactggctggcatcgttacattgaaaacgatcgcagtagagttgatcaaattcttttgaggtgcggtatgatttttttcgctacaacgggagcagtgaagtgcaccagtgcggcatgcatggagctgtgaaaccctttaacttcattggcgggcatcgtgacagtaaaacaatcgcaatagagttgataaacttatattgaggtgtggtatgatcttgcgctatatctcaataccatgggggcaattctacaccctccaatcattgagctcgactggctggcttcttactagtgaaacagtcgtagtagaattaataaaattctacatgttgtgaggagaagcatctcttcactactggctcctgtattggttgtcaccgcagttataaagtggtcacaatagagtcaataaatcatgttaattggtcacatcaaacttgactaatgtttttttccgcaccaaacagttttggtcgctatggagcaaaataataggatggcacgattatttcgccacatcctatatacatgtgctaatacaatcatcataaccatagcatgaattttcgctacatttctttacttatggcctatagttttacactgtggcacgattttcgctaccatacaaattttatgacagtattttacactgtggtatggattctcgctatagtttctttcttcgatgccattcctgtatatggtgcatgtgtttatgctgtacctactcgagatggagactgtagcacaaatcttgctacagtgacaaataagttttgctgccctatccttgttagggtctggtgctttgaacgcagatattaaaccttggtctgtactcaaaatactaatcttcagattgagtcacaaacaaattaaaatggacagctttgctatcatagcgataaattatccatagtttctaagtgatgaccgtgtttaagaaaaaaaaacagagagggcgacaccaaattgatttagaaatgggtcgactcagtttgattgttttgccaagtcgagtccctgttgcttcgcacatgaactctactcggcgggggacatctatctcatatgctaataatatttgaagcctgaatttacaagatgtgtgtgaagaaggcctttatgacgtgtggcaaaaaaaaaacacgtggcaaaaaaaagagaggatgatgacgtctatgattttcagacgggaattattcctactaagtttactgtggtgttcttatttattacagtgatatgattacttaatgggatgtgcttctatgcttcttaaaaaaaaactgcacgaaagttaaagcacgtcaatggtgaggattaaaagttgattaaccgagtaatcaccattagcaaggggcaatttcgtccagaagtaaaagcccatatccgtatccacatcccttctcatggattgattcgcggccagcgcgcggcagttctcacgacgcattccggtgaacagcgccgcacgcccgcaccctttccttcgccgagaagcgtcctctaccccctgtaactgtaagagtgttttccccttccgctactaaccacgccgtcgctgcttccttcaccggcgagctctctccttcggggagctgcgtgttgacgtgttgtgtaggtggtgctcgtcgtcgtgctttcaggttcgtcaatagtctcgtggttcaggaaacatggctggttggctgattcattgagcacaacaccctcactcaccattatcaacaccttattctgcttcttcatgattctcggcagagattgccaaagcttccatgtccattttattcctcagtatatggtgatacctgatatgcattcagaattgaactgaacttaacacaaggctgatcacaatcttttgaatttacatagaattggttgtatgcgctgatcctatccgtctcgtactgttcgcggccgcgtgcctatatataaactgcgtcggcttcttaccggccgcacgaagaatcgatggcgatggagattatgcaacagctcgccgccgccgccacggcaacggccctgtgccctgaaccatctctgatggcgatgacgacggccggcgcagatggaggccgccatcgcgacgctgcatggcaagaagcaacgcctccgcgaggcctgcgacagcctcgtcctccactcgcccatcctcctccccttccgctggtccgacctcgactcccacctctcctccctccagtcctctatccacgcccgcttcagctagctgcaggccctccaggcttcccgccccgcggcccccgccgccgccgggagccatggcgaggacgtccaggaacagggagaggacgaagtgatggcagcggggggagccaaaaagggggcttccgttacggggccggaaggcaagggaaagaaccccgcgaaggccccggattgcccaaccttggacccacaaggctggcgtcgaatgccggcggcaagcctgcccgcgtccggccaaaaggggtccgtccaacccgggggaatggcggtcccgccgccgccgccaataaggcgccttcgtcaaaggggccaggcaagggaggacccagcgaatcctagatggcgaccaggtgggctagatatggtcagctttttcttaggacaaaattacccctcgttaaaggggattactctgttaatcaacttttaatcctcactgttgatgtgctttaattttcgtgcaggttttttttaaagaagcatagaagcacttcccttacttaatatatggttggatcatgccaatgtccatgattttcggacgacaattaatgctataaattgtacactgcaatgtgctttctacagtgattttattatttaattgggttacacccgtgtccaagattttcggacgacgattaatcccaataattttgcactgtaacgaatttcctacagtgatcttattaataagatgaatcttcgctatggtatatttatcgacatttacactgttgcatggatttcgctataatttctaaagcggggaggctggtcttttaaaagccaaaaaaaaaattgaaatccatggctaagccagaatcgtgaagaattagtggcgttactgttactgctacagtagtaaagccactaaaaaaaattgaacgtgagcatcctttatgtgaggaaatgtatatacataaagaaaaaaggaagaagccagtgcacaaatattgttggtaacaatgcaacgctcctattaaatttgaaggagttcactgtgcttttctggtgcaaatcaaaatatatagaaaaaacaataaaggagttcactccgctatattggaaacaaataaaatatctgaagagctatttcaaacctgaaacaagattttgaaactagcatctactcatctaatgagcagcccatgaaaaaatcaaataaattgtagacatatctatattgagatagatcaaactcgtctggcttagtaaagtctataatatcttggagagacttttggtgcacgctcgcctgctttaagtgcgccgcaatctcagattttcgatctttagcttgacgatgtcgctcgagatgggagttcaagttctctgttacaacatcttgtcagtgttgtgcactggagtgggcatcttccacttgttgaagtcttgcttgcaacactgctatctctgctctaattttccgtgcttgtcgtgagcactctctcttgttgccctcctctactgcttgctctacattatattgactcgtcagtgcctccaaagcgacgcatgatgactccaccttgtcttgagcagtgcggagcagatcgacgtgttggttaatctggtcctgttgtgcgagaacaagattagtagttggcagtggcgcttcctccgatagcgctcccttaagcacgcgtaacccttccattagcc

SEQ ID NO: 42439 - DNA, 1573 bp, Oryza sativa
tatgacaataggtaaacaccccatagtaacattataagacaatgcaatatttgaaggaaaacaatagagcatttgcaatataggatcaacatgttcaagtgacaagcatgacttgccttgctctgctgctggagaacctcggcaactatttcgaagtacaccggagcgtcggaagaaccaaaatctagcgacatacaaggcaaacattgcaaacaggctataagactactgaaacagggaacaaaaccatttttaatggactctacacatttttcttgatttactgagacttgaatgggcttaaacggagttcggatgaattagatatgaattttagaagattcactgtgtttattactataacaaaaagtccttaaatcatttattgcgtaataaatcccagggctagcgtcagcacggggggaggaggcgcggcgccgacatgcggggcccaccggtcagcggctcgggagagggaggaaaggggcgccggcgagcgggcccactcggcagcgactcaagggggggacggttcaccgtggaccgggaccacgcgggtggtccaccgccggtccacgggaccgacggcccagatcgcccccggggttgatcggacgggcggcggcgacccggctcggcttggctcaaggctggcccgccagccaaggcgatggcgacggtgtgcgcgtgcgaacgcgttgccggcgacggcaactggcggcggaggcgacggcgcaaaggcgacgcgaaggcggtggctctaagcgggggctaggaaggagagggaggggaatagatgggggaggaagcctcaccgaaggtgctcggcgcgtacgaagactacggctaactgcgacggcaagccacgggatgacgacggcatccgacggacgggcttcggtgtgccctagggaacggtgagagagagagattatagagagggagatgaacctctgcgaccggcattcatggcggtagaggttgaactcaccggagcgcgagggaatgcgaattccggcgacgaaactcgacggggaaggggcggccggggtggagcttagcctcgcgaacccgacggcagcgacggcgcggtgcggcggcgagcctagcggcggccggagtgacgggaaaggcggcggcgggtggatgcacggtgcgggagtgatggagagctcgggagagttcggcgaaatgggggaaaaagggagagagggggccggacgtggccgggagaggcgggaatcgccggccaacgtggagaagtgggggaggagagagaggcgggattcgaaaatcgaatcccggccatctcgggcgcgggcgcgggcgggagagagaggggagtgggcgcgagggatgcggcgcacgcgcgggcgtggccgacgtggcccggaggaggcggaggcatgggcgtggcgggggttgcgggcgcggcggcgcggcgcgaggtgggagacgggtccgacaggtgggccccacctgtcggtgacctcgggagagaggagggggcacgggctgagctggggcgtggcctccggccggcccagcaaggcgcgaggagagaggaggggaa

SEQ ID NO: 42440 - DNA, 2301 bp, Oryza sativa
cctgaatcgacagaaaactctaagggcaaggtaattgtctccttacatggaccttcaatgtcatgtactagcaactacacaagaaaggcagttctgttaattattttttcccattgtttcaaaaagagaaaaaaacatttacatgcatttgttattgtgtaatatcagaccttgaaccatcgacttcatcccctgcaggtatctccaaccaagagaaaggagataatcttcaatctgttccagaatttgtattattcttaacaaatgttgatttatattaaactattacttgagaccagaattcatttcacctcaggcaaagtagtcccacactcgtcctcaaaaaagatcacgtcaccccgtctaacaccaagatgctcaagagcagaatcatcagcaatgcgttcaacaatgaagccaccattgatgttatgtttcagagagagctcctcccggaataacacaccagctagttccacactttttaaatccacctcaaacacagggcgggcaacacagctacagataagatggatttagtctattagtagacaatgagcgctacagataagatggatttagtctattagtagaaaatgagcacgcatgttggcgcgccaaccactttatagcctgtgcttattatttagcaaattgaattttaaaacttaattttaagttgattttagtttttttttcatagatttttttcaacattggattttaaaccgctataccatagatataaaaggtttatccacaaacgttcaattaataagaatatatcgtgattagtgggtttacgtgctagtctgctagatagatcatttaacttcaagaaattgcggaagacaatattacgggaaaatggcatctaaaaagttagtgctggttccattatatagatagtttcagatgtgcagaatagaatctgtgtaatcaggtggaaatacatatcctaaaacaaatatgtcttcgattgccaatttctatctatcattttccagtgaaattacaagttactacttagggcatccacaatgttaggaaaaagcaggtattaagcaatataatatttctatgatctagtaataagcattgtggaagtgggtagtaactaatgctagatagtaagcttatgacccactcataagaataaaaaaacattaaaatctctctcactctctccttccaacacaagatgtgctactactgcatgctgagttggacaaaaagcaactaaaaagcaatatttttttcctcatgggacccactttacaaagacctactacttagccctgctacttattacctagttaaacaagatacattggtgttgcccttacttctgctcatctagttccctgttttttgttttattcatagataaatttagatgctttctcaattttctatttgacttgtacgtaatatagtgttttaatccaaagatttttcaatggtgaaacaacccggaattttaagctatttaaaaaaattaaaaattatgtgacatatatcattaattaatcagttaactagcaaaatttttggaaacaagaataagccactcaaaatttataacattcacatctgttgaagtaaaacaaataaataatgtccaatataccaccacaatatactaataataataacatggaaatattatacgaacaaacatcactataaacagtcagcatgtatacataaacgtacactggctgtgttcttttggaggggttgggaacccctcctctccacacgcaaaacggagagatagattaacgaattattaattaagtattaactataaaaaatttaaaaaatggattaatatgattttttaaagcaactttcctatagaaactttttgcaaaacacacaccgtttagcagtttgaaaagcgtgcacacggaaaacgagggagatgtgttgaggactcacggcaaagaacacagccgcatatatttaaatatacggttgcacaggacatacatagcttgaccccttttatacacaaaaggtaatatgtaaataaatgttgccgtcagacccatacacaaagtggtgtatattcaaccgttcaccgagatacctagatcggctaataccgtctggcacccctcacttaagtcgggttcgtcatccggctaattaacacaaagaagccacacatctcaaataaagaattaatctcaccaaagggacctcaattcaccagaagtattaattttccaccaatcacatagctccacataggaagcttcacacaagaccacaaagatagtagcacaacttcag

SEQ ID NO: 42441 - DNA, 16424 bp, Oryza sativa
  unsure (1)..(16424): unsure at all n locations
attttgaatcccctatgattagtagccaaatagttcttggccaaatactcataccatcactatgtccgctaggaagaggagaagaaaaatcagcaaggagggaatgtgatttacccaaggaagaagaaaggccaatgcattggcgaagatgaacaccgagcgggggcctggaccaacttgtcacctaagcaaaggtgaattcctcaatacttggctttccttttttttttagcacctagcaaccaagcatctgttcccctacacctgcaaatcaccattagggccatcactaaattgcacccatcactgcacaagtgctagagccagagagatgagagaaggagagagagagagcacccgcagccgcagccgtagctgcagcaaccaccaccgccacagcagtagccgcagcagagctgatccacactagcaatggtagatcggtagccatggcttggatgatttagttggggaagggagaagtgccttaggaacagcagcaaggaagaagaagcggaggaattactgctgctgctgccttatctgttcgagagagaaggagagaatggaaggggattaaattgctagatgtacactactagactacacaagtcattaaattgaacctgctaccggaatagtattgtgcagttcaagcttagagttagataaattagctattaaacataagaaagctggcacaataaaataaactctgcagagcacattttaattggagagcatttgtatttcttgtgctgaaattttattgaagcctcagcgtatataacaaatttcaggaaagaagctagagttggaacgtgtcaattggcagtagtatattatttcagtttcgatcacagaaaactcaggcaagtccctctcatttgatcatgttgatagagataattctatttcaacttaaaaacctatttcataaaaatatttctcctagtattgcatcaatatatattttctagaataatgatatgaacgatgatgatatgattgacaagccgatgatgatggagatcatcgggatactagtatggtgggtagggggagctcagggatgagatgattgatgatgatggcaggtcagggctctccctacatacggtgtataaatataaggactaatcaccccatcattcgtatcagagaaccgtatataccgtgtcaaccatagatccgtcttaagatgggctggacctagtaccttatcaagtttattatactccacatgggtacgtagtagtagaatgggagatgatataaaccccatgaatgccgatgaagtgcattccaagcgcatatagtagcgcggtggtgtggagagctgataggctctacacaaacgtggagtgtagtaaattgaagtaggggaaaagttatgtactcttagcatggtgccgtatctagtgaagtgcgacaatcaaacatgttaagagtagctatgggtacagtgatacaagcctgcgcagtgctaaattaaatcgtgattcacgcctgtctcctggattggagtctacggggagttgctacaaactctattcaatgtacgagtgtactctagcttttataaatctccttttgaaaactcttttacaaaatagaaatatactttacttttgatgacaatgaaggtgatgatgttacgtaaggtatagtattgtagtatatagagttatatattattattcatgcgtgtacattttgctactaatgacttgctgagtacgaaagtgctcacccttgctatataaccccctttgtacaggtttgatcccttgcaagagtgagctggattagagatggccttaatactcctagggacgaattaaaggtagctctaactattcctctgttgcgatctctgatggtggattattatttggcaaaataatggttgttaaataataatctatgttctcgcacatttatctttagtgataaaagtgtggggcgtcacaaatggtagcaatgtaaatccttcataccatctttttggatcttagacatatgatgttatcacaaagaagttactttctacgattttgattcaacctgcagtatattttaatactgacagaataaagaaattcaaaactgatggaaaaatattatatacctgaattgcttccatatctcaaagaaggtgcaaataattgagattgaaatgataactgcaccagggccgtctatgtataccatgccaatggtactaccgccagtgccaaccacaggccctccttcaccaccctgcattaaataaataaataaataaataaatactactatgtagatggtaaaataaatagcaagtgtgaagaaaaggtaaatgtatcagtacctcaggaacatcacaatccacaaacatgtaatggtttctccacatcaaagaaccatccgaccacgtgattgctccacgcctcgccaccagggacatattttcgtcccgagacaaggcaagaatttcctggccatactttggggcggacccaaaagcggggacctacaatggtagttcagacgtgatctccaagatggagagattgtagtggcgattcatgaatctcaaccgtccctgcacaatagacttatctgggagatgaacctgtagctggaagatagagagagaaggcaatgcgagaaaaagaaaggttaatggtgtattgttacttatcttaagcacaaagagacggaactaatactaaggatatacaagaaaaggacatcaatttgacaatgataatgtttgagaattgaaatcagagggcagagtaaagttcacacaaagcaaatgcacagcagcccagctacagttagcaatcatttgaccatactatacttaacaaaaatggcaatggaactcggatgatagaaacatggggattagctaatggaaatcggtcatgcacctcgggttggggctcatgcggcttcttcttgaagtaagtgaagagtgtgaggatcatagcacacttggtggctccatcccaactgatgacgattccggtgtgcggagagatcaatttgccctctgaaaaacatacagttgattagaaggtagctacattgctaggagctgataaatacatatttttatatcgggctactgaatactaaacatattttctctctgcgacacattttcccatttgttgctggactacacatgcctatctcggtagctttcttctatgtcaccggcttttccctaagcatcggcagctagttaagcttgatcaataactagttcagcacaaaatccacggtaattcccatgtggagatgcagcatgattttctcatgtaatgctaggtagggaatgcgtaaaacaacgcaattaacgacacgcgacatgctagcacatggctcacttagtagcttatagctgcagcaaatatagtagattcagccagtaaaatctgaacatgcctccaaactcgtactacgatgtgtccatactccaaactaggttgccatattttgggacggatggagtaaattaccagaagatgggaatgaaacgcggacaattgagcgagacatgcccaacaccatgttcttgtgagatggggtaggcaaggcggccgcggtggagggctcgtcttctttatcgcgccggagagttaacttctgaagtcgatcaactgaagaacaagaaatggggagaaattaacatggttaataatgataggtatacaaaaaagaaattgaacaagaaacagtggtggatcgaaagctgaaaccaccttcgagccgggtgatccgggagcttcttctgacgcggggtgtcgtctgcgggtgcatcggcgggagtggccgggacgccaatgtgccatgcccctccctgtgtatcacacctgccgccgccgccgccgacatctgcgcctgcttcttcgccgtctcctcctcaatctctctcctcttcctcttcttcttgttgttggaagagattcccggcgattccaccgcctgaatcggaagaaccagtccaatctgctttgctctggagcgagtcaacctcccggaccacgattcgggactgggattgctgccgtcgtgcgagcggagatcggaatccggcgttgatttggaccgggtcgacatcgccggcgacgatttgggagcgtcgtggccgcctacggtcaatgccgccaccgatctcctcggtttggggggcatggccgccccccgccgcccagatcgccgccgctaggtaattttagggtttttgaaaaaaaataccgtgcgttgcagggttattttaatcttattattgtttttttttctagaaactatatacgagatttttattttaatactacttcatccgtttcacaatgtaaatcattttaacatttcctacattcatattgatgttaatgaatatagatagatatatatgtttggatttattaacatcaatttaaatatgggaaatgctaaaatgatttacattgtgaaacagatgaagtagttccttattgggatgatgataataatgtcgtttttttatggtttggcgagagtcataaaacaattaggagtctaactttcgtcccaaattagcatgtgatgtttttaaaaggatttcttatacgactccttatgtattttcaaaagcaaacgaatttaaaaacatactcagatacggacgacgtaccaaagtatcagcagtatcttcaatttttataatagtatattttcaacattaccaaattttaataatgataatttttggctcaatcaaattttggtaaattggttattgcgtttagtttgaaaccttgtcaaatcttgataaaatttttaagattagaaacttcttgtattatcaatgtttagtaaggtcgtattggttagaatatgtttgatttgttaccttactaattgttattcctttcttcccaaatttatcatcatatataatagcaggggcggaggtagtgtatgggagggagtgtgggagggggtgcttaggaacctgttgaagaaatttttttagttataactcaccatttttcatcatgtgtacacctccctcaatataaacttagacacacacattagcttaaacttgatcaaaagttgactaaattaagaaagaagctccgcccatagagtaaagtatacgaccggtccttaaatttggagcaatgtataaattagcacgtgtttgaagaaaaataaaaacattgttagatcgtggtgggtatacaattgattttatcacaacaatccagtagaagaaaactgtgcaacagtataatcacgtccaaaacaaatgcattaatagaaaatatttaaagaaaacatatttttttgaagcttgaagcaaataatccagataaaaacaaggcatcttttatcattattcttttgggtagtttttttttaatatataatctgcccattctaatttaagtaacctggacacatgtggatttatggctggttattcttttgtacccatagagagagaagagtaaagctttgaatatgcaccaataatactcaagtaattaacaccaaattaaagatgacattaccaccgcatatgtacatgtatgtattaatgtatacatataaaactaatgtatactcatgtatatacaaccgtagcacatatacacatacatactactatacgtatgtacatacacaccgacacaatcaacaaacaaattaaatagccaggtcccgtataaaataacccctattttatacgtgtcaaaaacacgaaacaaaggaaaaaaaaagagaacaaaaaaacaaaagaaaaaaatccgtacacgtatacagcgcaaataatacgctttgtatatgtattacacctctgatgattaattaagcctaatcaataattaaataatgaatcaagaatggctaatcaatcaatctttcgtttgctccagcacgtccaccatgagctgcatcaccttcacctgcacctgcagccgcgcgatgtagtcggcggcgcggaacaggagctcctcgccggaatcctcgccgccgccgccgcccggcacgagtctcctcagcgcctccatcttcctcctcacctccacgcaccgcctcatcctcctcctctccttgttgctaccggagttcttgcaggccgccccatgattactcgccggcggcggcatcaccgccggcctcgacttcgccgccgccgccggcgcggcgtcgcaacggccattgttgatggtggcgtgtgcaaccattgctagagcagtagagcttatattagcgaagtagtaacaatggcgatgattatgatgatgaagatgaagaagaagatgatgatgatgtgtgaaaatggctaagtatgttagagagagggggtagagatggttatatagaagggggttaggagggtacaaggctggagctaggttggaaggttgggggtatatgtgggggaattaggtggcatgaatggaaagttagagattaattattgatatgtgatcacaagcttaattaattgcatgaaacatggctagctattagatgatgtgtggataatgctctttacatgatacaaaatgttatgttaattagtgtgtgagagtgcatgcatgcatgggagaggaaggaggctagctttgcttgaggatgaggccatgagggcatgttctcctaactcaaggccacatgccaccacatgatcatatcatatataccttaacacagccaacaacacaacacctgtctctctctctcatgtatccaagcacaccaccaaaccaaccaaccatgaattagcatgcatgtaagtgcatgcactagctagctaagctaagctcccttttgatttgcctcctcatcacaacaccctggctatacccttgcatcatcaactctctaatatctctatgcatgtgttgtgtgtcatgtggactgctgccacctcagcaaaagttcatgcatgcatagagagaaaaagtctcctctcctctcctgcatcatgtgcaacatgcatttttttaaaaaaaagatgatatacatgtatatacttatgtagctagtgcatggtatataaatgtaccttgtgtgtagttaagtgtgtttagaggatgctattataatatagaatcatagattatactcacattgtgtgccaccatgttcccctatggggagctgatcatgatagccacccaatgtgccatgcaatcagggcaaatggagatattaatttgcaatatattgcattgcacatgtagattaatctccctgatttggggcttgattttgccatgttctcttctcatgctctcccacaatgacaaatattctcctcttggccaccactacaataatatgtacatgcaatgtacctcatgatctctgatcctgcatatatatatctgacgagccgacgacacgtgtcactcgcgccagccgtcgatctgtctatcaacagcgcgatttgcggaacaagattaactatagttggtggtgctgcccatgagcaagcatatgtattgaagatatatgtgcaacttctaggaagattccatggagaagattatgcaattgatcatataattaatgatgatcatctagttagttaattatgttcttttagtgaaattagttaattatgttgatgcatccatatgtggctgcagttgagcaacagccagcaggtttggttggttggttagttaaggttaattaagaatgcaattagattaattggaccgtacaaggggataagtctaccttagaaacaaaggtcaatgtgatttgagttattagtatatagttttggtgtgaaatactactgaaatggacgtcaatttccaggtcttagtttgctttctccaatacgcgttttgttaatcaatcaattagtttattatccctcattctgctgcaaatgaactgcacatgcatgctcgattaatttttcccttttgttcttgataccttaagctagcagctgattcacaaagattgaaatgatttgaataaacaaatgaaaatcgtgaaagttctctgtagaatttcaaaagattctgcctctttcggcagaaatctgttgtagcaaaggagcaaaccgaagcagataataatacactttattgacaaactactaactgtcacaaacttgagcgcgtcaggtaagtttcagatcctaaatttgtgtaaaatattgccattatcacctagtgtcagatcagattattatctcgatgaatcaagcgaggtaagaataatcttcgattaattttccccttttctcttctgataccttaagctagctgggtcacaaagattgaaatgatttgaataaacaaatgagaatcatgaaagttctttgtagaatttcaaaagattctgcctctttcggcaaaaaactgttgtaacaaaggaagcagataatgcactttattgacaactactagctgtcacaaacttgagcgtcaggtaagtttcagatcctaaatttgtgtaaaatattgccattatcagttactgtcagatcagatcattatctcgatgaatcaagcgtggtaagaataatctttgagaaatatttgcactaactaattcctactcgtctcattggaagaaaaaaaaaaaggaacattattctgaattttacaaatgagcccctgacgacctgacgttggcctgaattttacaaatacgtgtttctgcgtttgtttcgatcgggaatttcacacaagtccctgtttatttcagagaatcctacatttttgcaaatgagaccttataaaatagtattattccatgtcagcccttttcgtatctcctactattatacgcgatcagatcaagccgttgattccaagatcgacggatggagatgcttctccggtctccaagatatttccgccgccgatgaggctatcgcgattggctcagtgaagctgcagccaccggagaagccatggcgccgccgacggcgaggtctctgctcgcctcccacgccgccgtccgagccgcggcctccgctcgcaggggccgcctcgccggcgaccaccacccgccgcaggtcgcggccctccggcgcggggactgggtcaagctcatctgcggcgccagcttcgaggtagtagcacacttccgcttccttccctgcaagcgactgagttgcgagttgtagaagtggggatggaggagcagcgctgcgaacggagtagatatgatgagaaatgagagagagagagagagagatttttttttttttgctcttgtcattttgttaattttgcaaagggaaacccagctcaattgacctgtcaaggaacgatttctgatgaagttggtgcaaatccctcgtctcggggacatcgattttgaatttatattgagtaatgaaactagcaatggtgatagtgtgaatggaaattgtgaaatgcttgggatgtgattttcttgttcttgtgtaggatgctgccgatgtcaggaatctctcccttgtatacacgcttgccggaggtatgcttgttgctctaattataaacatttttgtggagcatatatgtagcatttcagaattcagactggcatcataacataatgggtggtgtttgaaaaatatcatgtcaacttggtaaaatagctgttttcaggaggtggttttcctagcgacctccttttgtttcgacagcttcttgtcggaattcgaagtttgtaaatttgtgcatacccttgatcttaatgaaatttggtccgcctctccttcggcagacctggcaaaaacttggtaaaatagctgtatattcagtgattccattgtgctaggttaatctactcttgataatcatggactgattttgtgtatgcagtggattgcattgattgtgcagcagacgcatctgtggtgggtgcagtgaatgaaggtattgatgtagcagcctcaattgtgccagcagttcaaaggccatgggtgatggttagtgttaatgacgattgcagagatcttcatttccgtaaagctggtaaatgatgtgctctttacaaaagttgtactctatattttgagtttatttttggatatttgttaatgccactttgaaataacagtctcgtttttattatcctcatttgagtatggaaaatttgaaattaaaagaaagttctgctgtatcatgttaaatgaacttggtttcctgctttcactagcaagacctgttgcatgtttatggatttctgaatacctttgttctttgcttctaaaggtttccacttcctttctcttttctctagaatttgatcctgaggattgcccaccagattgctcaaagccatgtgagaaagtctgtcctgctgatgcaatattgttagagagggttatgattgaggaagagcactctcagtctgatccttcatgtggaaaacttgaggtatcaattggtttgtttactttattctgcttttgtttattctcttcatttcattttatgacctgacctctgatgtcttgtgtagggtggtgtaattacggagcggtgctacggctgtggacgatgcttgtcggtttgcccttatgacagaataagtgagcactgagtaatgcattccttcgtttttcctttatggcatcatgacaatagtttacatgacctttgttcccacagtgttctttacatgtatatgtagcatccctatgtttttaagcataatctgatacttccacgcctttgtgtatcttatagaagctacaagccttgcttgaaaacatttcaggagctatgtcgtatgttcgagatcctgctatgactgctgaactgttgaaaaggaatgatgttgatgcaatagagatacataccactggaaagtacgtaagtttttctttgatgatttttataccaagtaacatttaccttttctccattactcagaccacttaatctgaactttttttgctactgtaggggaactgatatgttcaataccctctggagcaacttgggtgagtcaatcaataatgtgaagctgattgcagtaagtttgcactttgtttcatgatggatatgtttcctattgcatttaccatcataatgaataaaaaaaaaactcatacctttcaggtcagcctgcctgatgttggcgattcaacagttaatttaatgaatgcaatatacacaacaatgcagtcccatcttcaaggctataatctttggcaggtttgctatgaagagaacaaatgtatcaactgcagattctaatttgtctgtacatgatcatactgttcataactatacttttagcaatttgaaattctattaggacaattattttcttggtgttggctagttgattctacattctgtttttctgtaaatgctttgctggtccacttcatgtcataatctgaaccttatccatatccatatccatatccatatgctcaaaatctgaggttattcaagttaccttatttatacaagcagttagatggccggccgatgagtggcgacataggccgaggtgcaacgagggaaacagtatcctttgctgttcatttgtcttcaatgtcaaataggcctcctggtaaacaaagtcaatctttagaaaaaaaaaaactcgttatggctttgttatcatccacatttctaagtattttctaataatatggttttgaaggcttctatcagttggctggtggcaccaactcatacaccatagaatccctaaagaaagctggtcttttccaatctacaacttttcctggtattttgtttacttttttttaacatgtcaccggattttgtttactttgttccttttcttgttcaacttatgaggtcaaagaatactttaggcaaaatcacattttaagcccttgaactattaaactgtgtgcaattaaacctatgccttttgaaactgagcaatcaaactaatgttttatattctggtaatatgtttatttaatccatgaactatccaactttatttatcttactgaaacttaggggcagcaacctctggagtgactgattgtcagcaagcctttattggagggatagcttatggcggctatgctcgcaaggtttgctcttgatattacatttacagtgttttttattggaatgatactaaagtattcagcaaatacctgctagaatagaaaggctaaagcatagatactgtcagtggacgcaccaacacctagcaactagttaaatgaatgttgatctctatttttcttatttatgagttgcatttctcatccgataggattctaagtgaaatcattgctagaatagtcttgtatgtcatgttttgctcattttgttttttcttatgagttgcagattgttggaagagttctacgcaaaataccggcacaatttggccatgcacgcattgaggaccacccagattatctcctggaagcattacaagaagctctatcactagtcgggcctgtgaaaggttacccaaccttgccaagtctctgaaactagtaaatggcatctccaagttctcatccagatataggataactttgatccagttagttagtatggaagttgcattgtgaaggtaagccaaggtgagaaggtattctgccaactgattgcccaatgaacagtttgggagttgggaccaaccatttctggctaagtggcaaaaatcagtaatccaacagtcagcagatcaatcactaacttactcttaagcttggtaagtaggagatattccatctgagattggatgtcacaacatgctttccataaagtccatgtaaaactccataagaaaggtgtaaaaatccatttgttgtttgcatgtacaccttgaatattctatatagttcagtggacaacgaaggttttgacgtggacatgtactatagaataaaataattcaactttgttgcattttaaatggtccagaactccagattctagatgccaaaatacttctagaaaagatatattgcattttttttcttaatatcaggtcaattggatgtggatgatctttggataaggaatcttataccatgagcggtcgctctcgcaataggcacatgacgttttggactgatggtgcacgcatatattattatgtatggtgtttttactttcttgttttgtaaatacaaattgaacaacttgcacacatgttttgcttttttttcaagggacccaattggttgtcttattgttgattgagaaagaacatgtgcaagttgctaaattttgacattttatcttggagcaattaaatttaaagttctacaatttgggtggcattactatattattgatggattataaataattgaaaaggtctcttattatgcgtttggttgaaaatatggaccataattaaaactttgttgcttgttttatcaccatttttcctcttcagaaaggaagtgcacggtcaactcatcattctgcaaaactagctgcgccttttctttttgaaaaaaaaaatcttagatagaagaaatacaggttcatgactattttgaagaacaggaacagacaaattaacacttgaatactgattgacaacaagctaacaagataagaggaaccaaacaaaaaaaataaatggagaaacacatgcatggctgactgcttgtcaacgtggatcatcatcatacagatgctggccagctgtcatgcagaaagagcacaactctagacaatttctctcctttttcctcacatgaaagtaaaggccctgtggctcaacaaataatgtgaagatctctcattttcattttccttcttttccctagagaaagtagtagactgcaccaataaatatcctaacagttactcttcaattatatgttaattatatattgtttgactcttttttaattaaatttctataagtttaatcaagtttgtagaaaatataccgctattttcaatacaaagtaaacatattgccaaggtatatttaatattaaatttaatgaaactaatttggtgttacagatgttgctttttttcccaaagaactttcataagcaaaatatcaaacgacttataattttatgggggcgaagagagtatttattaagaaagcataacagctttgattataagccgtaacctttttagcaattaaaagtaatttatgtgtaatatatttacatatgtgtttttataaaatcaaaaatcataaaaataaaatataaatttaaaatttaaactttgactacgattgataagccaaagagcaaacactataacttttttaacacatatttgcatcaacaaatatcctcttattgaagaaaaataaaagtttaataagaaaaatagattaaaaaaccatccctggcatcaagataggcatgtctaaaactctggatcaaacaaatatgcttatgaatttcttgtttgagaataaaatagtgaaaagagaataaagggagaacaagcaggcgagtatttctaccttgcttccccatcccttccagcacagtgacctccacaagccaagaagctgcaagagcaagccaagccaagccaagaacgaagcagcagcgagagcgaggtgagcagcgagcatggcgggcgaggcggcggcggcggagcggtgggtgggggcggcggtggacttctcggaggggagccgcgcggcgctgcggtgggcggcggacaacctgctccgcgccggcgaccacctcatcctcctccacgtcctcaaggaccccgactacgagcagggcgagaccctcctctgggaggccaccggctcccgtacgctcctcctctcccttctcttccacttctacctcccatggcgctcgcgtagtcgcgttactgttcttgttggttgatccatccatcccatccgaatcgaagtcggatatgatctgcatgatgatggattccacgcgtaggctctgttcgatgaccagatcgagaggattaatcagtgatgcttttcagcttcttttgctgagtgattcagtgatttactcttctcagtcactgtggactgcttcttggatttttgcttatttggcgcgtagtagatgatgtttcttgattggttacttaagtttgggtgatttctttgtgtgaggttgggttagtttgcccattaccataatggaatcgaccgttgatttaccagacaccattttgtgcaacccagaaacgatgattgactagtggattggccgataatttgttgctaattgtgtactgccagctcctgggatcattcaccttgatatccttcaggcaaaccatagtgcatcatctttgtctcatcaaacatttttgcaagaacaggttacttggctagttggctagtggcagaatcacggcctagtgtacttaccattaatgggtgactgtgtatcttcagaatctttacccacatcctgctatatctccagtttaagattcggtgaacagtttaggaaaaatggtagatagttcatctttcatatgcagttgcgcacaatgtccatgtttcgcattataaagatagatgtcacaagctgtccaaacttttggagtttgctcctggtcaaaaaaaaacttttggagtttgcagctagagtatttacctacactgcacttaataatactgtgagtattgaaacactcatcagtgaaatattttgtcatgtacataaatggtaagtattggccatgtatttgtgctttgcgtcgccagcgcacgctagttgcatgtgagggattatgttatgctgatctcttattaaggtgtgtgtttgcatgatgcatttccaattcagactacttgcaagtgaaggattctgttttgttgatatgttattaaggttattctgcaattaattattattcactcagtgctgattattctagtctgcaaacaaggactgcttaacatcttgatttcgttgggtttttttaatatacagcattgattcccctctcggatttctctgaacctacaattgcaaagaaatatggagcaaagcctgatgccgaaacattggacatgcttaatactgtggccaggcagaaggaggtgatcactctctcaataccatatggttcaattaattggcactcccttgcaatattataaggtttttggttcttttatacaggttgtggtggttttcaaagtcctttggggagatccccgtgagaagctatgccaagccatcaacgaaatccccatgagctgcttggttattggaagcaggggtcttggcaaactcaagaggttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42442 - DNA, 6875 bp, Oryza sativa
ctaaaaaccggtgcaaattgactatttcggtggtttgggaagacaaaacaggttgaccgtggtcagacttgctgatcagcataggctaccgtagaactcacatgtcaacgcccactcttcttctaccctctctttcttctcttttactcccaaccaagccaagcagtatgggaggtggccacggtgagcccctcggagcacgttcgcctatccaccatcgttcttgtagctcggagaggcctctccgtctcaacaccgtcatcccttgatccagttttcatagttgagcgagtctctgtacctgattttgcaattgagggatacgattcgacgagtacaatagttgagggagctaaattagactaattctcaattaatatagctcagtgatgtcaaaatatgcaaaagtccaaccatcgagtcactcctctattggcccgtcttccattttttattttagcacaacaaatttgatcttttttccttttatgcatttatataattggaaatttggaattacatttttaattttttttgttcctgttacatttttaatttttaattaaatgtaatatcaacacggtgcaatacaataacttttaagttaaatagaagttcattttctccactaggatacttaaagaattttgagtatattttttttataactatcgtataataatatctgtaactttgtgttcattcatcaaaatatggttttatattaagactatgctattcactagaaaaatttgagagtgtacatcctgaaagtatgataacaagagagattttctatcattttgtttacgtttgggccaattattttcctcttagagattataagagattcaagtgcgatttttgcagaagtccctagaaaataaatgtcatatactaaaatttatatagaataaaatgctttacctataaaatactgttttagtagagagagagagagagagagagagagagagagagagagagagagtaactgagtcatctataaataactcgtatggaattacctagctatgcacaattttgtccaatgtcaaaaacatctcctatggaattacctacgcacattgttgtctaatgtcaaaataactcctacgctatcatatcgttttcgttttccatcgttgtcacgctgtcaattttgcaggcctgcaaaaactactagagtacaaaagttaaaactattttttcaccatggatggatggatagatttatatatgcaagtcctccaagatgtataccagtccaaaccaaaaactccaactcgcaatattaattcacactgaaaaatttggggaagattcaatatataatttccactcttttaatttaatttcctatctaatcttgactgattcccgtttcaactggagaggagatgggagtagatgcacggtgccacaatcgcgaaacgtgaataatgaaacgagcgaagaagttaggcagactgaaggccatatgagtatatgacatacacacgtgacgtcgggtacaatatactccctccgtcccaaaaaaaaaacaaaccctgggtttgcgtgtccaactttgactgtccgtcttatatgaaatttttttataattcgtatttttattgttgttagatgataaaacatgattaatactttatgtgtgacttgtctttttaattttttttcataattttttaaataagacggacggtcaaaaattgggcacggaaaccagggtttgtctttttttttgggacggagggagtacaaagtaaaatttgacgagaggcaaggaccccacttgtcatacactaaatccaccctggtatacatgacactaaaagtaggcaaggaccccacttgtcatacagtaagggctcatttgaatcgcaggaatgaaaaaacacaggattctgataggaatacaattgtaaaacagagaatttgtaaaacacaggaaaaacacaggaatggccgtttgattggaccacagaaaaaacataggaatctgatgggagagatagatagactcagaggaaatgttccaagaggttagacctcttgctaactttcctccaaaatatgcataagattacccattccatagaaattttaaaggattggataggattcaatcctttgtttcaaagaccttcgtaggatttttttttccataggattgaaatcctccaaaattcctacattttttctacaaatcaaaggtgccataaatccaccctggtatacatgacactgaaagtatatattaattatatgatagcaatagattttctatcgttttctttacaatgtcatggaggttgaactttcaactaaagtgatattacctcgtcaaagaaaaagtgatatcacctccatctcaaaatattgcaacccggatctggacagatatctagatttattatagtaggaacaaattacatcctaaattacaatattttggaatggaggaagtaataagagtaatttgaaagtgtgtggaaaaggaaactttagctctttatgtgcggaacgcagcctaactacctaagtagacactacaggaatattggcacgcatgttcaaaaaataataaatatggtacctgtgaaaaacagacttttaatagacaatgagagagataggtaactgagtcatctctaatttctaactcccatggaattactagagaagccaaacaaactgcctctaatgtcaatcagtttcgctttccatccttctcatgctgtcaatttatcagtcaatcacactacaaaattaacataatctcttttttttttcttcaccatggacgatggatatatagatagatagatatatttatccgagtcctccaagaacaccaaacgagaagctccaagctcgcaataattcaccaagaatcgcaccacttttcaccttttcttctcctcctccatttccatccatggcgacgctgctgctgctgctgcacacggcgcaacagtgagctatagctagagctcggcaccacgggttagcaatggcggtggcggcggcggcggcggcgaggcggcgagatgtctcttgtcttctcctcctcctgtgcttcagctcgtcaatggcggcgaccggcggcggcggcggcggcggcgagcaggaggctgacagggtggcgcggctcccggggcagccggcgagccccgccgtgtcgcagttcgccggctacgtcggcgtcgacgagcggcacggcagggcgctgttctactggttcttcgaggcgcaggcgtcgccggcgccggagaagaagccgctgctcctctggctcaatggaggtctcgatcgcttctgctttttttttttctaaaaaaaaagaatttgctgcagtaaaagctctgttaaatgttaatcggttaaaaattctgttagttaagtaagtaattactcctagtaaaaactacagtttctgtttgttcttttgtgtgtgcgatatgaaaaattcagatattttctcttgggtatttgttctgtggagtacttgtcgtttatgtttgtttagttttgagatgaggtttcaggttaaatttgtgatcattggttaatctgaacttctgaagagctgcttattgattttttttctttcaactgatcatattgcataaatataaataaataaatgattgttgcatgcaacatttatgttctttcttgatggttaattaggaatatttttttttctaaatggtttgttaattttgttcttggttttgtcaggacctggttgctcttccattggctatggtgctgcatcagagctagggcctctcagagttgcaagacaaggagcagcactagagttcaaccagtatggctggaacaaaggtgcagagtttattttgtttcctttaattcctgaattatttaaatatttttcatgcttaacatcactgacatttgtctttagtataattctgaaaacattttttttgtgctataaaattggtctttgccagaggctaacctcctgttcttggagtctcctgttggggtcggcttctcctacaccaacacatcctctgacctctccaatcttaatgatgattttgtaggtaattaagctgattgtaaaatgatactctagtttgcttggccatctacaggtgatctgaatttcgattgccttgtaataatgattagaagtgtaattttgtggcatcctttttttttttgttgcagctgaggatgcttatagtttcctggtgaactggttcaagagatttcctcagtacaaggacaatgagttctacatctcaggggagagctatgcaggtaaactcatttcagaaatgaaaccggtaaattttctaatcagttttgtatggtctaacattcagaattcttcattttcatcaagaaattaaaagatttcctaaccgcaacatattacaaaatctggtgtgagacatttttctcatttgttctcatgtggatgtaaacatgtccaagatgccttcctttcaagattccagttatctaatcaaaatggaaggcagcatcccaatccttgaccaaaattttcttatcgtttgctttcacaatatctcaaggattgtatgtatcgaattatgttagtgtcaccatcttatctgaaaccagaacttccactgaagaaaaaaatcatcactgactttatagaactagctgacacctatcatgagttcatgacagctcttagttcagcaatcatccccttagcaagcaaacaaaagatcatacttttaatggtgaaagtgtcagatcaggaaccaagtctctaaaataatataaggtttagtttcagccttctcaaatattcctgaagtacaatattctcagagtcatctgattgttcagaattcagaagaaatttatgtagaattcagtaaaagatgacctgcttaaacaaaaggtagaatgatttcagttgttacttgcatttatgtattgaggacagaaattataccgatgccatccgaactgatagattttctctgcttgaaacaaagtttgagtttttggattgtaatattggtccattagatctctgaacatatgtccctgaaagaatgaccaaagcatcagtggtaggttcacgggctacattgggcttctttcacaatccacatgctgtggaccagaagatgctctgcaaaaaaagcttttgttctgcacatcatgcaagatgaatctcaatctgaacttttcctgtgcaatgtccctgttatacaggtcactatgtgccccaacttgctgaccttgtctatgagaggaacaaagacaaaagggccagcacatatatcaacctcaaggggttcattgtgagaatttcttgaattgctttcagtaattattgttatggttttgccaaaaagttcttttatgtgaaatgtgctcatgtataagaaaccatatacaaacttagaaagtagaaagaactgtttactctcaccgtttcatattgcttgtcattttagctttgtcttaagtcaaacattccttacaacttacgccataaacttttactcataagatttatgtttttagattgaacaaaagaaatactttcataatatataattcacatgttcttaaactatatgaatttacagaaattgatggtcaaagttaggtatattcgacttaggacaaaactaaaacgacaagtaatttgaaacggagggagtattttgaacaatagtttctcagttgtaatgctcacaggaacacccaattggaacacgattaacttccatttaaaccatcctaaactcataaaattggttcctgcatgaacataacagtcaaaaaatctgcttgcaggtaggcaaccctctcaccgatgattactatgattcaaaaggtttggctgagtatgcctggagccatgcaattgtgtcggatcaagtttacgagcgcatcaagaaaacttgcaacttcaagaactccaactggactgacgattgcaatgctgcaatgaacataatcttcagtcagtacaatcagatagatatatacaacatttatgccccaaagtgccttctaaacagtacttcagcatcttcacctgatcgtgcattcttcgcaaataaccaggtaaaactgatccatatgcaaaaaaaaggataaagtttcattctggaccctcttctgaaattcatgcatttctgtgttttgacaggaacaattcaggtggagaatcaagatgttttcaggctatgatccatgctactcatcctatgctgaggactacttcaataagcatgatgtgcaagaagcattccatgcaaatgccagtggactgcttccagggaagtggcaagtttgcaggtgaattagcccaaagatttttcagttttatatttcaatgtattagccattaattcttttagcttgacaggaagctgagctcatccatttctttttgcagtgaccaaatcctcaactcttacaatttctcagtactttccatcctacctatatactccaagctcatcaaagcagggctgagagtttggctctacaggtttgcctcatcttaatcttagacctgttcaattaaatccatttttcagttttttttatcattcacctcagatcttccccattatcctccatactacagttcttgtacagtttctctgaaaccttgaaattactgttcaaatatattggtagtaatatgcatctacataaaaaatatgcaacaatgccctacaatttacctgaatcagtctctgttcatcaaagcagcggtgatgctgacggcagggtcccggttatcagttctcggtactgcgtggaagcactcggcctaccgatcaagaccgattggcaatcttggtaccttgacaagcaggtctgca

SEQ ID NO: 42443 - DNA, 11026 bp, Oryza sativa
aagagatacaggcaagaacacggggacatgaacaccaaacttcgttcaaaaaggaccaatcgggctgaatatatatgacagtcgttcatatgaatattagcagttcagccaaaattaggtaacatcctaggttaaacgccccgacagaagtcatcaagtcaaagaacactcgaattacataacattcactaaattatcctctccaggtaacttcagtcttgctgtacatcctcaagccatcctccgtcaggcaacctaaaattcaacacatttatcgctgcttaaggggtaaaatctaggtattaaaacaagcaaagtagaacaattgtacaatagtttagagaagtttacctttcctgagctgactttaaattctaagggtaaggtaattgtctccttgcatgtaccttcaatgtcatgtacttccaactacacaagaaaagtaattttgctaattatttttccccaattttgtaaaataaataagtaatattttttgttattatataatatcagaccttgagaaccatcgacctcttctcacccaggtatctccgaccaagatgaaggagataatcttctatctgttcacgaattttaaaaatagaaatcacaacacatttgtattattcttgcataatattgattacttgagacaagaattcatttcacctcaggcaacatagtcccgcacttatcctcaaaaaagatcacgtcaccccgtctaacaccgagattttcaagagcagaatcattggctatgtgttcaacaataaagccaccttcgatgttatgtttcagagagagctcctcccggagtgagaaactagctagttccacactttttaaatccatgtcaaacacagggcgggcaacacagctacaaataagatggatttagtctattagaagaaaatgagtgctagtgataagatggatttactctattagtagaaaatgagtgcgcatgttggtgcgccgaccactttatagcccttgtatattatttagcaaattgaattttaagacttaattttaattgattttaggtattttttaatcatggattactttccagcatttgctttttcgaaccgctaataacatagatataaaagatttatccataaaactaataagaatatatcgtgattagtgggtttacgtgctagataaactttttaactttgagaaattgctcaagacgatattatgggaaaatgacatctaaaaagttagtgccatttccataatatagatagtttcacatgtacataacataatctgtattaggaggaaatacatatcctaaaacaaatgtcttagattgccaatttctatccatcattttgtagtgaaattacatgctactacttacactgctcatctagttccctgtttattgttttcttcatacaggctactactatacccgtatgtagtgtagtggttttatccaaatatttttcaatggttgcaacataatccttgcttccaattttcttttggcatttaaacatacaatattatcgtaatgaagttaatttcttcgattttgattcaaacggcggtacattttagtactgatggaataaagaaatttaatactgatggagaaagagtatatacctaaattgctcccacatctcatacaaggcatgaataattgagattgaaatgattgctgcacaagggccgtctctgtatactacagcaatgatactaccacagtagtcaaccacaggccctccttcaccaccctgcattaattaaaaaaataaataaataccactaagtagaaggtaaaataaatagcaagtgtgaagaaaaggtatttacctcaggaacatcacaatccagaaacatgtaatggtttctccacatcaaagaaccatccgaccaggtgattgctccacgcctcgccaccagggacatattttcatcccgagacaaggcaagaatttcttggccatactttgctgctgacccaaaagtggggacctgcaatggtaggtcagacgtgatctccaagatggcaagactgtagtggcgattcacgaatatcaaccgtccctgcacgatagacttatctgggagatgaacccatagctgaaagatagagagagcaggcaatgggagaaaaaaaaggttaatgccatattgttactcattttaagcacaagaaacagaattaatactaaggatatacaagaaaaggcctgacaatgaaaatgtttgagaattgaaatcagagggctgagtaaagttcgcacaaagcaaatgcacggcagcccagctaccgttagcaattacttgaccatacttaataaaaatggcaatggaactcggatgatagaaacatggggattagctaatggaaatcggtgttctacacttggaccaagaaattaaagaaactggcaggcatgaagagtcatttttagcaattgggtttgcccctacttaacaagaacaataatggaactcggatgatagaaacatggggattagctaatggaaatcggtgtcctgcacatgccccaagaaatttaaagaaatatacaggcattgtaagagtcatttatagaaactgaattgaacatgatggttaataataacagattacacacatatagaagccacagtatatatatacagaagctgcaggaaaagaagcctgcacctcgggttggggctcatgcggcttactcttgaagtcagtggagtagatcgtgaggatcatagcacgcttggtggctccatcccaactgatgacggtgccggtgagaggagagataaattttccctctgaaaaacatccggttgattagcaggtagctacatacatagctagaagttgatataaattcatattttgtatcgggctactactaaatacatattttccctttcgttgcaattcgaactagacattgtctatctcgcctacagctaattaagtttgatcgatgactagattagcactacatccatggttaccatgggagtagagagcagcaataattttctgattttgactgcataagtagatcgatcaatctatcagacagtaaagtgggttgactcagttgaattagaagtagatgttaattaccagtcggtggagatgaaacacggacgattgagcgagacatgcccaacaccatcttcttgtcagagggggtgggcatggcggccgcggtggagggctcgtcttccgcatcccggagagttgccttccgaagtcgatcaactgaagaagatgaagaagagaaaaaaaatataggtactcaaaaaaattggggaagaaacagtggtggggatggatggatcgaaagctcaagaaaacctttgcgctgggcgatccaggagctttctctgccgatgcgcggtgcggtggagtgcggctgcggcgggtggatcggccggcgtgccaaggtaccaggctcccccgtcgtcgtcgtcgtcggaatcactgtcgcccgcgactcccccgccgtctcctcctcgatccttctcttcttgttgttgttggaagagattcccggcgattccaccgcctgaatcggaagaaccagtccaatctgctttgctcgggagcgagtcaacctccccgaccacgatccgggattgggaatgccgtcgtgcgagcggagatcggaatccggcgttgatttcgaccgtgccgacatcgccggcgacgatttggggggcatgtccgcctcccgccgcaccaatcgccgccgccgccgcgcgttttttttttcttcactttttagctactagaaaaatgcgaagtatatttcaatcttattactactatatttattactaatgtatagtactccctccgtttgacttttttaatcaacgtttgactactcgtcttattcaaaatttttatgtaaatataaaaatacttatgtcatgcttaaagaacatttcatgataaatcaaatcacaataaaataaattataattatataaattttttgaataagatgaaaggtcaaacatttatcaaaaagtcaacggcgtcatacattaaaatacggagggagtatatagtttagttaggatgaaatttggagtactgtacgttcgcttggatatatattacctccgttttttaatagatgacgccgttgactttttctcacatgtttgattttttctcacatgtttgaccattcgtcttattcaaaaaatttatgtaattataatttattttgttatgagttgttttattactcatagtactttaagtgtgatttatatcttatatatttgcataaaatttttgaataagacgaatggtcaaacatgtgagaaaaagtcaacggcgtcatctattaaaaacgaagggagtatatttttagaaaatcatgatctacaggaagtccgatcgtcttaagttagcatatgagtttttttaaacagatttcttatatgagtatgattccttatgtattaccaaaagcaaacgaacttaaaaaccgacccatacacaaataccgtacaaataccgtagagatatagattaaaaccaaaacataaaattaaaaccgactcaaacacagataacgaaccacggaaacatcttcaatttttataagcgactcaaatatggatgacggaccgcggaaacatatttaatttttataatagataatagattttcaaccacaccaaaatttaacaattttactatatatttatcggtaaattttcttttaaaaatttgacagatgtaattacattacatagtgtagcacaatgtaacttgtatataactttcatccgttagattttgtttcaagatttgtgcaagtgaggaaggaaaaaagtcagagcacgtatttatgagaggattcgttcccacgaccttctatttcaccgaaatagcatgttacggagagatttttttaaattacatacaagttacattgtagttacatgcaaattacagtgtaattattttacaattatactataattacatctgtcaaatgtataccctctgtcccagaaaaaagaccaatcctatctacgaatttagacacgtgtatccaggttcgtaactagaatttattttttccaggacggagtagtaggtgataccaaatttaatgatagtaaattttagcagattcaaattttgatagtattaattattgtgtttagtttcaaatgccatgtgcttctcgagcgactttttgaaaacaaagcaatcctccagagaatgtctatctgttttgtgtatggggcaccatgatttctttgtgtcgctgccttgtgggtccgggcgcttgggagggttcgcgtattctgctgcgaggacttccgcttgagctttccttttcccgtttttgcgatttttcttcttgctcgactcagatgtgtctgcggctgacttcttctctcccccagtcttcggtttgtcgttcttgcgtcttagtgcgtcatcgacgtgggcacatctttcaacgatctcgaataatcttcgagtagttgtgatgcgccttgttgccaactcctgggtagtgtagcgatctctgacaccagacttgaaggcgcgaattacagaagcgtcagtgatctcggggatggtgttcctgcactcgttaaagcgcctaacgtattccctcaaagattcacttgagttctgtgttaacgcgtgaagatcgtcttcgatcgcgtgacgcttgtatgttccttggaaattggcgacaaactgatgccacaggtctgaccacgaagaaattgagtaggggggagatgcatcagccacgaacgtgcagaacccttcaacgcggttggtaaatagtttgccaatgcattggcatctgctccagcggcataaagcattgtcgagtagacttgaaggaattcttccgggtcggtgctcccatcatacttttcaataactctaggtcggaatctctcaggccatcggacatcacgtagggaacgaccgaaagccctacacccagcgcttggagcggtgggttgtcggtggtcgcatgaccttcgtggatgtcggtctgacgatgaagaggacgcggatgatgacgatgatgacgatgggtcgcttggttccggcgtgcgattacgagggtgacgacctggatctcgggaatcttgtcttcatctctcgttgttgtctcgacgctgatctccttcatcttcgtcgttacggcgacggccgtgaccagtgttgtctggccctcgccgatcgcgatcgtcatggtctcggttctcttttgggcgacttcctcgatcatggcgtcgtgaggagacatgacgccgggagtggttcgcgtcatcccgtgtgcgtcgtgcttctcggcgtccgttgatttgatctcgaagatcgccagtgccacgaggtggaggggtagcttgtcgaggtgattccctccgttctggactttcaccgttagcgtcgccgactggcgatcggttttgttgtgctgcggtgatggcttcttcgaacgcattgctgaggttagtcaccgatgcccgtactcgttccgtccaacgctcgaggtcgttgttcagaacgggatcgtaaggtgtttccctcagtatggcttgaacagccctgatgtgttgggctggggtagtcgattgattcgccgccaccgcattggcttgtgctgacgtgccaacgtcatcgatagccaacacctcccgcgccgcgtctgacgttgatgacccatagtcttcgaggagatgtaaaacagatggttcatggggattgagatcgattaccccaacgaaccgatctagggctggagtcgctccttgttccttgctgttatcccggatggggacgtatgacttaggagacggagttttcatggcgccgagtagaattttgcaactcgagaggtcgtgattctttgtcttatggataggacaatagacgttccgagttggagaagtacgctggatcccacgttctttgcaggcgcggatttcagcacgagcgttgacgaatacccagtaatcttgaagagtatgtttcttggttttatgaataggacaccaagacctgatagtttcggaagtcatctttgctggcccgcggtttgtgtcggagggacaaggcctggccgcatcagaatccttcacgaacttggatgtagtcggtaatccgttctccgtttcaacgggtggatttttcgacgtggaggcgtcttggttcgtagccaccgcgttctcgttcccagtcattgggggaccggttgagatcggcattgtggtgtaaaccgggtagacgatttcgccgacttgagtccataccagcattgttgaggtaggaagaacttgagcggagctggtgttggcgttgttgtcgacgaagcttgatggcatagtagtagaaccttgaataccaagtccccctacctggcgcgccactgtcgacgggggatacccgtagaccggatatagagggtattggggtacgctggtataaggatctacgtagtacgacatcaagcaaccaaaagacgagaattatactggttcaggccccttgataggtaatagccctaatccagttgatatgggattatatggtggaaaacacagattacaaaggaaaagacggaactcgggggattcggcgagattgtagtcgagatgattcgactagctctcgtcgacttggctccttgcaggctccgacttcataggctgtgtgggttatgttgactctgagattcgatgatctatgccctccccggggggtcccttttataccgcaggttgggtgctctccgagtaggactcgaacataccagacctgacacgatacgtaggtaacccaattcttgtccgagaaggtctctccccgtccattgatttcacgaagagtttccttagatgccaaaagatctattcgtgtacacgtggatatgccatgtcgatacatgacgtatatcgaggggtagagggtatgcctgacccgtaaccctgacaatttagtagaatttttaagattagaaacttctagattattaatttaatttagtaaggtagtattggtaagagtatgtttggtttgtaataattaaaaaaaatggtaaggatataaatatcaacaaagttaacaagctcgtatatcttcgtcccactcatatcggattccttttatttttttttaacaaattttataaaatcacacctattattatctaagttgtataaaattatagggattttagtacgtgacatgtagctatataggtattgtggttttaaagttcataaaatcacaccgttaaccagtttaacatattattatatcaaaattttaaaatactactcctcccgttaaaaaaaataaatctagaacgggatgtgacatattctagtataataaatctgaatagagatatatccagattcgtaatactggatgtgtactagtttaattttttatggacggatggagtatataacaattaaacgatggataaaaaatttataaattttagatgtgatcttagaactcacggtactactgtgtgtttggcaaactgaaaataaataaatgtctactagctccaggtgatatacatggccgtattactgatgcctagacctacgattcatgtaccaacatcttgattccaattgtttatttatttcgtttcttatatatacaagcagccgttcgaatttcaatcacgacgtttgatcgttcgttcactactacataaccaatttatttttacgagggcccctatacattgcagcacaccgtaactaattgtgcctataaaaatcaatctctattttcgcatatggcttcttaaggacccagcaaaaatttattttcgtaaacggacctcttaaaaaaccatatgcaaaaataagtctatttttctatgtggatctcttaaaccgcaacatgagaaaatatatttttttagacgggtctttaaaggtccgtaaagtctgacttaactcctttactctcagcacctcaaatttttttaagtcatcatcctcgtctctctcctcgtattattgcaaactcctctctctcccctctcattgaaaggcgccaatcggatagtatccaaatcaatttgaagtgcgccgtaaattcaatactctggtgaatattattttaaatctgttgttgactacgcctttattcttttgttattttactccccattttcatattgtaagtcattttgggattgtctagtcattttttttaagtttgacaaagttcacagaaaatatagcaacattttcaacataacacaaatatactataaaaacatattcaatgatggatttactggaacaaatttggtcttgtagatgttatttctttctttaaacttgatcaaactttaataagtttgacatagatcaaaccaaaaatgtctttagtataaaacggagggagtgacactaagtaaattatactgatatatcaacgatatattggcaaaatttagcaaagttgaggtggcaccagggaaaaatgccccaacaaaagatccaaaagacaactgtaattcgagcaaacacctattgagatcacccgtttcttctgcagtgaccatacctcaactcttataatttctcagtacttaattccatcctacctacatattccaagctcatcagagcagggctgagattatcatgcacctcagattatccccattatcctccacggtacagtcctgtgcagcttctctgaaatcttacaaataactgtacaaatatattggtaatatgcatatataatccaaaatatccaacaatgacctacaatttacccgaatcagtctgttcatcaaagcagccgaactgacatcaatacacatcatgtgaatgtcattactagtattcatgctgaaacatcagcaaaacattgcaatgcaggtttgtggaacaaccataggggcaagttaccaagttgccgcgttcgtttggaacagttgggatctctcacacgcgcatgcataataaagcaagtcattaacatatgattaattaaatattagcttaaaaatgaatcaatatgatttgtttgaaacactttcctgtaagatgttttttttgcaaaaaatgcaacatttagcagtttaaaaagcatgcgaaaaacaatggagcagatggcatgagatatgctactaggctgctaggcaacattgtatagatagcacgagatacaggcaacaatgtggggacatgaatatcaaacttcgttcaaaagggaccaatcgggctgaatctgacagtcgtttaaattaattagcatagctcagccagccaaaattaggtaagtcctaggttaaacgcccgacagaagatcatgtcaaagaacattcaagtaactaacattcacaaaattatcatctctaggtaacttcagtcttgctgtacatcttcaagccatcctccatcgggctacctaaaattcaacacatttgtcaatggattaaaacaagcaaacatgggcaattgtacaatagattagagaagtttacctttcctgaatcgacagaaaactctaagggcaaggtaattgtctccttacatggaccttcaatgtcatgtactagcaactacacaagaaaggcagttctgttaattattcttttacccctttttttaaaaaaatagtggtattttttgttattgtgtaatatcagaccttgagaaccatcgacttcatcccctgcaggtatctccaaccaagagataggagataatcttcgatctgttccagaattttaaaaatagaaatcacaacacattttttgacaaatattgatttatattaaactattacttgagacaagaattcatttcacctcaggcaaattagtcccgcactcgtcctcaaaaaagatcacgtcaccctgtctaacaccaagatgctcaagagcagaatcatcagctatgcgtttaaccataaagccaccattgatgtatgtttaacagagagctcctcccggagtgacacaccagctagttccacact

SEQ ID NO: 42444 - DNA, 3923 bp, Oryza sativa
tgcaagttcagattacctccaaggtagttctgaggaggatgttgtatgttatatatctgctgtacagaaacaaactgggctccaacctaactgggctccaaccggctgatgttgttgattaactggtgttctctacccagtcagtatcggctgaactatttgctgcccaatcggctggaccacatgctgcctgattggtgtatgctgaattggttcaacaatctgctgagttggcccaaacattgccgcaatctgctcttgagtcagcctattaatattctgcccagcatgctgaggctgctctctagtcaagacatgaggattaaccacctgtctttgtgccgatgatgaagcaccaggtgctggagccgaaactgatgccatcggctagaccagtggtgcattggatacgggttgctggttaccagtcaccaaactcctatactgtggaaatacgccatttggtagaaagactggtaccgtgttttgatgctcaactatcgtgccatcaaccacagacttaaccatattcgttaaagtattgacaaggacccctgattggttgatcaaagcatgttgaaagcatagtcaacatgatcttggaaattattgaatttcaagggctcttgctcctcatcaccatcttcatccacatcctcaacctcaccatctcgaggttcctcaccttttcacctgagccatctgcagcacctttagtccctttagctttaccacctttggatgagcttgttccaggttcatcggcagcaaccaccttcaccttgtacttttgaataacttttccctggcggtttccccgaatgaattcatgaattgctcctaagcactcttcatcatttgttcaaactccttcctttgttctagtgataatttgtctatagtgaccgggacgatgttcccttcattaacctcagacggttgctcgggcggtggcttagtgaacggaggtttagttttgcctcccgttgctggtgactgtggtggattctctgccatgaggaaacgttgtcgcaacttgagtcccaccggacgtgccaaaagcgtgttgatgcgaaaaacgcacactggcctggaagatctgcttaacttctgtgcaggtccaaaatcttgcttttaggttcgtgagcgtgccagttgatttgatcctacaatcaacaagaaagaaaaacaagaaaaaccgtggttaaattcataaatgatagctgatcggctagttgccgatgacatatcatttatctttgagccgatgtcatattggaatcgatcggtagtcatgaataaataaaataaaactaaatctactcaatcggctgtagatattaatgacatataatccttccttcgatatatatttaaactaagtgattgggatagatcggtcgctatgccgagacagtataaatcacttaagtcgaaatatatattaaagcaatgattatatagacgtttatagcatagccgattaaatagatccagtatgtatcggctaatactctgataccactttaaactaggatattagaacaggcagaatatatcaaacaggagcctaatatacttgatgcatagacttattaaagcaattagttataatcaagctgtgagaataaagaacagatcaggtagatcggtgaaaccccatctatatcttcgatgatataaacagccagatttatagtatagattactaatagatcgactcaaccgatgcacattaagcgtaatataaatataggatctaggcagagatgaaacctataagagatggtagatacacgatataatctaaataataacaaaacataactctatcggtactttctaaccgatgacaagttatagatcgcaactagcggagattacaacgtgtatatgataacttgacgaatcacataaacaagattagagtgtcataaagatggaagcactaatcccgagaacgcaaggcgccatgacaagtttacctctagttgaagatcgtaatcgatgcagctcaacccgaaagtaagaactcgtcgaaatagaacgaaagtaaaaagggtggtgatgcactgaaagtgttactgaactgttgttgttgattacattgagttcgggtcatatttatacccaagatacaaaatatgtccttgccggacacgactcttatctctaacaaactctaagatatcataagtctttgcggcagacttttgcccaaacatatctctaagaaaattacacgaaatatcctaattaatagatacaattgccttgttcagagctctatctctatcgtggcaatcctcatgaagcacattgatcgattctagaaacagccccgaagccatctttatcagaatcggctgtaccgaccccatcggctttatcagttatcctctgtccgatccatctctgccgatgcaaacgccaacaaatgccttcgcaaccgatgcatactctgttcttcgagtctatttcttcgccgaatccgcttcgattccaatgtcgaacctggttcatatcttaccaaatttggtcgttaacacggaggtattaaagatgtgggcgaagtgctcgcaccacagtgctccgggcgttttcggggcgacgtgctcaattccgctgatgtccacatcatccggcgctggtcctggaaattttgcaaaaacgtcctcgcttaacttgacaatctttcttaagtccctcaatgtaagtttactgtcttatgtattcttacgtaacggccatctgtgtcctagtatatcctacgtgaaggagacgaaattcctaatataggaccgcactctcagaaaatgaaaagaaagggttttttttttgaaaaagataacatccctatcccctcggttcgccgaaccctagccgccactgttccccaccctattctctcctccttccccttgcatgacggcgccacatcgtcttccctccttcctcgcttctcctcgccaacgacggtctccaatcgcgctctccccgcccccccatcttctacccctcttccgaatcaagcaggggaaagagaacccacacactcctcttctcagcttctcttaccttaagagcagtggcatgagcgagtcaacttaatctcaagagggaggcaagcaatctgtgctagggagtggatcaaagagggagaccgtcagtgggcagggaggggcgacgaagtcgcgagccgccataacggggacatggagggaagggtgctagtatgctacagagctcgcctatgtcactctttcatccttttcttgtcaaacatttgtagactaaaaaataaaaaaaacactgcattatttttacgtctaatatatacgaatctttggatcacctctagatcgaacaattatttaggcacaccatggataacaatcataaaagaaaaggcagaactcatagaagtttaaaataaaatgcaattcttcaaattttgtatattatgttaagtgcctcttgagaaaaataaaagacgagcctaaatacctgcagttaaagtaaataggacagcattgttttgcattcctatcagatgcatgataatacgttatgtatatgtgtcttagtttggccatatcacctaaaggatcctcgtttagcttatcttactagaaataagcaaatcctataccctacagttttataagtagtggacttagaatacatcgcaatatagtcatctagtttacttcaacatctaattaatggatggcttaatctggcacatactctggtaactggtaagtacagtatacttccttgattatataaaggttgttccattatgcaagaaaggaggcaaaacaaataaatacatagacttgcaattcctaaatatagttgaacaaatcaaagtgccttcataaaaggcagaaacatccaagacaacttcctatttgtaa

SEQ ID NO: 42445 - DNA, 34687 bp, Oryza sativa
  unsure (1)..(34687): unsure at all n locations
aggaactccatacggtccaaatgattcttcaaaattttggcctcgcgacaggcatggtgaccaatttatccaaaagcgaagtctatgccattagatgtgacaccctcgacttataggatatctctcccccttcccggcacagatgaaacacttcccttgtacctactaggatttccactccacatcaggaaactcagaaaatcagatgttcaacctctcatcgataggttctcagctaggctcccaacatggaaaggaaagttactaaacaagactggtcggacggttctgataaagtctaccctctccgccctcccgacctatcacctcactgttttcccccttaaaaaatgggctgaaaaaaagatcgacaaaattcgtaggggcttcctctggacagggtcagaacaggcacaggggggacactgcctagttaactggaagagggtctgtagaccaaaaaaacatgggaggccttggtataacaaacctcgaactttttgggcgctctttaagactccgctggctttggcaggaatggaccgccgtcgacaagccttggcagggatcgagtcttccttgtgatgaaacagacaagcagctgttcagagcttcgaccacgataacccttggaaatggcaacaaatcaaaattctggcatgacagatggttgaacggatcacccctgaaagaactttacccttccctctatcagttggccacaagaaagaacagatcagtggcacaggagatacaagggaaccattggttgaaacagatgagacgaatgaataccacaacacaggttagggaattcatccttctatggcaccaaatccaacaagtggagttgcaggaaggaatagacgatgcgatagcttggagatggactccaaatggatcatattcagcaaactccgcctacaggatccagttcgttggaggcatacaagacaataggtctgatttcttctggaaggcgaaggtagaaaacaaatgcaaattctttggttggctcatgattcacagaaagatcctcacagccgacaaactccagcttcgtggatgggacaacagccacatttgtcctctgtgtggagtagaaccggaaacagcaacgcacctcctcatggaatgcgcctttgctaaacaggtatggagacagatatggctaaaggcggggctccacatgcctgtggcttccaccttcgatggagatatgctacgatggtggtcaacctgcagaagagagatggccaaagaacaaagaagaaattttgatggcctcttcatctgcacagcttggggcatttggctacagcgcaatgcaagaatcttcaatggcacttatagcacagtgatgcaagtggttgattcaattatcgctatgtgcaaagcctacgtcggagcgcatgttctagatgagtagtgcacgtactctctgttggcaactttttgtgacaagtcgacaagcacgatcgcaacacctaaacgccttgcggtgatatgaagtcgccaaccacctcgatctagccaaatggccaaatcaagatgggttttgcaaaaagaaaagctaaaccggctagcgaagccgatttagagatcaaaatcagcctctaggccgatttagatcgatatgaggataactacccgtctcgtgggcaaaacggaaggttttcaggacaaacctacaaagagatgtcgcactctcgcagcggcggcggacggtttacggcgcaaaccgacaaagatggactaaaactagggtaaaatagaaaacatagtaatagaacgattcaagtagattgtattcgggggttttacaatgaaccggccttgtcccttaaataggggttggtcttgccctctacaggcccttctccacatccaactcgggatagaaaccaaaggaaacacgaaacctgccttcccgagtaaggaaacccgtcactttccaaactttggcaattttcccctatttcgtccataggtgccaaatttgggtgtaaacacatgcccccctgcctttttggtgaacagacgtgaacctaaaagcatagaacatgttatctcagggcgataatccaattaccggccataggacttcctaagcatcttgcaaaatgctcgggaagtatttcttcaagtatttcccattaatttatccctgaaaacaccgtcttgaagtgtcttcatctccctcaaagtcttcaaacgctcgtcgatgacatcttcaaaaattacttcccatcaaggtcttgtaatcttcaaccgacaagtcgccttgcttgaaataccgaagagtgtcaagatttacctcaactggcaaaacggcaatttcaacaatgttttattactcgactcggcttatccattagcctgagcatagtaaagagaagaactcaacaacttaatatcataagattcggcaaaacttctcacttccttggacataaaagaagctcctttaatgtttgaggaataccgaatctatgaacgatatgcttcaaaataaagtcaattacctccgcataagtaatattctcgagcggcacagcctcggcccacttagtgaagtaatccattgcaactagcacgaaccaatgccattttgatggcgaaggataaatttgaccaatgaaaaccaaagcccaacctcggaacagccatagtttaatgatagatttcaacacagcggtaggcgttaattgaacattgccgatccgttaacaagcttcactccctctatagtatttgaaacaaccatcaattattgtcggccaatgaaaccccactctcctaagcaaccaatttatcttacgggccgattgatgaattccacaaatcccttcatgaacttctctcctagcaactttagattgatcattatctaagcatttcaacaatactccatctatttttcggcgatataatatttgaacgcttgccgccgaatcttccgatcaatcttaagtgtaggatctttcaaatatctaatcaaaggaattcgccaagctatttctatctcatgggcacaaatgtccgaattcacaattaattcggccttttaatcaactgtaacgtgccccccagcctcctgtctgggatcggtcagaccggccacgcaatgccggtcggaccaccctgtctgcccggtcagaccggccatgcagagccgatcagaccgcgggtaccaccggtcagaccggccgtgcaatgccggtcagaccacccctggtctatgactttgtcaatttcgtccaaacttttgaaatcaagcatcggcctttagtatataatttttttttcacataatagccagatgcttggtatatcaaattattggaccaaaattccttctctctagacatatgaaaaattataacattcaactaatatgtctagatgaatactaattcaattggcttttgaaacaataatcatcatgacatcaaaacacttagccaattgaagcataatcaataatgaatcaccaaagtcatatgtgtcacatgcatagattccaataaactaaaaatgtaagtaatcggcttaagcatgtatgcaaaatattaacaatgccaatgttcctaaatacaataactctagaacaaatcatcacattgaccattgacattagccgaattactaataagcaaaactttcatgatgcaataaatatgaaatatatatattatatggtgatccataaaaacacatatgatttggctttaaataaatatcaaagactcatgagccaaatcatacttcaaacaaattatatgccaacctaccaattccactacctagaactagcatttgcaacatgtatgcataatatcaatttgataagcaaaaacacacatgtgctagatatcaagcaatgttctaacatggcataggcatataatataacgttgaacacaataaacccataccttgccttagcatccaacaaacggcggctcaaagatgtgatgttgtatccatcgccgttcatcttctcttggttccctcatgagcatattaatgtcttgccccccgagcaaaatcggctctcttgactgcactatttcgaaggcaagacaaacaccgcaccaacattcatagcaccatgcgaaggagacttatctctaatgaccgatgattcttctctcatcaaattggatatatcactactttggaaaatcaccgatctcttaacttttacttctttaggtctccacactcgcttaggtgtcgttcgaggctctaaattattacatgttttgttctctacatcttcggcctccttttcttttttacctatggcccgaagacgttgtaacctcctcttctgagaacgagataagccagaaggtatccacttcggctgtggttgttttctaggagctaaacaatgattcttaatattcttggtcgaagtagaagctcctatgttgctctcaattttcccgctcttctccaatgctccccggttagaccggcctctgggcccggtcagaccggctgcaagccatcagtcagaccggccaggagggtcggtcagaccggccgttgtctggcggttagacctgccagacgcctcggtcagaccgccgacgttgacagtaacggcgccggcttcagtcttctccacttgtacaatttttgccgcatctccagtaggtacatgaacatcttgagactcctccttgacagcaacgacctccggagctttagcttctttcctcacccacaccttcttcacctttgatccaccggaccgattcttttgtgggaaacggtcttgtcttgaattagatgaatgattcggtactgacctaggtgattcctcccatccttgatgaaacggcgtagagaattgaggcatccatggcatgtaatacataaaaggataaccatatagtgacattggatatggataccatggcattacaaccggaggtttatatggagttggtatggttgatggctccgatttctttgatgtttgaccaaatctcttcctacgagatgatcttagtcttttcgaatcactagtttggttatcaaatcgttgaccggctaatcctttcttgtatttagccataagcatctcaaaagtgagcttcggctttttggtcttttgggaattagatgacccatcctttgcaactttatgatcttcggccttcgcatttttgatcctattcttgggccgaagatccccaataataacacttttccctttctttttgtctacatcaataggactaacagggagaggatcactaacaattccggtcttaggcatagatgtaaccgaaatagtctcacaagtgaccgatgaatcatcaaccggtcttttctccatcaatcttgcatctttaaaataatcatgaaactcatgctccatttgtgaccatgtacaaattgaactaggagcaagcaaactataccatgtagatgcaaagtttgacaaagaaaggggaaacaacttcaacttaagcaaatcatcgctaccggccttaccacattgatcaataaagcggccgatatgctcgattgtagtcatagcattctcacctgtgaatttcgtgaagttgggcacctcaaatccttgcgggtatgggaccgaatctacatgttcaggatatggcctttgatatgtatgcatagctactttggattctatttcaccactatcccgtaagacattgtcattatcttttccaacatccacatgaccgatttgtgattcggtcttaggtgacaatgctatttcactttcgcttgtgatacaatccgaaccgtcacttagttcggctatatttttaatgatgttattctctaagctagcaacacaatctaaaccattacttggttcggctattccatcgttgtctaaactagtaacacaatccgaatcatcgcttgattcggctataatggttattgcattattatccacgctagcaagataatccgaaccaacatttggttcggctataatcgttatggcatcattgcacaaatttttaacacaatccgaatcgtcgcttggttcggctacacatgatattgcactatcatataaactagtatttaagctattatcatccactcggctttcctgagccagagcttcatgcaacacatgatcaatatcaagaaatatctggccattcaatttctctttaatagaatcaagcaatccatcatatgcaatgttggccaaatctttgtcagttattctcaaactaaaacatcggcttttaatatctctaaacctttcaatataatcagcaatagattcattatatttatgcctaaccgatgttaaatcaaacaacttaagctcagtttcattagtgtgaaaataatcatgaaatttttgttctgattgagcctaggaagaaatagaatttgccggtaaagaagtaaaccatgtaaaagcagtaccggacaaagataaagaaaataagcgcaatttaaaagtatcactattagcctcaccacattgcgctaaaaattgacctacatgctcccatgtggtcctactatcttcaccactaaacttggtaaattcgggaactctataattacgaggaaacggcacatcatcataatagtcaggatacggcttttggtaaacattagcacgattcctagtttcagtcccgaatctattcctaataatctcactaattatatcctccatattattaggcccatgttgatttggcggtggattaggtggcctaataggttgtgtttgtggcgcaatatgattatattggccttgtctagtatcgggaggataccccctagcaacatcattataaacattaggaacatgtgggggaacttgaggactacttgtagcagtagatacaggaggatcaaacgttttaaagtgatacaaataactagcattagtcatcggatctataccctgtattggaacaattgcgttggtctgaccggcccaaggcccggtctgaccggcatcatgatgtgcggtcggaccggctggccggtctgaccgccggggtaatacccggtctgaccggccggctggccggtctgaccgacggctatgttacggtctgaccggtcgtcaggctcggtcggaccgaccatgaacgccgtcccgtcagtttaactacccattggatctataggagattgatcaacagtggtataggctttatcctttaatgtgtaatcatccataaaagagcctagcctactccttaaaaatccatcaaccttatccttaaacattacatctaatctatctttaaaattaaccatagataaatctattgtagatgcaatttgttgttggatagattgtgatacctcgtcattacttaccatgtcgggagcgagcttgggacgtggcccgggcttgatgatcacgccttgacgagtcctagtagtagctctcatcaatgcctcccgtgtgagctcgttgatgtactcctccatagttttacgatcttctccttcgaagtcatccaatgtgaccagcatcacattagatggctccgcctccgtcttggatgatggcttcgtcatggcgaagtcgaagttgagttgacgatgaacggatctcctccccagcggagtcgccaaaaatcgtgttggcaactttttgtgacaagtcgacaagcacgatcgcaacacctaaacgccttgcggtgatatgaagtcgccaaccacctcgatctagccaaagggccaaatcaagatgggttttgtaaaaagaaaagctaaaccggctagcgaagccgatttagagatcaaaatcagcctctaggccgatttagatcgatatgaggataactacccgtctcgtgggcaaaacggaaggttttcatgacaaacctacaaagaggtgtcgcactctcgcagcggcggcggacggtttatggcgcaaaccgacaaagatggactaaaactagggtaaaatagaaaacatagtaaaagaacaattcaagtagattgtattcgggggttttacaatgaaccggccttctcccttgaataggggttggtcttaccctctacaggcccttctccacatccaactcgggatagaaaccaaaggaaacacgaacctgccttcccgagtaagaaaacacgtcactttccaaactttggcaattttcccctatttcgtccatagtgccaaatttgggtataaacactctccttctagttgcttctcattttcttaaaattttaccaccttatctcccaggttgccttgatagaagaatgcttgggatcctttgtaatctgggtttgtaaaaaacctgtattgctttttctctactctccttaatgaaattggcagagctcctgccgttgacccctcaaaaaatatatatatatatatatatatatatagttgaagcagagtatgcacaaccaaggcaaacaattgaacactaccattgctattgctccattgtcaaccaatttgtccagaacatttcacagccagacacacagaaggcaaaccagtttgatagtatatctttgcatgcttttgctcaccttttgttttggaaccagaccttgatctgcttggggtcgatgctggcgaggatgggtcactcgcggagcagctgctggcggcaggagaagctaggcttagggcactcagtgtacacccgctctagcgcctccacctgctccggcatgtaccggggtccatcctggctttgtcatacccgtcgctgtcgctgcccgctccgcatcgggcatcgcgagtcaagcccaagtcaaatagaaatcgaagacaaattttgacggcgtaaaaaaaagttcggcaaaaacatgttaaatttttataataactagataaaatacccgtgcgatgcaacgggtgaaaaaaattctaatgacaatatacgtttttcatacatagccatgtcaatgacaatatttgtatggatcgtttgtagctaagacaattagaaaattggaacatcttcgatgtaatggtccaacctcgacgatgacaacatacatcatcaatgcttgctttacctaaaataattggattattcacgtgacaacatacatataatctaacatactctttcgatctcattattgtaaccaataataggatcaatcaaatccaacgttctctcgcatggtcaagtctacacaaaatagagtcactgtgcactcttctctaaataacaattaaaaatatgtttatcttttaaatataatttctatatgatgtgttatcaggaatattacctatatctgataatagatgatgaaaaaaaatcgagcaatccgacccaagcgtctatcaatttagcgttttttctgaccgtttttttagagcagcttgtttttcataaatggtgtttttttcatgagaggttttttcaaacaatttttttagaaatggcatgcttgctttttctaatagatttttcctcgcatgtatttttttattttttagggatgacggaaacctttttagcgcttttttcagacatttttttctcacgcgtttttttgcttttttttctcacgcttttttaaccgtttttattttctcgcgtattttttttcttgttagttgtacgatgaaaacttctttttttagttgtacgatgaaaacttctttttttagttgtatgatgaaaacttctcttttaagtagttagattacattagattagattagagctagaggagagatatatatagggaccacagaaactaatagaagcagagttttttttgccgcattttttttcctacctttgtactttttttctcattcgtttttttatttttcactaaccattttttgccattttcttagggaatcagatagataaaagatgtgattttttaagtagggacggacaaaggaaatgttttgaattttttaaatagtaaagatagagaagtatgcaaaacttatatacgtacgtatgaaaaagaaaaaaatatacagtatataaagtttgtatacgtgtatataaagtttgtatacatgcatagtattaagaaataaaaaaccaaaaaaagggaaagaaaaaaaaagaaaagaaacgaagaaaaaagaaaaacggaaaaaccatacgtacgaaataggattatataggaatatgattttttttccaatttttagatagataaaagatgtgatttttcaagtagggacggacaaaggaaatgttttgaattttttaaatagtagagatagagaagtatgcaaaacttatatacgtacgtataaaaaagaaaaaatatactgtatataaagtttgtatacgtgtatataaagtttaagaaataaaaaaccaaaaaaaagggaaagaaaaaaaaagaaaagaaacgaagaaaaaagaaaaacggaaaaaccatacgtacgaaataggattatataggaataggattttttttccaatttttaagagaatcggatctactgtttttttcgccgctttttttggcatatgaatcggaccctttttttttaaccttgcataggaatcggacattttttttttggttttccccatttttaaggggaataggttttcccctatttttttctccaactttttttttcgtttttatgggaatcggactttttttttggttttttcgctattttttatttagacggacgaaggacttttttttgttttttctctatttttctccgacttttttttgttttccccgttttttaagggaatcggacttctttctctttttattttgttttttacgctattttttattattattaaaacggacgaatgaaacatatctatatatatataatatatacctaattaaaaaatagataaagcttccggttaattttttcgtccgtcattaaagggtgggcccacgcgattttcgccagtaatgcgaatcgcgacgcgtgacggcgattttgacgctccacaaataaaaagagaaacggaaaaaaaaagagagaaagctagcaagcagcccaactaaagcagcagcaggccggcccaacaaaaagcaaacgcagcctagcagtcagcccacatagcaaagcagcagcccagtacagtactgtgcgatactgtagcaaacgtgaataagttcactttagctcccttagtttatcaccgaatatgaaatccatccctaaataaaaataccaggtaacctcatcctttaacttacaataccatgtcaatttcgatccctcagcagtatcgtggccagttttaactaacatggcaagtgggccccacacgggtcatatgtcagtgcacaaataataccacattttgcctagcttgggcagcactagcttaaataatagaaggcttgcccgaggctactacaccaaaaaaaaaaaggttggatccacgtctaccaagaatcatataaaaataacgagcaattttattaatttaaaaataaaaaaccacatgtatttttttaaaaaaaacatgtgatcaccaacaaaatgaattatttacgacaaaataaattatttttagaaaatagaaaacaatcacatgtctttttttaaaaaaaaatgtaatcaccaacagaatgaatcgtgtttacatccaattttttttctattcatcgtatgatttccgtctaattttttgagtgaaaatgattatgcgattggagtgcaatgaggttgatctgatagatagcgagaaacatttcttatattattgctactctttacaatatgtaaaaaaaaatgtgtttatcaatatcaagtaccaaaaaataaccatgtattgcaaccaactcataataatacatgacaaaagtaaatactttttgggtttcaaactttatagtctataatacataattttattttaaagtggtattaatacttttcctataatcattcatgtcaatggatttagatcaacaaataattatgtcatgttagtatcttacttgcaccggaaagattcgatttgctcctacacacccattactgttgtttttgggactatctagagaactgtcgaaagttttttaaggagaaaactttcaaatctaactataatataatttcaatataatttcactatagctataatgtaactcatatataagtattaaaataatatatatatataatatagttacagtgcagttacatagtagttacaatgtagttataactaaaatgtaactcacttaatttttccaaaacatgcagcagatcaagtggctagcacgcatggcttccatgatggggaccctgtgttcgagcccctgcaagcacacgtgtacagattttttttttccaaatctcgcgcggatcgcacggctagaaaatcatctcgcgcagatcgtacggccagaaaatcgaatcgcacagctagaaaatcatctcgcgccgatncgtaccgcagaaaatacaaagtttttagccctccaaactgtcgacagctagccagcaaaaccgttgtttttttttatgtttcacccaatgcaacgcatgggcattttgctagttattatatacatgctaactgtgtattttatagcatttaaccctttattttacccgtagcgaagcacgggcattttgctagtagtagatagaagtagatagagatagaaaagagatagagataaaaaaaactagagataagatgttttgaagaggtatatcaatttgaataagccctacgctccattgattctgggatgtttaacttttatttgacgtcctaggtcaatcgggagtctccttttttttttttttgtaatgtaatttaacgctgtagttcaatcacgaccgttgctttcatctttgccctcctcctcgcgtgccctcgccgactcgccgtcgtatcgtatggttccaccgtcaccctcggccgcccgctcgggcaccgctctccgccaccttgcttgtgggcccgagaacgccggcaagtctaccttctcctagctttgctccatcagtgagcttgttcgctgactagtagtagtggttgcgttctggtgcgtactgtggcaaccggcgaggaggcgaaggggcgaaggataaaaaggagaagatgctcctggtgctctggtgcgggtttctgttctttgttgttgttcatcaatcatcattcaagttgtcaacttccccaggccccaaatccttttgggatgaacatgttcttgatttgtgacaacagttcattttgggacacttggatgactttgactccaactgtaattttcactagtgtgaagtcacaatcatcgcagccatctgttgtctgatttgttcaatcgtttgggcatgatgttaatcgaccgtgatgaaaattatgtaagaacaatgacgctttgacattgggctaattaatgttttttttttgccaggtcggccgaaggaatggcgaccaaatttcattaagatggggaaggggctaattaatgtttatggttaacatatctgcaggttgcacaccgtgcagtgtaggctccaggtgtgtgcgtgagcatgtcagttggcaatctgattggatgcaacttcaaacaaccattcatgattagtacagagttcactagttcagtgcaatttgcagctttgaatcagctgcaattttctgaggaagatgcaattctgctgcttcacctgattttaagagaaaggcgtctgatgttttgaggaaagagcagcttttgacagaatgcttgactctatctggctatctgtagcatactggcatgcttgtttttatagtgtttgatctgcaagctattgcaagcttgcagatcataaacttgcaagctgtgatactcctgtgggatgtttcggagatactcctgcactgatgtttcatagatgtacctcagtttcagagatgttccagtttcaaaaattcgcacctactccatatccacgccaacttcctgatgaccgctttacgttgatgtgaattgacagaattgtctataatgtgaatgtttgcaatttcttgtaaagttaacagcaaaactcttgtaaagttaacaaaataaaattaataaaattatggtgcaataaaggaggttgatttcttccaggtttcttgtaaactgcgagtattcatccactgcatatgcagagcactgaattcaagttcagacactcctgtgctaattcaatcatattgcaagaatggtgcaattaaaaactgcaaatcaaccattcaattattctaaatataataaaatcacttataaatatgctccaaatgagttaacatcactttacacattgaaatctatagtccaaatcaactttaaagatttgggccagtcatctctttacagattttgaactggaaaagagaaatcagcacaactaaccactaaccactatggtctgggaaactattttaaactctcgaggggacatccccttgttgtttgcatgtcacccaaataattatgaaaaaatttaacaagatagattaatatgtgataaatcactccacaaacatgcaaaggtcaaatttaacttctacaagttaaaaaaaacgagagtttagaatctactcccactacggtcctcttcttggtagcattatctggctagagtattccatgtagactgcctccacctgttcagagttactcccaattaaaaggtacctcttcatgatttaaacaaagaaaagaaggacatgccaacctgagagagatatggctcccttctgatattgcaattaggtggtgtccatgatgacttgcgaaaggaagacatgcttacctgaaaaaaataacatgtgctaaatctggttgcatccaggcacatgagcgtacattattctactcctgattctctttgcaaagtaaaaaaaaaatcccgcctttcaaatatatatatatataaaatctttgcacaaggtaaagtgtggagtaactatgcaaccttccttttcaggctactggagaaagaaccagtacataactaatgtccaaactgcaaagaaaataatcatgtgcagcaaatctactctagctcattacctatgcagtgcctgaaatcttgagtaacaggatttcggcaatactgaatcagagcagagaaaaaactgacactatacacaactacacaagccatgagttcatcatgatgtagagtaagccctagtagtatactgaatcggagcttgctgtcttgcagacccaatgatcataaaacactcaattatcagaaaagataatgcaacttgtatgcctctattatttacataggaaatgaagctgggaaagtagaatatttttcatagcagagacgatggacttcagacatgatgcagacacgtgagtgtttccagacaggtgaacaggtgttatcttctaaaatgcccagatagtactccacattgggcaaactgcacagtttaatttcgtggaaattgaacaaactgcacaatatttatttactcctgactttgattcagaaacctgtagatgaacttgcaatgccttgtggaacctcttgattcacatcgacctgcattcttcagaagcacatggacctcttgattctctttgcaaattgctaggcaccaatacacaacaatttacagtatttgcaaattgcccatgcatgcaagaatgaaacagcaacaaaaagaaacggattcctagatatactcccctcagctgccatcttggtctattgcagatagcaattgcaaagtggccatcagacagtcaggtttgcgtttataggctggataaacaagggtgccgaaatgcatctaaaacagcaaagaaccaagatcatgctgttgtcgcagccacagccgcccagcgccccttgttccattgcctagtactgcctagtgaacaactctaattaatagacaatgttttgatgattagccatagtactgcctagtggcaacatgtttagtgaacaattctaattaattagctagatacgcctagtggcaatagttctagtgaataactctctaattaacgggatacagacagacatgttctctaattaactggaatacagatatgcagcattagacacttcagtagcgctagccatctcgacatgaagcgatacacagtagcgcagccaccagccatctctcagtcttcgtcttcgtctttcatctcatcttcgccttccccttcccactgcccctccccttttcactcccactcgccctgccccttcccctacccctgccgctgccaatgcccttgcccctcttcctctttctctcttcctcttcctcatcactttcatcatagtcactgtcgctgtcgttatcgtcattctcctcgtcgtcatcatcatcaccatcaccatcaccatcaccatcaccatcaccatcaccatcacctggcagctgaaaagaagaaaacaaacagaactaggactaaccgactaagtcactaagcaattgaaaagagaaaaggagaagagttaaaaggaaataaaattgaacttacatttgcaagtgcagtatctacaaaagttttcacatcttgataactgattgcgtatccggctttacaattcttttgtataccgtgataaaccgcaacacaacgtgctgccccattcagaattgcacttcccgatgttccggctgcacattgaaactcaggcacttcaatcagattcatcttatatcctttcacattcaagctagtaagtgtgtcgtatcttctgttagtatgactaatgtgcccccaaactgaagtttgtgatcgcaatgctggccacccttgtaaaaagacattctcagactcaactggtggtgattttcctagcttgatacgtgtatggtcctcgggacaaatgataaaattatccgcatcttgatatgagtagtagatatcctcacggttcaacttaagaagcatcagatcaacttgagtgttaaccgcaactacttttgcatcgcagaagtatctgttcagatgctcactcttatcatccactccttggagagaaagaaggtgcctctcctgatggatgcacaagactttgaaaataaatgatttattaagatcttttggggtaaggtcatggttctttgcatcatagtaatcatccaaagcatgggctgtggttagaagataaagtatatttcccctctgctcaataacaaacccagtgcagagctcagtcggaatagtagtttcctctatttcggctctatccagattcttattaatggggagcctttttaagattctacagaagtgacggaaagcagacttgttatcttcctcttgatgcctcacattcacctcgatgttgaaaacagagtgaatagtcttagaaacaagatgatgctttgctggatgagtgagaagatgcggggcagggaagacgttgtcgttgtttaaatcagccatctaaagaaggataggatagtgagatggattttcagaaaaatcaacaaaaactagaagacaagaatgaatgagaacacataaaaagcttaaagtaaatgaaattgcaaaccaaaattcaaaacaaacaaacaaaccaaccaatagaaatcgaatagaaaggacaagatgtgaactcgaaaaaaaagggaaagaaaagaaaggatgtgaacccgttagcaacggcagcacgaaccgaggccaccccagcgttggccgccgcgtatccatgccaatcaggcggcatggatccagggcagccatcgcgtgttgaagctgtcccggcatcgccatgcgtccggccaaccgccggcggcaacgatgggtaataaggcaggagctcaggggagcaggaagaaagaaagaaagaaagagagaaagaaagaggcggagtgaacggcgtgcgtgactcgtgaggaagaagagaagagaagtgtctgtccacgcggcaggggttgagacgtggcggatggctttgtgcttacgtggaggtaactttctttttcttttgtgatgagatggccatcggttttgatggtgggtgggctcgtcaaatgggcttctatgcagtccctattctaatacgaaaagggcccatctaaatggtttactttgaagcccaattcgaagaattcacaggcaggccggtttacattctactaccccagttttggacctctatatcgatccattctcattaggttagggtttttacgccattatcggttctggatctagatgatgtaaaaaagaatccatgcccgaatccgatggaaggggagctagctgttcaagagaggaaggactagacaggagaaaggcgcgcaacttaagttaattaaaatgaacatacactagtaagtacaaaataaaaaaagaagccagatctatttttttgacatctatatatcgtacaaaataaaaaagaagccagatctatttttttgacatctatatatccagatctaggagacaaaagtaatgtatacttgagattagttggtggacatgcatgcatgagatggaatggattacagtagtagaaaagtagcagcagctagctagccaagcagggaaagaaaaccaaatcggcatcacacaggtacagcagagagaacgaaatcaaaatgccaaaagacaactaacatatatataacatatatatagggagtggattctaatccctcgaggggatatcctctcgtataacttttttcttccaaattcgatgcaaatagttgtaaaaaaatctgaaaaaaattgacaatgtagattataatgatacctactagtccaccaaaattcatgttcaaattcgatctacacatcgagaaacaaaaaagaaaaatttagatataaacagtacgctactattcatacgctgaatttgtcttttttatatctcgacgtgtgagttgagtttggacttaagattttgtgaagttgtatatatgtgttgtatgaatgttgtcaaatttttccagaatttttcataaccatttagatggtttttgagcaaacgagggaacatcccctcgagggattagaatagtttcccatatatatacgattgttctacgagggaagaagagggacttaccgttgcaacttgtgcggcacagatcgacgaactgcgtgtgtgcgcttgcgctctccagtccacaacctcgatcgccggcaaagcaaactgtagatcgaggcagatcgatcgacggactgcgtgtgtgcgcttgcgctatctccagtccacaacctcgccggaaaagcaaactgtagatcgcgatgaatggacaagcaaaactttttcaagatgtgttcttggcttcttgcaagaatatatatatatatagtagatctaccaactgatgaaagaaatgatagatgatgcatgcataccgtctgttttgcttgcaacctctcacgagcggagagaagacccggacatctctgcaacctctcacccgcggccagctcctccagtagtgatgagatgagacatgagagagctcgccatggaccggaggtggagaacactggttgttgggggactcaagaacacaggttgctacttgctagggagcattcagtccggccatcgctagctgatgttaatgccaaggagctgcctctagccatgcagactagacttacctgaagatggaaactgcaccactgcccaaaggctgtagagaaaaaagatatggaccaaagaatactaagaatagtactgtgcagaactgcagcagttgccttcaatacagctctccctgcaacacgacatatacgcagcagccttcaactctctccccacaacttcggcgaggataaccgggtatgtaaatatggtgtaaaccttgactctacattcaaaaaacaaaattaattcaaacatgtggacgagatgatattacacaactatatataaacatgcattatcttgtccaaactcggcttcttttgtgagataaaaaataaagaaatttaaaccaagctgatacgatccatctagtgaaacaaagcttccgtttctcatgtctgcgtcattcccaccccagggacgactcgaaaggcaaaaatatgccaccgttgcctccctccctcttcctcctcttcacctcgtccctgcccaagcggctcgtcaacaaagccggacaaccacaaggatagtagcggcggacgctttctccccatggaaacctcaacggctggggtaccatggcccagatctgcgtctcctccactggagttagcgaggagaaccgtggaggaggcggtggcggagtggaagagggcatggaggcggtgcacagtggagtgataggcgacggggtagatggcacggcgacagtgcgtggaggaatggcaggctgcgcgtgggggaggggcctgtgtcgtcgggtttggcatcaccctagccagatctagtgccccgccccccccccctcctctcgtctgcggaggagtggcgggtggcgggggaggagcctacgcggtagtggcgaatctataggcaaccggatctaggtcccgctccggatttcgctaggagcggcgggatgtcgccacggccggtgactgcgggtgcggcgacgacaaggagggcagcgtggctggcaatggtggagctttgaagtggtggcgacgggtgcaagagtgggtgctgtaggcaaaagtctagcttggagggtttcctgagccgacaacaacgacttcttcgggcgtcgtgactctccttggggcgttatcgagcggccacacttcccctctctagcaggactctccgagtgaaaacctagtccggtaggacgggcaacgatggcatctatgacgtcatgacctccctgtagccattgcctagaaggtctttgttcctcgccgttgtcatcttctctcggtttggtcgtcaacggttatagattgccctcatcaggttggagtgagggacgagtggatctccttctctctcgccctctccctctcctcaacccctctacatgaggataatccagagctcatcgatgatcttctgtgtggagtcgatgttcggtgggttgtttgcgactaccttataggtttagcggtgattggcttggtgctagcttgttctcctaggatgtgcaaagagctaccagcttgcagtggccgtgtgtttgttttttttcggctacaattaattttctaagattgtaatcttataatattttcttgcttcatcaatatgaaaccttgcaactgtcttggtcatttgaagaaacaaatttcaaaccaaaaaattgtcctaatgatttttttttcaaaatttgttgcttttatatctcagaaatgaggtcgagtttgtacgagatttacatggttatgtaactatcatcttatccatatgtgtgagtttttgttgaatttagataactttttgttagagtttacaatagttttcacctaagttaaggttccatcgtatatttacccaagatcactagctgaccagccccacctataataatgaaatgaaaagaaatgtagccagtcactagctgaactttttgttaaaattgtcaattaaacaatataaggggagtagatgactgtgtgtatcgacagtgtataaggggagtattactttcaagtttgaactggctaggcgttgatagctaaatttggtacaggttttgttcggttattagtcaaacaattagccgaatgaatttttttggagtaaagttaccgtcgtttcgagttttttttcctttcctttctttgtttttcttccttccttggtataggccggtctggctgagtgcgtcgtgtatcaaaactctattcttctaatttttttttagagaagggtattttctacccagcctctatgtccaaccagatatatacggccattgagatagagaacttagccccgcaaacaacccaatctgaattttgctccataggagatttgaactcaggaccttagggagaagggtattttctacccagcctctatgtccaaccagatatatacggccattgagatagagaacttagccccgcaaacaacccaatctgaattttgctccataggagatttgaactcaggaccttagggtactacttaggtcactgtaaccactaggctacatgcccttttgtctattcttctaatatattgacgtgtaatcattttgcgcgttcgcgaaaaaaaatgaaattttttggcttattatcgatttggttgttagcagatagttgttttggtgttaattaaatagatgcgatgacactatatatatagtcctaactgcccgaactaatcgatattgactacttattgttactgaggacatgctattatactgttacatgggatgcatgtaaacggtctgacaacagtctcgcccatttccataacgatatatctttcgtatacagaatctataacgtagagctggaaaaaaattagtactgaaattaaatatcagaaaattagaaatagaactatacggatgaaaatgtgtcggtatcaacccggaaccggtaactgctgtcgaaaacatgaaactgcaaaatcatcacatatttagttcaccataactatataatatgactgtaaattaattaaaacttacaccacataataaattacaacctatatctctgttttagccgtgtaattaattacattaggaatttggttaaaaagttgattgacttttacactttgggtgaaacagatgcatgaccatataggtattagaaatacggcaattacaatattgtagaaatggtaatttccgcagaaacacagtaattatagtattgtaaaaatggtaatttccatgcatagaaatatggttgaatatgaaaacggttggtaaaacaacaaatcatttccatttttttaccatttttgttttttttgtcggtttaccatttctatttctgtatgggtcggtcggtagaaaaagaaaataagcgcgtccataaattcgggatattctaggtgcggtcaacgggtcaaggttgaagagaaaacaagagtatatggggtagccaagagccaaaagctgttgagagtgcatctgtgcatggaaaggcatcgaagagaagtatggccgatatatcgatcgatcaggacgatgtactgcgaacgggacgacatgcacgctatatatatatttttttcttccacgtatttatacttatttatgctgcgtcattacaacaataatcgaaaatattacgggattggagaagatatccctaaacacaatctatctacacgtagggtacttgggtgtgtttgtcgtgttttcgatcttttgctgtcattttttccttctcttcgtttttgttcgtctcggtctaggcggctatacccttttttttaagaaaaaataacaaaattgttatgtacatatttacaagagaaaattcacacaaaatttagtcgttttaagaaaattcaaacggtcaacttgtaggcaattaacagtatgggtatggagaggatcaaaataaaaactcagtatcatatagaggacgaggaaaaattcatagacacgaaagagattgagtgaaaattcatgagtaagttagaaattttatctatttaccataatttataactctctccggatttataatacttaactttaaccactattttctataataataataataatatatgaaaatatcaactaatatatgattttattgaagtactttttagactaatctatccatatggtctccatttctaaaacaggtattttagaaattatttatagtcaaagattttaaaatgtgacatcaggcctatgcaaaacaacgagtattatcaacatacagagagagctatgttatggaagacaaattacgtttgtcagaccaaaaattaccgttcatcgattaattggaattatgtagaaatttgacgttcgcaaatatgtgtatacactttataatattatgcacttatttgaatatgtaaatgtgtataactatataaattgaatatattcacgttgttttttaattgaacaggaataacttaacattaacttaaaatatatactccctccatactcgtattagaagtcgtttagaataatgtttaagtcaaaccttggaaatataaatcatgaataactctcaagttgttgagttagaaaatgtaaaaattatatgaatagatttgtcttgaaaactactttcgtaaaagtatacatatatcacttttcaataaatatttttatagaaacaagaagtcaaagttatgttttggtgaccgtgttactgttcaaaacgacttcctttacgagtacggagggagtagcttccaacgtcgcatttatacaccaaacattgacatgtttggtcatattgaataagtaaaactaaagagtatgttaaaaataaaacgctaaacaaagtcctaaaagactactttaggtcatcatcaagtacaacatacgggtgattattcggacgattaaacggagaatatggtcgattaatcactaaattaaaacagagttttgacgttcatgaataacaaatgtggatcgtatcacattaaccgaatggatttgctgtcgttacagtatatatatacggcttttttccactacactggtagggagtatactttagcacatgccatctttttctttttactaataatgtttacaaattgaaaggtttgaaagtaaaatataatatttggtgtcattatgatgaccctgctcttttccgattctggactttggatttttttttctctttacaagatgtcaaacttttagtgttgcatccctgtaaaatttttataggaacacttttctaaacaactacaattaatttatttatttatatttggggcctgttcactttagtgccattttcaaccttaccaaattttggtaaagttgcccaaaaagtggctatatttagtttgctgccaaattttggtacctatataagaaatcctgtcaaaattttgacaagtcaccaaaattttagcatagttaccaaaattttggtaaggtttttttttttcaacaaagtgaacagcccttggattctctctttgggctggttggggcgccagccccacctccataatcccctgcctcttgttagctaccaatgactaaacatgattagcaaaagctagttgtatggcaaggatacagagcgctagctgtctcactgcttcatgctagtgcccagagttgcaaataagaaaaataagtacaccatatacctcgatttttcacaaattttgttatatgtcaagtaatatgtttttttcattacatgcgtataggtctcttaggaacaatatcgagttgacaaaagctagttgttttagtcatctgatatttttaccacctcaattcatattctggattcgccactgtttatatccataaatagcaatcacaaaaaatagtttggccatcaatcgtcgtactatctcaaacggagcgaaaaatggagggcttggaaaaaaccgaaacatatttccatggcctgagcaaggtgcttgctgtctgtgcccggacgggaagctctccggaattctagcatccaaacattagcccttggcccgcaaagatatcaccggggcccagcattgtgcagacagcaaagatgcaaaagctgctccctacaagacgacacactctctgcaagactggacacacacactctctctcactctctctccctctcctttgcaatagtctttgttctcatctctcgtgttgctgcgactacacttttgcaaatctctcccgtgtctgtagacccctctcgcgtaaccagattatttctttatcaaacccaaaattcgagtctcacgtcaataaatttaatttagaccaaacccaaaatgtctttgtgtggagtatgaaatggagagagtaacactaagtacattataccgataaccattggtgtatatattagcaaaatccagcaaaattgaggtgacactagggaaaaattccccaagaaaatatccaaaagacaaaggtaattaagtcgagcaagcacttattgagatcacatgtttcttctgcagtgaccaaatactcaattcttataaattcagtactcctattttctatcctaactacaaattccaagctcatcaaagcagggctcagagtttggctctacaagtcatttttcagtttctcaagttacataagggcatccttaatattgagccacacaataaccataagataaaacccacatatcttttgcttaattatagtcaatgttacaatggtttaagttcttctgtttaccttctggctagctctaagcttaaggttagccataacaatattctcttctaaacacacatttctatacacaaagttgtactaatatttattgcttataaacacacctttacatgcacattggagatgccctagcattcactaaattatcttccccaggtaagagcaggtacaataagtctagtcagcaggctccaaaatattccatgtcagcatattcttaggtggaaggagaataactgaagagagagattgaagtgggcgactatttaagcgcccggcgatagcacgtgtcgcacgataaaaaatacattttgtgggtcccgcaaccaccctcatcggtatagatggccaaaaggctcgaggcccgacggcccggcccatggcacgatattttggctcggcccaagcacggcatggcccgacggaggtcgggcccgtgccggcccgggccgaccactgggccgtgcctgggcccctccaccggcacgttggctcggcacggcccggccgggccggcccggcacgatgggccggcacgatgggccggcagctaggcccgatacacagaaaaaataggggagtaaaaatagacatattatatgccatgaacgaaagaatagggatctaaaatagacttttttttatctatacatatgtcagccgaagaggagggacagacaatagacttattttagctatacatatgtcagcccaaagaggagggacggaaaatagacttattttagctatacatatgaaatagcccaaagaggaggaacaaaaatagacttaatttaaaaaggcccgatgggccacctatgccttcgggccggcacggcacggcccgacagctggtgggccgtgcctgggcaggaggtgcagcccatgggccggcacggcccggcacgaagtgcctatcaggccgtgccggcccgatgactgctgggccgtgcccagccgtgcctgggccgggccgtgccgggcaggccctttggctatctatactcatcggatctcatgtctcatacttgtgttcccacctatgttctgcttttcgccttttccttctccgctccggcgtgcgccgatgtgcttggttcctcgccggaatgttggccagcgtcacgtcactacaccggcaatgattcaccccaggagagttcgagagctccaccagctgatttcgagctcgcgctgatcgacctcatgcacgcgaaccgacgcccttgccgctgggtcgatcttctctcggcacgaatcaagcttctcaaacctcaaaatcgagttcttgctgctggggtcgacgccctcccttccgaactgaagcgaatcgatgtatggatggagctccttaatctgtgactcgacataacccaccgctcggtttgctctggtatgaatcagccattgcctagctgcaaaacccatctttcttctttgctattctcttgtttttttttcttttctctcatttttgcttccgtgtgaatggagatggataaaaggataaaccaccagtcattttcttttagttgctgtttctggtgttgatttcaatctaaagctgtgcgggagatgagctaggaaagcaaaaaccaaactctttctttttcttcatcggtagactactcacgctcatgacagcacaaatggctacaaagatggagtacattcttgatcgtactgtgtatccaaaattaattgtttaatagcttctatgtagttagcacaatagccaatctattgtattagttagctttacactaactgtaaaatgacgtggcatttggtaccgtcagcggtgggctatactattgaccttgctctaactagtcttgctgtacatcttcaagccatcctccagcggacaaccttaaattcaacacatttgtcgatgcttaaggggtaaaatctagagattaaaacaagcaaagtaggacaattgtacagtggtttagagaagtatacctttcctgaatcgacagaaaactttaagggtaaggtaattgtctcctcacatggaccttcaatgtcatgtacttccaactacacaaggaagacagttctgctgattattttttaccaatttttttcaaaaaaaaaagtggcatttttgttattgtgtaataccataccttgagaaccatcgactttttcatcccctgcaggtatctccaaccaagagaaaggagataaccttcgatctgttccagaattttaaaaatagaaatcacaacacatttgtattattcttgacaaatattgatttatattaaactattacttgagaccagaattcatttcacctcaggcaaactagtcccgcactcgttctcaaaaaagatcacgtcaccccgtctaacaccgagatgctcaagagcagaatcatcagctatgcgtttaacaataaagccaccattgatgttatgtttcacagagagctcctcccggagtgacacaccagctagttccacacttcttaaatccacgtcaaacacagggcgggcaacacagctacagataagatggattcagtcaattagtagacaatgagcatacagatatgatggatttagtctatagtagaaaatgagcgctacagataagatggacttagtctattaggagaaaatgagcgcgcatgttggcgcaccaaccacttttgtaggccatgtttattatttagcaaattgaattttaaaacttaattttaagttgattttaggtgttttttcgtagttttttcagcattggcttttaaaatcgctaataacatagtagatataaaagatttatccataaacattcaattaataagaatatatcgtgattcagtgggtttacgtgccacatagaaattgctcgattttgattcaatctgtagtatattttaatactgatggaaaaagagtatatacctgaattgcttccacatctcaaagaaggtgcaaataattgagattgaaatgataattgcaccagggccggctctgtataccatagcaatggtactaccacaactgtcaactacaggccctccaacaccaccctgcattaattaaaaaataaataaataccactaagtagaaggtaaaacaaatagcaagtgtgaagaaaaggtaaatgtatcagtacctcaggaacatcacaatccacaaacatgtaatggtttctccacatgaaagaaccatccgaccacgtgattgctccacgcctcgccaccagggacatattttcatcccgagacaaggcaagaattttctggccatactttggggcggacccaaaagcagggacctgcaatggtaggtcagacgtgatctccaagatggagagattgtagtggcgattcatgaatatcaaccgtccctgcacaatagacttatctgcaagatgaacctgcagctgaaagatagagagagaaggcaatgcgagaaaaagaaaggttaatggaagatagagagagaaggcaatgcgagaaaaagaaaggttaatggttactcatcttaagcacaagagacggaactcatgctaaggatatacaagaaaaggccatcaatttgacaatgataacgcttgagaattgaaatcagagggcacattaaaattcacacaaagcaaatgcacagcagcccagctacggttagcaatcacttgaccatactatacttaacaaaaatggtaatggaactcggatgatagaaacatggggattgcctaatggaaatcggtgttctacacttgcaccaagaaattaaagaaattggcaggcatgaaaagtcatttttagcaattgggttagcccctacttaataagaacagttatggaactcggatgatggtaacatggggattagctaagacatgcacctcgggttggggctcatgcggcttctttttgaagtaagtggagagcgtgacgatcatagcacgcttggtggctccatcccaactgacgacgaatccggtgcgcggagagatcaattttccctctgaaaaacattcagttgattagcaggtagctacatagctaggagccgataaatacatattttgtattgggctactaaatacactaaacaacacatatttccatttgttgttggactacacatgtctatctcggtagctttcttttatatcaccggcttttcccttaacatctgcagctagtttagcacaaaatccacggtaattcccatgtggagatgcagcatgattttctcatgtaatgctagatagggaatgcgtaaaacaacgcaattaaccacacgtgacatgctagcagcctagcacatggctcacttagtagctaagttagcagtaaatacagtagattcaggcagtaaaatctgaatatgcctccaaacttgtactaagatgttgtccataggttaccatatttttgggacggatggagtaaattaccagaaggtggggatgaaacgcggacaattgagcgagacatgcccaacaccatgttcttgtcggagggggtaggcaaggcggccgcggtggagggatcatctttcttatcgcgccagagagttagcttctgaagtcgatcaactgaagaagaagcagaaatggggagaaattaacatggttaataataggtatacaagaaattaaaacaagaagaagaaattaacagtggtggggagaggatcgatgacgacggatcgagagctaaaaaccttcgagccggacgatgcgggagctttttctgacgcggggtgtcgtcggcgggtggatcggcgggagtggccgggacgccaaggtgccatgcccctccctgtgcatcacacccgtcgtcgccgtcgtcgaagtcgtcgtcgtcgccgccggcgactcctcctcgatccttctcttcttcttgctcgaagacactcccgccgactcctccaacaccttcgctctggagcgagtcagcctcccggacgacgatctgggactgtcgtcgtgctcggcgagatcggaatccggcttcgatttggaccgagtcgacctcgccgccggcgacgatttgggaccgccgctcgaggccgccaccgatttcctccgtttgggggacatggccgccttcccgccacaccaatcgccgccgctagggttttctttagatcctcataccgctcgagtcggattccttttcttttcttttgcctgttactgtaggagtatttattagtggaataagttcactttaggtccctcagtttgtcaccaagttcgaaattcatccctgcaccgcaaaaccagatacaacgcacccctcagcttacaaaaccaatgaaaaggaggtccctcgtcagtattgtcttccggttttggttctttgtcttacgtggtattgatgtggcgcttatgtgacaattggatcgaaaaaataataaaactactagggcccacaaatcgttgtcaaccaccgtcgcacccgccacagctaccacgctcgtcggcgaccgctcgatctcctcttccggccacctctgccgttgctgctccctcctcctcccgccatcgcttcgcccacggtccgccggcatgctccggctgttgcgcgctccgctctgccggcctgctccctctgcccccgcctccatgcccagctctgcccactttgagggatataataggttggaatgatcctatatattgtttggatggagggatgaaggtgggatgcctggatcaatatattcgcatatgcgcatggtaagttgatcaatatattcttccacaatatagtagctctctttctatcatttttgttgcatgaatcctaaaataatatatgcttaatcactaaaacacatattgttatttttattgttttattttcattatcagatatcgccgtagcgttagcacgggcgtattactggttgcaattagttggggaggttaccccctagtatacatattgcaaaataatactccatccattccataatataaggcacaaccacttttttttagatgttccataatgggagaatagccactatggtccctgaagtatcgttatgagatcattttagtccttgacctttttaattgtgcaagcaagccttcatatttatcatgtggacacacagtcctctgtgcccatcgaaaattgccacgtgggtaagccatgtcatcttccaatgcaaatatatgatgaaatacccaatttgcccttacacatatcgtcatagggaaataagagagaaagaaaaggagaataataataataataaagaagtaggtgatcctgcatattaaatatccgttagagttttaacattgaaatgcaactactcacatgaaatttatttggcatgataattatatatttagtggttgttgctaatttaactttgtattagcataatccggtgaaaaaaagtttgccatatatccagtcgcattgaataaagtttgtaaattcttttcattatttttgtatggtacatggaagggtaaattggacatttcaccatatattttgcatgagagcataacatggcatgctcatgtggcaatttaagtgggcccaaggactatattagcccacatgacaaattataaggactcgtttggacaatataaaaggttagggaccaaattgatcctagagcaaaacttcaaggatcatgttggctattctcccttccataatataaggcatgcatgcatgcatgccattaactatgacatattctccattaattactacttttttaaatccttcactctcacgttctctaactctattggatgtatgcattatatttattaggatgatccaaactacaagatgataattattatttcttggtttttggatgaaggatggttgtgccttatattttggaatggaggaagtacttagtcatgaacaccacactatttgcaaatataaagtgaattgcgtctggtaacaaacaatcaagctccataagttatatagaaaatatgagtcaattgtacccacggtacaacaacttagtaggtgggtgcaatataatgcaaaaacttgagaattaaatatctgagtgcaacaacttgataagtgtgtgcgttctactacgagaacttgacaatttaatattttggtgcatcaacttggctaagcatatgctatgtgagttttttcatgatgtcaaaatgccattgcataagaatcctacggatattaccttaaatattgaatttattctttaagaattatgctgcatatacaattttttttcatgggcttcttcatcagactaatcacttgcttatacactcaataagcgcattagtcccttaatcgtttgtcatcaattaaccaaaacccactaggagcatagatgatctttcacaaaccacatataataatagcaaagatgtattaagtcttttttcctattactaagctaagcatgtattaagtctttgattcatgtaccaacgtcttgattccaattatttatttattccgttcgaatttcaatcatgatgtttgatccttcgttcactgccacataaatgatttttttaaggcccatatacatttcaggctgaccgtaactggtggcgcctgcaaaaatcgatctctattttcgcaatatggcttcttaaaagtcccgcatgcaactctatttcgcaagtggacctcttaaagagccatatgcaaaaataagcctatttttctaggcgggtctcttaaacaaccacatgagaaaatgtattttcggaagcccggcctcttaaaggtctacctagaagtcggacttacctcctccttttccttccgacacttcattttttttagggtaatttggaaccatgccattataattttgcaaagtttgagatatgacatcggtatctcaatgacatgtaggacccacatgagttaatgacacgtgggttaggatggcatatctcaaattttgcaaaataataatggcatggttccaattttccctttttttaagtcatcatccttatctcctctcctcatattattgcaaactcctctctctctctctctcttctcattgaaaggcgccaattggatagatttgatatgatagtatctaaatcaatttcaagtgctttgtaaattcagtactctggtgaacattcttctaaatctgttgttgactacgcctttcttcttttatattatttttactccccatttttatattataagtcgttttgggttggtcctatagtcaatttttttaagtttgacaaaatttatagaaaagatatcaacattttcaacataatacaaatacactataaaaacatattcaatgatgaatttaataaaactaatttggtgttgtagatgttatttctttctataaatttgatcaaactttaataagtttgacatagatcagacccaaatgtcttttagtataagacggagggatgacacgaagtaaattatactgataaatcat

SEQ ID NO: 42446 - DNA, 16738 bp, Oryza sativa
cgaagacactcccgccgactcctccacagtccgattccccacctgttcaatcgcctttgctctggagcgagtcaacctcccggacgacgatttgggactgtcgtcgtgctcggcgatatcagaatccggcttcgatttggacagtcgacctcgccggcgacgatttgggaccgctcaaggccgccaccgatttcctcggtttgggggacatggccgcctcccgccgcaccaatcgccgccgctagggttttctttagatcctcaccccgctcgagtcggattccttttcttttcttttgcctcttatatactgtaggagtatttattagtaggccaaggtgtagtggtggtgggccgaattcgagtactattcatctactcctgagaataagtccactttcagtcctctcgtatactcgtatcctttaaccggattatcttgatccaactattaaagtcagtgtaatttgactcccttaactgtgtttgacttgtactcccttagctgtttttgctgatgtggcttattgacctggtccaactagccaagtcaacacgcaggactgtttgtatttgttacggtcacacataaatccgcaagcgcaccgataccactgtagcacttcaccttagagtattcaaaagagtatcgaactatgtggaacgtgtatgtataatctaaaaacatgattcaaccaaggacaacaactaatggtaagattaggctagagaggatttctatggattaattaatatacttgagttaaaggtaaaactttattgattgtttcgggcaccggctctccacttatctgtcaagctaagtctggtctgtagctctatgacgtagccgaatatggagggatacgaaggacggatagggctatcaccacttgccatatatctcccgagtggggtcttcaatacctgcataatcaacggttcgatgcactcggtcttttataggttgcggaaatgtcttgagtaacatctacctgtcagtgttataggtaaggcatacccaatagtcttggattgagctcgacgggacccaccatatactaagtcttatagggaattatgtctcatatacgaaagtgttccagataagaaagaagtagagttcaagttggaagctacaagggctactcgaatcatatacatatttgtctccctaattctacttggacaagggagcatctatatgtataaatacaagaccccctaggaggagaggggagacgtcaacacagaccaacacctgccaacatgagggacaagtctaggtagacccaatctggagccatagaggctgacatgagggacctaacacaacctctaatctcgagttcatattcgacgaagaagactaccatgtcgtcaactacgtgttggacatccatgccgccaagttgatgatgactagaataggttatcccaaatattgtactcatttgatactgatatataagagcaacaccggcttctatgatcgaacaggagtaggggtgaaaacgggacgggtacggtcggatcacaacattcccatatcctaacctacatcttactttaaattcggaatcgggtacaggtagtgtcgcataacacatcactcatcccgtatcctgtcccatattactttcttcgaatcggattcgggtacggatattttttgtatgtcgaattcatggatatttaatgtaagaagacaattaaagtgctaaaaaagatacatcaaggaacaaattatataatattacatgtgagctcataaaaatagtgattaactaatcttttatcatgtttatatgtgagtttataatagattttcacatatgttttataatataggacatacgggcggatataactcttctcgtatcctaacccatatttttttccggattcgggtttgaactcggataatatagggtatcccattttctctcccatattcctcccgcaagcctcaggtcggtcggtccggcaggaaatatccgccccattttcacccctaaacaggagtatggctattacctatcagttcaggggcctgaacctgtataaaaatatttatctccggtctcttttaccttaatctcgtgtataccttggtatcaatgatcctcatactctaccaatattgtgtcgggatctactccctcgacactaccctagtcaaccctttactcctcatgtccgtgagtttcgcaatgatggcattgactcaaccatttccttgtctgagggcaacaagttccactaagaactatggataggagggagcccaatgaagccaggaagagagaggtcaggatttgaacagtagaaccactcggagtgccaacccttgttgaaagatttcaaaggaagtgaaaagtattgactttttaagtcagaccacaattggtttgtgcgccgctaacaacacagggtcgatctttgcaaggatgtggctttaggaagcaccaacgatggaagaaattgaaatggggaagaatgcggagaaaagcctcacagaggtgactaaagatggtgagttgaaaaatagtgttgggattaaggtggtacagtcgaattctgtaaaaagataacaagcacgggaagaaaccaggggttgggagcccaaatccccgatagaaaaagagtttgaacactgcaatttcgctagagttgggagtcggaaaaccctcaccaactgtagggtgctagatgatgatgtccttggcggggaggatgtcatacttcaccatttccttccacttcttcttcatgatgttggactgctcattccccaaatgggatctcgacttctctctcctcagtcattagtggatagattggggttgagatttagggatctttggtggaggatggagatacaagcgaccgtgacaaagtgtggcggagatctggcgaagatatgcggcgaaaaaaaggtggggatcatatccctagattttcagcgaggaggagcggagcaagcaatcgcaggagcgcgaaggggaaatttgagaggaagatgaagcaatggagaaggcgagaccagcacacgtacacgtcaattttttagtggctccagcgggcatgttgggctttagagctagcgcatttgcggcccaataacaactagtaatgtgctccgtagcgttaacctagcgcgtttgcggcccaataacaactagtaatgtgctcgtgctaaagctacggcgatatttagtgatgacgatatatgtctgggatgacatgtgtgtgcatgacagtcaaatgataaaatgctcttcaccatcagaaattagtttattagacaaccacaaatgacaaaaatatttttaaatgagcataaaaaacgaaaatgctacatgacagtatcctgttcggacgggatgatacatgttcaggtatcaggctaccaggtgatacttgtgaagtatcacgtgatacctgatacctaaccggtatcacactgtccgaacggtatacctgaaagtgcatctaggcccctaatgattttgatgattaattacaatgggattagagaggacacacacacttttcatatcacacacagattcactgtgttcggcctgaccaggggcgcatagtggcggtctgaccggcgtgccctggccagtctgaccgaccacaagacggcggtctgaccggtgcataaggccggtctgaacggcggcacatgcgcggtcagaccggccccctggagactgggagtgtcatgctctggtttgggggatacagagccgacggagtcgtattcggtcagatcgagctgagggcggtctgaccgagccgagggcggtctgaccggccaccccatgtcggtctgaccggccaggccgatggggccctctgacagggctacaacggctagttttctagccgttgcagagtagcacagtctgaccggccacatacctccggtcagaccggtagagcacagagttgggggatttcgcccccaacggctagttttggttggtgggagtataaaaactccccctccagcagcaagggggctctcttggcacccaattcaattgcatacacccttgcacctctctcacacacctttgagcttagtgttcatccattatagtggttgaggttgttctagcctacagtcaagtgcattgcttccatttatagagctagtgtggcacttgattgatcatctccacaccaggtcattgcttgttactcttggaggttgccgccttctagacggcttgtggaggagttgcccggtgacctctccgagaagattgtggaggaggcccggtgccggttttgtgagtggtttggagttcaccgccttcggagtaaaggaagaactaccccgagtgatcgaggcttgggtagtcctctccgtgggccggctcccgccttgcccactccttgacgaagggggcgtgcggtggcttcgtggttgagtggtggagttgggctcgtctcaacggggagtacgaaaccggtgagtttccgaacctcggtgaaaaatctcttgtctccttgtctcatttgattgtcgcatttacatttgcgcaatttacattcctagagactttcttgaaatcatatcaccctaggattgcaaaacattgacataggagtgtgatttactttcctagagaattaattgagccactatcaccctaggtttgcaaaacataacttagttgcttagtcagacttaaccctcaccgagcctagcaacttaggttagttttgattaggtgtcatttagtttttaaatcgcctattcacccccctctagtcgacatctcggtcctacatcatccacctttccaagccccgcttggttcggtttaccctctcatttcatcttataccaactctactatactaaccttcccactctttgggcaaggttcagatgtctctcatatttactctatgcagtattaaaatctatgagtctagtcaagtgtaatacaagtcccaacgctcattaaccgtgagcacggctattcgaatagattgatttactcacattgcagtggatgtacgcttttaatcccgcactccgtggcttgcccaacacatgagcctagtcccaacacatgaaactcgccacggcccggtttttcagtcactctcgctcttcggtacctactccaaggactatgaacccccattgcacccgggcactcctaactcctctgccgtatagtgaggggagtcctggcgctccagggataaggggtacctaattacttgtctatggtgtgttttaaaatttcatttcttgacgtcatttacctttccaacactgcactatactcaacgctcacatacagcacttgccatgactgaggtaccgctttgcgagagtgtcctaatctaacgggtctgcccatacctgaaatgtggtcctactcggttcgtttcttgcatagtttcctgactcggtccttaattgaccagggtcggcgactaaccgtttcctagaaccacccatattctattcttgccgccctagtcgaagttttgttgtattaagttttggttttcgcaaacggtttgtgtgtggcgggtggcactcatgtctccacccgcaaatcatcaatcactctcatcgagtgatctcacatccataatcatctagcgtaaatatgaagtgtacgcatgtctacaatagcattgctaagcgttttcaataattgaccgcatataaataaatgactccggcattaaaaggcgtacaatatgtataaaagtaatcaatatcaagggcaggctataatcaaatgtaggtatgcaatttataaatagcatgcaatttatttgcaaaacaacacatttgtaacataggatcgatatgttcgagcgtagtgacttgccttgctatcggtcctaatgtcttcgagataactgcttcagttagataactagaattcccacgatcgataaatatccggtacgttcgataaataaccaaagaataaccacgcacaatcctaaaagaaataaaataaagcaacattcaatacaactaatggtgccattaaatagatctcgattttagagggattatggaagttgaatggaggcaatcggagttacggttggaaatatatggattttcgatgtttggaaggacttataaacggaggatgaagcactctcgggtagggaggtggtttagacttcatgagaaggctctgggttgtatagagggtgtgttgtggactttagtggatgaggtggctactggtaggctctgcgaagggtattatgtagacttcagtaggtgaaaaatctctctggcttttatactaaagcatagggtggtgatgtagacttctagggggaagtcaactcagagaggaaggggctagaacgtgggtcctcccgtgggcgaaacggctaatacgcgactattcgcgctcaccctcccacgcgcgactggacacgtgtcgcgcgtggagaggaggcggcgacgacgtgcgtacggtccgttttttccggtgtacggtttcctttttttttgttttttttctcttccgtacctttttcggttttcttttttttcttttttttcttctcgtatatttttctgttttccctttttaatacgtatgtatgcaatctttgtatatatataaatataaactttatatacacgtatataaattttgtatacacgtatacaaactttgtatacatacaaatacaaactttatatacacgtatataaattttgtatacacgtatgcaaactttgtatatacgtatataaattttgtatacacgtatgcaaattttgtatacacgtatataaattttgtatatacgtgtatataaagtttgtatacgtgtattttttggtttttatacatacttataccagctttgtatacacgtatacaaagtttgtatacacgtatattttagatttttttataggaataagtctacataacccccaacatactgatggttgattacttagctccctgaccttacaaaccatgtatttaaccccttaagcttactaataccgtttacttaaccccttatagtggtttctttgtccggttttgccctgctggcactccacgttagataggcctgccacggcagatcgatgggcgcgcggggatacataaagacctaaacactaaaatcgtcaagtcacctaattaatttaccacaagaaattcattgaaatcgatgagccttactacccacaatatggcaccatctagactgcagagagaaaatacaaaatatcaatactaaaaacccctgtagtattagccctaatccttggagtgacaacgatctgattgggaaaaaaaaacacaaaaacgagttgcagacactcacctttgcccggctctgcaatccgataaagtggatccacttcttaacatcagctcgcttcgtctcgccggggaggcagaggcggaggatgcgccgccggagagaacgaggagaagtcgtgggggtatgtttgtttggcgaaccgctcgaatcttttatgcatgcccatctgtccaacgtggagtgccagcagggcaaaatcaggttaaaaaccaccgtatggggttaagtaaacggcattaacaaacttaaggggttaaatacctggtttgttaggtcagggggctaagtaatcaaccaacagtacattagggggttatgtagacttattccttttttatatgtatacacacaaactttatatacatgtgtatcttttatacattaaaagtgcatacatataaatagtagtactccataggataagagatcagactagactactagaggggggcacctgatcgcgcgcgcgcggccgcgcgactggtcgcggatcagcggcccctagtgggtcccactcctttcttctctcttatccgtttctcttctctccttctcgatctctcctctcgtttcccgtttcttcttctctcctacccacgccggagccgagacagagggggaaccgcacggcgcagcgacggcggctgtcgcggcggtgaaggagggcggagaggtgggggaggctccgggcgaggggcgccggaaggagttggtgctgccggcggttggctgtggggatgtggcaggaaggggtctgttaccaacttggaagagaggtaagatattttcagagaatcagagagagtttgagaggaatagaggaagagaagcagagagaaagacagagttgtagagagagagagattgagtttgtattgagttgggaattctgtctttacatgtcatgactcccgattctctctctcctttatatacagctagttaacccagtttccacccttatacttcgggttgggcctagttacacgaacaggccgttgctgggccgtactcagaacggagccaacgaccttggacacttgttcctgttcgtcatcagttgtgccggatgtaacattcccccttccttgaaacacagcttgaccccaagctgtggcagaaggaaagcgatgccttaactcctccagatcttcccaagaagtggtggatgacgaagtaccagaccagtgaactaaagcttgaacaatcattttatcaccatgacgacgtagccgctgttgaagaacctctactggagtagccagatgcccagaatcaggatccaaacgtggtaatgttgattaaacaacttcagaggcagctactgctttctttaattgagacacatgcaccactggatgaatcaaactggtggcaggtaattgtaacttataggcaacagaacccacgcgctgaaggatctggaagggcccgtagaacttgaaagccaacttctgattagcacgagtcatgacagattgctgcacataaggttgaagcttcataaaaacccaatcacccaccgcaaacacgcgatcagtacgcttagaatcagcctgactcttcattcgttgttgagctcgaaccaaatgatgataaatcaagctttgcatattatgacgatcctgcatccaactatccaatgcactaggcaccccaacagaatccactgagagcccaaaatgacgaggtttatgaccaaacattgcttcaaagggagtcaacatcaaggttgaatgaaatgaagtgttgtaccaaaattgagcaagagataaccacttactccatctagatggacaggcatgaacaaaacagcgcagaaacatttccaaacactgattcacgcgctccgtttgcccatccgtttgtggatgataagaagagctcatttgtaactgagtgccagaacgccgaaacaattccttccaaaaaatactggtgaacactcgatcacgatcagaaatgatggcctgcggtagtccatgtatagaatgaattctgtccatgaataattgcgccacagacacagcagtgaaaggatgggataaaggcaggaagtgggcaaacttagtgaacttatccacaatcaccaaaatgctattataagaggctgaacggggcaatccttcaataaaatccattgatatgacttgccaagcatgttcaggtatttgaactggttgtagtaaccctgggtaaggcacatgttcaggtttagcttgttgacagactgcacaactttgcacaaaatcctgcacagtttgccttaaacctggccaagcaaacagctgcttaactcagctgcttaactcgctgataagttacttgaattccagaatggccccctagagcagcagtgtgcaaatttgccagaacttgctgctgaagctgcctattattgcccacccaaacacgtttcttgaaataaagaataccattttgcaactcaaaatgagcagaatgacatgtgccttccttaaaagaatgcaaaagctgaagagcttcgggatcagacttataacccgaaacaacatcctgtaaccaatccggtaaaccaacagataatgcacttaaaattggaagaccatcagaggatctatgagataaagcatctgcggctccattctccaatcctttcttgtacacaatacgataacgaagacccaacaacttagtcattgctttatattgccaagaggtggttaatagttggttatcaagaaaggccagactgcggtgatcagtgcgaattaaaaaatcatcatgttgtaaatacgggcgccaatgatcaacagcaagaataatagccagactttccttttcataagtggaaagaacttgagtccgatgtcctaaagccttactcaaaaatgccaccgaatgctgatcttgcatcagcacagcaccaatacctcgatcagaagcatcagtctccaccacaaacattttctggaaatcgggcatgaccaacaccggtgctgatatcagactctgtttcaaagtgtcaaaagcttcttgatggtgttgtgtccagataaaaggctgccccttacacaatagcttagttaatggcttactaatgatgccaaaatgtcggacaaacttgcgataataccctgccaaacctaggaagctgcgcacatctttaacagatacaggaactggccattgccgaaccacctgaatcttttctggatctgttgaaactccatcagcactaatgatgtgccctagataagacagttgagtttgtgcaaaagaacatttagacaatttgactcgtaactgatgcttactcagagtctcaaacacctgacgcagatgattcttgtgctcctccaaagtgcgactgtataccaagatgtcatcaacaaagaccaagacattttgacgcaattgatcagctaaaactgtattcatcacaccctggaaggtagctggagcactcgtaagtccgaagggaagcaccttgaattcaaaatgaccattgtgagttttaaaagctgtcttagcctcctcaccaactgccatccgaatttgatgataccccgaacgcaaatcaagcttagaaaaccagcaagcaccagccaattcatccattaactcatcaattattggaagaggatacttgtttttgacagtgatagcattaagatggcgataatccacacaaaacctccatgtgccatctttctttttgactaacaaaacaggagaagaaaaaggactagcacttggctgaataattcctttttgtaacatatccttaacctgtttttcgatctcatccttttgggcaggtgtataacggtaaggtctcacattaactggcacagccccaggaattagaggaattgtatggtcataatctcgagcaggaggtaatccactgggttcctcaaataaatgagagaattcatgtaccaaagactagacaacatctggaactgaggataactggtctgtagagtcactgagggaagcacataagtgaaccaaacctgccactgagtcgatactgtgcagatgctgtaaatgctgactagaaatcaaggcacaatcagaagtatcggactgcaccccacgcaacaaaacctcatgacccataactgtcaagtgaatagacttaagctgccaatcaatttgcattggactatacttagttaaccaatccatgcctaagattgcatcataacctcccaaggccaccactttaaatgtggtcaagaacttctgaccactaacaaaccattcagcagaaggcatttctttctgacaatgcaacacctgtccattggccaccttaacagacagaggatgagctaagaactgaactccagtaagacggtcagccaattgatcactgataaagctagccaaactaccagaatctacaagcatcagtatattcaacccctgaatttttccttgtaaccgaatggtagactgagaatcagtaccctgaactgcatgaactgacatagctaacaaggaagaatcactatcttcagaagatatgctagcctgatcctcatttgcattgtcaggaaatagtgcaaagagctcctgaacagcgtgaagctgaactgttcctgaacatttatgtgtcggcgaccacttttcggcacataagtaacacaaaccttgtgcacgacgaaacgatcgaagtgcactaaccttgtcagaaagattagtaccccgattgagctctccgcctttcttctcctcagttttcaaaaccttggttggtggcaatggtaatggatatgcatttttaaacttctgcgatccatccacaaatttcctttgctcttgattccgctcagacaactcctcctgtaatagagccaaaaccagagcagactccaaatcctcgggacaatgtaacaaaacagcttcgcgaatgtcaaaacgcaacccttctatgaaccggtgaaccaaattcaaagtgttatacataggatcatacgtcaacaactgattcatcagatcatcaaaccgttcataaaactcgctcactgaaccggtttgtttaatctgatcaagctgtcgaatcagttgccgatgttgatttctgtcgaattttcggttcatcgcttcatagaatcgaccccaatcgacaaaaacttcatgagcacgagatgaacgtagccaagacgctgcccttcccatgaagtaaatggtggctatccgaacccacaaatttggatgagttccataaaccccaaaataatgctcacaacgcatcctccaactctgtggatccgaaccatcaaactgaggaaaatccaacttcggtagcctatgattgaacccttgctccccatgcaaatcccgatttccccgactcgaatttgcgccaaactcaaccccatgaggaacagaaaatttagtgggaatctggaacgtacccttgaccggaggtggcccgagagtatgaactacccccgatgccttcccccggtgaaaatttgtgacgcgatggccatctggaccgagatcgctcgccgctgttccggaaaacaacggcagcgtgctgggcgtaggaagcagaggagtttggtgactcccttcctccgccatccttgacgcctgcgaggtgttcgacgaattgccgccctcctcgctctgcttctccaacttgaggacatgcagcttcagctcctccatgtcgtgctgcaacccttgtacagcagcatcaacttgaggtcgccaccccgccacagatttgtccagtttgagcagcatctcttatgtctctccttgcttgacgaccatggttccgatcgccgcttgaatctccaacagagtcttctcgaatccctcgttttgcttcgccatgtcgtcgacttggatctgaagacgagttttgaaccgaggtttctccaggattgcggctctgataccaaatgttaccaacttggaagagtggtaagatattttcagagaatcagagacagtttgagaggaatagaggaagagaagcagagagaaagacagagttgtagagagagagagattgagtttgtattgagttgggaattctgtctttacatgtcatgactcccggttctctctctctcctttatatacagctagttaacccagtttccacccttatacttcgggttgggcctagttacacgaacaggccgttgctgggccgtactcagaacggagccaacgaccttggacacttgttcctgttcgtcatcagttgtgccggatgtaacagggtcgacggcggtggggagagggctggtgctggcggcgtggggtggaatggaggggaggccgtcggcgcggtgacggcgcagcaggaggcggcgcctggggtgcgcggggcggcggcctgggcgacggcgccggggcggcgcacggtgagggcggggcagagtgcggcggcgcagctggcacagcggcctggcgcgggggtggatgcggcagaccggcggccgggctcgacgacgcttcagggcggcacgcggctgcgcaggggggaggaggcggtgggggatggggaggggaggattgtcgcagtggggagagggtccgcggaggggtggagcttgatggtgaggatggatgccagtatcaaatagggaggcggcggtggtcctggcgcggccctggagagatcggggcggcggtcaggcgcgacggcggcggggctggcgcgcagcagacagaggggagggggctcggtgatgtggggaacggtggagagagtcgacaaggcggctaggccgcgtgcggctcagcgcgacggcgcgagggagaggaggattgggaggaggaggtcggggtgtcgtcgcgggcggcagcggttgggctgtgcgcaggcgagggaggcaccgcggtgcggcggcggcttggcgcagccgcgcgcacggcggggcagggtggcgtatggcggtagcctggcgccatggcgacgtgaagtgcggagttgggggttggctgggatgaggacgacgatgatggcggcttcagtggcggaggccaatgacaatgaggggatggagttcgacaggggtggagaggaggaggccggcggttggaaagggaaggaggcgatggggagagtgagccggaggagaagctgcacaccttgcggcagccgggtagcggcacaccgtgcatggtcgccgagcgtcggtgattggctcgcggatcgtcctcgcacactacgctttcgattgccaacaacaaaggatcacacaactgaaaggatcagcgggttagcgaaacaaaaatggaaaggtcagtgagtcagtgagtcagaggttaggacaactgaaagtaaagagtcagcgggttagtgagtcagtgcaacagaacaacaaaagggttagatgttaggggttagtcgttcaaagttagtcattctcagactgatcaatggcgcggcggacttcctgtcctcttgctcaactgaggcccagccggagccggccacggcggagcaagcggagaggtggcagccaatgcgcgagggaacggagtggtggtagttacagagcttgatcagggaggggaggagaaaaatggaggggtgcatggctgtggtggtgtttatataggctccttggtgttgctgaaattttcacaattcgaccctttgcaaaaactttttttacaaatgagccgctgccaaaacttattttaaaaatgactcttttggtcagcgccaagggttatttttgaaataagttttggtgacggttcatttgtaaaaatagtttttgcaaagggtcaaattgtgaaaatttttgttggtgttgtggttgtctgcatgggaggcaaggtgagttcccctctgtgaacttggtgttatttttcggtgtgggccctcctcactgtgtttgcatgtgtttggagagtgttatgtggaatgggggtatgggtgtatgtgtgttggttttgcatgttggtgaggggggtcccagacatttgatggttggtgcaatttcctgttgtgtgcccggcaaaagtggttgcaaactactgttgggcttgtaggcatttcatcgagcaattcttgtgcatgcatgcctgttgttttgagcaggggaggcaaagtagactttcagtgggttggcttgagaaagataacaggggtgggctgctacgtctctgggaaggtaaaatagacttatgctgggttgttcgttgggctgggagagagaggaaaatggcccaattgtaataggagttcttagtattttcctgggatttgtactttggtagtctgtacttggaacttgtaaatgggactgtataatgtgctgtgcatttggactgtagagtatggatattgattttggctctgtgtttggactagaaatatacttggactgtaaatgtggattggattatatggtgtattgtagcttggacaataactggatttgggtcggtatagatattccgagaatgcacaagggcgggataaatggattgtaatacgagacttgatttgtttggatggatgcaccgtgatgccaaaaaggagtttaggcttaacgcccgacaaacaaatttataggtcgtcgtaggattatttgagagtgctcgcacgaacgaacgatgatagcgaagggaggattctaggggtgacgtgtggcatacaaatccagtcatcgcggtaggaatggatttgaggatattcgaatcaacgtgcgataaataaatacgtcgatcgtttataggtattcgagggaattatcgagtcggaataataaaaggtttgaaataaccggacggtaagaattgagaaagatatgtcgcattgcgacataagaaaagattttcgggttatatattcaggtctgtgatttgtttagtaccgaagcacttaataaatcagaccgtgaagataatggaaggaaaggacgttggactgagggcgtccctctaggagatagatttaatcgagatctttggcacacaacctaaatacacacaaatgcataataaatcccaacatgcaaaaaaggttttaaaaagatttttgattattcttaatttttaaattccgtattccagattcaaaattttcaggatgttacacatcacaatccactcaaacaaaccgattgcaccagggcacctgaaagcggtcttatggatatcctcttcggccataaaaatctgattgtaaccagcattgctatccataaaacttataatcttatgtcctgaagctgcatcaatcaattgattggcaatcggcattgggtattcatcctatggagtagctttatttaaatcgcgaaaatcaatgcacaccctaagcttgctattcttcttgatgaccgggactatgttggaaacccactcggcatatcgacatggccgaataaaacca

SEQ ID NO: 42447 - DNA, 817 bp, Oryza sativa
aagaaattagcatgcatgaaaagtcatttttagcaattgggttagcccctacttaacaagaacagtaatggaactcagatgatggtaacatggggattagctaagtcatgcacctcgggttggggctcatgcggcttcttcttgaagtaagtgaagagcgtgacgatcatagcacgcttggtggctccatcccaactgatgacgaatccggtgcgcggagagatcaattttccctctgaaaaacattcagttgattagcaggtagctacatagctaggagccgataaatacatattttgtatcgggctactaaatacactaaacaacacatatttccatttgttgttggactacacatgtctatctcggtagctttcttttatatcaccggcttttcccttaacatctgcagctagtttagcacaaaatccacggtaattcccatgtggagatgcagcatgattttctgatgtaatgctagatagggaatgcgtaaaacaacgcaattaaccacacgtggcatgctaacagcctagcacatggctcacttagtagctaagttagcagtaaatacagtagattcaggcagtaaaatctgaacatgcctccaaacttgtactaagatgtgtccataggttaccatatttttgggacggatggagtaaattaccagaaggtggggatgaaacgcggacaattgagcgagacatgcccaacaccatgttcttgtcggagggggtaggcaaggcggccgcggtggagggatcatctttcttatcgcgccagagagttagcttctgaagtcgatcaactgaag

SEQ ID NO: 42448 - DNA, 1883 bp, Oryza sativa
  unsure (1)..(1883): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaggggcaaatattgagccacataagcatgcctccaacaaacttctgcaggtgtattacttagacttcagaagatatgttgcaagtgttactcagtatcacaagaatctctgatagaaacaaatggcaatagaaaatgctactgcatgatattagcaagtcatattatcaaataatggggaatatttttactggcatgatacttacttccggtaggtgatgtaatggttggcaacgcgtccagcagtgatgtacagactgcaatgatgtcagccgcctggtttggaaataaaatatatgtaagatattcataatcaaaataatttaatgtgcattttaagaattcaagtatccacaaatgaacatccagaacgaagtgggaaagggatggctcttggcatattcaagaagattgcatatgaattttaatcataatatacattatattaaaaaaagttataaaaaataaatagtataaaattattttgcgagaaaaataaaataatattagttccatgttcatacatgtatggccaatcaaagaactgcatgcatcataaataattttaagatgaaaaaagaattgatcgtgcatgcagactgttgacataaagcaacaattccctctctagttttttttaacataaacaactgactgttcaagaaggatgataagctaagataaggaatgctgtgtacgtagaccaattaagtttgccaaccaacttaaccttttccaaccctgttcaaaaccctaattaaataaaatagcaaagcaaatggagcttagaggggtctaagtgtcttccaaaatattgtacagggactacaatatagctattggacctaaagcgatccaaatgccttctctataaacaccacaccataacaagatctaaaagtctctttcctaaagtcaaggtttttggtgacctctcactttaatcaatattagtatgatcatataatgctgaaagcaacaaaatggtgctgcaacttgaaaggtagatgtagaatgcctactgtttcagaagcaaactttggctcggacaaaatccaggttgcagcttcaagaacatttgcaagaacacatgcataacctggatgattagatgatatatcatttggaagaacatcagcgcagctaggcaaaaagcaagctatctgatggatataatatttgctgagtccattagctgagaaaacctgaagtaataagtaacgatgatcagatactcaaatataccacccttgcaataactggttaaacgtctaattatttaaacaaactcctaagaatcaaaacttttcaattaatggagaaataacaccagtacattttaaagactaggtatgataggaaatctcattttgcaatttctatatttcccagacatgaatatcttcagaaaaaaatgataaaaaaatatggaacaactcaccttcttgaagtgtgataaacgatgccagaggaaaggaatcgatagaagctgagaggagaaactccatcttggatccactactggacaacaacacggatcatcgccaatatgtgaagcaataagcataagaacttgctccagagcagatgtattgttattatgctccaaatttcttgcagtttgctgaatcataatcacaaaaaaagaatcataaagatttactatgttc

SEQ ID NO: 42449 - DNA, 17858 bp, Oryza sativa
tggtgtgctttctggcggcatcaaaagctgactgccccaatcatgcctatagaaatataataaagaagtcaaacacaattatgttcatttcatcatggatcatggatggtaagagaaagcaaaatcaacaattgcaacacatctttgatatttttttcctttactgacacaaaaaacagaagttcacattaaggataagtgggaattccccaagtgagattgcaaatttgcaatgcaatgttccactaaaagaagttcattgaattgaacatgtatctcgagatagaagtgtttcattaagtgaaactcatcatgtttaccaggttctaccatagaaacttcataatgcaagcaatagaataacataagtgatttttatccaccagacaattaaataaaatatgcattatgcgattgaaaacaagaacagaaaacaatacatatatataccagtttactgtaattgaactcaccttttctgatgtacagtttgcacacaaatgagtgcaagttttttaaccctgtgaatcacaagaggttccagtgaggagtaatttgtaccaccaaagagtcttagaacatctcctaaacgaaaatgaaaggaaggcaattacactcggtgcatgaaaaaaaaggaataatgcattgaaaggttcaccataaggacaagaatacaagccatagcaaacatcccacaacctagacaaaagcctcatgttttgcaaataaaatcaaataatataaaggttcagagaaatttaatatccttaatcatcattcagatgccactgaaaaacatacaaacagacaagtagggtcatggctaagaaaggaagatgatcaccagtgcgaggcacaaatgagaatttgagcatacaatgctcatatggcaatattgtatagggatataattagaattaaatcttctctggtcaatatatatagatttaatatccctatagcactagaaacagcaagacataatattttgcacatagtagaagagcaatggtaattagtagtatggtgcattggtacttaccaccatgtttgacataatataacagcaaattgcagacttgacagagtatagcaatatcactgtctttctttgcattgaagaagaacaggaattgacgaaggaaatcagaattagcaccgaaactgctcctgattgagtaggaagatagtcaatgagctagctcaaggcataggttaaaggctttaagccatggcaatacttaccaatcaaccctctggcagtgctccccaaaagtagagcaaaagttccctcgaacttccgaacgtgccaattccaaatctctcttccctctgaagcatttctgcagcttataattagttaaattccattttgggaaataaaaacatgtttgtcttatgttgatacataggaagtaccgtttcagccactctacacagaccagattgcgcattgcctcgtcaggcaaaaaaaaaaaacagatttcttatactatattgcttaagctaaacaatgaaaaaaaataaacagatttcttctactagaattgcttaagctagacaatgacatattcgcaagttgcacgacaacattatctcatctcactccattgaacttaaccaacacaatgacacattcgcaagttccataattatctcatctcactccactgaacttaacctacacaatgacacattcgcaagttccataactacattaacttatctcactccacacaactcgtcatataacacaaattggaaaaggaaaaacaacttgaagcaaacatcacctaatgctgagaattccaacatgccaatgctacccaccaccactaaaaccacacgaaccacaacacctataagcaaataatgcccgaacgccgccactgcaagaggccgcaactcaactcaagtccccacgcgctggagaaaaccccgctaaacctagcgacgccgccccgcctcacaaccccccaaaaccaccgttcccctcgcgcgggaagcctcgaacatacctggatcttcgtggcggagctgttctgcaggcgcaggcccagccgccgccgccgctcctcccgcgtctgctcgagcagcacctgccggtcccgctccttgctgctccgcccgccgaggtccacccgcttcctcgccgtcgggtcaccggagaagaacatccccgactcccccttccccttcgcctgcacaatccccccgcaaaaaaacacacaaatcacccaaaaaatcaaaaaaaatcgcaaaaaatcggcggagaaaggggatcggatcctaccgcaatggagcgctcccccgatcgaaggagggagggggcgaggtagggtttgtgggggagggagggagacttgcggagggggagaagcgagggaggagtcgagaggtggaggggaaagagttcgtgttcgtcggggagaagggacgagacttggggggaaggggagagatggtggtagcgtgagaatttacgggattgccctccgcggcgtgatgcggctgacgtactggcctttcctgtgatgcgctgacgtgggcgtgcgtgtgaggaacttttattttggggcaattgtgttcttgacctcagtttgagttgcaattgtgattttaccctaacattttagggtttgtgattttgcccttacttttttcaaacgaaggtctgttttgcccctattctgttagcatcacttaacagcgtcaacttagcagtagaaggacttgtatacccttacacatttgcctctcctttctggatataatgtgtatatatttcgaatttgaccaaactttgacaaattttggaagaatttaacatatttctgcagcattttcaaagaacttgcatcgggtgcaaaaattcaccaaaaagattcatcacaggaagaaatcaccattcaccaaacaaatctctcgtagatacaagacaggaaaatgggaaagaaaacaggggatttgcagcagatttccaccatgcacaagatttactccattatgtctcctaatcctgtattttcaatagcgctaggcctccgtccctgcaccggcaagaggttaggagcgccagcccgccggcagcaagtcgtgcctccctgcgtccctagcctgcgctccagcccgaggtcgccgccgtgcctgcctacatcctttaacagcgccatcccgccgccaagctacctgctcgctgctcgctcgctcgctggccgacggagccgccgctcctctccgccgcgcgctgaccgcggggccaccggtcgccgcgccgcgcctccatgcgcgcgcgacgccgccgccgcagcgcctccctgcccgcgcccaactccgccgcgcgctgttccgtggcagctggcccccgccgccgctcctccctgccgcgtgctggccgcgcgtagccgccgccgccgggttttggagtggaaatcgggatagggattggggatttggttctttcattgaaccaagggtagaatggtcattcaaaaatgataataacattttctatcttcgtttaattctgaaattccggacccaccaaacttctgtcaaaaccaggggtagacggcacttcattttagaaaaacaagggcaaaatcacaaacccaaaaaaataggggtaaaatcacaattgaatcgtaaagcaagggcagaaacacaattgccccttttttttcggagacagcagcgtgtgaggattacaggtcggtttgcggtgatcggggtatgttcgggaactcaactcccacgcacataaaacttttttttatgattaattaaatacttcctccgtttcacgatgtaagtcattctaacatttttcatattcatattgatggtaatgaatctagatgaatatatatgtctagatccattaacatcaatatgaatgtgagaaatgctaaaatgacttacattgtgaaacggatggagtatttattattttaaaaaaaattgattaatatgttttttaaagcaactttcgtatagatatcttaaaaaaaccccgtattatttagcagtttgaaaaacgtacatgcggaaaatgagtaaaatgagttaagaaagttggagaaaaaacttagccgcaagtgtttgaaaccgatgaagatgttttttataaaaaaaaattgttaacgaagaagggcgagattaacaatgaactccattctaggaacaaacggcgttgttcttgtacgattttagtcattttatccatcggttttaaattttttgagcatcggtttgggtgttaggtgttttcggttgcagagaagcaagggtgttttagtatttttaagttaacttggtagcccattcacgtcggactaacgcaatggtataaaagggccataaatttcattccaatggcatataagagagcaatatattttcgatggcatataaaggaactaatgaagtttgagtggcatataaggaattctcaaaaaaagtggtatataaggaatttttactattgccattcatgtgtgatcgatgtagtgactaaggagatcgcaattcaattacacgttgaaatgttgcatgcgcacggagaagaaaccacaagcagctgcatgtgtacgaggagtctcgcctacatgcaaacggaaaatggtgaacattcaatacgtgagacttgttgcatgcctacatgcatagaacaaaacgatgcacgtgtttatcctaagaatgtgcggtggaagagaaatacggcgatcaaagatataaaacttttccagcgctaatacgtcgatcatacatgaacggatggagtattacttatattacatgtgacgatgaaaaatgtcgttgaattacacacttggtatatttagggtttacgtttagaataactcaattgataatatggcatacttgataaaaaggcaagtgagaagatagcggcattgaacgaactagggagagagataagaagggatagataggggattctctttgacatcggtgacacataaggtaattttcttatgagactaagagcaatgttgaaactattttccaatgaaggaaggtctggagccaaatatcataccaagatattaatagttttaatagttctttgatggtgttttatttgctgacaaagtataccagcaatacatatgagactaaatcaaccctaaggggatgttcgaacctttatattggacggtgacggggagcctgaccaagagccgtccctaccgccacctcgaccaacacctttcttcagccttgccgttttttgcaccgcggttgtcagagaaacaaatcaagagaaacactcttgcacccctcttcgcaccgccgccaccgctggagatggggcgcatggccaagagcagcccatgagcccatcctaaggtagccttcaggaaggccgtggcggagcggtgccgcaggcggtggcactcttgcacccctcttcgcaccgccgccaccgctggagatggggcgcatggccaagagcagcccatgagcccatcctaaggtagccttcagcaaggccgtggcggagcggtgacgcaggcggcggttgtagacgaagagatagtagagcttgagctcgcgaggaagtggcgcctcggcctccacctcccctctcatgagcccaccttatcaacgacagcatcgtgggcccaatcttgccggcctccccgcctcgtccctctctgcacacgctcaccgatggagagagaagatagaggttgggggatgagatggaggacatgtgagtcccactttttttttgactgacatatgggcttgacatatattttttaatttttttagtattcaatttttctctttttattttttgaatcgaacgatcatgtaagcgccacgtaggatgaagatcttgtttgcactggttttgtaagttggagaatgcgttatatcccggtttttcgcactgaggatgaaaatcagaatgggcgacaaatggagtatctaaagtgaacctattcctaatctcgatgtcgtggtccaattccagattaaaccattcagcccaaagcatagtccgtccttccttgctctctctcttccgtttgcctttcaggcatttcgccgaacactcttggagcaagcgagcggcggaaggacggcggctcgccgccgagggcgacggcgtggcgggacagtgagggagccttatatcaactcggaaagcacgtggaaggctgcgcaaatggggatcggcggcggcggcggggatggagctgctccaagccggaggggctgaaccgcgaccaccaggttttggctcgtcagggtctccgtgccgccgccgccaccggcggcgctggtgttcttgggccgcgcgtaggatgggcggaggccggcggcctcaggaatctcctgctgctccggttgctgtagctgcaggtaaaggtaagggcatgtcttgtagccgcgcgggtgttgtgaagtagtggatggctgcacaggttttcgttgcagttccgattgattgctcgtgcgcagctctgggctccgagaagatgcagtttgtgcaggaaatgttcttctgtgtgagaatcgttcgctgccacatgccaacttagtagagtaccaaatctagtgtcaggtttttgaatgtctaagcattgtgggcacatgactacattgtcgatctccctgatgctggaggcacagttggaacctggtccgattttgtgcactctagcatgatttgtgtggatgtggtggatgaagtaatcgacatattcgggcatttcttgtcctggatgttggctaaatgtttggcaccgcaagcgagctatcatcatcggtatctgaccatctgatgcgtgaagccacatgaaattgatgacagcctgcgacatttcaagttgctatttgcgagccaaccatttgtttcagggatgtagtaatcatgccattccctttagaatttagtgtgcccttctccaattttgaagcatgccctttctggacatgtttctgtttcagtactaatcaggtgcatctctgcaatatttgagaaacaagtaagcctggtgcgcgtgtgttccccttttgtttcaaaaagattgtttttggatgatgacaaactgacgatttctttgttggcaagttcaggtagcataggcatagcccaacctgattctgaacgatttaaagatatcaaattaagaaacctgagtacagtcctaccattcccttctgaacagaatatttatgacttgatatacatgtggttggaatgctcatatttatattgctttatgattcttgaagttgaggacattcattaaaggatgctttttgaacactgtttttaaacaacacccagtttctgctttagttattagtgctgaacagacatttctgcaatgtcccacttaaattgatacttatggaacaaaattcactttatatagtaaacttagagcaatcatttctaaagcattattttgcaggttctagattatttttgagattggttgtaatttgatcagttccctttttgttataaacagcaagctcaatgaatagttccatcagattggagctactttgtcctttagttggttgcataaccaatgtcttatctctgtttttatcttccaagaattaccgttgacttcatgaaagaaaatgttctgttgacatactgttatttttgcgtattgcaggctcacagcccttggataaggtgatgtaatggtggattttgatctactctgttgtgtatagtacatgctggtaagtgatataatgaaaatgctttgagggttctttttattttttgaacagtgctgtcaggtttcatgattattcttatctccatgaattacttgatcactcttttttttttattttacagattatatcagcctgcatgaatttgggtagttagagtggccctgaggaatcattgatgcagtcatcatctgccgttgtgactacacaccatgcagggaagattaatgggaaggattgtgattatacaagagtaaaactattgttggttttcttgcctgcagctgaccttgactctggttgcaagcaagggcttgaacttcgtaattaaagactgtgttaaccgcctattaaagaagaatgggggtggctgaactaggtacacaccatgcaaccaacatccttcagtaagatcatcaaatataatcttttcctgcttcagtatgtattgatttttgagagagtcacactactatataaagaagtgaaaagtttcgaagtgaatatctttgtatagttgtataattgaaaatagaaaactgcatgtataattgaccgccaccagaccacttcacggatttgctgtgatttatatcacaataattgcttatcactgactcattctttattaataatatatgcatacggttctttaatgatatgtatcttttggttcctttctgtttctgccattgaaaaagaaattaggaggtgcattgaaatataaattgggaggtagaggtgcatccgttaggcagtatcttttttttactaccctcttatttgcaactgacttataatatcatgttctttccgacagtgcatgaacatatatatatcataaaactctccattttgtttgatgtgatgttggctctacaattatctcccattcacaggaaaaaccatatgtaagttgagttgacacttggtgactgtcctgaagtatgaaatttaatctagtgtaataatggtgtggtttgcagaattacttgcaactagcttatgccaaccatgtgtcaaaagtattctgatttctcttaagatttcttaatagatcatagttctcaaaaactatctattgtgctctgtagttaggtcttacttttgtgctttagagggacaaagggaacacggatagttagctgaaaaggctatattacatacttccatacaaccatagcttatatacaatgctagcaatattacacatccgtcaactaactcattacatataagagagaacatggatagttagctgaaaaggcgacagtacattacttccgtacaaccatagcttctgtagactgctaacgatattacacacccgtcaacttaggcactacaccatcataatagtgagatatctgacgatagtagccagactgccagagagccaaaattttggggacagtttcagcttcctaatccccactggtccataggcatcgtctgcaatttaaccagcaattcctatgcttttccctcactggcattgtcgctgtcatcatcgtcaattttgaagagttctaggcggctgtggctcaggcggagtgagtacattgtcgtcttgtactcagcccaggtgaatgatcggtatcggcgtgggctgctggctgtgattgtctctgggagtgccgagattcgtgcatgcaggggtggtgatgcgaagtatattgtggacagccttggcctgcaggcggttgcaattaccctgtgccggatacttatcagcctcccatttgtcagagcctgaagaaataaaggccaaagaaaggataagccgaagaatgtcaggaatgcaaaactatgtccaggcttacagcatcatgttttagtgatttgtttttttaagttgagtaaaacagcggtagttgcaggatagaaagagatttttttgtcagctggtaagaattgcagcaatacaatgaatttgagtctgaaaataacaaacatatcagtgttgcattttttttgacaaaagaaacattgttcagcagtgctgcagccttatgaatcaaatgattaaatatatattactttcctgtgtgttttgcagtgagcaaagaaacattttttatgaataactggaagaaagccacataatttgtaaatcatatgatagtcaatgcggtccttttataatctatgaaataatttctttgcggtccttttataatctatgaaataatttcttttgataatagtaaaccttattctgatatatgtaatgctgtttttttttgctctagtcatttactgtgactacctggaggacatcaccaacattgacgaaaatggccgatgggtccgatggcacctgaacccacatctccttgccctcgtggtccggcacaaacacctgtagcccttccacatcgtttgctcggagcaagctaaggatctgcgggtcagagtgctcgccgaacccaatgcgcccacctgccatcagattcccaccattgctagccttggtgctaacaaggctcttgatattgcattggtcatcatggtcaagtttgtgaatgttgcatgatggagggtagtggttgatcctcaggaggcagtcactgtcagcgtttgtggtaagcttgctgaagtatctggggtccttgagacctagcccctctcctaacaggtccaggatctcacatgcgagcttcttcatggcttcaatgtactcattcacaatagcactgcaacagagtgagggaggatatcagcaagtgagcacaatcaacttgaaattgattttatcaaaagaatgctgttatcacagaatcaggttggatgtgccatgacaagtaaaaagaagctggagaaagaggagcaaggtctttgactgattgatggctgcagcaaatcaaaagctgcacccaccctccctcggcatgcctgcctgatgagttagaaaagatgatacactgatgggtatatgtgtatgcctctgtgcttgtgcaccaccatctacaagacgtgatatattcgtttcttgtgaatcttgtgatgcatggataggccacagaatcagcagtacatcatgcagccgaggggtgacaaattttccaatgggcaaaaatgtgttgttgacaggattggccatacttttttccactgctccatggaaagacccatcagtgcgtggatcacaagtatcactgcccctgccactacacaacctctgggacatttcattttatcttaccataaagaggactccttgcatgtgtgcctcctttcttttgtttggctttatatggatagcatagatatgctctttaggggcctggatcattttattctcatcagacatgtgtgtacttccatgtgggcccctgtctgttgcatttgacaaaaagaggttgttcttccttcttgtcttgcacttttcatatagcaaaatggttactgtgaagatttcctagccattctgttcttaacctgatgcattcttgatcattattatcccattctttgtgttcactacttcactggcatgttgctatcaatatgtttccaaaatgatgtgcttgtgataattaagcttaggcttttgagttgattaaggcattaagattaatattcttgtactagtatggatattatatattaatggctgatgtatgtatggtgatagagaactaagaggagtttcaaaaagtatatatcatgtatatcccaactaaacacatcattttctacatgaaaacctgctgtactttgctaattaagcttgcagagctttctggtagataaggatgcttcaagtactcactctgttgctgcatcagttggtggttggatattgccattaattggaaaccactgcatatatgtcagattggttgatacacaaatatatacagtttgttggagagggaccctgagaggagtcttctaactacctaagtgagggttttcttgtccatttcatcatattttctctcagcaaactctgattaggccactacctggttctgagtacagtcagtgagtggtgagtaatctctcctagtatgtgagctctcattcagcatacacaaagatagttaaggaaaatctgatatattattgtcttagttggtagacattttctccaatggcaatattcgctttcgctttcaaaaccacttatgtagtcattttttagagcaaaaatgaaaatatcaattggtatgcttgatccttttccaatgtctatttggttagacaatgatacctaactttcatcagaaaatttcttatgcccattttgtggagctatcaagtttgttatgtcccatcagttgcatgcttttcttttgctttagaaactagctatgtatgatcttaaattgttggaactaacttatcattggcctgtccatcatagcatcaattatgccattattgtgataattattgttttgaaaactatgtactcatgcatttccgtgatttaattgatgggacctgtgtctgaaaatgacagtatacatatggatatgtactgaagtagtactatgaagaattaaaaatgaaaaccccatatgctaacataataagttaaaattataacataaactgcagctttcttgagtcaactttttcttaataaaattaatgtaaattgatcttaatttaccttaagttatagtatatgatgacatgagtgtaacatttccatccttttccttattgtgtaaactaacatttagtccatccttgatatatagtcaaaaggctacatcagaagatcataacatggaaaatatgcaagccaaaccagctgaaaagaaaagaagcaagcccagttgcaattgcaagcttgcaactggcatgagtgcagtgcaggtatgcatgattccaacttggccttcttttgacttctgaacacaatatattatgcatatctataaattaattgccctgtagctgatgaaaaacccatagctagctagacatctctcaagccaagcctatcctacatatgcatcccatgcatgcatgtagatagacatcatgcaagtctataccttatactactatatagttataagcgaaacagtatattagtgattaaaaaataatatatagataaaacttttatacacatgttcttagtaaatactgaaaaaataaattacgataaaaaaaacctaaaaattaactataaaatttattttttcttatgcctgtaaactgaaggctaaacgatggagccctgagccctctaaatatatagatatgtacctgatgcttcgttgcatcacccctgagcagtactcagatgcagaaatatgtaagcatatctcactgtattttgacaacacatgaaaaagatagatagatatattgtagataggaaaacctaaccaagctgacaaaacccttttactgctaccaacccacactactactgcttggacggcatcacatcagcagtgagacagatgcaggattatgacatgaatatgtagatgtggccggttagttaaggaacacagcatgatatatatttaattttttttgcatgttcatctcacactgcagggacaccggacacccatgcaccgtcttaattaacatattattggatcatatatagtcgtctttcattaacagtttaattaagtaatcaagctttaaacccctgtagaggtcagctagttcaataaaaatactttagtgatgcacagggacgaggggtctagcaaaaataataaaaatgacaatctttaattatatgtgtatgtgtgtgtatacgggtaatacttaattaataatatatattattcacgttgcctcatatatagtttaagaccatatatgcagtgccatgcatgtgattgatatgcgtttcagtacataatacatagaagaaattaattatattgtaactattgcaatatttgcaatattagtttattgttgtaacaacgacactgtaaaacttagtgaatatagttctaccaccatgtatgcttaaatttgggaaatggtggggttatcaaagatttgtgacaaaatttattacgagcaaccaagcgcatccgcaaaaggatcgagagaagtaattaagctcgtgtatgtaagttcttaaaaaaaaaaaaagctcgtgtatgcccagctacatgagaattttttttttggatgaaccagctacatgagattttactgtcaacagagcttttaaaaggcacagagttaactgtataatatatcttatataggatactcctttcccgttgaaaaaagagccttgaacttttcaaaatgaactagatataactttgtctacttagttgtatattctttatcaccaatccaaatgtaagtcatcttttgaagtaaaaccatagggaaaggatccctacaatccaaaaataagttatacaagtatataatctcttacgaaaaattatgttttgatagaacaaggccacactattaaatatgccgaaaatttgtacttcgaacaataataattatcgtcgaagttaaactgatacattaaaacaaatatattcttctgtgaccggagtccggcacactttatttattatagaatatgcatgggtagcattaagaaaaaattaaaccatagagaacattagttatatacatgcataacaatgttttaaatacgtgtgccatgtaagcatgcatactttgacacgtaggcgcaacacaatacgccactccatccgttccatgttacaaaatgttttggactcttaaaagttcatcaatagatcatgcatgaatttattcaaaacccagaacattttatagcgtgaaacgtgaatctatatattcaaaaacccataacatcttataacatgaaacggggaaacggagaaatggagggagtaaaaaactaatcgattaagctaggctaagagtgagtggtggtattgtacgtacctgaagcgagaggggtccatggcgtcgatggtcctggcccggtgcgcgacggcggcggggttggcgtggaggagcaggtactccagctcgccgacgtcgccgttgaacccgatgctccggcagccgtacccgagcgggctcgccggcccggcgcgctgcttctccgccggcgccatcgcgaagaacgccgccgtcgcggcgtccagcctcgccgcgacgggcgccgccgccggcacgccgtgcccgacgcaccggaagaacccgtgcgccgcgcacgccgtcgccacctgcctcgccaccgcgccgcgctccgccgacatgtccaccgtcgctatcgtcacgccgccgccgccgccgacgacaccggacgccgccgcagctggcggcgccgccgccaccaccgtctcctgcctcgctggcgtcgtcgcggaaggcaccaccatgatcgatcgatcgatcgagagcgggagaatgcgcggccggaatggagtgggagattggagctcaggatgttggagttggctgcgatgatggaggagaggagggtggcgctggtatttatggacgccggagaagagagagaagaaggaaaagctggtgatggtggtggtgtcatcttgaggagtagtacacagcttagctgggagagtatagtatacatgtgtcaagcaagccacaaatctcaattaacttctgattaattagtttaattaatgaatgacacctgcatcatcttgctagtgttcttctagctagttagtgtcatgctctcatgcatacttctcgtttagtacctccctccatcctaaaatataaataaagctttaaagtgtgtaaatttggtgcatacatagtctccaacgtaaaactttaatttatcccgtttaaggtcaccggagacaaaatggatttataagatatattaaaacaacttctatataaaaagatttcgcacgaggtaaaatatgcatgttaataagaaaagaacaatgcctttgacttttcttttcatataacgtattatcaacgactctaaaattaatatcatataaaaaatactttcaaatatgaatataatgctgccacatgtacgatctaaacatatattattaatttaattattagtcaaaatatgtaaatattgatttttttaaactgtgggctccttatatatattctgttgtgagagtacctctaatttgcaggctcttaaattcccttctcatcttgacattgaaatggttagctatagctagccgtaggctgtagaagaggaggaattataaggtcatttctataaaatatatgactaataatgtttttctagataatgaatgactaataatgctggattagtccagttaatcgctacacgatctagttgtgttttaaaaaatgaatgtcactatagtgctttgaatcaaataaatcactctataggtcaatatccagcataaactggcgcgcacatcacgcaattgcacgggtaaggccaatatagttttcttatcttgtgatcatactttgacaaacataccataatacaattgataatttatcaattaaatatcgtgcacatcatttgttcttttgtaattgtatagatcgtcgactttttgcggtcttcggccctcgatcgatggaccatgttattttgactattgctttttaaaaatggatactagtcattccatttagatatggtttcgagcctgtcctaaaattgattgtccacacaccaataataacaactatatataaggccttaattaggacatctaagaaaagagacttgatcatatatctatataattctataagactccaatggtggtgagtctagtgacattgaatctaccaccatcagctactcactgtcatgtgagcccttattgtcagtgtaacaattcaaaattcaagcaacatcagagttggtcagtacccaatatttatacttcttcatgacttcctaactgtacaaggttctctagtatagcaagtgatcatcccctccagtggcggatccagaaaattggttcgttggtgtcataacgtgtctatcggtgtcatagtatgctaattatgtttagaacatgatgttatagtatatggataagcagttttgctataggttttgctaaaagtcgtcggtgtcgcctgacaccgatgattatagtgtagatccgcccctgatcccctctagaatgaatgaggtctctaaaaaagtgaatgtgttttccttttttttagataaaatgaacattacatgtttatactgactatatacagtcgaattaaaataatttggtatatgtatcaactattaactataatatgtcctagtcagaactcctatattttttctaataatttcataaaaaaaatcattacaaggcataggcaccctgccctgctagtataggtaccctacatccaaccagatcatatagacaacatcatttctttcaataacatagggcatggtatattggcgttgtcttttcattgcttccaatagctctcccctcccaatcgaaatgtagaaatgtttttgacaattgtctcaagggagtgtctaaactaattaaaaattaattttgtttggagccaatgatctgtattagtcagtatggtttaccacagttatatagtttttatttataaaaaaataattcaatgcatatcatctttatatcttccacttggttcactattggtctataatgctattacaagggaccaggatactatgtactttgaaaatcaatagctagggatcctttatcctactttaggtgacatagtttctttataattttgttatagagttttgtgtgatttatttattttcattagctcaggagttatcatgcaattggaaggagatgcgagtttgttgtataacctcgtatcttctattttagagtcaaaacttattagttgtgtgtaccgatgtggaagatgtaaacaatttacattatataaaataagtacatgccaaccaaatattttttttaacataacaatcggccttgtatatggtacaaatatgatgtccaagaaaagggaaatgaggaagaaaattagaccctagctagcatgcactcaaatatatgtgcaaaatgaacaaccattcatgcatgcctagctaggggaagctaagattaaagaacttcagggttcaatcactagtatggatgcaggggaaccag

SEQ ID NO: 42450 - DNA, 883 bp, Oryza sativa
ttggctaatgggaaatggaaatgatttccaacccaccaaaaggtatctttaaatcctaaccattcattctccctcttccatttaatcataacccttcattcatttcccaatcccaatcccaccccccatttcccattatccaaacacacccttatattatgggaacgaaaggagtagttatcaatcgttaagtttttcttcacatgttacaaagcacaaccattttgctagaaagaaaaagttagacaacgcaacttgagcctgatgtggttttgtgcattagattgcattcgagattcatgcaaagagagaagctagcgggacagttcatcttcctgcatcggatcacagccaagtcaccggcaactctattttttatagtgattttaacatattgtttctttacttaaatgagatgtatttcacatgaaatatggtgtttatatcaatagccagtaaaataatacattatttcttcatttaattttactataggcatttaaattttaaatacgcccgtatttggacatacatgtatgccggtgcgcgtatgcgcgagggcaaaaaggctgaagctttccactgatgcatactggtcaagatcatctcccataggagtcagcagaggtatggggaacaagtctctcacttcctttcgcaaagggtgcaccgtgcacaacagcagagggtgaaacaagtttcgattcaagggaacaacacaagtgtgtcctccctccgtcccaaaataaacatagtcatgagccaattccgtgtccaactttgattatttgtttttttagaaagctaaaaaaacataagtcacgcataaaatactattcatgttttataatctaataacaatagaaatactaattataaaaaa

SEQ ID NO: 42451 - DNA, 3487 bp, Oryza sativa
attttgatcaaagttaaactgttttagtttgatcaagtttatagaaaaaatagtaatattataaatttattataaaattatatttaattattaatttaataaaactaattttggtaatgtaaatattactatatttgtttataaacttagtcaaatttgaagcagttcaactttgaccaaagtcaaaacattttataacgtggaacggagggagtataacttatggacaatgaatttgaacttgcatgcttatatattgatatattttatcattgtttttaatttttttttattgatatgcaatagacaagtagatgtccatctagttgattagaagagtttgcttgataaggagtaactatatgatattcaatcaggggcggagctagaacaaaataaaggggttccactcgcttgttttagtctggtttgaatcaaatttagcttgatacgggtgcctaagtttaaactaacggggtatatatatagtgaaaatagataaattgtagctaaatttttttttgaatcaggttactgggcacccccctagctatacatagctccgccctgtattcgatagttgttttttatgaaaactactccctccatctacttttaatagtcatatttcaccttgacacacagaccaagaataagtaattctacttatcatccatttaaacatgctactagttattcctcgtaaacaagcgattcattaatatttacatttctcaatacccatgtaaccaatcatgtgtggtagaatggagagtcacgcattaaattcgagaaagtcattaagatgatgggtcgttggattgaaatatgactatcaaaaataaaattttcagatttggaaatatgactatcaaaagtagatggagggagtattatataaaaaaaatatctatagtataattagtttcatgctggacttgcaaacgtcgtgagcctccaactgaggttgggagtgctaattttttttttctctcttcgcatgattggcatgaatctctaagcaatttaacggtcacaaatccaattctccacatgtgtgctactgagtattttttgggagtagctatatttatggcgccatatttttcacgaaaaaatagtcggcatgtatttacattgtaacttcctaaattacatatgtaattttagtgtatttacaatataagtctcaaaattacatatgtaagtcttaaaattacatatgtaaatcctaaatttacgtactaattacatatgtaaatggtatgtaagtagggtgtaactactatataaatcagtataaatgtaattattaattttacgacggaggtgaagtgctaatgaggttggagcttgattaggtgcagttggttcattcgcataagctgtacgatgggtgcaggtgcttgaaacgaatctcatcggcggatcttacggttaaaacatccgactgtaaattgccctaaaatatgtcgacacaaatttagcaaaaccttatttttttttctctgcataaatctcaatacaatttaacaaaacttagatgtgtacgtagagaaattacaatgcaactatgatataattgcaatgtatcgaagatgtaattacaatataactatatatatatattataatttttttctggaactacattattaattataatgtaattagtctaatcaccttgtagtaccatattttaatagcacattctctgaaatatagtaaactctcgcagaacacatgcatgtaaaatccaaaatatggttgtcacgataaaacaagaaacccagcgtcctagcccatgatatttttttttgacacgaacccatgatatattgacacacattgaactgttttgtcttgaaaaaactgtcgccacaaatcagcaaatcccttgtttttttactactattccgttttggtttgagttacgtgtcgccgaacgaacttttttcgtttttagattttttttaatatttacagaaataatctatcggcgaacaaaattgcaaaaatagaccctgccgcccaccattggggcggcaagctggcgtggcagacggtgggtcgaccgcgccgtctgccgccgtcggccaaaattacgattaggcccttgccgcctatacagagggcggcaagggacccagatgtaaaaagtacggccaaaagatttttctatgcaatgttaataataaataaagaagtatttgttggtaaaacttgttaatattgttataaaaatgtattgaagttggttgttgcgcaatttcatatgttaagtgaggtattattttgtaccttattcgacgtattagtactcggataattaatataggcctatcgcagtctcggtcgtagaaacattatatggacttaaacaaggagaattatgtaacatgaagaaatagtagtacaatttgaacatgatacaactatttccattgcggttacatagatgatattagatttgaactaggagggaggtagtgcaatagttgaacacaacgacgatatagtaatgggacaaggaagcatgacagcagaaatttcaatatgccaagttgtccgataatagctaacccctacgtgaggatccctctcctctctcaaaccgcgctttagtaaccctgtattgctctggtagttcaagctgcacaacacggctaggtagagttagaacccttctggtgtctatccattctctgtattgacatctcattggtggttcctaggaggaaataatagatgtaaagcgagctaagttagtaaatgttgtgagaaaataaggattcatgtaatcaaaatattcttaccatgaaatcgtcgtccagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgactttcttgtaaacaagtggttaggtcgaggacgggattttctgtatcgacccactcgatgtatgcgcaagccgtagtgcgggtctgccgaatagagtagtgttacgaagaataaagcgattgcctatacggaataaatgagcatatgcagataataaaataccccacggtcatagttagggcacctaaaaaagcgccttcctcgaatatcaggattcctcgaagccattagttggcatcgatcaccgcataggcagagaggacgctggcaccaaggtggtagtaggtatacacaaggatcgctgcgccagtttggatcctcaacaccccggcgtctaaccattgacgaaagccggtaggatttgtaatgaagaagtggggaagagagtactgaatgtgattgagttctgaaagattgtgaggcctcactcgta

SEQ ID NO: 42452 - DNA, 2302 bp, Oryza sativa
ggtcctgggagtaggtgaaacgatccggtggcacagcacgggtagcacgagtgtctggcggaggagtggcctgcgcctggtcctgcgtctgcaccggcggtgcgcctcccagctgtgaggggccgatgacgtcctctgccgagcctgaagcgaagtcgaagtcagtgatgtcgaagagcacggtggaagacagcaagcagtccgacgaggtcccagcatggtccagtggtggaccctgactcgacgtgccggctgcctgtgacgaagtcccggtgtactgctggaactgcgctgagtgcgaggtcgacgcagctgcctgagacgctgaccctgcagcctgggagaagtgggcggcctgcgtcatagcgaactgggcgaaacctacacatcgacaacgggaccttgtaagctaggacataaaatgcatgtaaattgattgtcgaagtaatgttgtttttttaagtacttgtggggggcacaccagaaggcctagccgaggaaggcggggtgctgaacggtgcacgaaaccctgaatcaatcggcaagtgaaacggctcacatatatgtgcgagacatgtacagaaaaatccttaaaaatacttacctctgtgcggagggggagtcggcctaggaacgtgcgcagctggacggggaccagtcggtacgggtggccgctgtacagctgtgtctgcccgagcaacgtcgtctgcacgacaggtgagcactcggagaatcgactccaccatccgcgtgtacgtcgtccggtgttcctctacgggtaccggaatccccgcgtctaaacgttggctcgtcgttgaaccgtcaacgacgacccggttgatgtcgtccacctgcatggttattttgttcatacatattcgtaaaatttgacgatgagaaagacatgaaaacataaaggaatggtgcgatgcatgggtactcacacaacgagcgaagtcctggtcgcggtgcctggcgtagaggtctctagtgctcgcaatgtggggctgttgctccaagggagcgaaggtgaccctagtacgggtgcgtggctggtaccagcgtaggtaggcctagtacgcctcctcagtgtgtggctctccctcgtggtccacgacctccttggttgcgagcaaccagttctcaacaaaagtcgccaacttggcgggccagtcgccagctgactgctgacccttgcgcgagtgcctgcgaattaatgtactagtgcgaaacgtgccgtcagatcgtcctgccagtccacagccgtggtcactggcccaacagtgtctcccgcgagcggtagccccaacaagtacgatacgtcctgtagggtaggggctacctcaccgcatagcaagtgaaaagtgtgcgtctctggcctccatcggtcaaccaaagctgctaggagggacttgtccacagtccatcgtctggccgggtccacgtggccggcggcagcctccaccagccgacacatcggtaggaggccggcctcacgcagcctgcaataagaaattaatatgtcattataaaaaatattacagcgcaactaatttatagtaatacactgttcgtacctctcgacaaaggagtcgtgaaccgtgagtagctcaccgcacgtccgtgcccggaacgtcccaagctgagccccctgcaccgcagtaaggtgagaccggtgtcgctgatctatcgccgggtccaacagctgaggtgtatcctgacgtgccatctctgaaaaatatagtgtttcgtgttagaacaattcaaaaagtagtaatgtaaaacaaaagatgactcgcaaaattatgaaatagtaataaaatcatgagaataattatgtacaacaacagtacaggctatttaaataaagcaaacgttactaatggtacataacgatgacatgcaatttaacatatatgtagagttcgataatataacataacataacataacataacattacgtgtcgaagtccgacatacatcagcatacctaaagacactaggtgccttagtctgacgttacatcacgagacctaaagaaatgacatgccgaagtctgacattacacgacgaaacataaacacatcgataagttcgaaataaattacaagcaaacccacatgccaacatagaacataagaactacaccacgtagccagacgtggcacgacgacacctaggacgtggtcgagtggaggtagtgccttcacccgtagggcgagctccatctgctgctcatcctgatagtcctgcctccgccgcacttggtttctccttgtctttaggccaatgcttgtagg

SEQ ID NO: 42453 - DNA, 10703 bp, Oryza sativa
ttgcctcggagcttcgatgggtcaggaatattgagtacttcatcgttagtctctgtgaactccccagctatgccgaacccataaatctcgccgctccatgtatgatatattgcttgcttactaaagtactgtgacacatatactgcatctggtatgccacactccgctgcggcagcaatgacatgggtgcatggcctgtggagcacttcggctttgaacaagagcaatgacatgtgccgtcggctttcagaacacactcctgcttcactctcttgcggtagatacccctgcctgccttatcttgacataatatctcaaacctgtgttgttgggtaccttgcactagagctcgatgtttcatggcctttttacgcaactcctctagctttttctgcatgaaagttccaaacaaaatgctgttgttcggcatagagggaagaactgcctggaaccgatccctaagatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaaagttggactatccgttgggagacgtccaagagattgaggagggtcatcaacggcggtagatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacacatgcaccacctactttgtacatcgtcccaaacaccagggtatcctggttccatgctcccaaactgcaactcttctatcactcgcagaatgccagcgtgcctatcatgtatcaggcacacatttggcctcataccaacaacttttgttttaaccaaatttcaggaaccagtaccagctgtcggtattctcactctcaacaaaagcaaatgccaagggcaatacctgattgttcccatctacccctattgctgtcaatatctggccccgatactttcctgtcaagaatgtcccatcaatgcagagaactggacgacagttcacgaatgccatcttgcatgcatgtagagctaagaacgccctttgcagcacactcttgccaggatgttcaattgatgggaatttcttcacttcgtaagagctcccagggtttcttccctcgataacaccaagcaggcgtggcaaattgtcatacgaggcttcgtatgttccaaatctcatctctattattttatgtttggccctccaggccttggcatagctaatagtatacttgtatgtctcctcgatgtgtcggattattgaccttggttcatatgtgagattatcgatgacatgcgcatacatctcagatgcaacaaatgcacatgtaatgttcctgtggtatttctgaacaccaggtaaaaaacatgtatgcttggtaacgactgacactgtccaataatccttccatttccccttatacgcgtgcactctccagggacaaccatctttttccttaacacactgaacttcatattgcgaccgattggacttggcaaccgaaaactctctatgaagtgacactgcaaaatgttttaccgcctccttcatatcttctgctctactataaatcgctccctgaataacctcattttctttgtactcccatctcacactatcctctttagagacgatcagcccagaaaaatcctgactagcccattctgctggattaatatccgtctcctcatctgacgaatcaccttcctctacacgctcgttatcagaatcctccctctccatttcatccacaatggctgcgacagtcttcccctcgtcggccactccacctggttgaatgcccacaggagctactacgcccctatcctctcctgcgttgacctcctccacagaagtctcatttacttcagcacttggtccctcgccatcatccatgttcatctgcacacctggatccttcgggtgcacaaacggaaccaaagctagaggccacccacgttgcattgcattttccacataccatctccacacttgagagttttgaactggaattagttcccaataaaaaccctcagttgcccgacttactacaacattgattgttatgtcacttgtctgtggatcaactctcaagcccctcattaaccatccttttatagaaggtacactcctctcagccggtctctcaatttccctttctgatacaataaaatctgacagatctaccccagttggcccgtaacggacgtttcctggtccatggtaaacttggaatattggtttgttcgacatatctgtcaacgaattaactagatcatattactctttcatgcaataaacatctacaacgtaatatcttcttgtgtaagccaatgcaatggtaaagtattgattccaaactagcagatctacgtagttaccgatatctacaatacgcacttctaaattagtacaactaaaaccctaaaaatataatgcatttattcaaacaaatttttaaaaaatacacactatttaactcaatagtcacatataggaactatgaatattacctgaaatcggcatctgaatccggcagggcttcaccccttcttctcttctcctcccctctcttcttttttttttcactggatttgagaggggtgaggaatgagggctgggggctgggcggcaggccttttataggcagcgaggcctgccgcccggccagagggcggcaaggggccgcctgcaaaatggacggccccctgcggctcttttgcattctgcacccttggcgccccaccagagggcggcaagggctttcatgcaaaaaaaaaaccaccctccgtgaccgcccgttcctcccccgtttgccacgtcagcttgccgcccaccattggggcggcagggtctatttttgcaattttgttcgccgatagattatttctgtaaatattaaaaaaatctaaaacgaaaaaaattcgtcgccgaacccgagttgggccagaaggatgtgggcttgtccgactgcgaaaagaaaccatcatcatttatccgagccaataatcttactacttcgctacctaagaggaatcgacaaatcgacacagccaaagccgtcgtcgtcctgcttcctcctcccccgcagtagtcgccgtcgccgccgcgcaatccccaatcccttggtgttcttccccgcctctcgccacccaaaaccctaacccccctctctcactccacccgtgctgtgcacatggaaatccccaatcagatcagcggcggcggcggcggcggatcggttgttatagaaatcccggccgccacggagatcgccggagtggataccgcgccggcaaaggtatgtgacgatgatccccgtgctcaacccctccgcgaccgcgagtgggtgtcgcagctgcccccggaccaccccctacgctacacctgcggccttccgaacggggtcttcctctccatgtccttcgtcaccatcatctacgccgtgattgctccatggatgctgtggcgcgttgctaccgatcatgtgtccctcatgtggacatcgtcgatcctcgcgtgttcctacggcgcactgtggactatagccttgtccgaacggctagcaggtgccttcttggctatcatcttccgcgtctcctatgttgccttggtggccttcgcgtccacgcacctgattggtaccgccaatgggatctcgatcgtgtatctcgacacgttctacgttgctgggatgctcgggtacgccgtcgcggagtatcgtctccgtcgtggtaccgagcaatgccctagcgccatcttagccgccaaacctcctccattggaggaccaagagcgaggcgacgaggaggccgggctctactacatgggcttcttgtttggttcggtatccctctgtttggtggggaggatggcgtggctgcttctctacccctgcggcggcaagtgtctcatctcttacgtcatcgaggagctctcgtttgaggcatcaatgctgatctacatatgggttatctttgtttcccttactcagttggaaggggctctggtctgttacaacactctgttctgcaagatgccaatttgttttggtgcatggttcgttcttggcgtgcttcttggcgtacctgtgagtggtgctattgagatgctaatcttttggattggcactatggctctggctggattctttggatactgtctcgcggttcacgcatattgcaaaaggtaccatctctgttcctggcaagattattttacttttacgtttaattagctgatcagatttatgcagtcaaatataaaactagttgtgaatcatgttcttttttttctatggacaattacatgcaaactatgttttcaacgcttttcaatgtgagctgatgagatttagacaatttgaatatgctgcatgtaccattgcatgtctaacactagacttgttcttggtgggattgtgaggagccaaaatgatatcaatgtttatatcctagactgttctttatactctctccatctacttttgatagccatatttcatcttgatacacagaccaaggataagtaattctacttatcatcaatttaaacatgctactagccattcctcgtaaacaagcgattcattaatatttacatttcttaatgtccatgtagccaatcatgtgtggaagaatgaatagtcacgcattaaattcgagaaaatcattaagatgatagattgttggattgaaatatacctatcaaaaataaaattttcagatttggaaatatgactatcaaaagtagatggagggagtaattcagaacactagacccattcttaatgttgaactgaatatcagtttttgagcaaattgttctgttttttttacgaaacttttaataattagactattgcaaaactgtgcatgattatttatgacattgttggtgtctcttgtggtttttttctgaattttgaacatcatgattcacgaatgccccttttttaataagctgtaagtttgaaaacatatatatgttttagttttcttggatatgttgctatagtaatcttctatgctgaacttaattgttagcgatcatgttgtttctgttcacctaggtaggttgatactattctaaagattttaccatgcatatattatgtgttcaacatttcagtgaatcttgcgtatattgcttaagacattgaaattttgttgtcgacgattgaataggaatcagaagacaccagcttagagatttgcgggagctttgatgaccgttttgagaagccaggctttactctttgttgctcttagagaccaaagagcgattttaaagtatgatcaagatctcattctctaggtgtttggttgagtgctcttagaggcagagtaacgccaatgcctattgtgtgtagtattaacttacattgtatggtaaagtttattgtaaatgttgctgattgtgcataattggaaggtggtgactggatgaagaaatacactgtgttaggttcaggacgaaaaaggttaaggatatgcagaagtagcatatctgatgcaggcgtatatatatattgcaatatccgtcttttgcatttgttgtgttcgatcttataactgctttgacacggcgagaagcacgcaaacacgtttcgacttggctaggctcctagtagttagctagcacgttttgcccggtcagtgttaatttgccgcttggtttgcgtgagtagttaagcatcctggtaagagcaggtacaataatgggcggtagtagatccacgtaggcgcgcgtaattggccgtacatcccacgctattcagagcaaagagatgcctaataaacacatcccctaaagctatattttgggaattaagtctaaatcacaaattgagatcctaatatttcctcacgcccaataccagcccaaaggtgagactcttcaggagctgtccgtgctcctaatcgctgcatacgcaggagaaatcctagaaaatttggcaactctgtacatgtattctgaatgtgggctatagcgtgctgttatgcagagaaagaattgttttgttcatgaaatcagctgtcagttttagtctaattgataatttacttccaacaatcccctatggaaatattgatattttgcttggtagaaaatttgagtgaccaattcctctcaaaggggctgccccgagtagtctctatgcaggatttcttgatttgcttcttggacatcgcatcatatttaagcatgttttccttttttatctatactaatataaaaaggaggagttgtccccctctaatcctataggtgaaatcatccggattaatccgtaccgtccatccgcgcgcaagaggtctccaccgcacgattgagtactggcgcgaagactactctccattcacgcgcggagacttcgctcctcctcctcggcgtcctcactcgctcctctgtactgccgccgcgccgctgcatcctcgccgaagtcgtcttcttctccgtccgccgccggagccgaggtccccttccgccgctgccggatcctaccatccgtcgcggccggcgctcctcctcctcgctcgctcgctcgctccggattactgccgacgcgccgccgcatcctcgccggagccgaggtccccttctgccgccgccggatcctaccatccgctgcggccagcgccgagggcggccccttccgccgccgccgccgacgcagtcagtgcctccctctaccgccgcctaggcccccgcctccgtgccgtccgggagcaggagtttcggcagggtcgtgtggtcgccgtcgtgccgccacagatcgagactcgctgtcgccccgccgcaaatgcctctggatctcgcctcccaccacagccacgtgatcttctctcccaccggccttccactagctgcctgcacctcctcagtcgggtagccgccaccgacccttgcccttcgctgccccgtcatcacggtcgtccaagccgcgtgccgccatcgccagccatccttcttacactcacagaatgtagcgtatcttagcagatgccaatgtgaatgcagtgacatatgtgggcttcagtaattaggaggaaccaaatagcaaagaaggctcctaagctcctggtgcatattttcagttatttcattttctggatctagcttgattgattgacttgaacattccatttttccaggtgacatatatgaggttatgctcctataggttgatttcatatttttttcccctgtgaacgcaactgacctctcggtcaatagttcttccttactgtgattcatgtgcttcaagttaatagtctggttctttcaaaatgagcagatcagtgcttcttgaggtattctactaataacctttgcctttggttttactcacactctgtgagtgtgtaaaagtagctttccactggacttccttgatttccatggatatgcagttagacataggtgtgtgacgcattaacgtgtctttctgcaggttggcacttgataattttgtattgtaatatataaataactcagttgcgcaggtgattaatggttgacagaaaattgccttcaatttagttccgtcaataagatactgtgatctaactcaattctcttccatgcctgacagcattgattcttgctgtaaatttgtatttctctacaaatcaacttttattgctgaaaaaatattcacttcaaatacatagatgtgctttaatgactatttatgatgaaattcattcaaagctttggtttgccatcgtttggccaccagtttttaattccgattgctacagaggaattcgctgttagtttttatttgctatgcttgtttctaatttaccttgcagttgcaattacggagccctcaccaagaacggcaacaacagcaggcaaagctcaacagatttgggtttggcgctgcaagctggaagaagtaggcgcatcaacagcataatcctttcagttttgggatacaagatgcgagtgctcagtcacgaaatgctcttggccaatcaaaggttcgtcatctctaatcacaaaacaacttttgattgcacaacattttcctatataggggtatttttgtgtatatgactaacaaattgttgtattagcttttccaaatatgtgaggtaaggaacagatggacatggaagaattggaggtaaccaatattgttacgcatatattttcctatctgaatctgttgtagagaatggcagatttccttctcacaggcataattgcagacggtcaatactttgaaagggtagcttcggttagaggtttgtagtacctttgctagcatttatctactcatcttggagatattagttaattgtgaatcgatgagcagtggtcaaaaagaagaaagagcatgaaattccataactaaatcttgtgggctattttgtcaatccataactaaacctcagtaaaacttttagtacccaacctgtagatcataactgaatattcacctaatattgtggcctacaatttcatttcccaattcgatgctctagaagtttagaactataacatgcataatttcatttttcttgcactgcataattttgtaattacagcatgtattggacaaacctgcatcttttgcttgtatataaagattatgttgtagaaagcagtggaaatgatttttgatgtttcggttcagtatgcagtggataacgctggtgaaagctccaaaccaaattcgtccgcacgaacaggtaatgatacatttacatttattcagctgatgcattcacgtttccagttcactaattatcaatatgtcaactagaccatcctaatatttatttaattgtttctatacatttctgaatagttgtgccaaccctgactaatctgataccacatattgatgggcctgtactgccaacttttttcatgccttgtgatgtgctgtgcttaaaactcctacactgctcctgaccattgaatcaggcatgtgttttgaatgatgactacttcatgtaagcctatggaaaaaaaaacatttcagtggacggttatattactcaatgtgattactcaatgtgattaaggatagcaccccaaggtgatttagaactggtatttttctgcaggaaatgaacatatgcagtctgtaatgatacctatgtgtttccccgtttcagaaaatgacaatgtatcttgcatccagcatttgtttcttcagaaaatgtacaatgcctataccattcagtgtcacaaaatgtttcttcagaccacacaaagtatgggattgccacgattaaatcttctatccctataagctacaattgatgtacaggtaagatacatcaacctgggatttgttaggtgaattatgtccttgcttagtaataaatggtcttcctgaaattatttttatggacaccattatttgcactattctctatttccatttccgcactgttttacactaagttttctaccacatttatctcttgagtttcataaagttgctgaagtgattaaaatttggttgtattgtacatggagtctaatagttacatatattcttgacattctcaagaatttgttcggtcatcagcagcatatatagtacaagactttgagtttgctagaggcagcaataggataatgatttttgtaaaaagtataggacactaagtttgacaaggatgaaacccataaggattgtagctgaatttttttgtgttgtctatgaaatactactactatgtaatgtggtatgatcaaatggttaccagatttaatccttttacattatattatctacagatttattttgccaggcaagatacttttttttttcaaatgctggaagttactctcttagcaaaatataaagagattaagtctgttatatatatatatatatatatatacttttttttttcaaatgctggaagttactctcttagcaaaatataaagagattaagtctgttatatatatatatatatatatatatatatatatatatatatatatatatatatatatattagcacaaaggtgctttttagtatgtagatctagctaggttctttcagtatgtagttctagatggtgttatgacacaatctgtgccgggttatcctctattaaacatagtttttcatgagttacatttttttttaatgggaaccacaaataaataatgtttgaatgtgctttcttttaaagagaagaatgtgtgttgcagataattgaatcaacatatacttcttatgaagaagaatcactattggtgcacatttcacatggtttggtaactaatttgattgcggctatccatgggcgtgaagcagcatatacagttgcagttctaggagaaccatgtcatcatgtaaaaaacatggcaagacgcaagaatgttggctggatcaatttttcattgatccattatttggtcttgatatgggtaactttcagtcctattttgcatggtcaagtacattgttcattgaggtattctctttcatgcatttt

SEQ ID NO: 42454 - DNA, 4917 bp, Oryza sativa
actctattgatacatgcaagaatgtacagtatatttaattgaaagcatgtcacgtccatgacttttgacaaactagagaatgttgtaggatgaatgtatgtgttgtatagtcttacctgaagctaatttgacctttggtatttacaaaaagtgcctgcaaagagttattaagatattgcaatttacactacaatatatatgtaatttttgaactttggttgttcacatgttgggtgtgatatatattgtggaaaaaagcaataatcttcgggtgattttacatgattagtgtgacatgatgtgggaaacgtgccttgcacgttcacgtttactagtatctgtaatgctagaagatcagcagcatcgacctttttaacctgcatattgtaacgggggaatttcttttatatatatggtacacttttaaatcaaagaacagccatgttctgctttgaaaacacagtaatttctgttattatcctgtaattaagcaatcacaatcagcatatgtggctgttgctcaatggcatatatatatgcacctgcctatgactcgggcggaggtagagtatgtaagggggttaccaggaatctggtcaaaaaaattttttaagctatacttcacatatcttcaccatgtgtgcacctctctcagtgtaaacttaggcacctgcaccaacttaaacttgatttaaagtaaagtaaattaagcaagaggcacctccttcatttcgttctagctccgaggctatgatactactagaaaaacgatttttcatggtgtttggaaaatattcttcatggtggctacaagaaaaaaccgccatcacagaaaattaggggggtggggggtcacgggccgccagcgaaaactgatttttgctggtggccacattaagaggtccaccataaaaaatacttatttttcgaggcgaacctcttaaatgtccgccagcaaaaatcagcgttttcgctggcggctactaaagagatccgccaacaaaaaaacggatctgccagcgaaaagcaaaggctcgctaaaaacttttcacggcatttaaaactatgcgcgcgcgagatcgattccttcacccacccacgcatttaaaaccggttttcacccacccacccagtgcattcatctctcctctatctctttctcatctccacccaccgcatccctctccttctcccccacctctctcccctactcccggagcccccagccctcctcctcctcctgtcggtgacgacgacgactgcgtcgacgacgggcgcggacggcgaggccctcacctctctcccctccccttcctttccctctccctctcccagatctagccggagggagggggcagcggccgccgcggcggcgacggcaggcgggtggcggcggagctgacgcagccgacgacgtgccggacctggcgggcggcggctctcaagcgcgggtggtggcgctcgggcgcgggcggggaggccggcaccgacctcgacgccgttgactgtactgcctggctccctcctctccgacctcgacgccatcgaccatgctgcccggctccctccttcgtgatgatttttgtgatgcttgaatgcttgtgttgatttttgtgatgcttgaatgcttgggtgaacgaaaacagttgactgtaaattgttgatgtaaatttctgtggttttttgaatgctttggtaaatttctgtgaaatttttgaatgctagagcgttgacgaaggcggatggagcggtgtcgctccgtccgccgttttttttaaacttggccagtattaacactcccggctggcacaatgtaacccgccagcgaaaaaatattttcgttggcggccgtcttaagccaaccgtcagcgaaaatggatctttgctggtgactagcttaagatgaccgccagcgaaaatgaattatcgctagcggtcgataaccgctagcggaaatcttgatcttcactggcctttgttttgtggctgctccaaattccgccagtgaaaacctaaaatcatcaccaagaaaaatggttttttagtagtgtgacgagatgtgtatatttgcttgagttatctgctcttgcacttgtatattttgtatatggtgagtttgtttctaaatcctatgcatgtgaagatatatggtgaatggtagcattcctgattcttgtcaagatgaattctactgtgaagtatcaaatatgaaatgttgtgaattatctgtgaaccctgacatatatgcactactgtcaagacgttgtaattttttttctaaatctttcaggttaataataagagaaaattcgacctatagcacaggaaaaaaagcggtaccaaaaaatagcataaaaagttcccactttcgatctatagcataggccaccgtttttttcgcccggtagcacttccgtcgcattttgaagtaacggcgttagatcggagtggagaaaatttttgtcggactcatttacccttcgttccccacttgtttggccgcgtgttcggtgacgcctgcgccggcggcggcggaggtcacggaggagtagaggccgctgcttaggaggctgttcctcgaggaggggcggaactcgtccatcaggttgtcgtcgtcgtcgttggacatcaccgagctggacggcatgtcgccggacagctactgtgtctgggtgtcctcgccgtcgccagcatcctcgccgtcgcgccccccacggaagagcgggtcgacggggtccatcacgtggtggcgctgcatcagcaagctcgtcatcggccgcaaccacagcgacggcaaggagaagttccgcgctgtcgtccccggccagggagcaccccaaaccgaagcccaccgacgaagggcgccaccgccaccaaaccgcgttcttcactgacggcggcaaagaggccgcttgaggacgaggacgacgatgatgacgtgggcggccctagcgtcgatgtggatggatgtgggccgttgtacgccctcgggctcattagctccgtcatcgccgatggcgctggcgaacaacgccatggtggccgtactcggcgtcgcagcccacacctccgctgtcctatccctgctgctactcgccgtcgaggttgctgcctacctccaggggtggaacctcgaggaggtggcgtcactccccgctatcgacggcctcttcgccgcgcctccattgccctcttgctcgggaaaaagggcaaatgagtcatttttcatgtcgactcacatgtttggatggcaaatgtgacgggagtgctataaatcgcaagaaaattagtgtcatgtgcttctggtcgaagtagaaaatttgtcgtgctattttttggtaccgggttttttcctatgctacggatcgaattttctctaataataagcactactggatcgtagcagcgtcatgcacagggagaaagagatcgtaaagctagggatcgtcttcgccttccttctccacatgtgcaacccgacgtacgatgaactgtagcggcaaaaaggaaaatcagatagcggcgacgggcgaggcgtcgaggtactgtagcggcaccggcaccgtatgcacagcaagaaaattagatggatcaactgaactaggcccacctgctgactccagcctctaaacgggttttgggttttgagggaaaaaaaaaggttaattggattcatgccatcgtaaatatgcatacttagataaataccattacaattcacctattcgtagctatactattgaaattttataaaattaggatacaagccactgcccgtcatgtttccatccatctcttttttttccgttttctcccggccggcgacacgagttgagctgtcccccggcgtgcatgagccggcgacgcgccatggtcgcgagcccgcgcatgcgacaccacggacgagagtccacgctggtaacgcacaagtcacgccacaccgagcgccgacaaggctgcagcgccaaggtgccgcccgccgtgcctgcgtcacgctgtcgcacggcctcgccgagcagcgccatcgttgcagagctgctgcggctgccaagccactgggttgcggcgcaccgccccacggcgactggcaccatcaaagaagaaaagaaaacgaaaaaagaaaaagaaaaaaaaaactgagagcagcaccggatgaccgagctactagcctggtgcgcgtcgccgttgctcgcgttgtgccccggccgccgcagccgcacagccacgccagcgccgtcgatccgggcgttccccggccgctgcagatggcagagtcatcaggggagaagaaggaaaaggaaagagaaggggaacgcgggaggcagtgtcgatggcgacgccgttcaccgtcgcccacgctgcgccagcacggaggccactgcacccgcgccgaggccgccgccccccgagctcgcgctgaaacgtaggcatcgatgcaggcgtactcgaccttcgccgcgtcgagatcccgtttctcctagttgcttatggtgacgcttggcttctccgtgagtccgtgtcgaggccgagccagtggttgcaggcatcctccaggtccaccggccggcgcggcgcacgagacaccgtagtcggcgtccagcttcgccgcgtcctctccaacgccaatgcttgcgtcggggcgctgcacgccatgctttcttgtgccatgccattgtaaatcggtagctcaggaagaagacgggagaaaaaaaatggaagaaaacggaagaagatggttggaacgagacggaagtggcatgattctaattttgtaaaatttcaatggcacggttataaatagataaattgtaatgacatttatctaaatacgcatatttacaatggcatggattcaattaacaaaaaaaagaaaaaaagaggtccaacgtacagggtccctactactagagtcctagg

SEQ ID NO: 42455 - DNA, 1850 bp, Oryza sativa
ccttattactctagtcaagtaccgcgccatgctcgatccaaacttgaggtaaagcccaaattggatcgtaaccatgggttgggctcagaattttatgggccgaatctgagtcgtaccaacccgaatttttaggtgagagatgccactgaataggcccccggttttttacgctttcctcagaaagcaaaatccgcattcgactgagggttacgtaaacaaagtcccattgggggatccgccatctcaggtgaggaggcgggtagtttcctagatcaatcagcttgctcggtagtttcccagatcagatcctggtacctgcacaggcactgcaccattcctgacgttgctgctagctcttcctcattcagtgaccactttattagcagtaattcaacttactgtttcagcagatgagcaacacagtgccaggacaaaatgattactgcattttgatgtacatctacaggcaaaatcacaaatgggagagcacctgcaaaggtgtgtaaagttttgacgtgtcatcgggtattatatagggtgttcagacacttataaaaaactaattacaaaatccgtcagtaaaccgtgagacagatttattaagcctaattaatccatcattagcaaatatttactgcagcactacattgtcaaattatggagcaattagacttaaaagattcgtctcacaaattaatcgcaattgtattttttagcctttttttaatactttatacaaatgtttaaatattcaatgtgactgggtgaaaaaaaatttagggtgggatctaaacagggcctaaaaaacaaaaggccgacttaaaaccagtttagatgacagggtgagctgcactgttgcagccagcaatggtcatggtcccagtgccaggcaaagttaaataatgaacagcccatgttcttcaggcacaggctgggcacaacccatgttcctgaattgatgcactcagtacatggcaccagcaatgcaacctttttacagtaccgaaggaaccaaaccagcataacatttctgcggctcaagtgttgattgtgaccatgaattaccctcaaaagaactatagtacattacgaccagtaaatagataaagcattcgtgtattaacactcatggatcagcagcaatgggagaactatcagtaatgtggcccagaggagaattatcatgccatagattgcaataaataataaccaaaaaccatcaatcaaacgatcaaagaaccagatcacttatcttggagatgaatgtacaagataaatgataacatgactcgcacaagtacgattacaatagacgatcctaggtagtgggtacatctcccatttttcttttggtcctaccactaaccacaaacttagcatgacaaaagttggaccatgcatgccatgtataatacagcagccaccggacaaatgcataccaagagttcagaaggtgcataatattcagccatgaaacaaatccaacaacattctgataggacaccaacaatcccaaacagagtagcttacatgacaagggcttgtgaaaactgaaaagaaactgccttgtagataagcgattaaaaagccagagcttagaagcacttccggtgaacaattgctggacccgactcatcatactctccctttgagatccacatctgtagcatagatgccaaaagaatgatgttaacagaaagcagaaatacctgcattcttgctacctcataaagtgtaggcgtaaggtttacctgttggaaggtgctaagggaggcaaggatggaccctcctatccagacactgtatttcctctcaggcggtgccaccaccttgatcttcatgctgcttgg

SEQ ID NO: 42456 - DNA, 2072 bp, Oryza sativa
acgtgcgtgcgtgcgtggggagggacagatgaggaagaggacacgcagatgcatgctcaccggggatgcggccggaggagggaggacggtggcggcggcgcggcgggacggggagatcggcggcggaggcggtggcggcggtgaactccgagtcgcgaggaggcgagagtggagtcgacgcggagtcgagggggggagggggaggggtagataagagaagagaggggggttcctcgactagggccacacaatcattttttggacacaattaagcgcgctctgatttttcttttttcacttcttgggtacggttacgctctgaatctgagaactgagaagttggcgcctgtctgtcccaaaacaaaaataggaccctctatggctctatgggtttgtctatactgaatcccgcttccaaaatttaaagtttaaggtttgctttcaggttctttttcatctaagtttatcttttacattcaattttaaatcgctaagaatacatacataaaaaatttacctataaattattttttctctaatacgttgtacggcatttggcaaaaaaaagaaaaaaaaaaggaggagcctacgagttctcctaacacgatctctcatcaacttcggttatgtcgagctgaaaaacaaactagatggtagtatttcttttcacagtccagcatggattgaaataggagcacctatgaaaattttcatacaagcatgatgaagaagacgtcatctttatccacatatttggtcaatgaccattttcacgagcgtaggcaggtagtagagtgctcgtcaagggtgctagtgcatacctcaaggtgattataaccggttcatcacctataatatctcgacatggtagagcatgtaacttatttgctatacaagtaaaccacttaaaatgtactaatataacttagttttataatgcaaacaaaaatttattctttacaagaacacaatttaaaattaaaaatgtgtctctatattcttcctttgtgccttattttacttgttttttctcactcctcttccataattatattgttagcctagttgacagctaggtcgtatgccagtgttttgtaatatatatgatcggttctttttacatgagttagtagtaatattgtacttgtacatatagtctacatgcatccatccatatgcttttttaaaaataatctgagagatttttttaaatataatccagtatgatttgaggtacgatatatgtgtaatttacacctttttatatttaagaaaagaaaaaccatgttaggcctcgtttggatcacattaattttcttcaatttcgtgcatgaattgattttcttcataatgctgataaatttgtttccaaacaaatcttggtaatcaatgctttttcaaaaggatatattatccttccatttgaacatttcttcatagaaaaagaaaaccatggtgtccgggctcttaactaattatcgcgttaacggtgcacatacattaacacacacgggcaatacggattaaaggtgcgattagtgcgctaatcaagtgggatcagcacaattaacctaagctaggcatggcagcaacacagccaggaacagctgttgcctgcgctgtcgtctgcctgactgatgatatgatccgatgggatcttgattttggggaaggatggaagaatttcaggctattttagtacacccccatgtgtgcctgaaaagctgcttgctgttcttgcgctgtttgatcaactcgctttattaattttgttcctcccccccagctgtgttgatcatgaccacatgtgggcaacccctggaaagaaaagcaagtaaagcttaattgggttggaatcataatcagttcatcaatcagagaactcaatgtattgtagttttgcttgctagatcatggcgacagagaaaaacattccatagtgaaattctaaaattttgggtgttttttttctaataatacgtgctaagtgttacgtaaaaagagattggtcatctggcaaacctatggctgcggctgctgcagtccactccttgcctcactgttggtgctgg

SEQ ID NO: 42457 - DNA, 800 bp, Oryza sativa
aacaccgccttgaacttatgtgtgtttaataatataaaattaaccgtaaagttttttcttttattgtctaatttctagacaatattcaaccaaatgttagaagacatgcaatttgatgaaaaaggatgggtttctgtgtgatattatggctaaaatatgaggccccggttattccgcaatcgattttgctatacatcactcgggtgattctttacctgatatttgacgttttttctggccgctactatctccagggttggggtgggggcccatacggccaggataaagcattgcatgcagcaactccagtgggatcattagacgtgcgatttttttttctctcatttgttgttttttcgcgctgctctctatccttctctctcatttgaaactaaaataaaaataaaatacaaaattacagtcctatataactaaaattacatttgtaaattcagttgatacgatatgtaagtgcgctgtaattttgataacaatgatgtgtcagtaaatatgtatttgttattttctttaaaatataaaattacagtcctatataactaaaattacatttgtaaattcagttgatatgagatgtaagtgcactgtaattttgataaaaatattgcgtaagtatatatatatatatatgtgtgtgtgtgtgtatatatgtatgtatgtatgtatgtatgtatgtatgtatgtatgtatgtatgtatgtatatatatatatatatatatatatatatatatatatatatatatatatatatatatatatatatatatatatatatatatat

SEQ ID NO: 42458 - DNA, 1821 bp, Oryza sativa
tcaaactgcttcaagtttgaccaaatttatagaaaaaacatagtaatactttcaatccaagataaatttattataaaaatacatttaattgttaatttaataaaactaatttggtaatgtgaatattactatatgtctataagcttagtcaaacttgaagcagtttgactttaaccaaagtcgaaacattttttaacttgaaacagagggagttcactaagccatgcgtgtttaaagtacttctgagatggtaaaacatctcacaataaaatgataaatggtactctccggttttatgttcgacttggctgattttttaaatatatttatcattcattttattaaaataaatacacaattaattatcatttgtatatattgttgttatctgttttattaataaaggtaatttgagcatgattttttgcttcttgttgttatatttgcgcaaagtttttaaatatgatgaatgggcaaacatatgtaattatgtacaacattaaagactaaaggagtaattatgtaatttattccgaatgagacgaatggttaagttgtatattcaaaagtcaaagacgttgagctgaatatatacgtgcataactgggtatccacaaggttatttgttaaaaaaatgcatgtgcaaaagagaggcagacatcgcaagtatgtatatatgtcttgtgccgtagttgtaggatggtaacgctgtcaaactctaacatttctgatgtcatcttcctttttcaggaaaaaaaaagcatgtgcacttaatttggagtggcatttagtaaggaaaaacttaatttataccggcagatttctaattaaagcaaacctctcacaatcatattactactaatatatggaaggaaatcaaggaagttcgattgaagacattaattaattattgcccgatgcatgcatgctcctgcatgcttacgtacgtgcatgcgtgcgtgacggtcacatgtaataacgggatcaaatcttaatttcttagttctaaaaaaaaatcttaatttctttgttgtatataatggctgatcagacgaattactagatgcatcgtaaagtttattaagatgtacacatgcctatccttaattatgaatggttaatttggaagtgcacctaggtatctagctccttaattcgattgatcgatcgattgtgtccatagctagctgcgcatgtgattgatgcaaaggaggaacggctggtccaatgctgcctgcctctgaactctctggtagccatggtgacaacatcaatcgactgatcagcaagcacaggcatactcctgcatacaccccctcctcctctcacatacactgatacacacacatacacgaaaaagagtagccgctagcctgcaatccccgaaaggtgcataccttttgccaaagaaccactactaccttttgcccaagaacaaacaagactagtattgctctagctagctgctcagatgaataaattaatatatactgtactactatgtaatatgtacctagctaggcgaatatatgtatagatatagcgtatataatacgttaatgttacactaataatacagttaatataggcaaaaattaactaaaaattcaaattcgttgatcccaggtagtataattatcttgaatacttgattttaatattttatggacatgcattttaatttcaggaatgacggaataccacctcgcccaccctccggtatatattgaaactatttcaccgaacaaacaaaaaatcaaattcggtcaaactttgtttacatttcaaataacttggtttcgagctaagcgagagcaggtg

SEQ ID NO: 42459 - DNA, 4832 bp, Oryza sativa
  unsure (1)..(4832): unsure at all n locations
tatatacccctttgtaactggaaaaacaaaattaaccaacattatcggtacttggtattcacttaggacttcatcaacataaacttccatgtactgatcttaggcatattactagtatacgaaccacagccaattgaagtaaaatattcacatttgctggaccttgaaatgggagaagcacatagattatacatacttcaaatttttttgtgtggttgtatatgccatcctaacaaattcaggtttgaatcaattaaatagcatgatatctttgcttcttattgttgcatagtttgaatagattaaataacacaatatctttgttgagagacattctataactaaactaaaaaacaatctctgcttttttttccgtgctacaaataacgtgcaaaataaagccctatgaataaacaatgtgcaattattggagcggagaacagtgaggatggatggcctaggcggcgagtagggcaacagcgggcaacgaggaggatagttgtgtgggctggcggacggggttgcatggcgacgatctcttggtcgtcaagagagcgtgtcgagggagccaagggaacttggaggaggagggagcttggagggcgtgatgatggcagggtaaaacagtcttagggtctgtttggtagaattccaacgcctggatcctaactcctaactccaactccagtaggagctaactcctataggatctgagaatgatctaaaagtgtttggttagattgatcagttccaaaactcttaaaagagagaagggaggaaagatggacaatactgcccatggcttcttatatctgataatttcatgtttatttatatatgataattcatgtttgtgatagaatcacccacatgcatgcaaaatcactatttctcttccagatctgaaattgaaaaaaaaaaggaaaaatgcaaaaacaccggccgtgcgccgcccgctcgcgccagagagccgccgcccgcgcttcgcccactcgtgtcgaagggccgccgtctgctcgttccagaggttcacggcccgcacgccacccgcctgcgtgtcgtcagcccactcgcgccggaggtcccgttgtccgcccgtgtgcgccggagggccgccgccgtcgccctcgtgccgcctacccgcaccggatttgggagaggtgagggttacaggaaagagagagaggggtaaggaggtgggtttgaggtcgttcaatgacattttttgcgtaaataccttaaaaattaaagggtaatgtgtgttttggggtggagtggagagatggagcagcaaaaacccagctccacccccatagtacaattttgtggagcaactctgctagctccgctccaaaaaatgaaggatctagaccgtttgacacggcttcttctctaggtaagttggagttgggaggtagagctgtgccaaacaggtccttataatgtgtttgcgagggtccaggggataggatcggatcgagtgagttcacttgttggattgcatggcacatggtggagcttgaaatctggaccattggatgacatggttgaaaatgactaaggatagcatgtatacacttctcctgggtgaagctagcaaagagtatgaccggtgcttttcatattggaatagaaatagaaaaatacaaataaatagctggtttttaatgtttgacttattttgtatctcaatgttatatacttatatctaccattagttccttaaaattgtttggttaggcagttaaggcttgttacgctaccttttcaatctaccatactctgtttattgatggactaaactgctatttatatgtgcatcatcaattaggaactcttttaattgccatttttaaatttttatgtttaactatttgccatccatatgtcaattacatgtgggccctcgtatatctgacacgtgggtctagctagtggctaatagttaaatatctctagtatgatgtactctgtgatgcatgccccttttttttacttcttttgtatccattcatgtataattggtgaatttgtgaatacagggtcttcttctcgaatgccacaaattgggcttcaactttctatgattgctttaccccgctaacactgtggttagaggggatttactctggaatcgttctgctcctcttcgtgctctttattggaaatctggatgaaaactggggccgcataatgatagagttttctggggtggccatacagatggctggaatattttgctttgtgatgataaaggtgtcacgtgatgacaattacacgatgaaagaagctcaaaaacaggtatggataagggttcaagaattctgttatttcacacttataagaaacatgagattcattgaaaaaaaatctcctatgcagagtatcatggcccttgtcatcttcaagattttctcttttattatccttacgttcatcaaggctaagttggtgcccacagaagataacgtcgtgatcccaagagcatttgctgccataggttgtctgatccaatttgtgctaatgttgagttcgcctatcggccgttgggtaggtgatggctttctctcatttaaactctatatgtggttgttgaataagctttgttcttatttagtctttcttccttttcagttggacaacaattttaatgatgatgagcctaccacccgcaagatcaagttgtcggcagctctgatcaggctaatcacgctatcattcgactgctggcttttcactgtaagaggatactggagctcgccactgaagaagccattggcggtaagtgattcaaggttttaacccctctagattctgccaagaatggttcaagttattatttgttcaagtttaaaagttagggtgaaaaacaattagttttgtcgttgagggtgaaaatggacttccagcaattcaagggagataatggaatctactaaaagaatggataagtcctttttttactagttctattgttaccacttcaactttactcgatgtctatttgtcacctacacttataaaactagacaaacttcatcttaattatgattgtttctattgttagcttttgccctataaagaatcacactattatttttatgctatatatgttgctaacttgcatttttcccgcacatcatgtgcttaacatatctttactcctcacatcccttcactgtattatgcgatagaatgatgggagaaatgtgtggcatgtagagtcactgccatttttctaatgtttggggtgaaaattttacttggaacaaaattaagggtcatatataaatgtatttatcctagtatttctaatgtgtgcatgcaggaaatgacagcaaccaacttggtctttaccagcattgtggtggtctgtcgttacataggccccaacaagctcaggaacttttgtgttgatatttggaattggcttcgggctgtcccggaaaagcttcaaggcaagtggaatagcttcatacagtggaagaccgacaactggactccattcacgaatacagtgaaggtagcattacagagtttctgtactggctgttgcgctatgtttcaaactgggtggaatgcattgaagaacagggtgagtcaatgcattgaggacatgtggaatatactggctggtccgggtggaatgcattgaacatcaagatgagtcaatgggttgagctgtgttacttcagcagtaaagcagagtacaatatgcacgattttgttaatcgatctttacttatacaaagtttgttgatctttacttactagctgggttacttcagcagccggaggctgtgttcggacttttttttgttgagtgattagattttgttgaatgtattctcttccactatgacttccccggctgtattcatatagcgtttatgccaactgtatatagtcactaggtcagatatattaatatatagtgacacgtttgagtggggacgtatctaatgtaatttctgcttccattttcccgaactatagaaagcatgtttctacttactacttccaatattctgatattgttcttgtttccggcatcagaatgattctggtttgaaaaggtttaagaaatgcttggaacagttttctttcttttctcgatgctggtcgattacatgccaaaacagaaatgacgatccatgtccacaatgctcagaccgaataaatccacatgctttgatatgggaaatggtggcttttattacaagtcatgaaacccaaacagtcacaatagacacaattaactcattcagtttcaagtgcgaacaaggttacgcaaatagaacaagtcactgatccaaaagtagcagccggtcatcatttgagcttctcaaggagtttcggtgctacctgcagatgcaccccacagaaaatatgttattaacctagcttatatatgcagagcttctccataaatcatttgtttggttccagatatgcgatattgcacacacacatgcagatacttacacatttgtcaatgcatgaccaatagtcgaaatattgcccagtgcagtgtttatgcccagtatcatccttctcactctcttgacgcacttctgcaaaccatacaaacaccattaggatttaagcgttgaattcatcatagcgcatatcattgctaagtcgtcgcgatattatgagcctagggtgaaagggaacatcatgatggctggcaactcgaaatttagcatagaagattactacaacacaatatcaaagaaaattgaacatatatctggttttnnnnnnnnnnnnnnnnnnnnnnnnnnnnnnnnnnnnnnnnnnnnnnnnnnnnnnnnnnnnnnnnnnnnnnn

SEQ ID NO: 42460 - DNA, 17623 bp, Oryza sativa
  unsure (1)..(17623): unsure at all n locations
nnnnnnnnnnnnnnnnnnnnnnnnnnnnnnnnnnaccatataaaaatgtcacattattatccactaacaatatgccaaatcaccatccactaataattactctctcggttccatgatataaggcacaactattttttttggatgttccataatataaggcatatatgcatgtataaaattaatcaggacctcttctccattaaattattactttttaaatcctccaccctcaagatctctaattctattggatgcatgcattatatttattagggtgattcaaactaggatatgataataattattttttggtctttgcgttaaaggtggtcgtgccttatattttggaacggagggtgtattatatttaaacatcatacaagcatgctatattatctatagttttatattttattaaattttagagcttttaaaatgcaaacatgctaaatcgttattccacataattcacataatattttaatatatatatttattattttttataatatcatatatacctgtatagttcattctcacttagttaatgttgtttctctcttctcttattaagcaatattacattaattgtttttagtccttagatgattaattaatctatgatccaaattatatatcttcttttttctctcattaagccatatcacctcaattgtttatagctgttagatgattaatctatatggtccaaactatctccttcgttttgttctcataaagccacatcactttacttttatatttatatttgaatcattattctatatactatttaaatttaaattatcataaaccacatcaacttacataagcttatattatcttgctatcttatatattatttttacttattgttattatactaaaattttataacaacacgcggagtttcacctaatttatatagattcggaatatgtgttcacatagataaacggcatgcatgccattgatcatcttttattaatatttatgcgggtgacactgggtagaaagcagtgcccaacataattattcagagatttatataccatcaaggtattctatcttacctaggatattttaaccactacttcatataccacacactactacaaaacatcacaacagtgccgccaatcactgcaggttagttaaaaaccgacgctctctataaatcaatgactgttaattagactgtaaaaaaaacacagggatcaaatgagagagacatagacttaaaggaaaattttcaagagataaaatgcacgagaacacatgcatgtttcctagtttttaagaaaattgacgcaaagttacttttgcgaaagctgaatgcttcaaaaaaaaccaaacggccaggttaatatagttaatttaggaaaaatgatgccatattaatgacttaaaatgaccagtaaaccttttattgtaacagcagttgcttcctaacaaaccaatcatacagcacagccacgccagtagacccagccaacattgaagagcttgccgatgatcctcccaagaacaccagtggtggcagtgggaccagcgtgttatcccgacgagctaccttgacagtgacctatggctgtgtttagttgagggggaagtttggattttggttaaaattgaagatgatgtgactgaaaagttgtatgtgtatgatgggttgatgtgacggaaaaggactgaagtttaaagtttagatccaaattttgaatctaaacacagcctatatatcattggaaggcgttggtcagcacaacataggtcacctcagctgggccataccatgtgatgaccgtctcgactatggcactgttgtagtcggtgaagtcacaggtgcaggtattgcagaatatctccccaacgttatcttcctcatcgtcatcttcttcttcttggctaccgtcatggagattgatcaggtcaatgccgacatacaccgagatggcaaaagatgggccagttagcacgaggttcccctgttttgagagaaaacataacccaattaaaagtggtttaagcattcttcgaaagcataaaatttacataattttcacaaaaattatattgaatcccatgaaaatattttcgagagttaatttcagtttggacccttcttatcgaggtttaacattggaccttatttactccataatttcaccttggacacctttattttacccttagtttttcctctgtactcccttttattcatactcaagatttgtctcagtgtgctacaattatctgcaccttggtcatacttcacactcatcttgtctcgttacgtccggaaaaatacaaccatttttttaaacgcttattgtattaatccctgtcccatgaacacgccaaattcctcgctgttctactgctgcctttctttgtttcctctgtttcttctcatcttcttactctccaagtcttccaaatcgccgtcgttgcggcagagctcctcggtgcactagctctaattttgattgcctccggttagttttatggtgatgattcactcggcttcttctttatggactgctcgttgctgctgattgatctacagtgctgcttgatcaccatcgatactgtaagtatcatgtattcaacatgttcttctactaatctccaggcatgagttgcatcgatctagttaattagtgattattgcattttctataatttagtatatgtgcaaaagctatgcagggtactgttcatgtagattatatataatatcattgcaggagcctaattatcgactcacttccaattatgtccgatgttctatgcattgcatgcaacgcaattgtttaccaactagtgggaagctctgcagtattttcattcatggattcttctattgactacttttgttattgcagcagtagattacgttcttaattttgttaaggtcattcgcgatgatattaattcatgagctccgtttgatgcgtgtatggcatgtttgattcgatcatttcaataagctgcttaaaaattgattttttttagacacaccccctttattttttttcaaacgggccgaaaaaagacccatacgtacaaagattttcgaggtggccagcaaatacctgtatgtgaaaattaattttcgtgtgcgaaccttgtgatatgttcgcatgcacaaataggtaaattgctttatttgtgtagacaggcctgttaagaggcgtgcctagtaaaaaatcaaccgctcaatcctctccccctcttcttttctctcctctctttaaaaaaaaaaatctaattccccacttctctcctctcatctcctcctttttcaccagccccctcctccaccggctggccacgggagcagcaacaacggtcgtgatgaaggcagcgacaagagcggccacgacgcccggagggacaacgatgtgagccgcggaacaggcttgagctggcataaatggacccacgatggccggatccaacggcggtggccttgccacagttggatccagcggagatggcctaggatgacaacctcaacaatgacgatgaccccgactgtttgcgcgtaatggtagcgggagcagccaccgagcgccttggcagctcctcctccactaccactggcaggcttgcaaaggccggatccggcgctggcgggctcgcgacagccggatcctgagaaggtggccccgggtcgatgattccgattgctagcagcggtggtggctagggtttcttgaccggagggcatggatcgatggcggcatcccctagatctagtgagaggggaaggaagcagtggagagggcttcggatccaacggtggggtcgtcgtgttcaccccgatgaaccctgtttgacagtgacccatccttcgacgacgttggtcagcactgcgtaggtcacctaagcggggccatatagcctcgattatggccatgttgtagtcagtgaagagaccgttgcatgtattgcagattatctccacctcgttctcatcattatcttcattttgttcgctaccgtcatggagacaatgggtacagataacaggggcatatgccaaggtggcaaacaatggactggttagcatgatgctgccctgttttgagagagaaaaaataatccaattgaacctagaatatgcattatttgaaagcatcaattttacaagatttttaaaaaatatatcaaatcccacaaaaataattttaagagtgaaaattcagtctggactccttactgaagttccatgttacaccccctttagcccatactagaaaattggctgccggttggctcgccttgtagctagcccgtccatatggctttaaaaaaatcatttaatcaatatagcctcttatattgctacatcgatttctattttgttgtaacctatagcaggtagtatttttccttgtcatatgctaatcaccatctattacatatatgcaggtaattttcagggcaacgcactggctccggttttaggcaagctacaaagatgtgagtatgatggggagttcctaaaggttgcatgccgcaggttggagtcaatgcttatgtaactatttgctaattatgggtgaaggttaacaaatagacttcaataaatgtgttcttcttaaatgtgttcttcttattttggctaggttacctttgtttactcgtttctggggtgctactttgtaataattggatgtaactctttttaagcaaatgctgggatgatatattctattatcttaaaaaaatgcatattggctctgcgctagcttgttgcaacccgcagggaatggggttagaccggctgtgctgtgctcgggtggagcatgctaaggtatagctttgtaaaaaaagaaaaaaaaaagtacgaattacccaattacagtactagactattttaaccctaaattttttaaactggataaattacctcctataactcagctcgaagcggttttaatcttagtctcgaagcggttttaatcccacaggcacacaagtggcagtctaatcgataaaaataataaaaaatagtgggccccgcttatcagcatcttctctcttttgctttcttccacctccttcccctcccatccatctctctctccagtcaccaaggagcactgagtaatggcagcaacggcatcaccaacgcgggaggagaggagcagcaggtagcgtgcgtcttgcagcctcaacggcacgcgctaggggtggcggaggacggcgcgacagtctaggcgagggcggcggcagcattcccggcggcaggcggcaatggtgtgcgagacgagggcggcgaaacgggatgcggcctcggcttccatcaacacgcgggagctagggcgagctccggcgctgaacctctccggtaaccggctcaccggcgagttactggaggggttcttctcgctggcgctgctcgagaaggtggatctctccgggatgccggcgagcgccttcctcggcacgacgctctgcggcgccctgctcgccccgtgcgccaaccccgcgctgctgccgtcatcgctcgggaacagcaagggcggagggaagctcacccgtggcgcggtcatcggcatcatcctcgacgtcgtggctgtgctcatcgtcatgcttgttgggaatagtcccacgttgaaagtttagggggagtgacaccaacttaaaaaggggaggggtccctcacctcatgagctagcttttggggtgtagaaaggctttctcccggttgggccaacatctcccggttttgggccaacaagtggtatcagagctgggcccacaatctctctaagtgccgtgcacactcgtgtggtgtaagcccgaagcccagtggaccgcgggtgtgaggcccgtatgtgcctatgtgttgggccagtcagtggaccgcgggtgtgaggcctgtatgtgctcgtgtgtggagcctggtcagggctaaggggcaccaatgtgtgacgggagagattgttgggaatagtcccacattgaaagtttagggggagtggcaccaacttaaaaacgggaggggtccctcacctcatgagctagcttttggggtgtagaaaggctttctcccggttttgagccaacaatgctcgccgtggggtacttggcatgcttccggcgctgagcagagcaacggctggtcggagcaccaccaccgcagcggccacccccgacatgacggagcccatcacggtgaccgtggcgaggacggacagcgagacaaggacgtcgccgtcaagcagtcagcagtcgcactcgctggcgatgatgacaggcgaaggcaacaagctggtgttcctcgacagcgtgccggagcggccgtacgacctggacacgctgctgcgcgcgtcggtcgaggtgatgcttgcgcgggtggtcgattacgaggagtgcggcggcggcggcggcagcagcgaggtggtggtttgctctggtggtggagagaggtaggaggggagtgacctgatagtgggccccaccgacttttttaaatgaattgatgactggactgccacgcatataccacgtaggaccgaaaccactccggattgagttaagagggttatttgtccggttttaatagttgagggtctaaaaggtctggttttcgagttcgagggggtaattcagtcgtctacgatagttcaagaggtaattcgtactttttcctaaaaatacaacgctatgtttgtacattgacttagcataatatcgttgcacgcatcatggtattgataggatcatcacttcaaatgagttcacgcgcgatttgaaattattaccttcccatatatatgattgatgtagcattattatttaactttactttttctccattttcttttttactatagcccttttgtgccttcagtatttttgagttagtttataattttctttggagatagcagtgctgttattttattggtgtttcaaagtttggtagggtaataaacctttgttacatagttgtacaatgtatgtatttgattttttttttagaaagtggctaagtccataccagtttgtttattagattatatatgctcagatttttgtaataaaaaatagtcgtgacatccttttaaatataaaattttataattttacacttagctttctttacaacatgtaggagtgaaatagagcaagaaaagaataataaggaagatagagggaaaaaaaaagaaaggggggggggggcaaggcaggcccaagacaaacaggcccagcacccgtctcctacctgttgggccaggcgagctgaagcccacgccccagcagcagccagtttggctctagtgcgggcgtagcgcgagcgtttgatgaagcggtagcacgcgttgcgcaactattggtgccacgtggcgcataattttgcaagagaacccgtcaattttagaatattagatttttatttttgttttttatacattttttttgtttcactttgaactcctttttacctaatcctcaatgttactctccgtgtgacaacgtaaactgcactctggtgctcatctcgaccatgccgttgcattgatgtcctttgcatacccaaagacggcagggttcaggaaaatgggactaaagtgaatcaagaagatgtttaaaaagggtgtccaaagtgaaaatatgctaaaccaaatcgaaacttgggttaaatactaaagttaatctatttctttcttgattaatatgaatgctagttgcaaatatacgagttcaaaatttttgagtttttcatttgcactataataagaaaaaaagcaatgtacttgtatgtagcaccaataattattggtccggaacaaattaaggagctacacaaatcctgaattgctcattcgccattactagtcacgggaatattaggccctgttcatattatagccaaaataaaacttaccaaattttagcaatgccaaaattttgacaagatggtaatattgttaaaattttggcaggatttcttatgtatttaacaaatttagcgacaacctaaacatagatatttttttgacagcttaaaaaaaaagggtatggttgaaaatggcattaaagtgaacaggcccttagtcttgagactcttgtgtaggtttagactctgttgtacagttttagctaaggcccagtttagtttccacaaaaaaaacttttcaccatgttaaatcgaatgtttgcaactcttgtgtaggtttatcttgtgtaggtttagactctgttgtacagttttggctaaaacccaatttagttcccacgcaaaaattttcaccatgtcaaatcgaatgtttggacacatgcatagagtattaaatatagacaataaaaaataattacaaagatttgcgtgtaaaattgcgagacgaatcttttaagcctaattgctccatgatttgataatgtggtgctagagtaaacatttgctaatgacagattaattaggcttaataaattcgtctcgcagtttacaggcggaatctgtaatttgttttgttattagtctatgtttaatacttcaaatgtgtatccgtatattcgatgtgacacgccaaaacttttcgtctcacgatctaaacacagcctaaattcagagtatgaaacaaagtctgatggtttacgcaggaaagctgatttatgagtcagattctagaattgtggaatacgatgggagtcttacacaggggcggaacccaatggaccaagggggtgcccaggaacccggcccaaaatctaaaataccttgttaccctcgtacctagggaaaagtacacccaaggccccttaacttgtcatcgagatacaaaatcgtcccccaatcataaaaccagataccgggcgtctctcaactaacaaaaccattcgctttaggtttctcggtggttttgacccggttttatcccacgtggcggctgagtcagcgtgggacccacgtgggtcccacatgtcaggctatccatgtcagcctcctctctctctctttcccatccttccccttcctcatctctctctctcatttttctcctcttgtccgacggagcaagcgagccatcgctcggcggcgacgatgcgggagaaggggagtgcgttaccgatgcagtgggcacggcaggcccggcgggggaggagcgcggcggtggctcctggaaaacacggcctcgagctcactcccacgcgcttcaaccgcgcgtgccggtcccaggaggctgtcgtctccgatgatggcgacaacggcgacgatggagacgcgctaccaccgccgacaacgacggagccgctccgacgatctaccaccgacagcaacgacggagccgcgcccgcgcgctcctgattcctaaaggcggtgcctgcttccgcgcttcgtcgcccgtcacctgattcaagaaccgatggctgcggcgacggcagccgtgcagcagctggccgcggacggtgaaggtgacggcgtaggcgcccacgccacgggcccgcgcgtagccgtcggcggcgtaaccggcgttgagctcgttgcagcagccaacgatgtggaggccgggctcggcgatgaggtggttgagaatcgtgaggttcaagtccccgggcacggcgaagacgtcgctgacgcccacctgcacgaggcggtgtgccaagtggcggccgagtgtggtgtcgccggaggcagcggacggcaccaccgcctccttaggagatcctcctccgccggtggtctccattgtccttgttatcgatcgatcttaattactccgcatgcgggcgtatatatatgcatgatgaagagatgatgtgcgtggtggctgttgtaaatatgtggttgtcgatcgatcttaattactttgcatgcgggatttttcgccgccgctgtcctcatccgctcccgctgctcctttgatggtgcccgcgatgacggtaccggccctaggaggttgtcgccgacggcggtggcggcaacgacgacgaagacgcaccaacgcgctacatccgctgtcgccgctgacgaagccgctcctgggcagacgtgctaccgccgccgccgccgacgcgcggacgcgctactgccgctgctgccgatgcgctacagtcgtcgccgccgacggaaccgctcctgggcagacgcgcttccgccaccgccgtcgacagagccgacgactcatctgggtgtgtgtaggagagaggaagagaggaggaagggagaggaggctaacatggatagtttgacatgtagggcccacgtgggtcctacgctgactcagccgccacgtcagacaaaaccaggatcaaaaccaccgagagacctaaagtgaacggttttatcagttgagggacgcccggtatcagattttgcgtttggaggatgattttatatctcgatgacaagttgagggaccttggatgcactttttcctcatacctacagcatagaggcaccacaccctcctctcgtccggcccaaatttgaaaggcccaaccagaagaaagccccaaaaccaaaacgattttgctatatctcactcggaagattttttcttatctctcactcgattttctcacttaaatttacagtgcattttcttgtaagttacagtgtaatttatgaaacttacactgtaacttttgtaagttacactgtaatttttgaatcttcacatgtaaattttaaattttgtattggatttggtctttttctcgaggatatggtaatttaatgttcattatggtgtttcttaattgctttttgctttttattatatctatcggattttaatacaaatattaaaaatctgtgtgatacgattataaaaatcttttgaaagatgtataggtactcccaaaccaaaaattaagcagtgggagaaactgaaacgtccaacgacgcttcccctcgaagcctcgcgtgataccgaagcggtagtttcgattttctcgcctgagtcgcctcaacgcccaatctctctcctcgcattcgtctgacctgtcacctctccccgggaggtcgcccttttctcgccgcctcaccggggacccagcccggcagccccaatcgaagaaatttctcatgtgtaaagcactaaagcctttccctggtaggtttgcctcccttttccaaaattttgcactgattaggctagcttagggcttgcaactatagaggcatatagagatagatgacgggggcaggaggaggatgactggaggaggacggcggcaagctgcaagctagcaacggccaatagctggagcttgccggctggccgctcaccctagcttatcgatctactctgagccccacaaaaattgcagccagcagcactagctgagagcaactgaataagtgaactctttctctcaatttttcttatccttagtttgtagttttgtgccaaaataaacttgaaaatttttatttggtcttaatagattgctatatagcactggatagtacgaacaatatgaagaaatttgttttaatttgtaccaaatcatttcataacttattctcggttgaaaattaaactatattttcaaggtcattatcctatggaggaatgaagacggtgacattcgcatgatatattcatattattagttgatttcttcattatggtacgtattttttatttttttatgtatttcttgtggtatattcccttcaaatgaagaaataatgcttatatttatttattggtatgcaactatttagtataatatcgctctataattatagatgttagtattacataaataaaggtaggaatccctcgtcttttctctagctccgcccctagtcttacatgggtgtcgcagggcggtgggtaggtggagtcgtcagtacggctgcggctgtagatgacgtcgttgcagaagctgatggtgccgcagggcggcggcgcccgcgaagatctccgcagttggtcgtacgcggccagatcgtcgccggtcggggcgtcgctgtaccccgtcgccgccgccatgaatgagagatcgaatactctcgtcgatcgatcggcacccgcccaccgattaccgaatgtatcggggacagtctgcactgagcgaatagtatcaaatcagtgggtagagaaagacgcaaacggaaatcaaaaccagaaggagaagaatcaaggaggaggaagctggagtggaggaggagatcgatcgtcgaaccttgcggcgccggagcaccgatcaccgctgtcgggcgtggagtagcactctaggagagaactagacaaaaaggaaggagagaagatcgaacgactactcgacgaggattgccgggatgcggcgggccggggagcagcgtggaggctggatccgggcatgacgacgacctctctctaggccgcaccgccgtgtgcgtgtgcccctcctccccgagccgccccggccccgccgcgtgcctccgccacgatggaaaatttttaatgtgttttttctacttttgtatttttcaaaagaatttctcaaggaaatagtccaaatatcaccttagactttggacgaaattccatctagaatcatgagttttaaaacccgatatctaaccccctaaattttatattaccctctaagatgattttggatggtggtttttcatattttgaaagcttacatgaacaactttgaataactaatataatatatttgcataccatcaattgtaagtcaccaatttatactcatacagtgatactatattattattatacactggttcttatttataaatgtgagctaacgagtgataaaaagaaagatttaattaagtggagattttaatatatatatgtccaatttgtatatcacatgatcaaattcatccaagttatatacaaattagataaaaatcactaaacaaaatcaccttaggggataatatgaacgattttgcaaagtttagggagttgaatttctagttttaaagttcaggatgatggatggatttctatctaaggtttatggggggtatttggattttcttcatttttccaataatgcattctaaaagggccctgacagaacaaaatgattctctgataaaatttcattttaattttcctagatggaaatcacacgaaccactgttttcaaaggttcgataatacaagttgcaaatgcccacggtaataccattgtcttcttccaattaattaatgtcgatcagtatatagtcaactgcattatatatatgcctcacgtctgcaaaagggacgtgtgtattaccttctcccacagcgcgcacagtaagcagcaaccaacaagcacgctggcacacagtagatagctagatgagattattacttcaatttattcgttgcgcatataattaagaagaaaccaagatcattctgtactgctgccaatttatagctagtcagtccggtgtccatagacgcaagctctactgctgttgctcgatcgaccggtgtttgcaattatcatgagcctggtcaagaagtaagtttttaatttgttcactttattgcctatttcattatctacagattagtgaaatactccttccgtccaaaataaaaacacactaatctccttccgtccaaaataaaaacatatagtatagattaatggacaaagagtttttcagatttgttgtattagtaggggtcatatttcgattattttttattttcggatggagggagtacacatttatggcatagtttagatctaaagtttggatacaaacttcagtcctttaccatcacatcaacctgtcatatacatacaacttttcagtcacatcatctccaattttaaccaaaatccaaactttgcgctgaactaaacacagcctatagagagcgagatagcccgcaaaattgatcgactctatgccgctgaattgacaatctcattccaagtttcccacacgatttctgaggaattgtccgtggtacggcgttttttgaaccagaaaaggtccgcaaaacgaagttaattaagacaaacatatagtacgatctatattttgctccagatctccgatgttttagagaaaatatagttttatatatactcaatatcgtaatcatattctcttgagctatcccaacgcaattgtaaaagcgtgcgttgctaattgctctaggactgcaggatttctcacataatttcactgatatatcactactacgaaaccggtttttgcaaacgggcgaaaaacatttttgtatgtggttggaccagccgcatgcatgaaaagatcagcgaaagtcacgatttttgcatccggctagggcaaccacatgcgaaaatcgctattttcgcatgcggttgcttacataggccgcatgcaagaataaaaatccaaaaaaaataaaatcgcaaaaaaaaaatcacgtcggccgcgcaccggcgtcgtgccctccgctcccaccgtcgtgggagccaccactgcccgctcccaccgccgtccactccagccatcggatctgtgcaggacaaggcccgccgccgccggatctgggtgggaggaggcccaccgctgctgctcccaccggcgtcgtggaagccgctcccaccggcgtcgccgctagccgctcccgctgccagacctgggcgggaggaggccgtgcgcccgccgtcgaccgctattgccacctcctcctcctcctcgtcgacggttgcagcatcgggggggaatggagccggtcgccttctcgtcgttgtcggcggcggcggtgagttggggatggcggttgcgccgccgcccactcactggatccgccgcctccgttgcgcgcctgccgtagccatagccggagctggccctcctgagggtggcgccgccggatgcgctgtccgtcgacgccatcgccgcccagcctgctcctggccgccagcgcccactctcggagagggagagggagaggatagaagaaagagagagagaggagaggagagaaagagagaggggagagtaaaataatagaggggtagagagaggaaatgagttagaaaaaaattgaagtggtgagagggaaaagagagtggagggatatgaaaaaaataggggtggcatttttgcatacgggtatcttaagtggtccgcaattttacatgcggacaacttaagcgttcgcatgcaaaaatcatgcggctttctaaacttcgaatcgaattttataatactaaatgaactcatgtgaaaaaattgtcaaaaataaagctgcaaaactcattgagatctgccaatttgcttttggtcatttctccatccgaatttgattgcactatataaaatttgaattttaaaatataagaaattcaaataatttttcagctagtaaatgatttcaaacggaaaaattgtcaacaataaagttgtataaagcatcaagatctacaacttttgttttggtcatttttctatatgactttgtttcaataatttgaatttgaattttaaattatgacaacttcaaataatatttcaaatactaaataatttcaactgaaaaagtcatcaacaacaaaaacaacaaagttgtataagtcatcaagacctataacttttattttagtcatttcttcatccgacaaagttataataatattgttcaccaatttaacatatatctcatatggttttataaattataagagagatatgtaaattttttgaacaatgttactatcactttgtcggatgaagaaatggctaaaattaaaattttatatcttgatgagttctacaacttttatgttcatgactttttcagctgaaattatctactacttcaaaatattatttgaagttgtcatctttttaaattcaaaattttaattgataaaacaaagtcacaagaaaaaatggccaaaataatagcattaagaacacaataacatgatagagcatgattttaaaaatatttaggaaaaaaccatccaatttggagttcatatgagtaagataaactagtttcaaaatttcaaattttattttcgcatattttcaaattttattttcgtatatggccccttcaggaaaatcgatttttccatatgggcgtcttaaggagccatatgcgaaaatgccgctcgatttttccagacacggtaagttatggtccgtttgcaaatatcgtgagatctcgtacacaaaaatcgtttgtggactagtgtatagagctgttttaaagcgtcagaacacacgaatttgtactccgtaactcattaagtcataggttaaaaaacactcatttgtagtgttacaaagtactccctttgccctataaaaatccaatcatgtatatgtctatatttaaacgcaggattgggtttttacggaacaagggagtacgttgtaactatattctttacaaatgaaaaaaaataatgcaaaaccatatatgtagcgcaaacttaaatattactgtagattccagaaaagcatgtctgagacttatcaacgtcattatgagtacaacaagtagggatacaatttataaataacataatatcggaataaaaaatattaatttttcagaaaaacacaatccatctagaaacacaatgatgacaaatgacaataaaaaagggagaagcaagagggccgcgaaggagcagggcgacagtggttgatgtgacatctaaaaatataaataaacatcaaatagaatcccaatgatgattaagaggagggacgacagccaggacattaggcatctgttaagccgatggttggcggaacttctataaagtaaaaaataaaccacaatgataatcaccatgatttttaaaatctcaatgacaataaaaaggaagggcaacaagtgtaaaaactataaacaaaactccaaataaaatactagtgatgattaataggagagatgacgggcaactcgttaagcatcacaatcacggtggttggcgagacttttagaaagtaaaaataaaccacaatataatcacatttgattttaaaatattcaatgataattaaaaaaaagtatcgtgcagggtgtagaggacttctagatgacggtttggcaggacttctataaagttaaaagtgaacaccgatactaattatgttcgagtttcaaaatctcaatgacgataaagaaaggaaacggacggacagtagaggagtagagtggcggcatttgacgggacttctaaaaattataaaaatgaaagccaacaagatatttaactctaaaatttataaggtgcaattttaaatttccaaggaggacgaatagaagccgtaatagatcgagcatgcaaataaatgggtgacaaaggagtaagaggtagtgataggtgtgacttttaaaaactacaaaattagaaatatggagatgataaggttcagtcttttaaagtccgaaaataatgagataaccatttaacaaattttaagtgaactcatatgtaaataattttgtatggatacttgtcgtgcgattgcgtgggccacctagctagttcttattttatcttatagtaattatcaggtttatactacatattttcccacaaagaattcatttaacacttgatatgtgtgtatacacctatagtaaaacaaccagtgaataatacagaactgtaggcaaataatacaaataatttgtaaaattatgattgttttgtccct

SEQ ID NO: 42461 - DNA, 9503 bp, Oryza sativa
caacaatgtcgaggcatacgtcgacgacatcgttgtcaagaccaagacaagcgactaattgattgacgatctgcgggaaacgttcgacaacctccgacgatatcgcctcatgctcaatccagagaagtgcacgttcggagtaccgtcgggcaagctgctcggtttccttgtctctagcagaggaatagaagcaaatcccgagaagatcaaggcaatcgagaacatgaagtcgcccacaagactcaaggaagtacaaaaactaaccggatgcatggcagcactaagcaggtttgttgccaggatgggagaacgaggacaacccttcttcactctgctgaagaagcaagacaaatttgtatggacacaggaagccgaagaggcattcgttgcactcaagcgctacctatcaaacccccctgtacttgttgctccccaacctaatgaagaattattcctctatattgccgccacgtcatattccgttagcaccgtcattgttgtcgagagagagaaagtacaacgaccagtctattacgtcagcgaagctctccacgacgcaaagacaagatatccacagatccaaaagctgctttacgctgtaatcatgacatcaaggaagctacaccactactttcaagcccacatagtcacagttgtctcctccttccctctcagtgaagttgtgagaaacaaagacgttgtcggccgcattgcgaaatgggtagtcgagctgaaacaacttctgacgtgtcattcagcctcaatcggccaactcatagattcccctccacctcagcacatttggttgcttcaccaagcacggaaagccaaaatatgatacctgttcctcatcaaaactattactctaggctcacacaatttcgtgtcccgtgccctccgggaagagagaaaggaccaaaggaggagaggcatccacaccaccgagctcgtcgaaaagagagagaaagaggaccgggctagcgctggcgacacagccaccgcggacaagaaccggaaggggtgaagaagggaggagggggaaaggggagctcgacgtcgatccacgccgccgcttaagcctcaccgccgccgccattgttgggggtggaggagagggcgccgacgaagacaggaggggggagagggagaggagctctcggtcaacccgtggtgccggtggaagaggaggaggggaggcgcggcagccggatgaggaggggaggcacagcggaggtggtgctccacccccgacggcgccggctaacctcgtcgtccaacgctactgtgccgccgagctccggtgaggaggaggggggtggtgtgccggcgagcactaggccccaccgcctggctctctatggtagggaaaactgggaaaggaagaggggagagagggggaggggaaaagtgaaaagtaaagtagtagtggtgggacccactataaacatcttgcattgtagaacatgtggctaacattgtttttggtctaggtggcatgcgaagtccaccaaagcttcgtgacacactatgaaagcccttagtaccggtttagaaattggcattgatgcgcatgtacgagcaaaaaagaatatgaagcggcggctccaagaatcggctctagccgattcttcgagcccgcccccatgatccacgttttcaaattcatatcccttaatcaatccccttcgacaacaagaacactcaatcccagattgatcaaccggaagattaactataaatcaatcacaagcaagaacatgaagagggtctggacattcctcaaacaagagtgaaaaattataaatattaatttataaaggtgaggctgaggatctgtacaccggagaaaaagagggcaacaactgctagtctgctaccacctctccctagggtttatcttatcgtttgggccggggttaccgtcactccgtggtagctcgataactgtgataatcacgcggtgaccgcctataatcgcacaaaaatcacttccaaaaaattgaattcaaaactctatggtttcgcggtttcaccgcggttaccgcacggtttaccgcgatatgtgggatgtgggatttgaactcaagatctctcacctcaggcctcacgcgtgttgccatcatacctactacacacatctagcttggataagatactttgttttttaattaaccctgaagacatctttagtactagttagtaacaccaatcggtactaaaatatcttaagttcagattgatgttacagtgctggttggtaacaccaacccgaactaaagatcctctagctttagtctcggttggtgtgttaacaaccggtgctaaaaatgtttctagggacttatacttttagaactggtagtaaagcatctttagcactgttttttaatctaatcaagatatttgtgttttgggggtgtaggatataaaagatcatttctctagtacttgtgtatgtatgttttttttttgacatattttctattcaaatttgtagtattagaatgtatatttgtttagatttatgatattaggatgtgacttattttatactaggttggtttattttgagattgagagaattaatatattagtatatgatatgcattgttttagtacttgttacactaattaaaattcctcgaccgaacgaaatcggcgtggcaaaataatcttggctagctaagtaataaatcggaggatggagagaacagtcgtcgttgagaatgtggactacaatatcatgacaagcaactacagtgatttcatcatcgacctccaaagcaggctcgctgagcatccagaacaggctaacttccacggccgtcccgtgctagcaaggcaatgccatcctaaacagccggcgagatggttgtacattaaccttgtgggcgagaacaacgatagggcaaccctagccgtccgggatgacaatgtctaccttattggcttcaggaacctgaacggaaaatggttccatttggggttctcgctgaggagcgttccgattcttccggaaccatccacgtttttggagtgcgacgtcacttatcgaagcttacttggtggaaatgtgaaagatgttctggtgagggtggacgtgcggaagatttctgtgatacatgccgtccatagactatcgggctacgcgcagcgtcgatgtggagtcgatggagccaccaaacgggatctagcacgcctgattgtcgtgatctgcgagtctgctaggatggctgcacactacaacacggtaaacgatggttggctcattcgcaacaggcaaattagactcgacctttggcacgtggattacctgtggaactgggggcttatgtcgtgggtggtgcagcagcagggagggaagatgtggcccatcaggcttataaactccggaatcaacagcataagtgaggcgctcgcagtactccaactgctgcttaacacggcgagaaggcctttgccagatctaccacgagcttcaccgccgccgccagtgctctatctgccacgtcaggcggcaccggcagtaccctgcccaccggcgcctccgttatggttgccatcgccatcggtgccgtcgtcattggcgttacatgtgcccctctttcatgcgtcctccttagaaagatggagtcctacagcattagctatggcgccgccgtcattgccgttacgtgtgccgttctttcatgcgtcctccgtagaagaaaagactcctgcagcatcaactgatggcgacgaaggatctaccgtcgactactgtgttggacgcttattagtggaggtgttggccgtgtggtccagctttgacagctgtaccatcgcagtatttgacgggaaacgcggccagatcatctacgagaaccaccgaggagatcacgatggcatccacgattctcaggtaaggaggacggagtatatatatatggactctctccgtcccataatataaaagattttgggtggatataacattcgtacattgaattttaacagatcgtctatttagatttattataccaagatatgttacatccatctaaaattttttatattataaaacggagggagtacgtttctagctatagtcttaccgttacttcttgtgaaaatgaaagatggcacattcgtggatgtgcatatactactccagccagtacttctctctgtcctaaaatacaataatttgaaactggattgaacatattttagtcgtaggttgtattttttttagaattaaatagtacaaagcagacactcacaacgcacgcacactcacgaatttgaaaagcttataagggtggtatactaaccgaataatacctattggattttaaaagtacgatttcttcatgaattttatccgttagcgttgcatgataaatttaattttgtcatttatagaattacctgctggagattgggttcaaaaattatggtatctagggcagctgactcttgaagttccattagaaaaatagaaaaatagagaaaacttatattgctataaaagacattagatatataaccatatataaattaaattacgcctgcttttttctttatcagaatttttagaattttctttaacttgttaagagaatatttaggagcattaatcacatatttgatttaattttaaattttttttgtgttgtttatcaatcataaaatccaggtactatttcttacttcgtgcatgcatgcctgccgggcatatgtaaattctggtctatgcaactgcaagcttgtcacacagagacataattaaccctaacgtggtatttgcctatttgatggggtcacgtcatgtaactggattgggatgaccaattttaaattttttttgtgttgtttatcaatcataaaattcagggactatttcttacgtccatgcctatatgcctgccggacatatgtaatttctggtctatgcaactacaagctatgcaactgcaagcttgtcacacagaggcataattaaccctaatttggtagtatttgcctatttgatggggtcacgtcatgtaggacatgggtggataggacatggcggcccattttttgtgggtgtttggttgctgggcaggggtgggatggggcggcccgaagaggaatattctcctcagatgctggatggggggatccgaccgatttgcccggatccagccgcccgagcgcccgggcaagctaggcaagcgagggaggcggtcgcgtcacccgcgagcgagggagggaggcggtcgccgggcgagctggccggcaggatgcgggcacggtggccggcgcgggtgcggcaacgggaagcgggagcggcggcagcaaggagaagagggggtggcggtgagcccgaaggcggcagcagcgggaggagggaaggagacgacggcggcaatgcgagttcggcggcggcgggaggcaagctcggcagcggcgcgggatgcgagctcgtcggcggcgggaggcgagctcggcagcgacgccagatgcgagcttagcagtggcgggaagaggagcgacggtgagcccggaggcggcgggagcagcgagctcggcggaggcaccggaggccttctcttttttttttcctatctccttctctctcttttttttttgggggaatttgtgatttgtagtatatatgaatttgatgaggggggtatgctcaccctttctaagtgagaggtgaccacacctgctcatccacctacttcctccaaccaaacaaaaaattggatcaccaaatccatcttcatccctacaaccaaataaaaaactggatcgccatatttacccaatcaaacaaaaaactgaatcgccctatccaacaaaatatggtccgccatatcccatccaacctatccaatcttgaccgtgaaccaaacacaccctagctggattcggatgaccggggtaggcccgagcacgggagaggagggtgggcctgggatgacacctttgactttttatgtatatgtttcatcatccgtctcaattttaaaaaatatatgtgattaattttttttcggggaatgtgattaatttatagatgaactatttttttcatatttatataaaatgtttgaatgagatggatggtcaaatatatatagaaaagttaaagttcacggtgtcaatctattaaaatcggaggaagtaataaaatgtataatgtgcaggtatagggatcacactatttttttatttgacaataaatcatagtccatgtgcaccttaaataattgattgaaatgtcatgatataaaaaaaagactaatcatcaaacaactcaacttataaaaagttattcctagacgatcacacatatattagctcatgtctccacatgcatgtaggcttgcatgagacacccgtaactgggagattaggctatctatccatggaatttttatttaaaatcagtaacaaaataatgatttagatcttaaccaccgtggagaaaaaaaggggagggaggagagacgcatacacaggcgcgtgaggggaggcgagggcaacgacgccgtacaacattggacccacacattcaaggaaaaatcatacgtggcagtctgagagcgtttttaaatcgccatatggtcgtttgagagcgtttttagaaagtttaatggaagaaaaatcatatgtggcagtctgagagcgtttttagatcgccatgtggccgcttgagagcgtttttaggaagtttaatagacttttagtatataatagaagataaatttagattcgttggattaggatatgtcttatccaattatagattgttatattttagtacggaggcagtatatgtgtagttgtgtgcacacgtgtgtgtattagaaaagtacttgttgattgactgaaactctgaaggtgctatatatacagggtaatttgatgctgactggaccgtacagggccatctcagccgacgggagcttcctgatcgaagttcataccaacaatgctggcgatgttgatggtacgctgttttgggactgctacgacgaccgcaacgaccatgagcacgacataacattgactaacaccatcaacacaagccttggccccgttgaggtgacctacgcggtgctgaccgacgcagtggaggccaccgtgcaggtcaagctgctgcatgcttctcgccggatacagcaccgccacgcggtcgctgccaccatcttcgtctacggtgatatcaccgcgcgcagcgaatgcttcagcgtcgggagcgtgctcttcagccgtggctcgcagaacaaggtggcgctcacctcgggctccacccttcttccactgtcgcgatgcgttgttgcggtgccacttaacgaccaggtcgagatagaggtgaagctgtatgttggaacttccagcgaagagagtatcaattacacttttatccatcgtattctcgtgttctactcgggcggtgaacagctggcacaacaaatattcctccatggcaacccagcgattgaagtcacttggacaccgtacttctgaaggcaagttgaactatcaacctacttcaaattaacgttgtatgttccttcttaattacattttttggactcatatattagattgaccatatatatcatatatcttccaatatttaattttacagcgagtgctaaacagcataagttgacaaggagattaattatctgcagttacaactactacagtggctgcaaggacagccaactgcatccatccagaaaatatgttgggtcggtatatatctagatatctctcaattactctacatgactatgtgttccagtaaataaggctctttacataaacggaattgtttaaatacgacgatttcagtaaagaagcaggttagtgtgtgctctatatatgatctgtactagtacaatatatactatgtgctcctatacgttctgtgatttgtccaagatatttatcatacaggtgattaattgtgtgtcagtgtgtggttgtgaactcatattgtactagccacttagtcgtgcgttgcacgactttgaattcccatatgaaagccatgtatatatacatcgtaattaaatcaaaatcaccaatgatgagcgaattaaactcattaagatgagactgaatagatttaccttctgccatgcgaattgtgtacgggtgttatttgaggcataatttgttggcgagacttttcttcatgtatataaaaggcaggtgtataatcatgaaattatatgcttgaaatttgaatatttgcaagattgtatgacatgataattaaatctagaaagacctttatttccaactaaaaggttcaaacgttatattcaaaattgaccgtttactgttggttccaataaaaaaatgctcattttatgctcatactactgaagtgcttgttgagttcctagtatgtttttatgagctggggtaaaagaattaggcaagcacagcatctggcccctcgttggcttcttcccgatgtctctagactgtttgctctttttgtactgagcttctttcactagatcgtacggcatggactgaatttctgttgcatccaacggctcacattaagcagatccgacggtggtcgtttaccagcagttgtatcggacggtccctgttttatggatgacgtggcccaaccagattgcaagaaactttatttctttcaatactttagatccctcgaatagtttgattgttaactataatatacaagtatgtgactattgattgtcgaagctgctcctgtttaatttttacattaatgaaaatggattacatctccagcttctgttatgacacacaaccataaattttatagtaataaaaaaaggtaaagataaaagtaaatcaaaatgagaaataaagtgatgggacaaatctccaactcccctttactattgactagcgttaaatcacataaatttttttagttagcaattataatggaactacatcacccatagtggaataatagacccttggctaccgattcgaagagtgtagcaccattgcgcatagtatcctgctcctcctgtggtagcattttagaccaaaagtggagccagtaagaagacattaagataacctgcatagggttagataattggttaccattaaaaactttatcattacgacaacgccaaattgaccaacatacaacactagcttggaaatgctactgggcgagcgattgccctcgcccgcccagggcgatcagatccccctcctcctccccctccctccctccacctggtttccttttttggcgccgtattactttcctattttagtaaatttatacacctaaagtttatacacctcaagtttacacatctaaagtttagagaccaaaagtttatatatccgattcaaatttgaatttgaattcaaatattttttatatatagtatttctatacatctaaagtttatacacctaaaatttgtagacttaaagtttatagacctaaagtttatatatccgattcgaatttgaattcaaat

SEQ ID NO: 42462 - DNA, 6191 bp, Oryza sativa
ctaaaaaaaagatgttggattgtcttttgtgcatagtagaatgaacaatgtttgtccccaagttttatttttgccaggttatctttcgctagaactactttcttgtgaagaaactacataaagaccttgatctttagtgaaatttttaagtcccactagaatttacagttcatgatcgcgccatacatagatttgattaaaatttggccattcttatggaacgaccatacaaaacagtccttttcatttgacagaataatattagctagcctgaggatcaaatcgttccactcgacgcgcgcgctgccgctgctgcacttcaccctctcgctgctcgccggcgaggacctcctcttcttgaccgccctccgcacccaccactccaccacgtcgtcgccgcccgccgtctccctctcccgctttgtctcatatggttcaatagaacctagaagatgagcgagggtcattcagtaaagtatctttttcaaatggtaaaaaatgataagagcaccactaatagtgattaacaaattgctctactttggagtgctctcagatgagtagctacagtaaatggtcatgagagcactaccaagggaagtccaaccatgagattgttacttggatctcatcaccacccattccaataacacgttgtacatgttgatcactagtctaaggttcaaattcgacggcagctctgacaatctcatcaccggaaaaagaacgcaagtccaaatcgatcgtcaacagcatcatatatagctggttctgcgaacgcacgccctgccaatgggatcaagtagagatggcaatgggggcccgttcaccgtttccccgcggtgaattcacctattaggtgacggggatggttaatatctactcaccatggggaataaaatggttaaaaccctctcaccatcggggatgacggggacggtgaaccattaaccgtccccgccccccacggtgacccgactgtactgtacaagggaggaattctagactttttagatgtattgacccacaatattgaagcccatttaacaggcacatatataatctaaccctaagtcaataggtcaaactccaaatcctccacccacccaaatccacaccagccaccactcccggccgagtcacgcgcgccgccggtcgccagtccgccgggagccgcgcgcgccgccgttcgccagccaccaccgacgccgccgggagccaccacgcatgccaccactcgctgccttctctcgccgggagactgaagccgccgtcgccatggactgaagccgtcgttgctggcctccttcgtcgatgcgccgccgggcctgcagccgtcttcaccgggagccgccggcagcctccgtcgacgcgccgccagcctgcagccgtcttcaccgggagccgtcgtcggcgcgccgccgagagccgccgtcgccgccgccatctgtcgaccatggcttcggcctctcccccgtaagctacgacagcgacgatgcaaggtgagcatactacaatccctaatcccttctctgtgcggggacgggttcaccacgaggaaaaattcaccgcgtggtgatcagggatggagaaattatagccccgtcgtggttgacgggggcggggacggtgaaatattttcaccacggtgacggggacgcaagcatgacccccgacggtgaattcaccgttgccatctctaggatcaacccgttcgatcctatatgtgtgccgctacttaagtcgctgtagaacaggacgcaaccaacatcgagaagcttgttgcgtgcgacaatcctcccaagaacgccggtgcttgcaatggagtctgttggcaactttttgtgacaagttaacaagcacaatcacaacactgtacctaaacgccttacggtgattgtagagtcaccaaccaccctaacccagcaagcactaggtcaagatgggttttgatagattaaaccagctagcagagccgatttagatgaaaactagggataactatccatctcgtaggcaaatggaaggttttcagaacaaacctacaaagaggtgtcgcactctcacagcggcagtggataatttacaacgcaaatcgacaaagatagacgaactaaactagaactaattgaaagtaaaaaagcaatattgaaaaaaacgattctattgattgatcgttggatagattacaattgaaccggccttgtcccttatataggggttgatcttaccctctacaggctctcctccacgtccaactcgggatagaaaccaaaagaaatccgaaacatgccttcccaagcaagaaaaattcgagacccgacaaaacagactcgggctcggactctgccggtcagaccagccacatgtcggcggtctgaccggagttcaggccacggtctgaccggcctatacacggcggtcagatcggcctgctagaggaaaacaccgttggatcccaaactttggcaattattcctatttcaatcctaggtgctaaatttgggtgtaaacacataccccctacctttttggtgaacaacgtgaacctgaaggcatagaacatgttgtcttagggtgataatccaattaccggccatagaactttctaaatatcttgccaaacactcgggaagtatttcttcaagtagttcccattgactgctctctgaaaacgctctccatgaagtgtctccaaaaaatacgcgttccctgaacaatcccgcatactcgataaggacattcccaactaggagaccaattaccgaactccttagatcgagtaccctctcccacttgaaacaattttgctttcacccttttgttgtatgctttagccactctcttcttctctttctctatttcttccaaagcctttaaacgtttgttgataacatcatcaagattatccctatcaaggtcttgtagtctccactcaacaaatcgtcttgcttgatataccgaagagagtcaagatttacctcgaccgacaaaacggcttcatatacataaatcaactcaaaaggagtgaccttagtagcaccatgtttagatatcctatgcgcccataatgcttcagaaagcaccttatgccacttatttgggtgttcttcaatcttctttttgactaatttcaacaatgttttattactcgattcagcttgtccattagcctgagcgtagtaaggagaagaactcaacaatttaataccgtaagattcggcaaaattcttcacttccttagacataaaagaagcttaaaggtataaattcgtaattacaacttaaaataaggacaagaaaacaattaccctttaaaaaacttaatttaatagtggaccataaaaaaaaccttatttcaaaaattcgactgtaacctcaatactaagtccgaagatgatgagatctaacaactaaacgttgcatagggcagcaacctctctgccgccatgctgccctagtgagttggtggccaccgtgaaaagggggtcaacactcaacatcaagagttttggcgcggacctcccaacctcaacgccagtgattctagcgatgaagtaaaggattttttttattagaagttctagatctcaacaatgctatgactgcactagatgtgatgaggctagacaataacaacggtggtgtgtagaatagcaatgagttagtagcggtacgggagtctggtgacgctaaaactcgagttggatgacatcatattatctactcccgccggtttgataatacttatcgtattggacaagagcatagttttcaaaaaataattttgaccattattttttattataacatgtataaatcgttaacaaatatatgattttattaaaatactttttaagactaatatatatgtagtcaccatatttaaaagataaatatttaaaaaatgatttataatcaaagattcgaaagtttgacctcactcttgttcaaaaggacaagtattatcagtctggagagagtagatgttgtagtcattttgagctcatgatcaaggcccctatctcattgctaggtccatttgatgctgaggttatttgaagacactaaccacccgccatgttgatccaccagatcagactcgtacccatggcggtagggaagtcacactactagaaaatcaatttttcacgcgtttgaaaaatatttttcatggcggctaagtggaaaaaccgccagcgcaaaaaatcgtgggggtgagaggtcaagggccgccagtggaaacacatcttcgctagcggttaacttaagacggccgccagcgaagataggatatcttctctggcgactctcttaagttgacgccagcgaagatatggtaacttcgctggcggtaaggggacatggcccgccagcgaagatacctacatcttcgctggcggccctcttaacttaactccagcgaagatgccatatatatcttcgctggcggtgtggtgacgtggaccgccagcgaagatacctacatcttcgctggcggccttcttaaccctccgccacctcaaattattttcaatggcggttcaaacgaaccgacatatgacgaccgtcaggaaaaatgcgctgaactatatcacccagctacagtaacttcgagcaccattaggagcacgattttctctatgcgcagatcaacattttcactggcctttgctttatgacggctgcgatttccgccaacgaaaacccaaaatagctgccacgaaagatgatttctataatagtgtttagtgctagtctcgttggcattgaaatggtgaagctcagtgttacttggcattttaggttgaggtttacttttaaaacatttaaataagcttttagcacgcggtccgtttttaaaatacgtacgtttcttgaaggattagatttcctttttttttctactctgtttcgtccaaccttgcattgcactcgatcttggtaaccatttacttcactatacaaatcctgctgtttatataaatcgaggtgcccgtggaaactgatctgtaagcgtctgtctatttccggtgcagcgcggacagcgccagcgccaactgtttatttattggttcgctggtgacctggtgtcaacgtaccccgggcagccaattaaccaccccttgtcaaggaggtagagtaattaagagccatatgacagtctctcttacagtctgatgatctcaatatcacacgaattatactgaccaaggacaatatttatatgatggattgagatgtttgcattaaacatgtgaatatatactgcttaccgtatggcttaccgtgtaattcttaatgtggtttgacttcttctatgccttttgtcaactaaacttacagcaaaatcgaaatgtcacagcaaggagaccggccggaaagcaatctgaatgcatgcttttcacaagtcacgaccaggccgtgaaaactacggctaggctgacctgaggtcaacctttctttttttctacgttggatattatatagtacttccttcgtcccactgaaatgatactaattcgattgatttgttacgcctataaattaccaacagatcgtgcctgcaactctgcaactgtcatactgtacctcttagtttgcgaagctagcaagtctggtgtccttggacgcaattagttgttgtttgatcgaccaatcgatcgaataccgtcatccgagcagtaagcaccacttcttcgttcagctatattacccgtttgattatcttagttctcttttcggtcataaatacttgaatttcaatttgagccagctttaataggcaaagtttcagcatgaactaggaccatgcatgtatagttaccctcctttgcactttggaccatgttccatccatttaacaaaatggcacttaactcactgcataaaatacatgcaggtaaaatgatttagacaaagtaccaaaagttaccaagatatataattattgaatacaaaatgtcacatatttatgaactgatggactatacaaaattattaaaggagtaacatgttaacaggcccccttttctccaagcaacaactagcattatagcaatcaagtattttggcggaagaagaagaaaatgggagataagaagtttctgtgagtttctagaaactagggaaagggttggaggtaggaggaaaggaagatcaagttaatttcaagccttccccgttgccat

SEQ ID NO: 42463 - DNA, 26291 bp, Oryza sativa
ccattaatatttggtcccacctttcatacacacatagtgtattggagtttgtgctgcagttagctacaattatgtagcccactttcctttctctcttctcccttatctcatccacatgtgtttataagacaatcttatctcatccacatgtgtttatatgtcttatagcctgctattgtaattgctcttacttaatattctccttttagcttattttttataacatgtggatacaagttagatataagtgctcactttaagattaaattaacttggacgccctaatgtaggtgagtggatattatgtgttaaaactaaaaaaataagtgaaatctattaacttattaagtgttcgctctcgtgacctagaaaattctcatattaatcggagaaaaaaaacagagtccatattggaatacaattttaaaatagctgaaatttggaattaaaaataagaaatattgttagagaagactacagtccatacttgtatacagtagaactaatggaaattcggaattaaaaaagaaaattaaagtagatgttacagtccatataggaatacaaatagaaataacaaaaaattgaaattaaacaaataaagaatattggaataagaatatagagtccatatagaaatacaatttataaataactgaaattcaaaattaaaaaaagaaatatagaaagataagtttagagtccatatagaaatacaatttagaaataatattattttaattaaaataagaaatattggaagaagagtatagcgtccatataggaatttagaactaattaaaattctgaataaaaataataaaattaaaagaagattttagagtacatatagaaatataatttacaaataactaaaatcagcaattaagaagggaatattggaatacaatttaggagtaactgaaatttaaaattaaaaataaataatattgaaagataagtttagagtccatatagaagtacaattataaataatgaaaattcggaattaaaaaaagcattactaaaagaaaagtctagagtccatatggaaatacaatttataaataatagaaattagaattgaaaaataagaaatattgaaagagaagtctagagttcatacaggagtataatttagaaaaaaaactaaaattttgaatttaaaataataaatataggaataaaatttattaataaaaataaattcataattaaaaacacaaagaatgttggaaaaggagtctagagtccatatagaaatataatttagaaataactaaaactagcatggtggcccgcgcagcttgcgcggctagcatcattatattttctctcatataatagtatatatgttttctcaatatattattcaaatatattaaaatgacaacataattttaaattttgcaataactttacgaaactactaatgggtaatattcatattgtattttatatatatgttagttattaattatttttaatatcaaattttaattatttgtaaattatatatattcgtatatggactctagactcgtcttttaatatttatctttttaattccgaattttctgtaaattgtatttctatatagacttcatgctcttattctaatattattatttttatttctgaattttttttatttttaattgtatttctatgtggactctaaactcatctttcagtattctttaatttttaatttcgaatttcagttacttctaaattgcattcctatattaactttaaactcttcttcccatgtttttcttaatctcgaattttagttatttgtaaattgtatttttatacggactctaaactctacttttaattttattatgtttattctgaattttagttagttttaaattcctatatggactctgtatatactctacttctaatattccttattttttaattacgaatttctatttttttcttaattgtatttctatatagactctatactctacttctaatattccttatttttaattccgaatttctatttttttcttaattgtatttctatataactctatactctacttctaatattccttatttttaattccgaatttctaattgtatttctatatagactctagtctcctcttctaatattccttattttttaattccgaatttcaactatttctaaattgtattttatatgaactctagtctcctcttctaatattccttttttttaattccgaatttcagctatttctaaattgtatttctacatgaactcttctttttctttttctccgattaatgtgagaatttctagaccatgagagcgaacgtggaggcttctttttctattcctttaataatataatagatttggtattaaaaaataattaagaactatcacgtatatacaacacaaaatgaatagtaaacattgatagtttggtcaagttagtacaaaatttaaattatgttgttattctaagatattttaataataaaataagaaaatatatatgctattatatgagagtaaatataaagaggctagccgcacaatttgcacaggacaccatgctagttcaataataagtggacataaaagttctataaatttataaaaagaattactaaaaacatgtgtaggcatgaactatattaccgtcaaatctagcttaagtccaaacttaacttaatttgaatgggaaaaaagatctaaattacaagttacattgtttttatctgtttgatagttttcactggatatttcctctggatataggtgagctaattcctggagatgcatggatcgaaccgaagaaaattggttatggaggtgagagttgaggacgtgaactacaacatcatggcagacgactacagtaaattcatcgaggatctccggaaaaagctcgccaatcatccgcataaggagatgatccatgatgttcccgtgctggcaaggcaacaatctcctagacagccggctaggtggatgtatattaatctggtgggcaggaagaaggacagggcaaccgtagccgttcgggatgacaatgtctaccttatgggcttcaggaacatgaacggagaatggtttcacttgggcttttcgaagtggagcgtgcccattcttccggaatcatccaagtttttagaatgcgacgtcgcttatagaaacttacttgatgtaccacaaggagaacaggtcatgagtaggttggtggaggtggagctgcggaagacggtggtgctagatgccgtccataggttgtcgcgctacacacagcgagggcaagatgatcgtattgatcgattcaccaaacgggatctggcacgcctgattatcgtgatctgcgagtctgcaaggatgaggccacactacactacggtaaacaagggcttcgttcacgacgagacaaccagcctcaccaagctgcacgtattctacttgtggaactgggggcttatgtcacgggcgctgcgccaaggctggcggccatggcccatcagacttgttgaagatgcccgggcagtagtccaactgctgctcaacgctgcggccgcgatgccgttgcgaatgaccgaaacggaggctgcctcctcgtcctttgccaatgacatgccttttgcctcctcggcctttctcgatgtcatgcattttgcctcctcgcccgatgagatggcctttgcctccttgccctttctcgattggatggattttgattactccaacactaaagctaaagccactgaagcaaacgagcagcctgcagccatagatgacatggcgccagtaaacgacgaggagcccgcagtgacgactgatgacttggcttgggaataccatgaggagtcggcagcgagcgatgacattgatgacctggcgtccgaagaccatgaggagtcggcggcgtccgatgacttcgcgcccgtagtcgacgaggagcctgcagcgacggattacgaggacgaatttacaggtcaagtccatggccgacgattagtggagttgttggccgtgagttccgacttcgacagctttatgataagtatctttgacgggaaacgtggccagatcgtctacaatcaccaccaaggacatcatactgtcatccacgactctcaagtatgtattactcgaggttgttatgtgtaacgcgcaactttttttaaagaaaaatcattggtctaacttatatatggagtacatgtggttttacgaaattaggacatgtaataagtttttagaagttgatgaccgaacagctgattaaatatatataatcagatggagtacttattatatagatggtctcttgaggtcatttatatatggactatatatattttcaaaccaatgaatataagcattaatttgcccttcacaatgcatgcagcgcaatttggtgctgactggaccatatagggccatctcagctgacgggagctttctaattgaagttgataccaacaatgaggatgtccatcctgataagaaaagaaaaaacaatgagagcgaggtctcatctgatgatgttgatggcactctgttctgggacagctataacgattacaactacactaggtctgacaggatattggctcacactatcaggacaagccttggccccgttgaggtgacctacgcggtgctgaccaacgccgtggaggccaccgtgcaggtcaagctcctgcttctcactggagacggcgccgccacgtttgctggcagtgacaccctcttcgtctacggtgacatcacggtgcgcagccactgcttcgacgtcgcgagcatgctcttcagccatggctcgcagaacaaggttgcagtggcactcacctctgacaccgcgaccattccactgtcgcggtgtgttgttgcggtgccactccaccatcgggttgagatagaggcgaagctgtatgttgaaacttccaacgaagaagagagtatcaattacacttgtttccaaggtaagctggacttcgccgccggccgtgaccagcagatacaacagatatcccacggcgacaaccctgcagtggttgaagtcacctggtcgccggacttcttttgaaggtacattgaactctcaacctatatttcaaatgttttcggattagttggctatatgcataattttcagcacttatctttcacacttacagggatcgagtggtaaacagcatagatcgagacgacggtcgatcggcggagattctctatggtgaaaaccacaaaagtattgtaaggtgaaccaataaatggttcgttctagaacatccaggtatctagctatatcgcttaattattctatatgggttctgtataaataaggctcttcatataaacggaattgttttaatacgaggatttcgatgaggagaagcagatttgtgtgctatactatgatatgtaccgtctataaaatattgtgtgctctgacgttgtgtggcttttcgaagatctatcatataggtgattgtgtatggttgtgaactcataaaacaacaattattgtatccctccaatagttttgtgttaattacaagtatgtgactattgctggtcaaaattactatttaatttgtgtatagtgcaaaattatagttatgggtcgcaaagagcatggccaaacaatccaatatgctgattatacaatggaaccccggaaacgccaactcacatttcaaatttcaaacgttattgtattgaactttggcaaagagaagcaacattagatccacggttgcaagaggttaaccacacccgaccccatctgtctgatgctcacctccaaatgcctttctgtcggaagaaaatgtgccacacacagatgagcaatggaaaagtatgcaaccaggtagctcatgttgctgcacaatcatgaaatggtatagaattaaaattatcaagtccatttgtcaaataaaagcattggagaacatgagcacagcttgaatagaaccaaatcaaatcagatggtagaacgaagcaaaacggatcgaagagacagagagaaaaaaaaatcatagacaacaaggaacgagggggggttcaagaggtcaaaaaacttaaccatgcttgttgccaaatcccatgatgaagcgtagcttctctgcagtggcatgctaggaaatgcgctaccgtgagctgaatgcttcttctgatttgtgcgacacctaattaatactgcaaaagcattaacatagtggctttggtgttaggctcaactacaaaagtgtgataaagacatcaagctaataaatgatacatgtcgtaaacttgagtcaacggtcatgtaaatttttgccaacttcggatgaaggttcactaatagaattcaataattgtgggtctttcgtcttgtgttggtgcttattagtttgtttcttttctttttaggtaaatgttgctacatgatacccaaattttgtgtaatttgcttatagacattgaaaaacatgtcatggttaaaagacatcctaaaaaacttgtaatttgctatatgaatttttcgacttaattgaaaagataaattgttaagaaagacaagaatgcccctagatcacgtgcttcaaacacaacgttagagtaaaaatttagaaattatgcaactttaaatttagcatcacccttagtacatcactagtaaatattatatttcatctttactctagtctcagctcaaaaacttttgaccatagtttttctagattataaaaaggtaaccacaaatagtcttagactctcctaaacggcttatatataaagctaggcgacattgccgatcttaggtcttaaagaaacattaaaagcccaaaaagacatttgaaaacttttgtatctatacggtgaaagcagcaagctttcttacacgagaatgtgtcacatcatcacaaatatattagccgtcggataaagagtttggataaacaatggccattggattaaaagggtatatgtatttaaaaaacacaaatgggctaaacatatggaaatttctggaggtttctggcacctcctcctagacacatgataaaaaagagagttaaaagagagaagaaacacaagacttctagtgattgctcttataaacatataatacaacttagttaaatctataattggctagcgaaatcaatacttatatcaaaacatttttaaaagcttaccttaactaatagaacatatagaaaagttcttaaacaggattaaaagtcgcgcaacgcgcgactatgtggctagtcttccagaaggaaattcgcctccaaacaggttgggctttaaaagcccaaaaccagacctccctcccgtaaggccggcctggacaaaattctggcatgggccctaatctctgaaaaattccaaactataataataaccagattattgaatcttcccatggctgacaagtgggcccttatacagagagacgctgacgccagcatgacgctgcggtgacgcccaaaatttcggggaatgggaccaaatggcacgcagacgcagcagcaggtgagaggcgacatgcatgcgccggccggttctcacctcttccatttcagcaacagctggaaaaagcgccaagaaacaaacacctcatcatcaagccaatgcaattcaaccccacaaaaaggccttccgaatgatacagctcacatcatcacaccagccacacatctgcacaaggtctctgtaactgctactgctgatgatgaatcattgttcatcaggatgatatatgattcacatgaagaacagaagtgagcacaacagaagaagctcctctccatttcagaagtgagcacatcttgtgaacaaaaagctcatggaaaggagggcactgattataatgtgaacacgtggcagatgaaccagcagggaagccattataatgttgtcactaattggagaaatactttaggttacagaggatacaggacagtgactggatgatgatgatggaaactcaatactacattttcagaggtaaaaggaggagatgatcactataattgaggatcatcagatcttttcttccaaccttgtgcttcttctgcacatcattattgaccttttgccacaactgtgagaaaatgcatctcaaactagtgggttttttaggtacatcagaagctgaatttttcctctattggttatgtacaagattagcaaacactctcaggagtttcagttgtgagttgtgacatgcagaagcattcactagttcaaaacaagtggaaatgttcacttgttcaggcctgagttttggtgtcagggacaactacaagtccagaaccatgaaaaagattgcacagaagactgaaatattagggtcaagtacatcaaccaaagtagaaatattatacaggagtacatctaaccaagctgaactacaaagccgacatgcacctattcagtgaatcaggttattgtttattaacatatgacaagatctgcactagtatcttttccatcctaattttataatagtttggtagcagcactaatacagtttgacctgatcttttatgtcagatagaattatgcaggagataagaagatcacctagatatagattattgacaatatcacacagacaatcttgcaggggtcttatcattattggcactagaatttaactcataagtgtgtgtaatgtgaaatctgttactccgcactctatccatgttgatctcctaatctaattcttaatatattatattttctgctggcaagaagccttcaaataaattggacaacagaactgatccatcacaaactgcaatccacaatgaggaactcttaaaaagattcccatattgaatataaaaccaaattaaggatttcacagaaccatatgtagaactgaaaggatggaaaaagtctacaccgctacagcagtacttcataatgtcaaacattgctgaattttgcacgcatgatagtttcaagatttgaccttttgattaaaccatccaaatatcaggaccaaacatgaattatgacacaacacaatcgaactaaaccacagtagatttttttttcttgtttaatttttttgtcgacattctcgacaacaggccacatttcatagcgacctcacagatttttcaactataagttactcccagaattagccgcgcacacatggaggactaacaaaaatgccatgatatacaccaaatgcagcatcaaaacatgggaagaaggaatcatctttacataaagatggttcctttcctttccccccttcctttacagaacggcacacattttataattactactagaccaccacaagtgaggaaaaaaaccaagaacaggagagctacctataaccaccacatttgcgcgatcaaatccaaattctcgacggttcgatcggcattacctatcaccaccacattgcgcgatcaaatgtgaattctccatgtttcaatcggcgttgagcatcggcgaatcgagcccctccatgcggctgcgaacaatgcggtggaacacctccctgacctgcctttcgagaggctcaaggccggccctcatggcggcgcacacggcagccagctcggcggcggcctcccgtacctcggcctcgcgctcaccggagagcgggacgggtgcggcgtcgatcgcctcggcgagccgctgcgtgcatttctccagcgcgtggatttccttgaggaggccgcaggagttgcgcctgtccttgcgcttcccctcctcggtgaggcgctcctggagcgcgagcagcggcggcgcccatgggaacgcggcgcgcggcggcgcggcggggaggtggtgcgcctggagcgcggcggcgcggtccgggcacggcacggcggcgacgagggcccacgcggcgaggtggagcaggcagcccatggagtacaccggcgccacgagtcccccctcgtgcgcgcgcggcgccgccaggccggacccgatggcctgcagctgcctagccgccgaccagttgcgggagacgctccacgagagcgagcggaagtgggaggaggaggaggacgacgacgaggaggatgaggaggaggcgagcgtcgcggagcgggagggcgacgcgcgggcgcggccgaaggagcggttgcggtgggaggagaggaaggaggcgacgccgccgccacccgcggcggccgcggcgtcgtcgatgaggagcaccgagaggtcggagagcgccttccgcgcgcggcggagctggccctcgtggatctcccctggggcgagcagcacggacgccgcgatgccggcgagccgctcccaccgcctgacctggtcgacgccgtcgcgtgcggcgttgcacacgtcgagcgccttcaccgcgcgctcgtagaaatcccccaccatcttctccgccgccgccgacagcgccccgcggcggcgcgccagcgccaccaccacccggaactcctcctggcacagcaggaacgcctcgagcagccgccggatccactcgatggacaggagctcgtcctccccgcccctgagatcggcgaggtgcgccgccacgtgccgctggaacgcctccaggtcggcctcctcgccggacgccatggccggggacgcgccggcggcggcggcggggctgtcgcggcggagcgagaggagggagcggccgaacgaggagaagggcgacgggtgggagtgggtcgaggaggagccctggtagtcggtcgccggcatggtcgccggcgagatcgccggagaggaaaccgaagcggatcttggagagagagcttagcgggttaacgggtgagatggatggagatggtgaggtggtgatgtgtggatggatggatggatgggtgtatatatgtatgggattgtgattagggaggggattagtttaatgatattttggggtttagggggaagtggtcttagctaatcatgattgtttggatttgtttaatctttggtttgtaaatgatttctttctgtgggtgcaaatattcttctggaactgagaatgtttctagtttttgtttagctttctctctcagggggttttggtaggaggggctctaaaagggttgtaattactcctgggtccttacaaagttaaaatgaaatattgtcatcttttgcatagaatgaggtacgagcattttactatagtggaatacttgaagagcccttcttgtttgagccgcgatttctaagttgttgctaattttacgtcgtaattttagaattaattcaatggtttatttgccgaccttttaactttggaactgctaagagtagaagtacaaaattgttatcctatttttttattgttatgatcatgtattattggtttatatatcgcaaccatagaaataccttccaaatcggccggtctcctcttatcattgttaaaaatgtattgccttgaatacgttaacgagcatgcttgtttgagctacgacttataagctgtagctaaattcagaccctaattctagaattagtctaatgggttttctcaaccttgaactttttgactgccaagagtacaatcatatagtttttatcctaaaattatctttcattccttcagtcgtcgcgtattttggttttatatatcgtagccatagaaataccttccaaataggccaggcccctcttgtggatatgaaaaatatcagcaaagattgttgtttgtgtattcatcttcttctcactgtgctactacagtgatcagctgactatactgacaatctgacatgatgcacaataattggccatacttcatgttgatgcatggccaatttgaggcagacacaaaaaccatcaatcctggagggcttttctgcaaaagggcaggatcagcagccagattaattggcgaggtttagcttaaccaaatcgcaaaactaaacaaatccgatcaaactccggtgaccagtcgccatttgcagaggggatcattagatcaattcattatcatcaaatcaaaagagaaaagtaaaccaaaccgagttaagcccctcgagccgagacgaatcaatcagcaaaaagctagtgctacgcggggaggggagtggtacacgcggcccgagagtccctgccatgtgggcccgacacgcgtaacccgcccctcccacgcggggcccgtgcgttcacacctccacccccacgattttacctttctaccccccgcactccagtgctcgcgccggcgaccgacccgggggcagtttgggaataggactaccgcggcgcacgcggggcgtgggcgcggccggtgggcgggtgccacgcggccaccggtgaggcgcggcgcggggcccgacgaggtggggcccaggtggcagtgggaaacggtcaagcggccgcacgggcgcgggtcggaaacggttgggatgaggtgagggtggcggagccggagtgtggtgcggcgcgtgcgggtggttgtacggacggaccggacctggccgttgttggtgccggtgaaacggggtgaggtgtacaaaagcctatcagggactggagtcgtgtgcgtgacatggtgagctggcacgtagtagaggctgctggttatggttggagttttgtgatatgctcttttatattgcaggattttatttttaaaaaaaatcagtaaactcagtcatttcaattttagagagatgaattagaggagttgagaagaaatagtttcacattataataggtgtggaataaatctctttcaaatcttctcaatcctctcctggactaagggaaatttttcatactctgaagttctgtcctagctaaattctcagtggtgtttatgtacagtgagatgttattgtattgtttaaatggaatctgattgtttgcttgttgacttataagctgaaattcaaattttcaatcttagtttctgttgtctcactttttttttacggcttatcagctgaagccaaccaataaaaccataaatatgtaaacaatttctcttaccatggaaatatagttgttcaattttaagtcctaaatttaagatgggtgctcgtatttactgctaattatatttttagtggtaggtgatttatatccatcgatagtgagatgtttgtaatgacgcaatcaatttaagacgcactggtttagtccctcggaaagtggatgtggtcatagtgtcatgttgtgtgtgctcgactgttcgtttatacaaataagtgtgcatatatttgtacggatttctgtacaatatttttgttggaattaatacgtgggctactaaggctcatatggagattaatttttttgaaaaatcaataaaggtcccctcttggaaccttcgtccttcgacattctgtatcgggagaagacgataattagctttttggaaacggctcgcgtgactgcttgctggtctttcacgacggctcgtcttcctctacactctagggacatccagcaccgccgttgttcctgcagtgcgcgctgctcctcatcaatctaatccacaacaaaccagagctttcgttatgtgttcaccatgtatcatctattcgatgtgctcagggtttactgtttagtatatatgtctagatcgtatatcgtggttatgttagtatacatagtcaataacgtgatttatttatgaaataaattaaatctacgtgtgcttatattaccgttaatgttttgcatcggaatgttctgaagttcttggccgctttgtaacccgtactaatcgaagcaacagtgggcgaagtggtcgcaatcatgcatcaatcttcggggatccacactacttgtgcctaacgtttggtaggccgtcaaattacaaaaaaatcggcgatgctttttggccactcgatcttgtacgacttttgtcattctccaagccacactatcagcaaatgtttcaccgatggtggcattcgatattagccggtgtggatttttttttctttctttctttcttaaaaaaaaacagcatatataagtacttctattatgaaaatgtcaccgggaacatctattgtctaataataattgggatcgagcaattcatatactcccagatatgtctccttttttcaagacaggattcaataatcaacgtattaagctatggaactttattttagatcttgttcggttaatacatctcttaaagtattgaagctgtggaattaatttggagaattcctttatcacagattaactacacaaatcatgagaagagagttgacttaaaaataagaggtgatgcaagaaataaaaaaacactaggtacgataaatcaaaaaaagcaaaggtggggcattgaaaatgctactacaatgacgtggagaagtggtggccagaacccaaaacgcataaaaaatggctcgttaacaaacatggtactagtctcgtattaatcgagggtttaccttatcgtttccagatgaactcatctactctccctcgattcaccgatcaaaaaccgagcaaattaaaatcggtctgtgcaccaatacattaaattttaggtgtacaaataccctgcaaatatttatgattggtaaaaaaacatattaaattgttctagaagaagaaaagtcacaaaaccattgcttgcaatttgcaaatactccagtgtaaaggggagtactccaagaaaacaattctgccagtgggcccaggtggcgtggccggacacgtaaaccagcgaatgagaggatagcatagccaagggttggttttccggggaacacacggccggcagccgttgttgttgtgacttgtgagggaaggcaaatccaagcctgccttgctgttgccatcgtatgggaagaggacttgttgcttgtcttgtctcttgcatgctcagtgctgcatgcctagctagccggcatgttctaattggacaaactcactactgtttgttcatccattccgatggattatgacatggacatgtggtcttctatgcagggtctcccaaaccactgtggccggggttaccgcgtcccggcggtaagcacggttaccactgtataaaaccgtgtaaaatttatcaaaaatttaaattgttttttaaacttatttgaatttaaggaggttaccgcggtatttatattaccgtaccccgtgataagcccggtaaccgcagtaaccgcgcagttatcggcggtaaggtaacccctgcttccatggctatgtttcgagtagattttaactttttttcttcaaacttctaactttttcgtcacatcaaatgtttgaacacatgtatggagcatcaaatgtggacgaaaaaaaaaccaattgcacagtccgattgtaaattgcgagacgaatcttttgagcctaattacaccattatttgataatgtgatgctatagtaaacatttgctaatgacggattaattaggcttaataaattcatctcgcagtttacaagaggaatctgtaatttgttttgttattaatctacgtttaatacttcaaatgtgtgtttgtatactttaaaaaaaaattggcacacgaactaaacacagtctatgtacattgtttagtgtcccttctaccggccaattttgacatgcttagagcaaggtcaataacatagcccgctgttggcttcaaaaaaatagccatgacatctatagtaagcagtgtagctaatgtctacaatagaaatactataacacgaatattttattgttttgtgggacccaccatcttctcctacctcacattctctttctccctcctatccccttagttcatgtcttcatgtcttcttctttcttgagctagcttcgattcgctgtcaccgacaacggaagacggcagtggcagacgcaggagatggcagtggaggtggaagacggcggtggccgtgcggcgggcgtcgaagatagcggtggccgggccgcgctgcagaggcggaagacggcggcaaccgtgcaggcgagggatgacgggggccgtgcagcggatgtgggagacagcggcggctgtgcgtcggcacctgtgagtctaagggcagcggtctggtggccgcgggagttggcaacggaggcaggccaacgcaaggcatggccgatgcttctccatctaggtaggccccacaaactcctcaagcggcgcatgcagcccgacaacaaattagtcgttgtctctatctctctctctctcttcccctctctcctccagatcatcacaaaatcctacgtggaactactactgcccattattaattgtatctgctcttattaaacataggttaaattatggagtaaaatgcaccagcggtccttaaacttgtcaggaggttttacttatgtccacgaatttgcaaagcgcacatcgaggtccctaaacttggtttattgtatcatcccggtccaaagccgtgtttgaccgtggtcttgcctacgtggcatgccacgtggacgatgacatgaattttttatatttttttctcccttcttccttctttttttctctttcttccttgtcgaaaagacgaaaatgcctcgcacacgtcatcgtccatgtcatcgttttttcataaaagagaaaaaagaagtaagaagggagaaaaaaaatataaaaaatccatgtcatcgtccacgtggcgtgccacgtaggcaagaccacggtcaaacacggctttggaccgagatgatacataaaccaagtttagggacctcgatgtgcgctttgcaagttcgtggacctaagtgaaacctcttgacaagtttaaggaccgctggtgcattttactcttaaattatgcaatagtttgttaccatatattactttagcattaacatatactatctccgtcctaaaattaaccttaactacacttcttcacgaaaaccttaaacctgttgaacacaggatcataaaatagcctatggatctgtctggttacatgtcacatattgccaaaccaaatactattagactagttgtagtttgttaggttagtgtttggttggttgttgaaattgtggcaagtcacattttactactttatagacccacatatcatagatacaatttatagccaaacattaccatacttgtgatgaacaaattattggccatatgcccaaattttgtatggcaaagccccatacttatgacaaatttagctgtggaaagctaggcacaaccaatagaagccaaactaaccaatagaagccaaacaactagaggtacatttccatatatcccatcatggaagttatgcttttttacataattctacttgttgtgtgtgaaaataattttttttatcgtaatgtacgggcaattaactagtcatgtgttaaaaatagagttttgacaagggggattttaaatttcgtcactcaagtaggaatttaattattcactataaaattaataatgtaaacatagtaatggattcgaagaaaaatatctgatactcttaatacgtgaaaataaaagggaacgtacagatggacctggtctcatgaaccggtcaaaattccagctgaagtgttgaccatgcgataccagtagcggtggtagttgttcgttgaacaagttcagaccataagctaatttcaaccagagaaaaaagttcagacttgaagcctgaccacacacacacttggcacttgtatataggcagagacacatgcactgaacctgagtactaagagtatcagataaaatacctacagtacctggtactgagtactgacacgtcgtcatttcatttgcttgggaatcaagaagaattcaggatacatcaagtttgcattcattagggagcatctgctggttccctttctttcttttttctctcctaaagtggatggatgcttcatggcctcactcacacaaccctatcgtttcgcctaagcttataagtcaaattttgtattttaaaaactaattttgaaatcaattttatgcttttttcaccatagttttattttacaggatttgcttttgaactggtagggacacctgtacaaaagttgtgttcataaattattatttgttttctaataagccataaagataagaatttaagcataagcgaaagaatgaggcggtcagtaatctcagttatcagaatggttcgctctcagtgataggaatatatactatctgaattgatgtttttggtcccaattctttagtatttcttgggctgcaggaaatgtgttcatgcttgccaagttgatcgattacatttgacagttcagtcactgctactagatacctcctgatctaaacaagatatatttcaccttaattcagggtaaagccaccttttttttttataccggtaaaagttgattgtaatagaagcagatgttgtatcctctactgtccctttctggccacctaactctagaaagagaagcactgtatctaaaataggaagtcactttcgaatctttatttggatggagatgcaggcttacatggattgtacaagatcggtttattttagtgcctgccgtgataagatctgcatgatttgggttgcaaaagcctaactattggtcactcttggaagcaaacatagtatgcgctttctgatggtgacactggactacttgagcctaatacaaggtacaattatccacctcacaactgaaatcatgtggacttgaatcaccaaattattagctttctcagttaataaatcactggagaacagtcaaatgaattctgcgaaaattatccgatgcacatacagaatacctgttatagagagagctatgggtcaaaaagaaataaagataacattcaattacaaagcaaaatcagaataaataagctaaatgctaaaataacaatttgccttttgttgcttgggtgtttctgagttaacacatcatcagtaacatacaacagaacggcgtcccaggctaaacttggggatggtcagctccatccaggggcatgccctcagggcgtcaaataagaagcatccatgatgtttctggcctgcctggaagttctattcgcaggccagcttggtgtcgaaactactcagggagatagcaaatgcctggaaggctgagagcgggtagtggtaatccatggtgaacatgtccttggcaaccttcccgaattgcagtatgaccttatcatgctctggtgggggtggtggaacaggctgtgatggagttggggctcccgcagcaggctgcgtggctgcgatgagctggaagttcttgacagaagcaacagttacccggccccggaagtttaagcaccagcactgtagctgctcatgccatcttggagccttgttttggagaatcaaaggtgtctccttgcactcctcatcatcgctcaatacccggcccccaatccttgggccatctccaattgagatgtcagagaactgagcactgctgaaatgcatggaatggtccataacggacgatttcgaaaaggagacactcctaaaggaggattcattgagggaatgggcaaggatgctatccggctggctaggaacagtcccaccagcctcaagagatgaggcagggatggagtgcattaaacagcacatccgcctaggaccccgagttccaaagacgtttagctcatatgagatgtttgctatgctatatgtgctgcagggatgctttgctgttcccttgttggagaatcttcggcttgttttccctgactgtgaatcactagttgcattgtacggagtgtgggtatcatatattacaaactttgtgccaaggaagtttgacctacaattcaaaatggagacatattagcagcagcaataatttttagattaaaatggggtaagttctgaaataaggttgtagtttcttcgggttaatacctcaattttccaatgtttgtgttggtagacctagataaattgttagcattcatagatatcacatattctgtacatgttgcatgccagtttctttttgctgatagaaggaatttgccattgtcaacaagcacagctgcagaaaagggaaatcaaaacatctaaaattagtaaatgctggtactgaaatactaaaagtattccagcaaggaaacaaaacatatatgtgcaccagtgacggagcacgcgcaaaaattaggtgggtcagacacacaagacatactgaagtaaaagaatgacaatgcttgcatattaaaacggtacaactcataagacgattaaaaataacaaacaaacaacggtttccaccatataatattaattcgttgtgcataaaaatattatgagaagttaagaacatatgccgacatcaaagcagctcaaatatgtcttgcatttacacacataaaattagtaaatgtctttccatacatctcatcccgagattccctcctattttgtttcgtcgtcatttcctaatatatctagtcggcaattagctaagctcacttgatgttactagcaggcggacgcaaggcaacagaagaggattgagttcgcacaacagggctcaaagggctagcagtggtcgactttgaggcccgtgccggccgatggcagagcttgtgcagctaggagctcaatgcaagcacgctgagctcatcgcctcattctcacgatgcatgcgtgcacaacagtatagccttgaggccctttgtatctgatgtgcactatgttacctataattggaaaccaacaatgacagatgcacacccacatggacacagcaaacagatagcatgcaattccaatcaagcaaaggacacagcagctcaaattacaattgcacagaaccagtcccacttgtgaatatactcgcaccatatgggtgtcattgaactattgaagtggttcgaatgcaaacaatctcaagagaacaacctacttgtgcataacaacgggaatatattttattagtgtactgttgcttaattgacattatcatggatcaggtcaactttttttccagattgtcaagtcaagtagtaaataccaagtggtataggtcaggtaaaacagtagaacaagtgcatgacagaggtatacaatactaaaaaatagcacttaattatacataacaactattgtgtgctgtatcctattatttggttacaaaaatgagacaacttattacagaattgtagttataaagaacctaacttaactgtatgaaagccaaggaatgctgaatgatctgttcacaagttcgcttgtgcatgattgtggaagatagacaatgacaaataaggaataatatgtttctagcatattcatgtcaaatgataaacatggcaccaattaccatcccaaggcaccatctaccctatgcaagggctataagaaagaacagctcttcatttgctatgcaatacaagcatagttttggcagaatatatgcactcattcagcagctcacaagtatatacaactacatatgaatcttcttatgcagaagcaaatatgggctctggtacataggcgcatacaacataaagcatatgagatgtaacaagtaacataccagagccaagagagaggtacaaatagtaggtctgcgtagacttatccctcctaatgaaacactgcatagttccatctcgtggcccaggctgtacatagaagcggaataacatgaacttattagcatataagcaaacggtaatcctgcaatatgtgggtgttctttctatttttgtgtttcgaaattccaacaatatgttgaaggacaagcacctaacatggacgaactgatattgcttgtaaaggatataaaactaaaaacaacacaatttgcatgatcacctgcctcagagaaatagggaaggtgatcttcccacacaactctggattcttgacgatctcttacacatctccctccatgttctgcagacacccgcacaagcaaccacatgcttcctagaaggccatgtagcctcactttcttccaacctctcaatgatatcacgaagcaattccggaggcaagctagcccagcagctgctctggattacaggcaccgggtcatgcaactcatggacagcaccatgagacttccccctgcgatgccccagaatcctgacctcaaatcccctcctcgataggctcccaaatccatccctcacatcgcgcacgatgctgcgaaacgacatctactctctgaaaaaattgagatctctcctcagctaccaaaagggatctatacttttcgccaatgataacatcccagagtaattccagaccaactcaaattctcctcattattgttgaccccgcaaaaagaacctgcagcacaaatgaattgaattggtcaagattaatcttcgattattctttcttgaaaaagatgggagactagacgacggtgccgcgcacgatggcgacgttgcccctgccctgcgggaatgcaggtcacaatgcccccaattatctctctccacaccgattgcagcagcagtagcagggcggaagctacgagggggcacgcgaaaatgctggattcggcaagcctacctaccaacctactccccggtctcccgcgccgaagatgcccaatcgataaacacgaaacaaaattctctgctactgcaaaccttgtcgtgctcgcgcgaagagggtagacgcatcgtggaagagagcgcccactgctccgccggatcgagcccgccccccgtcgccgcccgcgtcgagccccgcgcgcgcgctgcccgcaccggatcgagcgagcgagcccttccgcgcgtagggtttggtcggggcaaccaattgggcggaagggggagaggggaagaggaggaggtggtggtggttgccggcggcggagatggccggagacggcgggatcggcggaggtggggatgcgatgcgaggcgtgtggtgtgagaggagacgaggcgagagtgtttgggatttctttttatttattttaacgtgtcgtggtccctacttcatacggtgcggtggtgtgtatattcattcccaccaatataaatgtgaaaaattctagaatgacttatatcgtgatacagatgaagtatttgatttgtttaaactttatgttaagatataatcatttctctattattccctccgtcataaaataacataacttcccccacccatttatcgccgcaaagactttattttgaaacaatcaaatatattagaatttaataaagttagatacatacatcgagatgtgataaagcgaagattattgtaggcattgttttagatcccatcccaaaactttacatcatgtcacatcaaatgtttgaacacatacatgaagtattaaatataggctaaaaaataactaattgctcatattgcgactaatttacgagacaaatcttttaatcctaattgctgcatgatttgataatgtgatgctacaataaacatttgctaatgatggattaattagacttaataaattcgtcttgcggtttactgacagattctgaaattagtttttttagtagtgcccgaacaccccatgcgataccctatataatacgcgatatgagacaccaaaactttatacacctggatctaaacacccccttagtcttttaaacattgtatttgtaggtgtaacaccgtcacctcttatatcaactaaggtaattatttatctggatactgccaataataaaggataatctagttttttatcttcgtgaaaaacttcaaagatattatcccaaaatacctttggatacttcggagtattttaattttaagagtattcacaattaaaacttgactgttgattttctttcaaaatatgcttttagtagttataaaatcagagtctgaaagcatttttagtattgaatgttacaattgttatacggtaaatatatttgcagtattgacctactgttgatttaaacctataaatttcaaagtattactatctaataaaaacgacataagaaaacgacatgaataatatgataatcatttttgctccaatacaacaggacatatatgttgattaaattatcggagtcatcatttggcttatatttatgcatatttgtattacttattagcaaccaaataataatttatagatgaaaagtttatatacgtatttttagcaatttaaaaagtaaatactgccaaataaactacaatgataaaaccataaaataaacttcaaatttgaattttaaattttcaaaattggtttataaacatacatagcgaaacaatgggattatctgtgtagtgctgctgatgcattagttgtcagcttctgctattgcatcagcattgcagacgttctgcatccatagcaaaaagatggtggtgtatgtaaaaaaaatcgtttgcaaattgcgagttacggaagcgctgtgttactccatccgtcccataatataacaaattttaactttctacttacactgtttgaccattcgtcttattaaaaaaatttggaattattatttattttatttgtgacttactttattatccaaagcactttaagcacaactttttattttttatatttgtacaaattttttaaataatacgagtagtcaaacagtacccttatattaggggaccccttatattacggggacggagggagtacatttattgcaattatgcggtcgaattttccgtacgctctctctgcccggcagcacgtactgtactgccgatgatgctgcagggtcactgtgtatggtcctccgttctgcatctcggcgatggctctcatcccgggcccaccaaggcctggtcaaaagtcaaaactaacagccatatacgccaatatgacatgattactgtaaaacgaaggtggtaaaatgtgatattacagcaacaacaagcagcagcaaagatgcccggtccatgcagctaccattcaacatacgagttgaccagtcaacattgaccgagggccccacacacagagacccactgctttcttttcacatcgccatctggctagcaaggccaccacattttgacttgacttcagcattcatggtcaggaagagtacccccttgattgagtaaaacaaagttggatagaaaaaaatgatgaaaactttagaatacagatggagcccagtatcacatggaaattttacaagtagagagaatcaggagatataatgatatataaacaacaagaggagaggatcactgagctagctataaagcattgaaattgttgtcacttgtcagtagtcacagataatctgccacctctaccatcttgcataaacaatctgccacctctaccatcttgcataaacacggtcctgaattgaattgatctgcaacctgaaattaacaatccggggaacgaattgagtttcagacaaccattattcagttctagagagaacttggaattattggaagagcatggaagaaacaaaactcaatgcagaaaataacaggatgctaccctgataaccatctgcaatccattttagaaaaaactataacaatgtaatctgttttagaggcaaacgttcagagttaagtcacatattttcgctaaaattagccataaatttaagatttaaaattcaaattttggctgtggttgataagctaaagagcaaacgatggagttggctaagcataggtgaaccagctaagctagactcatcagttatatacttacgagttttagagtaaactctctgtaataaagcataccatcatatttaaaagcagtgttctacatacagacaaactgtaaacattgttcgtgcaattgaacaaatataagctacttcttgtcaagataacaaacaccataccaattacccattaacaacttatccatacaagagtaagaactaatatctgtttaatcaggggaaaaagaaaaatttggatattgttgactttgaatcatgaagattattggatattgaaactcagcttggaagtgccaatctgacagcacacaagatcaccaaatccgagcagcatcactatttgtatcttggtgatgcagttgcttcccttttgttatcttttattcgctgattatgtttacacccaagtacaccatgtatagaaccacagtcattgcagttgatcttaatactagtcacgaaataactcccagttgatagtacatatctaactgatgccttctttgctgtagaacagtaaaatctccgtcaaaaactgatgccgcctctatctatggatgggactaatttttgtactacaggggtttgggactataaagctgaagtaaacactatcaataggaaacagccccaatgcatgatttccatagttccatatacactagtagcacagtactacctaaaaacttgtcatgaaaaaactcccacaagaagctacccaaattataaacattg

SEQ ID NO: 42464 - DNA, 8724 bp, Oryza sativa
gctcaaaccgcttattctgaagcatcatttgttcttctccaacgccaacttttccaattccaagtccttgttcttcctgaacatctcccacttgagacgttgctttgcgagttgcacagccttggtttcaatctgcaaacgatgtttttgaatctctgctgctttcagagccaagtctttttgcaccaaagccaaatcacatccatctggaaagggtttgttgatatccaacacgtcatagggatcagacctcccactaccatcattcgagcatgaggtgacaaaacctacatcaccatgatctacaacatgccacatccttttatgcattgaggggccccttatattggtatcaactgctcgatgttcttcctcattctcctcataatctgaatcttcactctgatcatcatctagttcagcatctccacttgcatgcctcatgaaatcattatcctctttacatctaagagcaagctgtagtgactgctgaagtgcgggatcttcaggcagacttatacggttattattatggtaggaacacatctcttcatagaacaagtgtttggagttcagtatcttccttgcatcctctttcatcttctcagaaatatccatgtgatcaagaagtgagtgattctccacaacattacaagcagtaccccttccaaggatatctgttagtcttttgtatctcttattaaggtcattgaacttatcctcacactgctgtggcgacacatggcaacctctctcgcccatgacctttgatattgctttccattttcccttcttttgcatcattgaatagttcctcctcccaccgcctaaatcagctccaggatcctcccctgtgtaggatactgcagtaatcaaaagcttcaccattgaatctgtccacttcatccgatgccatggagagcccttcttgtctttgccatcagcagcatcctcattcatatcgtgctcctcttcatcactcccatggttctttgagtggtgtctgtggtgatggtgatgatgggcaatcttcccatgttgtcctaactgaactccatcagagatgttatcaggctctgtaaccctatccataggaatggtaaaattccctggtatctgaggctggttgaagccctgatttcctgagtttggaggatgcatttgcttggagataccatgcaaatctaaactcccataggaaggtccctgtgtcatattaccaggtgggttgctgccttccatttccccaaagcgatcacccaaacacttcaacttcttgttggtaccatataagatggacacaggagtgcacgaggatgcacatgaatataacctgaaatggcagtttggtatgaatttttggaaatccaacacatgtatattgcacatttctatacatctcaatcttcagaatcaatttgctaaaagaaaaagatcttcagaatcacacaatatatcttaactagagtccatatgtaatcagggccacctaataagaaataactaatgcacaaatttgaagagattttaaatcagtgttacacaataaagggtaatttcagcctcctatagttgtcataattgccaaagcaagataatattggagcactaaaaatcagagtgttctgaagaatctaaactgcatcaaccaacaacctaattaatcagcagcacaaatgacaaatcaaaccatattactccactgggtaatgtgagtggaacaattttaaaacattattgcagtggcaagtggcaaccaatcaaccactagccaaaacaaaaaaatgttgcaacctttccatgctactcataactaacgagaagaaaatgcatggggaaaaataaatcaatttgtcacctcacaagaaaaaatagtaaaaacaaagtgtcgtgcgcaaattagctgtccatgtgtaataataatccacgaaccacaccaaaatataaactatcaaattctcacacgcacgatcagtggcagaggactaaaaaaagaagaggtgtggctcatgaattatcatgagaatcaacccaagaataatgggaaaaaaattctcaaattgcaccacattgtaccacacaatattatcttaacaagtctatattaagcatgacaacaacccctcatgacactaaaaattacctcaagtaatgaagtttcagcagtacatgggatagccaaaggaggatagacatataaataatctgcaaaacagatactcctagcaaagatggatcgattaataggctatctttaaggtggataaggcaaatagcaaagattgaatcatcctgttgatctgctgctgctgccggcctgccctgctacttgttggcccgccactgctactgccgcgctgcccaactgcagccacagcctgcagcccacccagccgcccttgccggctgccgcagctgcgctggcggccctccgccgcctgtcgacgtgccacctcccgctcgcccgtggctgtcgtcactcatcagctccgccaatcgcacgagatggggaatcaatggagatgggggaaccaagcacctcggcagcgcgcgaaaactgcccggctgcagtggattgggagcgggaggtattctctactggtggagaacggaaacacgggattagggtctcaaaatttttggaagctggtttggatatctgttggatccattttttttgctcgaaaaaccccaaaatttgaaattgggagtagtaggggaactcttggtgatgctagtaacacacaaaacaagcccaatgtgggtctccaattcaacggcgagaggccaagaagcgagaacgccttcgcctgtcggccgtcgctcgctcgtctcgttgagtccgtccttctccccagcggcgacgccgcgctctgcgccgccggacggcgcgaggtatggcgagccctaccgagtcctccgcacgattaaaccccggcccccaagcgctccgcctccgaccggggtagcccccgagctcgggatggcgtacgtggccgcgacgagcctacgcggagtgctcgtcgccagcgatccgagcggcgagtacccccccccccccacacacacacacacacgcacacacaaaaaactcattgggtttaacgcccccacgcgatgacagcggaagccgctgcgaccaacaaagcgatgcatcgggagggaaaaggagagctgactcacgacggtatccggcgactgaactgaacgccggcgaggagacaatccgcctccgcctccgcctcagcctccgccgaaatattgggcctcgccgagcacgaggtttctctttctcagaagaaaatgccaaagctgaacggaaaggaaggaaagagtacgaaaggtaccataaaaaaaacaaaccaaaaaaaggaaatcgccgaaacgacacgtcggaggcgcgattcctcgtggcacggtatcggctactgtcgcctaccgctgacacgcggggcccaccgacagggggcccaccgaccagggggcccacatgtcatcttcacggtgatggcgtggggacggtgaggcacggcggcgcggttcccacgttccgttccgtttcgcgttacgggggtgggtggggcccgcatcacagcggggccatgacggcagcaaccgaaccccattctctctggttggggggtttattattggttatgggcttgtggcaggatgcagatgacacctgaagaaaagaaaatataaacacacttggtgattaattgttgcatttgcatggagtttaatagtcaaaaagtgatttcactggatgttatgatgcgaaaggagtcgtctaattgcacttgtaatggcgttgtttttgacaaaaatctatttgttgacttttggttatgtcagggtgtccggttgttcataaattctgatggggaatgtcaaaattgtactgcaagggtgaaaaagattgcagagccaggacactcttccgaatcagacgagtgcaatacaccaactgtgtattgtctgctgatctgacgagctcaatcagtagacagaagtttagttcggagcatttggctaacgtgtttcctaaaccatcattgatttgccgaatttagaaaacaattatcacaccaaaatgaactagtatactgaaccatccagagatgccatgcctatctcttgggcatcatcaagaggcagttcgctgattcctgaaaatattttctgaaactttcagcacaccaacttggagagtagcagtactaaatttactcttggcgatcgcatgatccgaggaatctttgaacaagctacggacaaacaaaacaaacaacgcatgacgtcaaccacgatctgatcagaacatttctttactcccattaatttggtgatcctgctttgtaatcttccattgacagaaaaaaaaaaggctcctctgccaatctgccatcagggcttgtaatcaactgctccctcttgttaccgaccctaatcctatcaagacaaggcccaaaggcacaagacaaaggaagcccaatacccatgtgagtgggccggactgggttgtgtaagggaacatctgagtctataaagatgttacccaggcaaggagagaggatcgttgaaaaatattatgtacagactatcttccccaaatcaattccaatcctctctcctctcccaactcctctgttcttcctggactcttccttccttccttccttcctcgttctcaagttgttcgaccgaattctcaagaggggttcgtgacaaatctggtatcagagcagtcgatcctggagtacttggagaaaccccgctatcactcgcgagcgcaactcaaggcaaacaagatggagcagcagctgagcgagctcatgacgaccatggcgacaatccaaaagcaaaacgacgccatcaaggtgtcgataggggccatcgaagaaatcaagccaatggtggtggagctggtggggtggaaaccggcggtggagaaggcggtgaccgagctgcgggaggagatgggggatctcagggcgcaagttcatcaactcgccaaggggacgacgccggaggtcaaggccgacgagcgaccagcgccttcctcgactcctcccaacattaagcctgacgagttacctgcgctgcttccaactccaccaggcccgaagctgaagcagatgaaggaggaggagcgctcgattccgcaggagcgcggtgaagaatctcatgggctatttagccatcgcgtggacttgaatcaccgggggaaggctgtgtggggaaatccctcttcacagtttctcccggtcaaggtgcgttcaattccttttcccctactaattatgttcatgaatttggagggaattcgcggggtagggtttggggaattcaaaacactacatctagggttgagtgtccagtttttgatgggggaaatcctaaggcatggaaactgaaatgtgaaacttattttgggttgtgtggaactcattcagatcactggattggagtggctattcttcagttcacgggtgctgcattgacttggttgcagtccacccatgctcatgaagttagcggtagttgggaagaatttgcagcgtgggtgtgtgggaaatttggtagggaggagttccagcgtttggtgcgctagtttaataggttgagacaaactgaaggggtgatggcgtatgcagagaattttaatgagttgatgcatgggttgcacgcgcatcatccgtcttggaactctgaattttttgttactcaattcctagaagggttaagggctgagattagggctgctattgtgttacatcgacatgccaatttggatactactgtggagttggcttgtttgcaggaggaagtgttggaaactaatctcaaggaaggccgtaagattgactcacatggcagaaatactttgcgtgctacctccactctggcacgtccatttgggggacagtggatgaaaggggaagaacgactgaaggctgaagtgccagctgaagataaagttgctgctcttcgtgcttaccgttgttccaaaggtttatgtcatacttgtggagagaagaggagtcaggagtatcgttgtggaccgacagtgcaattacatgtggtggaggaattgttgcaattatttccctcagaggatgttgttgaatctgacaccaatgatgctactcctgatgaacctgaaacagaggaattgctggccatttctagggaagcagttctgggcattgagtctcctaagacaatgcggttgcaagggttaattcagcgccatgaagtcttgatgcctgtagattccggcagcactcatagctttatcagtgaacaattggcaaatcgattgtagggaatatgtgcttctgtatcgccgttgacagttaaaattactgatggaggtttactcaagtgcacaagggagtttcctgattgtcaatggtgggttcagggagaatctttcagtactcctctgaaagttttgccgttgggttgttatgaggtaatacttggcatggactggcttgagcggcatagcccaatgcaaattgattggaaactcaaaactttgcagttccagtggcagaatcggcaagtgacattacagggagttatacctgatacaagtgattgtcctccggtgacctgcaatcagcttaagggtttgctgcatcataatgttgtcttgcaggcagtggctctctgtccggtggacacacctgtgaaaccttctcagacaattgtgccagctgatattgaaactttgttgttggaatttgcatcagtttttgatgaaccaactgggttgcctccttctcgtgtgtttgatcacagtattccacttttgccaggggcgtcgccggttaacttgcgcccttaccattacaaccctgcgcaaaagactgaaatcgagaagcaagtgtcagatatactgcagcaaggggtgattcagcgcagtgctagcccgttctcatctcccgtgctcttggtacagaagaaggatggcagttggcgattttgtattgattaccgtcatattaatgcgattactatcaagaatcgttatccgttgccaattattgatgagcttttggatgaattagcgggtacatgttggtttacaagtttggatttacgggccggataccaccaaattcgtatgaagccggaagatgaacataaaacggcattcaaaactcatcatggacattatgagtttaaagtcatggcttatggattgactggggcaccggctactttccaaggggtgatgaacactatatttgaaccattcttgcgaaagggggttctggtttttatcgatgatattcttatttatagccgaactcttgaggatcatattagactacttcgagcagtcttctcttttctcaccgagcagcagttaaaggtgaagaggtctaagtgtgtctttgcctaatcttctttaacttatttgggacatgtgatcagcgctcaaggagtgtccactgatgctcgtaacatatagtctgtgctcaattggccagttccaagtaatgtgaaagaaataaggggatttttgggacttgcgggctattaccgcaaatttgtccgccattttgggttactaagtcggcctttaagcttctcaagaagaacgtggtgttccattggacctcagaaactcaagcggcatttcaggccttgaagaatgcacttacatcagccccggtattggctttgccggatttctccaaagtttttgagattgaaacggatgcttcagcttttggcataggagctatgttgatgcaggatggacatcctcttgcgtttttaagcaaggcattgggaccacgcaatcgaggactgtctacttacgaaaaagaatgtttggccattttattggcagttgatcattggcgctcatatttgcaaggagctgaatttgtgatccgtactttagcggagtttgatacatttgggtgatcagaagttgaccacaccttggcaacagaaggctatgacgaagttattggggttgcagtatcgtttggtctacaaaaagggtactgacaatcgtgcagctgacgctctctctcgccgtgcgcaggatacttcaggggaagttctttccatttcagtctgtgtacccgtatggttggaagaggttcagcgtggctatgctcaggatgatcacgccactcaactgattgccaaacttaccctgcaaccggatgcctgtccacctttttcctttgatgctggcattttgcgttatcagggacgaatctgggtgggagagaatccttctttacagcaccaaatcttgcagaccttacatgctggagtgttccattgcttggtctgggctacggcgttcagttaaatcttttgtcgaaaattgcacagtatgtcaacaagcaaagacagagcgtgtgcgctatccgggttttctccaacctttacccgttcctgagcatgcctggcagatggtatcacttgactttattgagggattaccagtgtcttctaggtttgattgcgtgatggtcgtggtggataagttctccaaatatgctcattttgtggccctggcgcatcccttctcagcttttgatgtggctcaagcttacttgacaaatatttataagttacatggtttgccgcagtctctcatctctgatcgggatcgtatttttactagcacactttggactactctgttcaagctggccgacactcaactccgaatgagtactg

SEQ ID NO: 42465 - DNA, 1735 bp, Oryza sativa
tgggggaaggcgggacgttacaaaatatcagatgtaagcgggcccggcctgagtgggcccgtcctggacaaaatggtatcgtcctgggggaaggcgggactctcacggtttcacgggcgtgtgtgtcgcagttgtgcaggcatggtgcgcatggctggtgtggacccgaagtggtcacacagcatggcacatgcgctggcactggacacacggacgaaggcgggactctcgcggtttcacgggcgcgtggacccggagtggtcacacagcatggcacatgcgctggcactggacacacgaacgaaggcgggactctcgcggtttcacgggcgtgtgtgtcgcagttgtgcaggcatggtgcgcattggctggtgtgggcccggagtggtcacacagcatggcacatgcgctggcactggacacacggacgtggccaagaggggacgttcctggcctggggttgatcgacgggggcgtcaatctctcttaaggggacgttcctggcctggggttgatcgacgggggcgtcaatctctcttaagggggtgagggtgtaacatccccgtcgatctctcttaagggggtgagggtgtaacatcctggcccagggcttaataggattaatagaatactcatataaacaatttgcaacttcttttccggaagacgatctccaaataactccagggttaagcgtgcttggcctggagcaatttaggatgggtgaccgtccgggaaattcttcccgggtgcgcatgagtgaggacaaagtgtggagggcagtctatgacctatgaaagctacgccgatgtaagcgggcccggcctaggggaaggcgggacgttatagagcgcagtatcattacatccttactgcggcaacatttgcatcgagctcgacaacgtatgaagcaccaagctgataagagacgttctgatcgtcaatttgctatcggcgattgggtgttcctcaaagtgcagccgcatgctcagacgtctgttgctgttcgagttaatcacaaattaaggccgggatgttatagaccgcagtatcattacatccttactatggcaacatttgcatcgagctcgacaacggatgaagcaccaagctaataagagacgttctgatcatcaatttgctgtcgacgattgggtgttcctcaaagtgcagccgcatgctcagacgtctgttgctgttcgagttaatcacaaattggctttccgtttctttggtccttttcaggttgctgcacgagttggtaaagtggcatatcgattggtgttgccagcctcgtgtgccattcatccggtggttcatgtgtctcagttgcggaaggcatctcaacctcaagtacctgatgctccagcactccctcctgtggtcgcggaggttgatccagttccagcacaagtgttggcgcggcggcttgtccgtcgaggagcggccgctgtgcctcaagtcaaggtgtgttggactgggtgttcttcctcggaagcaacttgggaagacttggagcgattgaaggagcgtttctcggatgctccagcttggggacaagctggttctcaagaagaggggaatgttaccgaccctaatcctatcaagacaaggcccaaaggcacaagacaaaggaagcccaatacccgtgtgagtgggccggactgggttgtgtaagggaacatctgagtctataaagatgttacccgagcaaggagagagaatcgttgaaaaa

SEQ ID NO: 42466 - DNA, 8181 bp, Oryza sativa
ccatctgatcatacaaattcggtgatgagcactgtaaaacatactcattgccaacaattaatctagcagtcatgtttacaaatacaaccaataaaatacgatgaaccataggtatgtaaccgtgtttttatcaaaatgcacatgattgttaagtttatgtaccagtttgcttattttacaaggtttttacactaaatcacacccacctgccaaatttttgtaccgctggcgcaatttactcattaataaaataagaagacttaaatagaagaggtagagagctgacatacaaaatctaccatgggtacaataagattatcgtgaatcatgaaacatatgtgcttccattgtgaatatcttaaaagtgcacgatcttcacaggaattcaatgaaaaattgagctaattcctataaagtctagcaaaatattagcattaattacccttagcaattatagaagccatacagagagcatgccaactagcacgtttattttcccgaagagttggctcttgccttctccaagaaatgttaattatatggaagacttgctaattaatagtacggcatgtgaaacatttacataattgaccgaataaaacattctgtattctagcacattaatatgtttttacttgttggcccattatgcgtcaaagccaagtctcttttgagatgttattttgagcttagatttttttgcaagttttcatttatctaagttatcacaaaagctaccgattattgtcgcttagttaatttttactctatctcatatatatctaaaaatcaaactaattccaaactagtaatctgctcgtgctaacgctacggctgtttttgataatacaaatcaaaatatatgtctaaaaatacaaatatccaagcaaagatatgaagtatatgttcttatgtgaatgctaaaggatcaacacatatttagccttaaaacaataattccatattcttaaatttatagtattttatgaacttgttgaaaaatataaaattatggtcaaacgcacgccaccaatacaaaataattcaaaaatcatataacttttaatttttgtataagggagtagtaaatttagatggactaattaattgcatcttatgcatatgcacaaacggtaaattatttgaatgtttgcacaaaaggtatatgcaccgatattataacattataacctgaactgtctcatttcttctccaaaagggaatatctgacaattctttatccacaatttgcatacaaatacatctgataaatcttaaatctctccatacatttactatcagaacttccgcatgtctaaatgtaccagaccccgcataacccatcaacacattttcctggaggatatggacaactccaacagcttatcagccaagtgcacctagatgacacgcatattgatatcttaggattgttgcggcaacatatttcatataacacaataaatttcatagcatctttgaaacctcatttaacacgctgaacttttaaaataaaaaatataatcaatacttaacagtacactattattgacttgttcgtagttcatacattccatttgtaaaataaatttaaaagcatcttacaacacaaacatgcatttcttcactgcacaaaatatcttaatgagaaaactgcaccagaaggttagcaacgtaccatgacaaagcaaaaaaatcatatcatatattcattattggaccatttgctcaggtgaacagtttggtgccatacaaactcctgggaacatgaaaaagcttggcgccatataaagtagggtgagtggagataagtgtaggcatacatcatgacagattgaaataaacagtatcgatctatgaggtgtaaagtattttgtaggaaattgattagggagagaatagttacctgatttagagggatgctgtcatggctttaattcatgctatttggtccaattcggcagtcagtcaggattttctttttcatgattcttaaacaatggagccagaacagatcctccttatgtgaaatatgcaggtggtaatggaggaagaggtggtgatgtcattcttgagtgttcaaggtcagtctgggatttcagtggtttgcaacatcacatggtatatgtttaaaaccatcgtagtgtccgtttcgtccagagatgcatatactttttctgcacttactggtttcctgctgtttgaaaacatcatattgtgctagatttgggagtttgttcctaaaaacactgtgccgttgctgagaatctgaacttgttgaactaaaaggggctaaccctacccaatcatgaaccttaagattttttttttaaaaaaacaaatcatcacgaaagaataggacgaactccttgcggagagcttgcacttcttcgacagctatcacagccttgcccgcccggtctattctgaactttctccaagtcatgggagcttggccttgccttggcggctgtccttggatcgccggctgaggctggcgaacagagaggggaggtggttcggtaacttgaacttttgcttgagcttgagcagcggcgacggaggctttgtcgtactcagcttgtatagcttgtcgtcgcttggaatcctcctcgcctcttgcgaacccgtcaatgatgcgaagtaggtgctcgagcgtctgtggctccttgttggcgatttttcttgtgagttcgccctcgagcagaccggccgaagcggcgtttataaccgacgcctcggttatgtcttgaacttggcaccgggcttgcgagaagcgatgcatgtactcccttatcgactcccccggcctttggcgaatgccgagaaggtgttgctgcgtcttcggctcctcataggtgcctcgaaagttaaggacaaaaacatcgcgcaattgctcccatgagtaaatgctattggctggtaaattgaaataccaagaacgggcgatgccgtctagagcgagatgtattacctttgccttggtattttcgtcaccatgagccgctttgatcgctgactcgtagatggagaggaactccttcgggtcaacttcgcctgaatagcgcaggacgggtgggaacttgaactggggtgggattggacgagtcttgattcccccactcagcggtagccccttttcgcctcccgccctgtttaccgcaccttgctgcgggtacggtgtggcgaagggcaaaatcgcagcttgtgcgtgaggttgggccgtggcattcgactgcccggctccaactggaggtacttgctgagccgccatggatgggtcaaaaattggctgcgaccacgtcatggcagcttggattggtgcttggtttgttccgaagcctggagttggagcttgctgccgaacggttggcgcctgagcagcgttgacgaagtcgagctgcggtccttgattccacggcgaaactcccaggcccggctgaatcggtggcaaccaattaggcgcaccttgacttgtattcccctccgggtgggccgatgggattgtacttgaaatgcagtggggttggttgagttgctgaaggaaagcttgaagttgcgcctgcagagccgaagccccttccgccactgtttgtggcgcttggccaggtggttgatggtgtacttgggcagcgactggttgagcttgctgttgcacgtgaggggccggatgcactgctgcggccgattgctgcccggcgaagtacaccggcgcctgtgtggcttgtggcggaaagggctgggtcgtcacttgcggatggacttgaggtgggacataacctgccgaatactgaaggattggagccgacgtggccttggcccgccttgccgcctcgtatgcttgttgttgttcttgcatttggcgaagcatgtcttggagccatgtcatgttctatcgcatggcttccatgtcggcttcggcttgtgtttcggggtcagggctgacctgggcctgcacaacggcgagcgcagttggggccgctgccggctgcgatggagcggcttggggcaccaccagttggcctgtcgaaaggatctccgccctggtctggagtgcccttgccgccgcagccgccttcgccacgtcggccgcgttcggctcttgcacaaaggttgcaggggccgaaggcggttgtgatggcgcttgtcctcctccatcttcggccacgggcgccgaaggctctgctccttcctcggcggccatgtccggtccggcgtcgctttcctttcgcctggcaaccttctccttcacgaccctcttcggtagcattcgctctcagtggtttcgctcggaggtccccacggtcggcgccagctgttgtcgaaatgacaactgcatacgtcgaaagacgtggttactcaacagtggttggaaggaaacgaagtgtattgaattttgaattgttttctttctttttttcccctccccccattacatggccctaggagactattaatagccccattacaggtttttactattagggtttaggttgtacaggggaatttacatgattacccttacgaaagggacatttacaggggtacataatgttataggggctcatgggcccctgatgggccgtctggcgatcgctagccctatagcccctaagcttgttgggccggaaaggcttcctcggccctcgcgggggcgaacttgccatggcgaagtcgtcttccttcggcagatagtcttcgccttgcacccttcgcctgagacgcctctggcctggcaagacactcgtacgactcttcgcctcacgccgttcttgctccatagccttcgccacgggtttcggcagatttggtcgaagggcctcatgccatccgtcaacacaatgccatccgccaacacaatgaatggtccaacaacaatatagttgctttatattaaaaaagaattccatatgactatataaccttggaagaggtttcaaatatttatgaaacttatgcacatacggaccatgtcacgtagctgtccactcagctatttcattcaaacaaatagcgtgcagctataacatcagaagaagaaagttatttattttccttctctgttttttttttgcaaacatcgagagaagaatatcacaaccgcaatatatactaggaaaaagaaatataatctcagaactgtgaacagagtattcgggtttgaagaacctcggcagcgacccaaaattccaaagcgttattgcagaaatcacgttaccttagtccttagcacttcaatcaatcaaatgtggtcacagctgaaaactctgtgaggtttctcagctgcaaccgcaagcctgagacatcgaccttcccattaatggtggtgatgtccaccgcgacctccatctttcgccgactccgccatctctctggtggtccgctccgggtggaggctccaaatatctcatttttggtttctctgctgcttcattctgtgctagatcagtttgtcctggaaatttatagatcactgatgctctgtaagataatgtcatattcctcttgatcacggctaccgtacagaagcaacaatttcgatcacggacaaagcttccacgaactgcaatgtaaatcaactaacataacaacaaaactaagtatatctactccagcactaaccggacttagtaatgagcgaaaaatataactttaacttgaaactttgtatattaattaatgaattcggccatctcttaacatttgtttttaaaagaagggtgaatcctaaacgagtaatctataagggcagtcctagtgctccagtgctctaggtaggatagtttccatagatttaattatgctgccacataagctaaaaatttgatgtggcgcctgagctaatgagagtaaaatatgacgactcaagaaaactgcacaatgacatgctagtagttttcttgtcatggcctcctatagaaatgcggtgacccctacacaaatgtttgttatatctatttttatagaaaaaaaacatgaagaaactatgtattggggaggttaggtttaaattaatatttaatgtgctctctcatctagacactgcctatgacactacgcatcgagattgctcattgctctaattcacttcatagtttccttcggtggtttcacatcattaattagttgatcatggtgatcaccatcatatcatgggacgacaatgttccattgagccagccaacaaaaggaatttcttttttagattaacggactcccaggcagccacgtggatccttcaccaggatcagttgtctgttggcaagttattccctagagttgaccaggtttttaacttaaccagtcatatggtttcctaatggtgttgaaagcaacacattcaagcaagcatggtagattgtctcaaatattttaccaaaactagcgcctctaaagctaatcagtcatgcttgtatacagttaatctagctttccaccagacaactaatgtagtttatggaatgatgggctgtaaaactaaagatatgagagtgctaaatagtttcagcacgattggtgccagaaaggctgcactaatggaacacaaaaggagtggtcataattcacagcattcttaattgtataaaaaggacaccaataagacaaaaaagtttcagatccttataagttgcaaaagagggattaaaaattaagatggaacttgcctgtatcccttactatatgtagtggttgcctgcagattgcctctcctgcttcaatgcatactgtggaaaggtaaatagcttagacatccaagtttaaccgtaagtttatactcagtggaagtaatgattgcaatataagtgcatcataggtgtttaaacttccaaatactactttcttttgccatatccgtaattcaaatctcttgaagtgcacattgcatggtatgactcatatgcatgaagttgtaataagtcaaataaatgctgaccaaataaatgattagggtatgtttgcaccaatgaacaaaaaaaatagccaacaatatttgatggcagacaaactttgttagttgattctacaagctttattctgtgggttgtcatgttgtctttgcagttaatatcaaccaaaggacttattcccaaattaacaggagaaacatggccacattaacttattcctccacacaatattggagcaaacgaggccatgttccatctcaggcaaaagttctggacaggtgaattcagtagccccacgcagaatcagacatcccatctattttggtaccagaacaaaagaacctgagagggttggtcaccatgtgtttgctaagaaatgcgctgccagtagatgacaaataactcacaggattgtggtgaggtcgaactgaacaattggaggaggggcagcactcagattgaaggaggggacatgtacctataacagaaaagtttgttaatagtgctttagaagattcagaagaaaattagtaacgtcaactcaatagaaccaacttaatttagagagaatagagctaactagccgcatcagaatgaccacatgttaaaaaatatatacatagactgttttttcatcagaaaagttcatatatgaggttacaattgtagccatgacagcatcagatcttcaaggaaaaaaacaattgttctttaccagatatggatgaatcataaagaaccacaattgctacttcagtaaatgcactgcactctaattcttcaagagtcaaaaacattatgaaaaactcaaagttcttggcttcatgacctgtaaaactatttacaggtctaaaaagggttcatacttgaatctttcatctctctaatcatgagcatcttctcaaaagctggaagcaaaaccttagtgaagcttactcgttttagtgatgttcactaatgtcaccagaaaaagacacgttattcttgaagagtggcaagcaacagcatcagttctttcattggaataacggaactgttctatatgacggagtaatggagcatcatattaatggctgcttttcaaaattatgagcttaacttactgaaggaaaaatggataaaagagcaaagcaattgattgttttcatgtttgcttttcatcgtgcatcagaagtgccatccaagagcaacgattctaagctaatatttttgctaatgctgttccgcagggttcactatatcggtttagggcttttgatcgggggtctccgaa

SEQ ID NO: 42467 - DNA, 14735 bp, Oryza sativa
aacaccaggacagatttatcaattcttttgacattgaacattgtacagaatattacattcataatagcttacatgcatgatgaaacaaaacttccaaaaaaatatatatgtaggaacgcaaggtaaacttacatgcatgattgccaacttctgtacataaattcagcaccatgaatggatgtcaaaagatcttcatggatttggattggtgtaagttatctaaaaaatagattgatgttaaacaacagaaatcttgtacaaagtacttcatattgctctgatgatagcaaagagaaatcccttgataattacaaacttcactgtgtttacagttatgtttatacctacaattaaatcgtgatacccacagacaaattcatgactcgcagataagcagtattgcccaactatgtaaagtagtcaggataatgatttcaaccatggcataccttgacaagaaaacaaatagatgttggatgcggatgcgcaaatcaaaactagcatcctggcaaaatagctttctttcacacctaaatgataccaagtgcatgaacatattaattcttgccatcttagcaaaatagctttctattacatctaagtgataccaaaaggcatgaacatactaattcttgcaacaccctaaatagtacataaacagctaagttcaggttcctgctatggagttctgcacaaattttgcaatagctttaacagcttccatttctgcagcttgttgattcactccagtagactcttgatactttttgccgattttaaaggagtggtcaccaccatcaataacatgcagttcattcttgcagttcatcttcttgcgagtggcctcaagcttatccaaagggcataacccatctttattgccctgtgaacaaaaatgcattgcataccaagcttaaaaaatattgaatattatttttcatttcaaagtgtgttcagaaagaaatacctgcacaaacattgttggaatcttcagtttcagtagtgtctcatccctcactgccccgttcactccctaagaggaagaaagcaaggatgcaaaacaaaacatccctaagtagagccataacagagagtgaaaataaccaagtggagcatgttttaaaatcacagcaacccttttcctgaaaaactggttcaggtcctacaaattattatataatggaaaccgaaggctaaatcattttttgatgtgggttacatcctcatacattgtagcaatcatattaccccacacaacacagaggatacctttaacggataacccaagcatatgacagcagaaacaataatatcatctgaatcagccaccatacagctgaccctgaaaaatgtatgaggactacaatcttgagacagatgtcaaaaacacaaacaagtctgaaataaagtaataaacgagattaaagctcccacatatcaccttgaacccatagacttccccatcagaacaagtgggtgccctggatgcttcgctacagcgtccttcaccacaccaaggtgatgatcaacaagcttctccgccttcggcggagccctgcgcttcccacctgacatatctgcagccaacaaattgttgctctaccatgaaattctccccccaacagattttcatcaacgagtttagcgaacagtgaggggtcaacaaatcagcacttagagctcatcagacaaactcacatgggtaatcaaaggtgacaacttcgatagcatcgagcgcatccttcaccatatccttccaactaacagagatgagaaatcactccctcaatttcgcacatcatcacgcacataccaaaaaaaaaaaaaagacgctacctctaccaacaaaatagtcgccacaattccgattatccatacgcgcacacgcaaaggggggagagaagacaggacagagagataaagagagtgagagctcactggaccatccagtcggatgaagagggggcgccggcgccgtgggcgaaaacaaccaccggctgcaaatgcgaaggcgccgtccgcaagggaggaggcggcggcggcggcgtcgagctctcgtccgccggacgggcacggcggcgcttcggggccatggagatggagatggtgagagaggcggaaacctagctgggtttaggaggggggattgggagggagtgaagcggcgggcgctacagggcgggaaactcctcggctttcccgcgggagtctctcctgagtctgaccagggttggacttaccgccggtaaccggtttatcgcgggggtatggtaatataaatacttcggtaacctttttaaattcaaataaatttaaaaaataatttgaatttttgataaattttgcacggtttatcacggttaccacggttaccgtgcggtaaccgtgcttaccgccgggacgcggtaaccccggccccagcagtttgggaaaccctggtcctgactgagcggtgggttcagctcatacgtgtagtgtaggtgttacgagggaggaatgttcccagccttgtgatcatggatggacgcatcggatcttgtttaagatgagaactaccttgaaatgcaatctttgtatactggagtatatcagttgttttttcgaaacgtggcagagacacacaaacacatatcactacccgcaacatcatactcacaatcccattaacacatgctctaataaaaaaaatcagcagcacattcctgaactttagatggccttatggcccgcggcctagcccatggcacgccgctttggtacggcctaggcatagcacggcccgaatggtgtcgggcccgtgttggcccgacccaatagttgggtcatgtttgggctgccgccttggcatggcacaacatgaagttcagggaggacaaatagtcttattttcaaccatatattataaaatgggtgcgccaccaactaaaaatatcctgtgaatatttatatttttggtttagaatacataaatattatagagttatctatctaccctatagttcaacaaatggtttcactcatcacttatcactcattctttcatttgtcactcaacagtccagattatctcatctcaatctaacgtctcccgcgtacccatcgccttccctcacccagcagcgcccccgaatcacgcgcactttccttcctgttccgatcgcgaaattcctccgctcccctcccccggcaccgcatcgcgggccatcggtcccccacctctcgctccactgcgcctccaacccacgccccgccccctccacctctcgctcctcacgccgcctccatcactctccaaaccctaacgctgccagtccgccgtcgcgcgccactccgccgctcgtcgcccttctcgccagtttcaccgcctccgatctgattctttgaaactccattggctcctcggcttgctttcttacaggcatcaagtcaggtaagcaactaagtatgaattttctccaaacatatatctcagcagaattgctccttatcatatgaaactactccataataacaacgaaatatttaggctctgaaactagccaaaacaaaattgtcagggtggatagataatcttggtcagccttttattgtaactgaacctcattgtgtctttttatacgcaaatgtatatgcaggcatatatcatgagacgcccagcaagcaagcaaccatcagcagccagcccgcaagaaggtccgaaaagacctctactgcgcctttcacggacgctcttcgcacaccacggagcaatgccgaaacattaggcaatgtggcaacgcgtaagacccaaggctgcagcagggaacaactgtcgaagcaccccgcgaagcagttcaggagcaaacacccccagccaaacaacgccaagatgcacagcgaaggataatccaagtgattacaagggccgacccgccaagccagttgtccaagcggcagaagaagatgcagatccgtatggtccacagcatcacttcggcgggcgaaggggcgccgcaatatctaaaccagctaatttcttttgggccggaagacgcagaaggagttatgttcccgcatcaagatcctttcgtaatctagtttcgaggtccgacgaatactggtcgacggagggagttcggccgaagttatctttgccgaagcatatgccaagatggggttgcctacccaagcacttaccccagcaccagcatcactccgcggtttcggcggagaagcagttcaagtactcggccaagcactcttgctgatagcctttggctcgggggagaacagacgtgaagagcaaatactgttcgacgtcgtcgacatcccgtacaactacaacgccatcttcggccgtgcaaccctgaacaagtttgaagccatttcccaccacaattacctcaagctcaagatgcccggcctggcaggggtgatagtagtcaaggggcttcagtcttcggccgcttcgaaaagcgatctagccataatcaacagagcagtgcacagcgttgagaccgaaccgcatgaacagccgaagaacatgccaaagcccacccctcacggcaagataacgaaagtgcagattgatgatgccgaccccacaaagcttgtatcactggggggcgacatgggcgaagaagaagttgagagtatcctagaggtgctcaagaagaacatcgacacattcgcctggagccctgacgaggtggggggtgttccggcagatctcatcatgcatcacctggcggtcaagctggacattaagccaagaaaacagaagttgcgcaagatgtctgccgaccgccaagaagcggcgaaagccgaggtacaaaaattgctcagggcaggggtaatccaagagattgaccatccggagtggttggtgaatccagtgttggtgcggaagtcaaatggcaaatggcgcatgtgtgtcgatttctcagacctaaacaaagcgtatccgaaagacgacttccccttgccacggatcgaccagctcgtggattcaacagctggatgcgagctcatgagtttcctggacgcatattccgactaccaccagatccacatgaacccgcttgacatccccaaagcatccttcatcactccgtttggcacattttgtcacctcaggatgcctttcggcttaaggaatgcaggagcaaccttcgccagactggtgtacaaagtccttggtgagcagttggggcggaatgtggaagcttatgtcgacgacatcgtcgtaaaaagccgcaaggctttcgaccatgcgattgatctgcaggagacattcgacagcttgcgcaggcaagttgttgggtttccttgtttccgaaagaggcatcgaggcgaatcccgagaaaatcgatgccatccagcaaatgaagcctccgtcaagcgtacatgaagtacaaaagcttgcaggccgaattgcggcactcagtcgattcctctcaaaggcagccgaaagaggtttgcccttcttcaagaccctcctgggcgcgggaaagtttgattggaccccagagtgccaggcaacattcgacgagctaaagcaatacttgcaaagcccgccagccctgataagcccacccccaggaagcgaactgctattatacttagcagcttcgccggtggcagtcagtgctgcactcgtccaagaaacagagttcggacagaaaccggtctacttcgtctccgaagcactgcaaggagcgaagacaagatacatcgaaatggaaaagctcgcttacgccctagtgatggcctcgtgccagcttaagcactacttccaggcccacaaagtcatagtgccatcacagtaccccttgggcgaaatactccgaggcaaggaagtcacgggccggctcagcaagtgggcggcagagctatccccgttcgacttgcattttgttgcacgctctgctatcaagtctcaagtgctagctgacttcgtagctgaatggacaccggtacttgccctcgaccccgagcccgccgaacaattctgggtgatgtgctctgatggctcgtggtcgcacaggggggcaggtattgcggcagtcctcttttcgccgaatgatgtgccgattcggtacgcagcaagactgcagttcgacacaaccaacaacgcagcagaatacgaagccgttttcctgggcctaagaaaggcgaaagcactaggagtccggcgcttgctaattcgaatcgactccaagttggtagcaggtcatgttgacaactccttcgaagcaaaagaagaaggaatgaagaggtatctggaggctgttcggttcatggaaaaatacttcactggcataacggtcgaacacttacctagaagccagaacgaggaagcagacgccctggcgaaatccgctgcttgtggtggcccacattcgcctggcatctttttcgaagtcctacatgctccaagtgtgtccatggacagctcggaagtcatggcaatcgaccaggagaaactgggcgaagacccatatgactggcgaaccccatttgtgaaacaccttgaaactggctggcttccggtagacgaagcaaaagcaaagcgtttgcaacttagagccacgaagtataagatggtctcgggtcagctttaccgctccggggtacttcaacccttactttgttgcatctcttttgccgaacgcgaagaaatggcaaaggaaatacaccagggactatgtggcgcgcaccaggctgcaagaacagtggcctccaaagtatttagacaaggagtttattggcccactgtgttgaaagtctgtgttgagcaaatcaagaagtgcgaaagttgccagcgtcatggccgaagccaaaccgcgccccaatatgatctgcagcccattgcgccaatatggcccttcgccagatggggactggacatcatcgggccgttcccggtggcgcaaaacgggtataaattcacaattgtagctgtggaatatttctctcgatggattgaagccaaaccccttggagcaatcacttcggcagcaatacagaaatttgtatggaaaaacattgtttgccgttttggagtgccaaaagagttcattactaacaacgacaagcaatttgactctgataagttcagagaaatgtgcgaagggcttaacctggaaatcaggttcgcgtcggtcgcgcacccgcagtcaaatggggcggccaaacgtacaaatggcaagatcctagaagcactaaagaaaaaactcgagggggcagcgaaaggcaaatggccagaggaattgctatcggttctctgggcccttcggacgacccccacaagatcaaccaagtttagcccgtttatgcttctttatggcgatgaggcaatgaccccagcagagctaggggctaactcaccaagcgttatattctctgggggcgaagaggggcgcgaagtatcgctcgaactcttggaaggggtaagggtcgaagtgctcgagcacatgcacaagtacgccacaagcacttcggcaacttacaacaaaaaagttcgacccacggagctgatgcctggttatcttgtcctaaggaagaaggtgaacccagtagcggttggtaagcttgaatcaaagtgggaaggaccgtacctcatcaaacacaagtctaggacgggatcttttcgcctagcgacactcgaaggcgaggagttcgactattcctggaacgccgcctctctcaagcgcttctatgcctagaatgggtggcacccaaatcgccaacttgtaaaaatgtacatacagtcatgtaagcccttcggcactatgtaagcctttcggcaaagaaaaaaaataagagagaaaaaaaggaaaaaaaaactggatgtagggctattatccaccatggaggcccgaaccagtataaaatctctgtgtcctacgccttctttttattttttttcgcgtgattgataatttgtggaaaaaccccaaggcaaacgcctgatcagcgaaaaaagccaggggggagaaacgaatcggccgaagcatcgctcgccgaacgttgaaaccgcaacagcttgtctcgaaaaataactagccgaatgacgttacgattcgatcaacataaaagcaaaagcgtctctttcgacacagaatgctacagatcgaaaacgaacgacgaaaaactgaaaagacagtacacctatttcgctaatatacgcaaaggggccggcatgttccgacctaacaaaagcacaaaatgtgatgatgcgaaaaataacgaaaaggaaataaagcacgttctttattaacttcaaaaaaataatcgaagaatagaaggttcacaacacgatacaattcactctacaagtaaattacatcttcgcccccgtaatcattatccctctctaaggaatggtcagacgaactaggttcgtcatcactactaatatcatacacaaccttaagaggagtagggggcgaaacacagactaaactgtaacgacgctgaaagatcgtttcctgacgtttagtcttctgatggtttcgccaaaagcgagccatatcctccaaacgtcttgaatgaacaagatcgtaatcttctaaggttcgcccggggtgcgctcgtagccagttggcaactttgataaccttatagctctgaccgtttatctccattttgcgataaacagggcgaaatggacatcgcaccttcggcaggtccttcaatgccacaaatttctcgttttgacttcgccagctcccggaagggggccgaatgcacaacttttggcgaaccccctgatagacagcgcagaaaaagcaaaacacagcttatatagtaagaataggcgaaagaagggggaggtatggcataatgcgaaatgagcgaaataataatatgctaaagacttcgatcatcaaaaaagaatttaacattgtgtcatacattccaaatatacaaaaaagccttttttaaggtttggtggcaacttgctgaatatacatcattcgcctctctaggcaaacgcaaaagagggagaaaaactacaaaactctaaagaaagggtggagggcctcacacctctgggtgatcctgggcatcgcctccaacctctttgcccaccgcgccctcttcttcgcaccgatctaccgcctccgccttcgccagttgctccagaaggtgcgccttggcagcggaccggccgtctttctgccaaaactgttttcgccacgcgcgaagagcggtcaaaatgttctgcgcactaatctcccagtcccccttcgcataggtagggaactcggcaacgtgctcacagccgaactgctgcaaaaggcctaaggtgaaggccgccgatacacgcgcacagcaatcgccgtacgcggtggcgcagtccgaaaccgatccgccagcctgctgggtccactcggagaagtcgaaggctgaggcatcctcggcagggaccccccgcaccttcgcgtccatgtcggtaagggcgaggcggagcgtttggcaagccattctcgcagattcggtggtcttcgccatctctcgcgaaaaccgctgcgactcctccgcggcgctcgcttcggccctgctagccttctggcaaagagcctccatcttcggctcagtaaggttgtagtaatcgatgagcaccgccgaatgggccttctccttctccagttcggccttgaggcgatcaacctcggccctggcctctttccccttatccaattcggactgaaggcgtttgacttcagttttcgcctccttgagggtgtgggccagggcctccacctccaagttcttgcggcttatttcatcatccttggcccgaagacggctcttaaaaccgtcaaaacgggcccgcacggttcgctccgtcgaacagtgagccgcaagaatctagatgaaagataggagcgggcgaaaagaacaaaaggctaattgtgagacgtaaaaaaaagagggaagaggaggaaaacgaagaaggaagaaaaggcatacccgaaccgccaaacttttaatggtggaacacccctcgtcgaacttgttaagttcggtgaacaggctcggggtgccggcgggcaagacaaggttgctcacaccctccacaaagggaataaggtctgcccgagtctcgaagtcaccaggggcaaagtggggcgctgcaagggaatactccgaggcagatgcttcggcggccgcacacttccccttcgccttgaccagtggcgaaatagctggctcatgcacagggctcccgaaaaccctcgccgtagccgacacgatccgttcggcggaggcggaagccccggcggcggtgctactgcctgccccagcaacgccgagcggagcaaggggagcagtcgaaaggtccaaactacggccagcaggcgaagtcggagtctcgtcagaagactcgtcgtcgctgaaaatgcgggcgatgttgacgagtcctttctttttggagatcttcttcaccggacctcccttcgccaccgtgcccgaggagaacgcaactagagccttcgccccttccaaatcctttcgtcgaaggagggagctgttcgactccaccccggtctcgttgtgacctggacttggggtaggagtgtagccgggggtatcgacgcgatcttcgatcgcctctttcgcggccttatcggccacggcctcctcctctccttcattctcgccgtcgcgttcttcggcatcgtcctcgttgtcggcgtcggagtccgacgaagcagggacccttcgcttcctaggggcaagcttcacttgcccgcgcattcgctttcgcgaaggccctgcatcgtcgtccgctttgtgggggtttgcccgaggaggcaactcgctgttataaacccggttcgcccgcccagacgcttgtcgttagggatgacaacagagcggatacggacggataatgctcataccatattcgttttcatatttttttaccggatacgaaaacgaatactgatagctcgaatacggaaataaatacggattatctcgaatacgaataagaatcgaatatgatcggacacgaatacggaaacaattttttctcggaacacgaaaaccaactcaacttctaatagaaacaaatatcaacatatataattagctcattttatataaaatgaggtataatttataaatattttttaaaatttaaataatattaatagtatggactagtgttaagagataaactactattaaaatctataaaggtatattgaaggttatagagttagaaataaatggggtatgtctcatgggtcctgcggatatccgaataacactattcaccggatatccgaattattatccatatccgacggaaaccctggtaccatattcgtattcgtatccggtagaaaatatctgtattcgtatccatatccgaactatccgagaattatccgatccgaaaggtatccgtatccgtttttatccggagcggacggaaactatccgctccgttttcatccctacttgtcgtgttagcagttggctatactcgacgaccgatacgtcgccgatcatcctgcgggcttcggtttcagcctggtcgagggtcaacactgcaaaagtaaaagtgtgtagccatgttaaaagtcagacaaagcaaaataacaaagcacagcagtatatagcaaaagaacagtcttactgttcgtcccctcaggaagaatcaggttcggcaaaccgtcaacctcttcgccttgatcaaccgtgacttgccatgcctgggagaggggaaagatgcgaagcatacagaattcctctaccaagtcacggcagctaaggcgggagcaaactttgcgcagcagaacgaaccgcgcctccatagcgccgtccacggtgatcttgggtttccggttcggcgcgatcgccctgcgccggcaccggagggctttcgccgagtcagaaccagcctcgaaggggatggagtgatagaaccacctagccatccaatggcggtcccacttcgacatggcagcgttcaccggccagagatcggaccgctcaggatgaacgttgaagttcacactcctgaactcggtcttctttgtcccagttggggtaatcaccgtcttcgagttcacggtggcgaagaatatggcgccgaaaagctcggcgttaggctcaaacccggaagtccggcatgcccagtcgaaaatagcgatccgaacaagcgccgacgggctcagctgtggaagctccaccttgaagaggcgaaggatctccggcaacaacacgttgcagggaaaccgtagccctgcatcaaaaaagacggcgaacaccaccgtccgattgtcgattggtttcggcaccacggctttccctggggcgaaagcctacccctcaaccaacgccccagagctgaccagcttcgccagctcgacgtcgtccataagagaaacccccaaaaaggtggtgctgtcgtcattgactcggccgggatctggctcttttgccgaagcagggtttggcttgcgaggggtcatggcgaacggtgcgtttgcgatggcgaagaaagagaacgggcgaaacgcttgaggggtcaagagatgctgtggaagaaagaaacggaggaagagagcgcacgcggtaaaatggcaagtgtggcggtgaaaaggaaagagcggtgggaatatatagctcacccgggcgaccgttcgcctacccaccagtaataaagcgccacgtgtcgcaagggtaggcgaaacggtaaattcccaccgtccgagcggcacagtaaaaagcccacgaagggaaagcccaatactgttccgttcggcccgggaaaagaaaatatataaccaccaatcgcaggaggcgaagcgcggcaaaataataccagccgcacaagtaacaaacttcattcgcagaaataatgtaggtttcggcaggagcatcggtcgaaagggggcaccgcataccataccacatggtttgcacggtcccggccgaagctccaatctcacccttgtccgtgaggggcttgttggcggatggcatgaggcgcttcgaccaaatctgccgaaacccgtggcgaaggctatggagcaagaacggcgtgaggcgaagagtcgtacgagtgccttgccaggccagaggcgtctcagggaagggtgcaaggcgaagactatctgccgaaggaagacgacttcactatggcaagttcgcccccgcgagggccgaggaagcctttccggcccaacaagcctaggggctatagggccggcgatcgccagacggcccatcaggggcccatgagcccctataatattatgtacccctgtaaatgtccttttcgtaagggtaatcatgtaaattcccctgtacaacctaaaccctaatagtaagaacctgtaatggggctataaatagtcccctagggccatgtaatggggaggggaaaaaagaaagaaaacaattcaaaattcaatacacttcgtttcctttcaaccactgttgagtaaccacgtttttcgacgtatgcagttgtctttcgacaacaaatttaatgctcaaacatagtactcgtttatttccgtctgtccattagttcagtttgtgcattcatcagataaacaaataaactgtcgagtcccgcagtaatagtttttttttttcagcgccacattatcagtagatatgttgaacacgatatgcatgaatgcatgcatgtaccattttgtcaagtatctttgaagtatacatatctcagatatttgcataagttgtactttcttgcacatacacaggtaggatggggatcgtagtttctgcttgcaagagaatacccaatgttttcctttctgttggcacttggcaggggtacggatccccataatcattgttaactgttaagttccatagaagattttgtttagtacggtcattaaacaaaagtatatatactatgtattatgtatttttaatggactttttaacatgtaatgataactttttattcatggcgaagaacagacattgtattgggtggcaaattccccatatggaccaggaaagtaggaaacctctaggcagggttgacaatctcgataccagatcaaaaccgcagacaagaaatatctttagattttacgtctaccattgataaaccgcgagaaagctaaatagcgcgtacgcgttgcaggcacgcacgcggagcgcttaggtttttttttccttttgttttaactttttttctttttctttttccacttttttcttgtttgtttttatgtttagcatgttttgagtttgaaagtttttaatttttgagttgaaaatttttaaatctgaacttgaaagttttcaaatctcgagttgaaagttttcaaatctcgatttgaaaattttcaaaattttaaatctggaagttttcgaatctcgagttgaaagttttcaaatctcgagttgaaagttttcaaatttttcaaatttggacttgaaagttttcgaatctcgattctcgagttgaaagttttcgaatctgagttgaaagttttcaaatctcaagttaaaagttttcaaatctgagttgaaagtttttaaaatttgactttaaaatttgaaacttaaatcgaaagttttcaaatctaacttcaaaaattttcaatctgttagtaaaaatatctcaaaaaaatctttaaaatctttcctaattactatcattagtgttaaatatattaactaatatagttagttaagactaagtgaggggaggagtactcgctgctggcgcgcacgcg

SEQ ID NO: 42468 - DNA, 12682 bp, Oryza sativa
atggtgaactacttgcatgtggcacttactgattcagtaagaagttggcttttggggcttcggtatcggtttgttgcaaattttcaaggcacctacgtgaggcccgggatacagttagatgtttaccatgtcatacaacagaaaaatgaattattaaaggactacatcctatcgacggtggatacctgtagactagataaatggggtactggggtatgttggtacaaggatctacacaatacgacatcaaaatagacaagagacaaggattatactggttcaggccactcgtaaggtaatagccctaattcaatttatatggaattgatatggaagaccacagaatacaaagagaactgatgaacttgttaatacagacgagatccttatcgagattattcgacgagacctcccggcggcttcggcttgagtccttcggcttcgtagactatggtgggtgtgttggcgctatgattcgatgattctgaacccctctaggggtatgctttttataccgcgagttgttttagtctccaagtagaactcagagataacgaaccctgcacgatatagaatattattcccacgagtaggactccgataatctccagcccgtgaggatattttccatgctatctcgtatatttccttatcgcatacagaaacatatcgtaggatacgggtatgccaatcttgtatatttggtaaatcgtaggatagtaggtatgccttatccgtaaccctgacacatctgacgtttctttgagacaagcaacaagattccagaagacacggacaatgtcatcatcgctacttttcaaaaaagaatctgtgacgaaaatctcatcggcaagttcacccgcaaaccgccacttaccgtcatgaagctcttcaaaacagccaattcatacgccaattcagccgaagccatcaatgttgtgcgggaggacaagcaatcaagtactccacatctggtgaataataataatgagtattacaagaaggatcgcaatcgaacacctgaaaacttggtggccgcaacgtcttattttcagtcacattgtcggcgtgctagaaaattacaaccgaatcttgaacgggccctgtccaaatcacccaaattccaaacactctgctaaggactgtttcacattcaagaaatttgttgaagacaatgctaagcagttgaagctaacagctggaaaaggaacttcaggacagaacaaggacaatactggtgaagctaatccggatggtttccaagacccagagttgagctaaaccacatctttggtcgccctttagcttataagttcaagagaaagaagctgatcgatcattatcaacgtaatacactcagcaaatatcaattcccaaaatagtagtagggcattacctctcatattgagagcttaaacttgtctaaacttttgtccctacagtccatcaacttttagatctcacgtgcttcccctttaaagtatcgcctatatagaacgtcgacggtttatcaatttttcgaattcaccaatgccagtgccgtgccatccaaaaccactacaaatattctcgaggttgaaaattaaattctataattgaaattatggttagagagtctgtctaaataaagtctagtgttgatctagagtattggacctccataaatgtttacgattggaacacaatatttgtcctagtcaataggtgggaagtaattcggcaagtaggtactggtattagatatataaagagtttatgaggatgtttgtccatccaatcaacatatatcgtagtttttccaaacacacatgaatcttgtatgaatttatgttatatattattattactctatttttattatataatggctatatgttattaatataaatattaaatctatgctacttaaaaattaaaaaataagagttgctttcatcgtccttaaaaaaaccaggcgaaaaaaacggacaaaaaaaaccaaatctgtcctatccaaataaatgggtgaaaaaaaccgggcgaaaaaaaagaaaaaccaaacctgtctgataaaaaaaggcgaaaataagaaaataaaaaaatttctgtcaacgcggtaaaaaaaggtgaaaaaaatataaaaagaatatgtctgattccaaagaaaaagaaattacatgtgacgcggtaaaaaaatcaaatcctattatatgtggcacggttaaaaaaatgcgacgcggtaaaaaaaacaaatcgaatccgattctatcgatgcagtaaaagaaaaatcaagcataaaaaaaatgaatatgtccgattccacaaaaataggaaacaatctcccatccgtttccactacttctatctatctactctaacaatctcccatcatccgtgcaaaataaatcgggcgaaaaaaatcatccgaaaacaaaatcgggcggaaaaagacggacgaaaaaaaagggtgaaaaaaatcctattctgtgtaaagaaaagggcgaaaaaaaaataaaagaaccaatctgtccgattaaaaaaagaattaggcaaaaaaaacccagcgaaaaaaatcaggtgaaaaaaaaccgggcaaaaaaacaacgacgattccgtgtaaagaaaggcgaaaaaaaatcaatctgtccgattaaaaaaaaggaatggaaaaaaaaccgggcgaaaaaaaatcaatctgtccgattaaaaaaaagagtcgggaaagaaactgagcgaaaaaatcaggtgaaaaaacagggaaaaaacgaatccgattccgtgaacgcagtaaaaaaaggtgaaaaaaaataaaaaaacgaattctgtccaattaaaaaaaataattatatgtgacgcggtaaaaaaattcgaatcctattatacgtaacacggtattatatatctatatcttctctatctctatctatgctacttaaaaattgaaacgtttccatcgttcgtaataacgaaaaaagggcgaaaaaaaatattaaaacaaaaaagaaagtccgattcaatttactttcgttgtccctgaaaatcttatcttatcttaaaaggtccaggccgctcggtgctcatcgttgtttgcacgcccacctagccggaccaccgatgtcgtggcacagctttgcgccgcccttgggtgcaccctcagcaggcgaagcaggagccgctcgttggtcaacaccgcacgcacgcactagctcaccggactgctatcgccgccttcgtcgtcgttccgctcgttcgtcaccggagagaagagatttgggagctagggttttgcccctctcttccggtcggcacttcatccatcatggggacaatcggagccgtccattagatcgaacggctcagatttgcccagcgttgggcctctaccgctgctgattacgctacgcccaatgggccgccgaagtacatcgaaccatccccgcatatgtgggccgcgctcagctgctcggcttgcgggctgtcgaattgactcagctcgccgaagatgggccagcccaagtttgggttggctaggaagacctgggccgaaagcaaatttgatcaaacaatgtggctcatattttttaaatcaaagtccgtcggataagctcctaagtaggctcgaaaaataaatataagactaaatcataaattctatgctaattcatcaaattagactcggttctacctatttgttaatatatcaaattagacttagatttttaccgatttgaggttttcaaggtgtcacactatcaaatggtgttttacccgttgcaacgcatggacactattgctagttaaacttaaaatataaaatttcatgatatcccgatactacgatacgatcctacaatccgatactactttaagaaaaatgatactatctagaatcccgatgctaacaaccttgtgtgtagatagcattgggattttacgcgtgacatgtttaaaaatttcattctagcaatattttctcttaatgcataaatctcgagatgatccgatggtcacaaatctgaaagttttagggacagtaaacttatgaatgttttctagcaaatttggaaaaaaaaggtataataacaacaaaaatcaaccaaaaaagatttagcactcctcacacatagttgattttttggacaagtttgatacatcgattcggatttaggagcacatcacgtagcgagaaaatttcgatcgaaatagtaatcccatagaaaaacaaaagattattttgtgcttcaactcaggcatataatcgctttgggcttgtctgcttagccacctgtatttagtcagattggcagcagcttaatccgtcggctaaattagtaatttagtaccagcgaaacttgctggtcatattgttgacggcctgaatctgcaactcgaggacgcggatctgcctgcgcttcgccgccgcctccgccgccgcgatcacgagctcctcgacgcgcgcatccttctcctccgccgccgcgagcacccgcgcctcggcgtcgtcggcgcgggcctcggcgtccagcctccgcgcctccaccgccgcccgctccgccacggccacggccagcgcgcgctccagggcgcccacctcctcctccaggttcgccgccacctcccccaccagcagcctccgccgcagcagcgccgccgtcccctcctcgccggcgtcgtcctccgccgccgcagcagcgccgcctctgagcgaggccagcaccgacgagaagcatgacaacggcatgttaatccaaagacggcggcacgtagagaaattagtcaaattatggaaagtgatgagcccacgggcttttgataggccgattattatgaaggaatccgagtccaattacgctgcgaagtaggccgtggtgtcccggtctgaaatagattacgtttatacgcccagcccaaacaagggagcgaaaatggttccgactgtggctcggatagtatcgcggatgtaacagaaaacctagacaatggtatcccgttgaaacaagatactcttttatgagacagtaaatgatacctgttgtggtacagttgcatggtacccgatacctgtgatacctgttactcggtacctttgatacctaggacctgatacctgtgatacccgtacaagacaatagttaatatgtctattccgttgcaacgggatcctgttttgtagcagccctccggatgcaaatatggaatattgtaccacttaccgatggagagagactacagaacgggatcccgttagaatggaaaattttaagtgacttattccctgtcttccagtgagcttccacatgcgttcccctgacacctggtaccttgggtatcagagtatctgatacctggtaccgactggtacctaggtatcacagactttggtatctgggtatcaggactgatacctggtagagaagataccgggactggggtgccgggatcgccggcttcttttgcttctgcggtggtggtggtggcggtggagccacctgcgctcattgtagctccctcatcctcctctggcgcagcggtagccaccacagctctgcacccacgcacccactagctcctacttggttcttgcggcaggagtcctcggtgacgcacggtggaggcagagcaggggtgaccagcggcggctgttccctatccctgacgatggcgatagcctagcgtgggcgccatgcccatccgatgagaagaccgacgagggcggggagccagagcggtgcagcaagggaggcgatcttgagggtgacctcgccgaggccgtgccatcgtcatcctccttggccgccatagacgacgacccctttctaccgtccggcttcatctccaccttcttggccttctcccaaaagagagagagtggaggggagatggagacagaggggagtgagggattcggattatcccgtggagaacgggatccagtgctatagatttttctcattattcatcaatggataggtaagaaaactgtcgacatattttcttttagaaatgtgtcacatttttttatccattagcctttaggcagtggcggaggggttgcctcacttaatcatgtgtccataccaatggagtcatatagaattttcatgtaatattgtactaaataattgcgcctcccatcaattattaaaagagataaatcaatatgtgatgtcaattgtatcaaaagaggagtacaacgattaaaagtactaaccaatatgagtgaatccattataccagcctagtagcacctgttcggcttggtggtctgcaatgcacgcgttgggctttacatcttcgtagcttaattctccatctaggggtacacatacatgagccaggggtgcccacatggtaattaatcactaattttactttcctacccgggttcttaggaacccctcgggactgcatagcttcgctccagctttaggcactgctctctctatcctgcagaaaaccaatctagtattcaatggaacgtttcttatttaaatttattgtattagaatatttcatttaaagtatgttgttttttagatggaggaagtagtgttgtagcagcgttattgtgacatactccctccgtcgtaaaaaagataatttaagattagatgtgacatattctaatactttttatataaagtcgttgtattaagatatgttatatttattcccaggtttattttgtgtttgacggaaggagtatcgttttcaagaaagtgctaaagcggttacgatagccaatcaatccactcccaacctggactcgctattccaccttttggctaaacgtgcccatgcactcattacaaacgaacaagtctcgacacgtaggctctattcagattcaaacttttttttaaagaaattttaacttttccgtcactacgtacctcttttccttctctcggtgacaactgactacagcaatgacgcaacgtcgcctggacatactagcctcgccacaacttcaaatgccccacgacatccacacacatgcaatccatcgagtacactccactgcgcacatccagccgagctagctcgcgcgcgcgacacagctctcctcggcgagacggcgacgtcgtcgtcgccgtcgttcggtcctacgtcggcgggcatgggaggtggccgtggtggagctccggcgacggcgagcgcgcgtgcgcggcggcctcatcagcctcgcgtgctgctgctgtgcagcccgtgcttgggccacctcatcccgttcgccgagctcgcgcgccgcctcgtcgccgaccacggcctcgccgccacgctgctcttcgcctccgcgaggtctcccccctcggagcagtacctcgccgtggcggcgtccgtcctggccgagggcgtcgacctcgtcgcgctgccagcgccggcgcccgcggacgcgctcccgggtgacgcctcggtgcgcgagcgcgccgcgcatgcggtcgcccgcagcgtcccgcgcgtccgcgacgtcgcccggtcgctcgccgcgacggcgcccctcgccgcgctcgtggtggacatgatcggcgccccggcgcgcgccgtcgccgaggagctcggggtgccgttctacatgttcttcacctcgccgtggatgctgctgtcgctcttcctgcacctcccgtcgctcgacgccgacgcggcgcgcgccggcggcgagcaccgcgacgcgacggagccgatccgcctgcccggctgcgtgccgatccacgcgcacgatctgcccagctcgatgctcgccgaccggagcagcgcaacgtacgccgggctcctggccatggccagggacgccgcgagggccgatggcgtcctcgtgaacacgttccgcgagctcgagccggccatcggcgacggcgcggacggcgtcaagctgccgccggttcacgcggtcggaccgctgatctggaccagaccggtcgccatggaacgggaccatgagtgcctgagctggctgaaccagcagccacgtggatccgtggtctacgtgtcgtttgggagcggtggcacgcttacgtggcagcagacagctgagctggcgctcggattggagcttagtcagcacaggttcatttgggctatcaagaggcccgaccaagatacatcgagtggagcattctttggaacagctaatagtagaggtgaagaagaaggaatggattttttgcccgagggattcattgagaggactagaggggtggggcttctggtgccgtcgtgggccccgcagacatcgatactcgggcatgcatcaattgggtgtttcttgacgcactgcggatggaactctacgctagagagtgtttccaatggagtcccgatgatcgcatggccactctatgcggagcaaaagatgaatgcagcaatgatggaggttcaagcaaaggtagccatccggattaatgtcggaaatgaaaggtttataatgaatgaagagattgcaaatacgataaaacgagtgatgaaaggggaggaggcagaaatgttgaagatgcggattggtgaactcaatgataaagcagtgtatgcattgagcagaggttgttcaatcctcgcacaagtcacacatgtgtggaaatctacggttggttaaaaatgaaatgatcagtggaaatcattttgtactgtgtttttcatattgcaaatttgctttggttgaccttgtgaaatttaatgcagactatttgcactacatccggatcaatcaaatatataaccaatagatgattatatacttggtctcgagggcagggacaaggctaaaatagtttaggacacttcgattgtcttaaatcaccttgaaaattttagagaaaattcataattcattagttcagctccagccgagccctaagtattaagtaatttctagtccgccctgtttggtctggttcatatatagacaggtaaagtctacattattaacgtctcaataagttgttttagaaaaatgcgtttctcattcgcaaaacatggtatttgattgagcaaaggttgttcaatccttgcacaagtcacatgtgtggaaatctaccgtgtgacttgcacattggcaaaacaaaggtaattgatataaagtcaacattaaagtctccagtgtgactttcgctgttgcaaaacatggtattttattgagtaaacttaacattaaagtcgacattttacagtttccatcggttgtcttagaatcgtgcgctttcgcaaaacatggtaaaaaaaaaagtctgaaaaggcatgttaagaaatgccagtaatttttatctgttaaatatatgataaatatgcctatcgtataggcatgaaaatagagcggatacggacgcataatgcccatatcatatttggtttcattttttttgccggatatggaaacgaatacggatagctcaaatacggaaacaaatacggattatctcgaatacgaataagaatgaaatatgatcggatacgaatacggaaacaaatatttctcagaacatgaaaagcaacccaacttctaatagaaacaaatatcaacatatataattagctcatattatataaactgtagtataatttataaatattttttaaaaattaaataatattaatagtgtggactagtgttaagagatgaatcactattaaattttaaaaaaggtatattaaaggttatagagttataaagaaatatggtatgtctaatggcttctacatgtatctgaattattatccgtatctgacggaaatcccgatatcatattcgtattcaggagaaaatatccgtattcgtatctgcatccaaactaaccgagaattatccgatccaaaagtatccgtattcgtttttcttcgtagcggacggaaactatccgttccgttttcatcctactctcgtaacctccaaaatttgtttgttctttatgagtgacggtgattttcttcttaacttcactggcgagtagagagcagagactgtatgcacggtagtggtactacgtatttcagatgatcactcgcaagagacgatgaacctccagccatatattcgcggccaaccaattcgttagttgtaattgttctaaaaaaatcgttgtaattggtcggtgtgccagtttttttttttttgtgtgtgtacaatgaatttgaaagctcactagtcaactctgattaattgccttgatggaattcatagattatataatatactagatcctagagattcacaactttttcaaagcacatgtatctcttcctcgtaggagcaattttcttattttggtgataacactgtatagttgactacaacattgtttttcaattcatagtactgtactgcagtaaaaaatagttgtcagattttacattaagatgtctaaggtttgactgacaatatgtttaatcaatcaatttttttagatttttaatcagatgtactttactaatatataatatattacctttaaaactactcactttttgttgttgctttaacaaatagagtaaattttaccatactataagttttatgtccaagttacacaaaatcacatgggttttggtatatgatgtataaccctgggtattacagttcaaaaggattacaaaactacaccattatctaatttaacttgttattgtagcaaaataaaaatgctagtatgcgacgagtcaaagaagttgtaaatttgatatataattttaaactcctaaataatggtggatcaaagaatactttgtcaaattaattaatgtgtggttttataaaactatattatgggttatgtagcatgtgccatgaaccatgtggttttatgtaagttggatcataatacttgtgattttataaaatttacttaaaaataactattaaaattcaccagttctggtcaaaactaaaaggttattcaaaattcaatcgtatatatatatagtaacaagtgtaaactggtactattataaccactggataacacatgctaacatcgcaggctgccaccgaccttgtccctctcttgctaccttcttctaatccccaccttgccttatccttcagcgtaaagattcctttgtagaaatactttatgactttcgttgagaagtgaattttagtatatgacgccgttgactttttgtccaacgtttgaccattcgtcttattcaaaaaatttaagtaattatcatttattttattgtgacttgattcgtcatcaaatgttctttaaacatgacataaatattttcatatttgcacaaaaaatttaaataaaataaaaggtcaaacgttagttgaaaagtcaacgacatcgtacattaaaatatggagggagtatttatttgttgaaaatgattgcttaaacatgtgtgcacaagataaaagtgccaagtgaacataaacagagggtacacagtctttggtctactaatttagaacgtcatttgcactgtttactgcattatattttgggtaatgaaatgaaactagtactatatatggagtatgtggtaatgtcgcggtgtcatctgatattaaaaggaaacaaccaaaagaggttaggttaatatatattttggcgataaaacatagaataagatagttcttggtcagctcgttaatgtattctttcaagaactacatcacaccactattaaacttagtgtaaaataacaagagtcggtagcagggtgatatatacataagatcgaaacatatggtcatcgaggtcagcttgtcgtgaacaagtgcctcccatgatgtagcacataccggtatgcagcaaaggatgacggccgggcacgacagtgcggtagaggatgacgaaaatgtggtgtgatggtccagatgcgacggcagcgataggggaatgggtgtgacggtgaggacaaccgatggatgcgttgtgtgaagtaaaggacgagggtgttgagtgatgaaaagggtgtgtgatttgcgggattcatggggaatgacatggggatggaaaggacgtgttcaggggacgccagctacatacgaggtgggattgtgaaagtgaagacaatcggagacgctttagatggaccgtccaatgcaagtctaaatattggatgacaccccttatcctcttgagcacactttttcccactctttctctctctttcccatatctctatgtcatttatacgactctaccatatctatctagagcagcggcgactcttaagctcagtggtggctcagcgtgaccagcttggcctcaacggcacgacgaactcaacctcaacatttttggggcagtgaggttggcctcggcttcctctgatagtgcaccatgacggcgatgacctctacgacctctccttcctcgatggtggtgcggtcagcgtcgtcttaattctcaacggcagcacggtacaacggcaacaaggttggccttgacttcctcgatggtggtagggttggcctcagctttcaccatgggccgttagcagcacagaagagagctccggtgctgagcccggcaatggccaaccactcacgggagaggaggaaggaggatcgggtactttttttttacgatttttttatgcttcagtccacatttttttggtgtttcattttgttggatcaaaatgtctaggtgggtattatggtggtgtttcacatatttctgtctttgtgtgtgtaatccgtggatgtctcaataaataaaatgtaacaccccaggtagccacatacctagag

SEQ ID NO: 42469 - DNA, 2189 bp, Oryza sativa
atcaatatcattaggtacctaaaaaccaaatgaaacgcaagagtgagtaaaaatactccgcaagtataatattgaactagtaaaacatacacaggtttaatgcaataagaaaaccaatatgaaacatttgtcttcctttaatttaaaacgaaggaggcaaaaagtagtagttccctcccgggcaggtgtgaatatcctcttagcattaccgataagccgagcaagtgtgatcagctcttctcaaggatcatgaatgaagatccaaattgcattcccatgactacgcatggtacttgaataatgtaaacaaaaacttccgccagaagaatgaaacatgaataacgttgtgaacttgaacatcaagtgaaatatgaatacgtagcataataccaaaaccacataattgataatagaaaactttgaataataattggataaatgaaaccaaacaaagtaacacagtttatccatcacacaagtccatcttatacttgccttaactccttcaataatccgactcaactcctccaacattggaaccctccacacctgtggagcaaaactacgcataaactactatatctaactaataatagttacaaggatatttgctaaaatcgaaacccagttcatataaatttttgcccatttgtattaaatagcctatagctcttccattactgttttatgcgtaactcacaaaccgtctaatggaacctagcaaataatacaacttcggacatctagaaaaaattgtctaccactttcatgttgagcacaaaatcagattatgcctctgaaaatcccagattaaggaaaacgaattgctgtcctgatttccggacccggtcggcagtactgtttttgttgtttatcccaaactgtttgtcggaattgagtgaaaccagcggcgttagaaagatatcgacgatgactacaaactttatttaggacaactaacctgaatcacgatggtttaataccagatttgaaaatactattgttagcccataatcaacaactaagaaaacactcaaccggcaattaatcgatttccacgtgaaaattgtatttctatggactaagaggagttacctcttacccttacagaggagaaatcgaatttgagatcaatttgtgaaaacccagaaaatccccaacttttgcctctcttccctttttccttcttttctcctcctgctttccccgcttcctgaaactcctgttctctgttcgttccagaagcacagcaacagaccagcatcagtagcagcagcggggaacgttaacagaaacagaaacgtcaccaaggagtcgagcaggagtggcgctggacggcgatggctaaacctgtggcgacggcgcagcagcgattggggtgatggcggctagggtttgtagcggctgcagggttatcgatctcttccccttttctcctttttttctttttttttcagttggttaaatagatatcctgatgaagatcgaatggcccaaattaatttaatcaccagtacttcgttcggactccgattattataaactcatagtctattttgcactactcggcgagctctacgcatccacggttcctgatcgcctattcgaacaacggtttaaaaattaaacttttgcgcgtttatgctaatattccccgaaatatactattttgaaactcggggcattacatgaaacctaaagtttcaaacgctacactaaaatgtttcacggcgcgagtcaattgggtttcattgtttctatttgccgaaatatttctgtttgagaacagaaatattttcatttatgaaatgacacatttttttcctgattgatgaaacatttgaaacattttgttcatcaagtagtgtaacatgtgaaacatttcgtaacaatattgtgcaacaacatccgatgttttgcataatatcggacgtccgatttgtagcgctccccgaagacaattttaagcgttgggtttcacacaaataatctaaaagtgttgagtgatgaatgaagaatgaaagaatgtaaaaatgataaatgagttagtgatttattggatagatattaaatactagttgtagttattcggggacatccggtgaaaacgagctaagtattggaaaccggtaaaaatcatacttaaaagtttcataaattcatgaaaaaaaatactagatctaggtgta

SEQ ID NO: 42470 - DNA, 16039 bp, Oryza sativa
  unsure (1)..(16039): unsure at all n locations
tcaccggatatgttctcgtagtttatatacgttcatgatgacaaataactttgcttgaaattgaagttaagagcacttgacagtgcagtgagaagagatatatagtttcaactaagtctcgtgttcaatcccgaatacactcatattttttttctcaaaaatgtttgaagagacgactcttactctaaatctctcttttttttaaaaaaaaaatactccctccattccataatataagacacaaccgcttttattagatgttccataatataaggcatgcatgcaagcatgcaatttactatgacatcttctctattaaattactactccctctgtcccacaatataagggattttgagtnnntgtttgcaacgtttgatcactcgtcttatcaatttttttttgcaaatataaaaaatgaaaagttgtgcttaaaatactgtaaataataaagtaagtcacaaataaaataaataataatttcaaaattttttgaataaaacgagtggtcaaacgttgcaagcaaaaactcaaaatcctttatattatgggacggagggagtacttttttaaatcctccactctcatgttatctaatcctattggatacatgcattatatttattaggatgatccaaactacaagatgataatctttggattaatggtggttgtgtcttatattttggaatggagggacttatattttggaattgagggagtacatgagagttaagaaaagacaaagtctcaatcataagaccatagtaaggactgcggcccagtggaaacggatatccgcaggtaaaatgccatttttcatggctggaactgagaaggatatccattctactccagaagtccagaatcgaataagtaaaagacaaaatcaaaaattcagaccaaaaaaaaaatcagagaaatgaaaagaggctgagcaacaactcacctcacggcggcaatgggcctcctcgtccacctccccaacctcgccggcgcccgccgcccatcgccgtgcggcggccaccggagggcccgcggcggcgcgcggttctcggtgtccgccgcggcgcccggcgggggcgtcaaggaggaagaggaagaggaagaggaggaggaggagaaggggacgagggggaaggagagaatagtgattcgggtgtcggacccggtgcgggagaggcggctcccgccgccgctcttctcgtccccggacgccccctcgccggcggcggggcggcggcggaggaagggggaggacgaggacgacggggaggaccggcggcggcggtaccacgtcaacgtcggggacgccatccgggcgctgcgggaggagctccccgccgcgttctaccgggagcccagcttccatatctacaggttcgtgaatcgtgagtcgtcgacctagattcccatgctttcccttgtcgggggatgatgatgattgttgatttgcgttgacggtgaaactgtggcgtagatttgacccttttctcagcgcacgagtggcactctaatgtgctctcttaagtcaaaaattggggagagaaaaatggtgatttctagtatactttatgaggtgttcttaggccgaattggagagatgatttgcaaaatttttgatgttttagtcgtgtcgtggccatagctaaaggattgttatcaggacttagataacatagtcaagtgcgatagagtctttctcagtggtttagtggtgtggttagaaaggctatgagttataaaaagtcaatcactcattatcttgttggtaaaagtactggcctcattatttttaattattaatttaaactaggaaggtagcccgcgcagatgcgcgggcaccttatttagtgatatttgaaattttgtaacgaatgtttatatataggattgtttttaaaaaatattttttactcttctaaatctatgtttatcaatatttttttggattgttttgaaagtcggtttcaatcactggatgtacggacacgcgttaagaaggtacatgctcctggacatttgtctatatgcttatgtgactatggaggtaaggtggaccaacatggacgtcgggtcctttaagggggtttatgtgacatcctagtgcaattaggatgtggtctatgttttttttatttaaaggatatgatctgtgttgtccataagcattgtgtgcacttgtgtccataagaatgaaagtgtaagtgatgtgatagcgtaagtgagcgtgccagttggatgcatgctgagctgccttgttttgaaggacgggttgttacaaattgtaaacaaattaaatcacttaaatttataagaaaaatgtctcaacaatagagttggttcatatgaaactatcattttatactactgtgtttttttaatttaaacttttaagtaatattttttccttgtatactaaacatgtctttgtagattttaggacaataatttaagaaattttctattaaaaatatgataatatgacttctttatctaattaaagacatactcacgtacttatatttacttctactacctacatccataaatcgaaggattcaaattttatcctaaaatataagagatttttaatactactcatttcatccaaccatttttcatttaattgttatccaacattactctaaccatcttctaactctttaaataccccttatttaatgatggatatcttagttttttttttcattcctccttaattcctataaaattttagaatccattataggatggagatatatagtaataaaaaagagcttcattcatagacatatttatttgtacctttgagattgatttagctttacatatttgtataggtaaatagacttcgtatgcaagttgagaaatataattaagttggtagaaagtcgttagatatctaatggtataaagtaattagtacacaaattttattaaaacattaaggtggattttttggggggtaatttttaggatcttttggttaacaattgttgtaaggaaaacaaagaggcgttggattcgtctcgtccatgaggagggaactgtatacatgtgttgtacatacgcactctgacgaactgatcgtttggtagggtttttttaagatatagatctaacagtttataacggtttaaaataagatccatcggtttgggtaaaataattttttttccttagaatttcttatacttactttaatttattagagcgtcgtgtggtagcttagaaatgtttataggaagccatgtatacagcttaagagcatttgtaagatatctaatggacttttagtatataataatagataattcatgtcatattaattaatatatcaattaataattaattttttttataatttttttatgggttcgccactgaaaagaaatggtatatatcaaagtgatatccggataattttttcttacttcgtcactgaagggtatattcatccaagtgacataataatttctatatagaaacatatgtaccaagagattatttttatatactgtgtatttggttgttagcttaaaaaataggaaagaactcggagagacacagaagggaagagtcagagggagggggtggaatggggtacgtacatacatgtgaacgcattatgttttcttttcggaacatataatacctattgaaacgggaacgtgcagatttttttcttgaagataagatttaatggtgaaaaaatttaattgtttaaaatattgggtctaccggtctaaatgaaagtgccacgtagcgatgtaggagcttttacaggagtgccaccggacataaattaagtacaatgagatagataatcgtacatatgatgcctataatgtctatccacttaccataattatcaccgttttcactctatattagttagaaaccatagttaataaatagctaatttttatcggtttaagtcattggattatttatagtttatagttaaagaaatatgttattttgaattttattgtgactttttagtatcatttaaacaaatattaaaaaaatgaaaaaaatgatatatatttgaccggctgaaaaactacatatcaaatatcatatgtcgtattctattgtgcactaaattaattatagccaaagtaagtcatgaatgtaaaatcacaacaaaataaatgataattacgtattttcttttagtcaaacgaatgataaaagatactatcaaatataaaaaggtcaatagtgtaaagaccggaggtaatataaatatattatgagggaaataaaaaaaagagggtgaatgaggagaaaagaaatgaggagtccggtacctacggtacctgtgtacgtacgtgtgaggttcacgtacacgagagagagagaggagagggagagattaaattctgtttttaatctaattaaatctaatggtctaaaataatggacccaccaatttaaatgaaaatcgatggctcgatattcctaatctattagaacgccacgtggcgatttaggagcgtttataggaatgccacatggcggtatgagagcgtttgtagtatgtttaatggacttttagtatataatagacttgtggaactatgagagaattattggtgtggatgccaaaaacacaaaatgtcacaataaaactttggtatcaaggtgttcttcttgctactactaattgagcaaagcaaaatttcaattttattcttagccacaaaatattatggttttcttagtccacacatgctgtctgtgaagcaccaagtatggaaccagcacccgattacttcaatatcctttaccccaactttgccgcctgtatttcttattcaaagttattatttccagactacaaaaaaggcccattttgtttgttataaaccacgctcaagttaagtttagcattaatcctcagcttattttgaatggattcaaattttcctaattacatttgatatacctctagagggtatcagaatccatacgcacattaccaataaggtaaggagacattacaaattgtaaaatacagaacgaaatgtttggcatcaatagcattatttcctctctttttttttttgcctgaagaagatacacttactcattaagaaatgtatggaggccattgcttatatcaacaaaataatgtggtaacttcttagattagcatgttatttgtacacaaactggttgtgtcaaggttttctgcagccaaatgagggttgatgatgtcagattgtcagatgcagcccattatggtaccatgaaagttacaatatgggattccatggggcagcagctacatacaacttgctagctcatcaacagatggccaacaaatgagaactctctgcctgttttcatttacttcgcacgttaacttactactccctccgtttcatattataagtcgttttgacttttttctagtcaattttttttctagtttgacttagtttatataaacatatagcaacatttttaaaacaaaacaagcatactgtcaaaatatattctatattgcatttactaaaactaatttggtgttgtagatgttgcttttttttttacaaatttaatcaaacctaaagaaatttgattaggaaaaaagtcgaagcgacttataatatgaaacggagggagaattaaattgtgactactactaatttcatatttattctgtttagatgaatggaagtcaccgttggatttgtgatgcaatgcactttagtactattggtaaaagaacaacatatggtttacatagcaaaaacaagtgtcaagtatttggaaacggaggtcaagtatttggaaacggagggagtgtttggttaggttggtcatatacagaaatacaactgattgactggtggttaagcaatgaataaataactcattcaagactgcccatggttttctttctttggaaggctattctagggctactcccataatctgtactcctttgactaggattgttttatttttgaagtcacctttgcttcaataaatctccttttgtttatcttgttagccacatttttagttttgtacttctatgttagcttctggcttttatcgttcaagctacttgaaagatgttctccattctgcttgataacaatgtcctgtgctcatccatggttagcgatgctatctctggtccatgacaaataaaccttttaggtcaatgagcaaacaggtgtaaatattgatatataagcacatatcggttagaaaatctactcatcacagtaatagaattaggatagtacttgatatcgaacaacttgcttgtatgtcatgcacactgcatattggcgttcatgtatgaagaaatcaaggagtggccactcatgcatgctagtgggtatgtggaataccagatcagctcagcattaaaattctttgtgaagtcttatgcaacataaaacaaattcttgctagttgtattcaagcaaacttacaaatatcaagacctcaaggttgatttttagcagaatttagctatgtaccagaacaaattttatctatcatggtatattcatttctgaaagaagatgcaatccttgttagttcctaacctgctgtgatactgcctccagagatgatattgtcttcaaagatcctatcaataatttcacgggtattgataactacaaaaggatattctgggctctacggtttactgggcaaattttcttcaaagcactatggatcgacattatcagcatatggcagcctgtcgaggatgtaatcatgatccgctggattgtccatggcattcctagagttctctcggatggccctggcagatttgaaggcacctcagagtataagtttgacaagaatgggaagatctatgagcataaggttgataatgttgccaagaacacaccaacgaaatttaaggtcttgccagtcgtagagctcatcagatcacttggatgcccatctactccaaaaccaacatattttgagacgtcgtccctacagctaatatcgctcttgccattctggttcaaattgacttggatgagatgctacttgtcattgtaccttatcctagcaaatttatcaaaaggatgaggatcgatggttgaggtccaacccaatgcctctaaattttgcccttccattgtatggtagtgtatacctttgagcagctcgccaatacctacatgtaaacgattttgtttgtgtacagctcaaagtttctgtctaggaatgtaggcatagctgaagttattccaagatcttggctgagttttgtaagctgtatattgccccctacctgggtatgtaatcaacagacgaggcaagtaaggaaatcttacatgcttgcacgttgcctgatactgaactttttgctatcgaattgcaaaaggttttataccaaaccaattaagtgcttgggctgtgttcctgtgaatgatctgaagatattttgggtattatgatcaatgagcagtgaagttcagttacagatctaagatgtcactgtcctttttttggtctcaaggaaggggtcaaggaaagcctgcctttccatcactgtctgtcactggcggagagtatagaaagtcgtcagcggttgcattatccataactatgatcttgtctaatgtctatgtcagccaggaagactggtttgtaatttgttacttatctcttgaagctttgcatgcaaaactgggttgtacttgaaacttctgatattacaactgaaccttgcaatctttattagtagcagatatggatctgaatcatacaaactagcatcaaatcaattagcacatgatgaagctgactatgaactcaactgaacacctctttcaaaacatgtgccatactgccattccacatgtagtacctttccaattcttgtttttcataatttggaagctactaaccccgataaccctgcctccaaaatccatactgctattagtgatgtagtaccttccatttcttgtttttcctaatgttttctcatgtaataattcgtgatatttgggttaatttgagacaggcttttggttggtgtgtctatgtccataaaataaatcattaatcataagcttttctaagaagaattggcagacctgaattacaagatcagtagaacttgatcagcatgatctcttacaaccttatacttaagagtgaaaagaaacaaacaaatgaacatgatgaacatatatcatatatatggatcatagctcacagcaacacaaccaaactagacaagacaagtacgtagtaaagtatgctttgcaaagccctgtttgaaacgcgagaatttcagagagatttcaccgagaatagtttgaattccgacgcgatccaaacaaaaattcttgcgtccaaatacaggagcctagcctagttgtactcgatcagaagcaggggaatcccccgctgatgaccgccgccgacatgccggactccctgcagaggcagtccagcttccaccctggcagctcgccgccgccgccggagcccggcctcttctcgctcgacgcggcggtggacaacggcaagccaccggacgatggcgtcctgcccgcctcgcaggaggccgcagcgccgccgctcgccgacgccgggacgacggcgtcgtgggtgggctgagatgatgatctctccggcttgctgctcttgttggcctccatggatggctaatggctttcgcctccttcttcctcggttttcttggtttggttggtttgcttgcgaattgcgagatcgcgtgcttcgctagcgagcgactgtgtgcttggttggtgcgatggaggagagggtggtgctattacaagggtgtagactgtagagaggataaggatgtgcatgaataccatcaacgagatacacggtttcgccgccacgtcaataataaatggtagtaggttggagaaagaaactagtattgtactccctccctccgtttcacaatgtaagtcattctattctaatattttccatattcatattgatgctatatacattcattaacatcattacgttgtgaaacagaggaagtagtagtaacatggtgaagatcaaagttagaatatactagaaaacaagaaaaccattagcataatatataataattaattgagtttaaattattacataatttgaaaattaaattatctgatattttatataaaaagttttcgtacgaaatacaccatttaatattttaaaatgtgtgctaatgaaaaccaaggtgaaattttatatctttataaaaaggaacatggttataagtgaaaattttcttcttcacgttataattaatttctttgaaaggcgagacttgtttttaaaataaaaaaaaaactagatatcaggtggtgggagggcctatacgagattctgttttttcctctagtgccttcgctttttttccatatgcacatatttcaccgttactattttcgttgaagctcaattcatctcatctaagttcaaagttgcatcctatgaaaactatccaaatttgaatatcacattcaaaatgttacatttcctacgtaaagctgtgggtggggtacaaagttttatggtttctaaatgaaaattttccactctatagttttttttttgagaactccactctatagtttgatatgtattctctaatcaaaatggttctcgtatttactagaaattttcaatcagttttctacttttcttttttattttacaaacctctctcaagtagttatcaagtgagtttagcaaagaaaccgtcagtactgagatacaaactattctattcgtcttaaaataatatagctaccatatagttatattatggagtatatattagctaccagatagttatatatattttagaatggagtaagtacgatacacgatgtatatagagtacacgtggtcttctacgatggtctgactcaaaccattggcgccgagggagagctcgtgcgtgcttgcgaattggacttggccgcccatcgctgtagtgtgggaggagaagctaattcttataaaaaaaaatcacacctatttagtatcaattagagtgacgttgaatgctgcaagaaatgcactccagttgaatggggtaaggtgatgatgtgctgctgatgtgcagatggcttgtctttgtatcgacagaagggtctggacatagaggatcaagtcaattatgtcagctcttactagattaataaagagacgatgttgatatatacttggcagatggactgtactcagtgtgacaatctgctcatgttgtgtgcagtctgaagggagaagcagatagagaatagcagccacaaaagatattggtttacagttagtaaaataattttcgacctcctaacgaggggaaaaccatttgcttgcctaagaggaaccaatcctttgtatcaaagctcttcatgaggattcagtactgtttacagatagtgccccaaatacaaatgctgctaacttgtcgactgaatgaatgacacaatttattgtcaaaacaaccaagacaacacaagggggagagtcatttgtacttttaccccatgcaggtggtgcacataaaaactttaggaacacaagttacacagcactgctcttgcagttaaagaaatattaaaattcaaattaacatctagttactttttgttgacatatacgccgcaaaagtatagccaggacagtttgcccaggtaccctctttctgctatagcctacaaattctatagaagcatctaaaaaacgtgtaaaaagaataaatcagatcatggtcctcaagatgttcaataaaacactagtcatcaacattgtatttcagaccttctggtcaagctcagactgtgatgacagtatattgtgtttctgtgttttctcgctgggtgctgagtaaacctggcgctctttgcctcctggtttcgatgaagcattcccataccaaatcatgccaataacagcaaggatcatgccaatcgcaacatggaagttaaggccctcttttccaaagaaaagaaagcccaaggtcaacacaagaaccgtcttcatgtggcctagaacttggaacgagactgctgtaaatcttccgatgcatatgaattggctaaggttggtcccaacagcaattatgcacgacagtatgatgaagaactacaatgcaggtagatgaaaaaaagaaaatgttaggccctgccacgataaaaatagtaatggtcatggcaacaacagattataaaaaatatatcctccaaatctgtcacatgctcctttctattttattcatagttgaaagaaatgcttgtctaagaagcatctatagtatgcacatacaatatttttaatggcctaaccttataaagcaataaagcattaccagtaaggcgttttttagttcatacacttctctactattagacacagcttccgtatttcaatgacacatctttttagtcagaggaatttacatggttgtttcataaatttataattggttgatgtgtgatattgggtatgtaaaagctatccatgtgcaattctgtgtttatgcatgattacaccttttgaatatgacatatttacaagaattttgacacaataagcatgcacaaaggagatagaaagagacattgccagtacagaacaatgcaacaagtacttcagaaaacacatttcttaaaagaacatgttaaaggtagcggtaaccttataccaaacattatttatcatagtcctcattgctttcaagcctacttgaaattcttgaaccaaaccaagggcctcatcgtttgccctatggcttataagccaaagccaaaatttgaattttaaaacttgattttgaatttgactttgattcttttttaacgtagtttttttttcaactttggcttttcaatcactaagaacatatatacaaaagttttactcacatatcattttttaatcgctaataagccgttatggcttataataaggccctattcttttcttgttgtcttttctccaacaagagttggatgaagattaagattttcgtggcacgcttttcaaactgctaaacggtgtgtttcgtgcgaaaactttttatatgaaagttgctctaaaatatcatattaatatatttttcaagtttataataattaaaactcaatcaatcatacgttaatgacacctcgttttgcgtaaaaaacttaatcttcatcttcatcttcatttttaggacaaaagaacaccacctaagactagaccgaccgatgggaacccaagcagaaaaatgtttcagttccaggatatactaccatatttcatggtaattaatatttacctggtgaaattatcagtagagctatatgggtttctaatgatcagtttataacaagataaacagagaatcaccgcataccgtaactattgctgtgtaattgaaagtatcaactcttttgttggtcagccagaagtccacgaaaggccccagtactagtaaagatgctgcctgagctggagcagtatgacccaagaggttgaatgagccaagcgagtacttcctttgaaggtgatgaacatactgcagcacagaagcaaagaaacaaaacaagtaatagtgttaagaaaatttgccatgaaagtgcgtagaaaagggacaagacttctattagcagacaaacgagcaatatccaaatatttgaagatcttttactaactaaacatttcttttctacacgattaatcagaacagtagttagatggaagctaatacattctttagctcaccaaacctacaacaaaggggacaaaattcaggtttataggatgaggcaaaatacacatgagttcacattaatggcttggaaattctgtagaagggaacaccacatactattttttttcaggtttgaatattaccaacttgggagcaaaagtatcaaagtagagacttagttaatacaggagaattctcagtatgtaggaatggggacaacaaaggcacaatctaggagtggcaatactcacatgctgttgtagtgcagtgctccaaaccgctattatggcagctatgagcccttgtgaattcacactaacatcagtcacagtacacacggcaacacctactagaacaaccattatactgaactttgtatctcttgagtatcggactttatcaaacaggatttccagaaagcacaaaactggaatgatgcataacttggcaatctgaaaaaagcatgaggagcaaattagtatatgcatccaattctaaaagtgaacattaaaggacttagttactttcttcacctggtagaatccaacagagttccacatcaaactaacattcatcccaacaattgataggtttgcaaaaaagacaaattttattagttctggcactggtaagtaggacggttgaatatatcccagccatttcattactaatgtcatcaaagtcgtggttgcaaaatgcagtccagtcaatgttgtagctgtacaagcaatagcacccccatattagtacaagcatgtgttcagtagctgagtttgttacagattcatctttccaagtgatcacacatatgagtaaataataaagcattatcaatttatcgtaccaaaactaaaaccatgtgtagccattaaggccttgttgaccatgatgataccaacagatgtcacaatgttgaacatccaagctccagcatctaatgctgcttttctctctgccttgcttccaggtgccatgttctcttgtcatgtagaatctaatccaatttggattttggagtatcacaatctacattagaaacatattttaattaagacatgagtttaataatataagcatatataaatgcacatagaaaaaacaagtgaaatcaatacgagtcactagtcactaaccctaaaatatattgagaaaactatttttctaccatagcagggacatgaaattagggaaatattgccacaaaagaagatctttatcaactatcatcctataaagatcagatcaaaattatgaaaataacaccaccgtttagttcatgtgttctctgtggctctgttagtgctgagaaatttacattacaagttcactgttttcagtaatgaatgggcgagggagagagagagagagagagattcagatttggagaagaggaaagagagaggtggctatcaggtgggaccaaccatcaagtgaatgtaacaactaacagaatgatattttgttaatctaacgccttttgcaacgtcacattccaacttgtggattttgcaattgtgttactataatttcatgttctgcggttcttaatttctcaaatactgtaatagtactgtttgattttttctggatctgaaatttcggaccttctgaaattcaaaggcatgcaataactaatgaatttgagcacaggtaaaagattcacattaatgctctttttttgttctgttgcaatctaagcattaatgctcataatggagaacctcaaaacaagagaatgctcaacaaaaacagtataatgcctttcctgaataccctgtaatttgtttggcataacaaatggtcatgcaatagacaaataatctaccagagtcatagacctatcttaaggcaagaagtgtggaatcatatttgcactaactaggtttcaggataattatgtggaatactctacatttcagtaatttttattgagcatcctctcattatgttcttccctattttcaacattaaactgtagactgttaatagaagggcatatagcacagtaattatactagaagtgctggactaacatgatacacggaagcctgcgtctgtcaagaacaggccaaatatcttgtgggggaagagggaacattagtaggaacagagaaaacaaccctcaagctgaggagggctcatccctgcatgttgtcgggcggctctgatcggccgatcagctaatgctagagtgtggctgaaaagccctttgtgatacttctcattaattaatttatctcctataaacactagcaacctttataacaaaacaaaaacaacaaggtgccgactcatgaactaggagatatacgataattagtaaaacggagatagctaattagcaatgcaatcaaattaaactggtaaattgagaagagataagaaacaaaacaaatctttcatctggctgtagacctacgcctctgagacttgcacccaaaccgacagtgcacattccataaacaagcacatcattatactcctcttgaaaggaggagctgtggttgatctacactacacccatcccctcacttgagaagaaatttcgtgtctagatctatgcaggtgcggatctaacgtgggagggctcaaatttccgtggaaacaaactgccagtaacacacatcaacactgcggccacacaggcaacaagaagccgcaaatcgggacgaactggaagaattaattacttaaaaattggagcgcaatgaatcgattcgatccaaccaccccgaatgtatttcccaatctacctacagacgccagcacacagcacgtgaaggcgcgcgcaaaggatgagggagggaggatacgagatgagaatggatacctccgactccaaattcggctcgagcgagcgagcgcgaggccggagaaggctagggaaggcgaggaggaggaggagccgcgactcctccgaacctgctcgccggccgcgcggcggcgcgggggagaaggctcgccgtagctccgccggaaggagggagagagagagagagagagagagagagagagtagaggtgaagtttgagggtctctgcagcgttggattggatcgatagatagaagggatcgaattgggtttcctgttttgctagtgtgacagcaattgcaggatcaagaacacaaggccaagattgctcatggtgacgagagtgaaatggaatgggtcatgtatatgtttttttttaagggaatgtctatatttgttcgcagaaaatctcaccaaccatgtttcaaattttgaaccgttggatatgctttaagattcgtgcggagccc

SEQ ID NO: 42471 - DNA, 5184 bp, Oryza sativa
cgccgcgcgttgccgtcgccccgagccccacgccgccgcgccgtcccgtcgtcgtttaaagccggccacccctccccgcgcctatataagcccctccccggctgcccattgctccccacactacccccaccacctcccctcccttttccctctctttcccatccccggcgttgccgcctcgttggaagccgccgccgccgccgctgagccaatgtgccccgccgccgcgatgtgcctcgtcgccgcgccgtgctccgccgtcgacctcgccgccgcgtctccgtcgaccccgccgccgaaccggtgagcctccccctcccccaccacttgccatcgcgccgtgccgcccgccggttctagccgaggccgtgagagagaggagaaaacagaggagagagagaaaagagaatggaggagagaggttagagtgggccccacctgtcattaattccatccaatttcccttagaaaaataattctgtagaaaagaaaatcaagaccttgaccccacctgtcagtcactatagcttgtggataaggttgtattataaataaatgaattaggaacagtaccatttcacaattattagaattaattcaaatttgaatctttacactagcataacttattcatttcagctccgatttgagtgaaacttgaacctaaattcatctaaattcataagctttccaatgatatataattcactatttgataaaatatatttataaatattaaataattaatatcaagatgatgcataatagtcaacttaaaaatatgctaataaataaaattagtattgtacagtagagtggatgtaataagttttgtctctaacatgtcttgccactgtaacaaccacacaaactaattttatgtgatgtctcaaatgaatggatgtataggaaaatactagtacttatttaatattcgatggccatataattaaatccatggcttataggttatttaaatcaagtatagccttatgattatgtaactaaaatataaacacacatagatgaatctttaacttgtttaggagagtaatcacagagctagttgtatttggaccacttaaaaaaaattagttgatacaatgtcatgtgaagtagaatatatatatatagagtcagttgatatccattagttaaccaaatagagccatcttaaaatcaacatgtattgtatagcttacagtaaaagaaactactcaaatatatgatccaataataagatattgttgcttacacatatactatacatcccattatagtggtacggtataatattaatttgcgtgttgcatatatgaaattaagagggagtgtatgacaaacatgtatatcagataaatactagttataaatcttgacctcatataattataattatagttcaactgtaaattaggattattcattgtaaaattatgtgatgggataatctgtaaccataatatgattaacctaaacaactctaacatacaaagcatggataattattaaccttttataatttattgtgacaagtaaaatatgttcataattaaagtaaagcttccatcaataaaataaataatacaaatgattcactgtaattatttgattgatcctaaatccacccgacaacagaacctctagtatacgaccattttatttagatagatgcatgtgtagccataatccttccatagccattagctagactaaaccacaaattagccagatacgtatctcattcatactacattggctagctcctaaatagaccaccatgataacagaaagattaagaaactttagcccttagcatgttggaacccattagcaagcgcgaataatatgagcaaccttaggttcaacctcaacaaatatattttgtttgtgcatatttgattgttgtttgaatattggtttttctcgcgtattatagactttgtgtatcggttagtcgtgaggcaacgtcagcaatttccaggaggtgaaggttgatcaagaattatatcaagaataaggactatcctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgcctggggcggacggaggatttgggtggtatctggaaaaggctagtaccgtccccggtcaattaaggaccgagccatgaagttaagcatgaaacgacccccgtacaaccgcacttctcatatgggtatagacctagcggattagatagccgagcggaggcagtatccctgcatagatggttcacccctgagtgaggcaggtgcgctacggtggaacagccgttgaggtagggccgagaggcgtgccctacatcggtgtcgccattggtaggactgccatgagtgtgtgagagagagaacttaacttgaaccataatttaatatatgtgtgagacttctctttcccgggagcgccagaactcctctcactgctagaaacatggacgcctagagtgcatgaggatttaagtttatggagcgggtactgccaatgcgaggtcatcgaaaagctttgccgtgacgcatctcatgtgttgggacgaggctcatgtgttgggcagtcacggagtgcgggtaaagtgtgcatccactgcagtgtgagtaaaccaaatctattcgaatagccgtgctcgcggttattgagcaccgggacatgtattacacttggctagactcaaagttcttaacttgtgtgggatgggatattgcatgatgattttatgctgttggagccacttcctgagaggcgggaaggtggacgtcctcagaaaaccatgacgattcaatggcgggaagctatccttgggatcataatggatggtggatagaaccgtcgttgtttaatgtgaaaactggtattaaaatttgatcagtctatgctaggtcttaggcttgtgaaaagaattacaaaactagctttatgcaaaagaacctgaagccattccttgaaaaaccctctatcatatgcattgttgttgtggtggcttgctgggtacggttggtactcacccttgctatttatatatcttttaggagagtgttgaagagaagcccttgtcggtacgcttgcgtatctcacaagatgatcggagtgcggtcttgttctaggtctcgttccccagtcgactacctgtggcatgttaaccgggcccttatattattttgtcttccgctgttgttctctgatagttgttggcctacctggccctaatgtaagtatttaattcttttagcctgaattcattcgtgatatgttgtgatccaactatgtatgtgtataccaactactgatccagggattggtacggataaacacagaagattttcgatttccaaaatcggggtctacatttcatttagggacaattgcttatttgaccccgttttgaagcttaactaccaatttgactctactttttagagtttacttatttgaccatccttttcgaaaatgaagctcccgtctgaccctgttaagttttgatttaaaataaaaaagaaatataactaatattcgtaatacccagaatacccataggaaaccctatccatccaccgaaccctatccacacatttctctctctcgttcttgtgtgagttgcggcggcggcactgagggggcggcggcggcgtgaagcagaaccccgcgccgacgtctgctcgtggagggtggcagtggtgctctccgtgcgtggtggcggtgctctgcatgcgtggtggtggtgggacggggggatccgcgccggcacgtggtcatcacagtggatccctagctggtgcggcagcggctccccagctggtgcggtggttgatccccagctcttgcgcgccgtggtgggaagacgcgcgccgtcgggggtggcggtggtagagggttcgacaccctctcttgttcacatctcggtagtggcaacacagggaaggaggaggcgatggcagcggtggcaccgacgccgacgcggagagcgagcaggagacaacgtcggcgcggggaggaggcacggcgacagcgccggtgcgtggagagaggcggcggcaggggcgccggagcacgcagagaggagcggtggggagcggcacgaggagggaggccggagcgtccggcgtgtgaagggaggagggggcggtggtgcgccgctgctggtgcgcgggcgcgcggagggaggcagcgggcaaccgacgcgcggtggcagttgctatttgatattttctctgttggatttgaccataatttatgtttttgcttcattgtatgtaatttgggattcacaaaattaagacaatattctgtcaattttttaaaaaatttctgccaaattttatttgccttattttgtgaaaaaccgtcgaatgaaagataaatttgttaaaccgatccaaaattttcaaattaaaatattgaagctaaatttttcaaacttgtctcaaatgtaaaagataaatcaaattcgttataaatttgttataaagcaagggcaaaatggactatttaccccttagttaacaccgttaactcgctttaatggagtagggtcagtgttcatcttcgattttaaaaaatagggtcaaataatcaaaccgaaaaaatgggattaaattggtagttacacttcgaaatacgtcaaatgagcaattgcccggttatgttgagcaatattgtagtacgggggagaatgggagatcacacaagatcgcggtatggtcggtgtgtgaggaatggtatgtaccgtcgtggtgatgcacgcttatattgaactggttgttgggttactgttcctgtaaatagagaaagacaagagggaaacatctaaaaatcgataatcctccgcctcgggcgaccgggggggggggggg

SEQ ID NO: 42472 - DNA, 3836 bp, Oryza sativa
cgacgcgcacatacccccgggccccaccatgtgttctgccccacctgtcatgtatctcaaaaaaaaatatttcacccagtgtactcacaatgtttcactatatatagatataatattacagtgaattgaaacattcttttgcaacaaatcacccacatattatgaaaaacctctattaaggaaattcatttcattttttgttccctaaaaaatatttcacctagtgtactcataatgtttcactgtttcatctagtgtactcacaatgtttcactatgtatatatctaatgttgcagtgaattgcaacattcctttgcaacaaatcacccacatattttggaaaccctctattaagggaattcgtttcatttttttttgcataaaaaatgtttcacttagtgtacttataacgttttactatgtatggatcaaatattacagtgaattgaaacattctttcgctatttactgaaccattatttttatataaggtgaaacaacgcccaatttaaactatttaaacattttcgatctacttaatgaaacaattccaatatacttggtggaacatcgttgcaacatttaaaataattcaataataagctaatttttttgtcagaatatatccatgtgtggtattgttttaaagatttaattgcaacgatgatttagataaataatttaagagaaaaatagtttaaagtagttttgcacgcatgtatcatactgacgtcagcatgacgtcggcgtccgatttttctccctcccatcggcgcccgattctgagttgcttcctctaaaaatctactccgtatgtgcttaatcaaacaagacaatcaccaacttctcttgtttttttggtagtttgctcactttctcggacaatggaataaattaagatgatttgtgctcttggtttggcggtcatctcatatcgctgccacataacggtgagtcaattttccgcaaatccttgttaccaattaatccttttttcaatccccacactgctaatgtttcaaacaaaaaatcctcacactgataaaaaaacacaataattataagagaggtgaatttcctaggtgtaataacatatttgaaattttactttcccggttatgtagagatcaaacacacccatcacccatttattgactggtattaggaatattcatgtgctaacgctacggcgacaagtggtatcgtgaactaaacagccgaaagaaaatatttaagagaatcactaacaattctcctatattcttctcaaaactaattttaagggtttttaaggtagaaaatcggatccaacatatcccttatagtcctctaacatgttttggagtttccttccctgtatttctcgctcctttgatttgaaccctacagtcgtcaacatgttttggagttccatttccagtatttctcgcccctttgatttgagggagagggagtgctcccctccgactcccaaccgtgactctcccgcgccaggagagcacgcaatctaatctgcgtatatggagaaaaaaaatggagaattgggcccacttttagtttttgataaaatttagactctctctcggagagatcaattttttttacttgctattttcactttaggaagcccaacaataaatttttgggggaagtcaacaataaatttttgggcaagattatacgtaatctttttgtgatgctataagactatgtatgtttgaaaaaaaagcggtacagacataatactcagcacacaaaacacaacttacgtatattgggaattgttttatgatggagaagtgaagggggtccgaaacgtaggaaactttattagatgcttataaagtgaaccagtacagtgctaaagaaaaaaaatgaaagatctagaaacatttttgccccttttttaacccacgtacatctgaggtggattgcttgcatttacctctactaactaatgtatttcatgcatttatagcaagtttaatagtataatcacctactatctttaatagaataagaaatttcataggcggttctgactgttaagaataaaaagttttgttgccgccgagtaaagtatattcttgtcggtccaaagcaacaaggtttatttttcttggcgctttcgaaagttgacaatcttcttaaaaggcggaccgctaagaagacattttcttatggttagccgccaagaaatcgtaatatccctgcctttttagacttggcggttggaccgccaagaaaattgcactcttgtagtgatctatagctaatctaatggcctattcttgcctgggaatatatcctatgcacacaagcctctcgtgcatactcaatgcacaccaactaacaaatgtcataaaaaattctacaaaaagttggacattccctcctaatagtattacatatatctgtaaagtaccgtattcaaattcattatattttagctgtaacaaaaaagtaaaaaaatatgacagttttaagggtaaaaatctgtcagaattttatctttttttgttacagctaaaatataatgaatttgaaaataagatttcacacgaacgtgtaatactattaggagggaatgtccaatttttttgtagaattttctgtgatatttgctagttggtgtgcacgggaagctttgtgtgcataggatatgtttccttcttacctataaattcatgtatattacaccattaatatctagtctcacctctcgtatacacagcgtcttggaatctgtgctacaattagctataaatttatagcacacttctcttctgttatgattctcacacaagcaaccgaaaactggaagacacatttttattttgtgttgaaaccactttgctctcctctagtatgcttaaacctcactttataaaactgaatggatttgtttagtcattaagagcaacctttcatacacatttttctttgccaagacgcctctatacaaagaaagtatgagtataccgccctgtgcaaaccaaactttctttggtctggagtggatcaccatgtcgttggtaagcactgctagaaaaatacgaaaaataaggcctaaatggtagataggaacatggcaaaaataaatgccaaaatttagttgtttccatgtccaccgttgcttgtctggagaaaatcctacagttcatgtctgttgggcaatggcgaagaagctgaaggcaccgacgatggctttggcaggagcaatcacggtgcatgacctcacagcttgtctagctcggtgggagtatcacgccatcgacctgtagtgtccactctgttattttcgtgtctctatataaaacaagtatgagtatgcctatcgctgcaaaccacgcgttctttgggctggagttgatgaccataccgtttcgaaccgctcctagaaaactaataaaaaatgcctaaaaggtagacaagaagatgggaaaaataaatgccaaaatttagccatcaccacatccaccgttgtttgcctggagaaaatcctacgattcatgtctgctgggcaatggcgaagaagaagatgaatgcaccgacgatggctatcgcaggatcaatcacggtgcacgaccttgccactgcaaagtggcttgtcctactcagcgggagcagcacgccatcgaccggtagtgtccactccgtcgtttccgcatctctatataaagcaagtatgagtatatctaccggtgcaaaccaagtgtcctttgggttggagctgatgaccatgccatttctaagcactcctagaaagctaaaaaataatgggcctaaaaggtagataagaagatgggaaaactaagtgccagcattccgtcat

SEQ ID NO: 42473 - DNA, 37099 bp, Oryza sativa
agaaggaggggcacaggggcgctacagcatgttgccaagcacttcattgccagttcaaagcccctgcaccacctaggagcctggaccacgccgctgagcacctcatcactagcacaagctgtagtttgcgaggagtagtgccgctgggaccaccacctaatcaccaacaagatacatgcacaaggtcagtctttatttcatgtgtgcttttccataatgtgcggcttgtttaataatttttgccatgatttcagagaaagaccaaatcttacctgaaatatagcctagagtgatggtgtcattctctaggcatgtacggaacattatgttagatagggcttctacaactgaacaatggaaagtaatctttgcttcactcgtttcttttctctcctatttttcctttccccatcatactctttctcctaattttctattttatgttcaaatgaaaagttgaaaacaataattttaagatagaatttgggtgttatagcgtaattacctctctatatatatagaatggggaaattatagtataacacataagacttctccaattcagtctaatctagcagctcgatctgtcattatctcctcaagaactagagagaatatcaacttcaattccgtccaaaaccttgggaattccacaataattggcataaattcagatacttttcactctgtattatgctctagataattgttgtgtatgaatgtttggaagtgtgtaggactgcaaactgtaatcctactgtgtatgtatgttgatctgaaagtgtacatgtatggtactgcaaaatgatgctctgcatcacaaaaataaatgtgtgttccacctggcatgtgtttgtgtttgtattaggtaagtgcttatgtgtttatagtaagcaactgcttatctttagcaccgtttaatttgggattaactcaggaaccttcatccacatgatgcaccactcagcaatcctaacaaatcttcatcccttgccaactgggaaagtagctagaaggtatcatgacaccctcacttcttacatttactatttggacaataattgaggttgagtaggagagaccaaataatggtgctcagcaccaaaaaataagtgtcttccacttcccgggtgtttgtgtgtatatcataagtaagaacctatgtttgtgaatattacgtaagagtttcaaaattaaagaattgccttccgttgtacttgatgcgcaacaaaaccaaactaggagtacatatgctatgatcattgagaagagagcgctcaatcatatccaaattgtgtagtgaacttgatgaaaattgttacacctccatcaaaaagtctaccagtagtagagtttgcaaaatgtggcatcctttgcttgttagatcaaatacgatctcatctagagtagtaactgtaagcttatcatgacgccctcgctgcttatgtctaccattgggacaatggttgaggttgtataggagagaacaaaatggtcctcaacaccaaacaaaaaaatgtgtcttccatttttgggtgcttgtgtgcttatcataagtgtctatctttgcgaatgttaggtaagtgtctcaaaatgaagaattgtccttccattgatccttgatgcatgacaatatgtagtggagagaatatgacgatcatcttgtccaatccccgatccatatggaaccttctagaaatttccattatgctgtttccattctattgaaggcaacaataatttttgatcttggttacatgctcaaaattagactactgaagcatagttcttgcccaaatcagaaaaatacaatcccaatttcttatatcaacaaacaaaaatagcagtcgcacgtacctcgtaagtactaattctgcacatcggcacactgcacaaaatcataagctagctagctagccatatgtatccatggagctatttagatctagactaatttttatatatgggatgaaatctcgcatctgatgtcctcttacactcacacagataaaccgatatagagaattaatcataaacccatcagaaccatcaaacaattaacaatcgaaaattaaacatgcatacgagcaaagctagatatcttgaagtattattattgcagaaaaatattgctgcaataatgactagatcatggacataaggtagtagaacctcatccttcacttgagtcccgagcacctcctgctcatcatattatacctcctcatcacggagatacttggtggaaatggacacagcttgcaccatggccggcagggcattcacttatcaattttatttatagcattactgccagtttgtaataaaaactagcagtgatattgctgccggttttatttgtgagtggataaaaggatttgtcgagtcggtgtggatgtgtgattaagtattgatccctcaggctcttcctctagcatgtttctccctttcactgtcagccttccaccattgtcgtgtgttagatgtgtattagataggttgtatttattgttttatgtcttttggctttccatgttcctgtcttttggttttccctgtatctgtatatatatttgggctattgccctctgatgtatacaagtcgtattcataacatggtatcagagcatggtttagacttctcatcttcttagatttttctctctcggcttctccatgatttgatttgaggattatcggcctcttcatcttgaagccatgatgttcctcttgatctagtatggtgtcgctgagaatcatccatctctgctccccaacatcatcaatttcttcagaacagtgtagagggttggtggttgtcctcatcaccggctatcgtcgcttctcatcgccggccgccgtcgctcgtcgcgggcccccggccgccgtcgcccctcgtcgccggcctctggtggcgggactccggccgccgtcgcccctcgtcgcgggcctccagccgccgcccctcgtcaccggcctccggtcgtcgccgctcgtcgcggccgccgtcgcccctcgtcgcgggcgcctccgcctgggttgtagggcgccgtcgcttggcgtctgtttccccgatccggatctggatcgggaggtttaaaaaaaagaaaaagaaaaaaaagaaagaaagaaagaaaaaggcttctctggctctgctactgttgtgctctgatcgcacgtggtggctctatattttgggctgaggcattagaaaaaaaaacttgctgccgcttgttctgtttgctctctcgccgtcgcttcttccttcttgatgatgtcgtctttatccggcactgtgtctgttcctcattgcccagttctttttgatggttgcaactacagccattgggctcagcacatgcgtcttcatatgcgtggtcagcgtctttgggatgttttatctagtgagctaccctgtcctccttgccctattgctccaactatgccttcacttgcaagtcaagctactgatgacgatagagaaaaggctaaagagcagtttgatgatgccatggaaaattatcagagtcagtttgctttatacaaggcttggttggatgaggatgctcgagcttctgctattcttgtagctagtatggagattcatcttactggtgaggtggttactcttacttcagcccatctcatgtggacacacctacatgatcgttatgctcctactagtgatgctctttatcttgctatggtgcgtcaggagcagtctttgcagcagggggatagtacggtagatgagttctatacacagttatcctctatttggcgtcagcttgattctttgggaccgactatttgtcatacctatccgtgttgtcagcgtcagcgttctcacatggatcttcgtcggatctacgattttctcacacgtctccgatccgagtatgagtccactcgtgcacagttactttctcggcatccgcgtgttactatcatggaagctcttacggagattcgttctgaggagattcgtcttcgagaggcgggtattctaccacttccttcttcagtgttagctgttcgtactgtggcttcttcggcttcttcgacaccggctgttcattctacagtttcttcctcttcttcatcggcgcgtcctcctaccacagttgtaccatctactaggggtcaccttcactgcacctattgtgataaagatggacatgtggagtcattttgcttcaggaagaagaaggatttacgtcgtggcaattcttcgaagggtactagtggttcttctcagaagagttctggaggttcagattcacaggaaattcttatgttacttcgtcgccttactgcttctgctgcgacaggttctgttggttctgtggctctaccttctgcacagtctggttctgctgttcttggttcttcatcttctactgagggatcatcttctgcttcaggtactattccatggattctagattctggtgcttccttccatatgactcatgatagatctagtctttcatctatatgttctcctttagttcctactactgttcatactgccgatggtactcctcttgctattgttggtcgtgggactctttctatttcttcctttagtgtccctgctgtttcttacgttcccaaattggccatgcaactcatgtcagccggccaacttacggatcatggctgtcgtgtaattcttgattctgactcttgttgtgtccaggatcatcgcacgggtctcctggttggtactggccctcgccgccgtgattctcagcgtctttgggagcttgactggcttcgtcttccttccgctgcgcctgctagtcttcttgcttccactgcttcctctacggtgtcttttgctcagtggcatcatcggttgggacatctttgtggttctcgtctgtcggctttagttcgccgtggtcttttagggtctgtgtcaggagctgtctctttaaatcaatgtcaaggttgtaagcttggaaagcaaatacaacttccctatcattctagtgagtctgtatctaagcgtccttttgatcttgttcattctgatgtgtggggcccagccccttttgtttccaaaggaggtcatcgctattatatcatatttatagatgacttttctcgtcatacttggatttacttcatgactcatcgctctgaagttttggctatttataaatcttttgctcgcatgattcgcactcactttgattctcccatccgcgtgtttcgtgctgattctgctggtgagtacctttctagagagttgcgtgtttttctttccgagcagggtactctttctcaattttcttgtccgggtgctcatgctcagaatggtgtagcggaacgtaaacatcgtcatcttcttgagactgctcgtgctcttatgattgcttcttctgttcctcctcatttttgggctgaggttgtttccactgctaattacttgatcaacatccaaccttcctctgctctacagggtgggattcctattgagcatctttgtggccagcctcctgattattctaatctgcgtcttttcggttgtgcttgctatgtgcttcttgcaccacgtgagcgtacaaagttgacggcttagtctgttgagtgtgtttttctgggtatagtgctgaacataagggttatcgttgttgggatcctgtaggacggcggatgcggatttcacgggatgttacttttgatgagtcccagctccacatcctctcccgatgactctcttctgtttctcacttttcctgatactcctgttcgtgctagcattccttctcctgtctcttcctctcagctggcaccttcttctgagaattctgcatcttcttatgtgcctcctcttacccaggtttatagtcgtaaacctcgtatccaggagccttctctggatgcttctccggttgctcctcctcgatacaattttcgtgatcgtaatttagttacgattcgtccagaggatcgctatggttatgttgctacagttcttgctgaaccttgttcttatcgtgatgctgttgtccatcaggaatggcaacatgcgatggcagaggagcttgctgcacttgagcgtactggtacttgggatcttgttcccttaccttctcatgctcgtcccatcacttgtaagtggatctataaggtcaagactcgctctgatggaactcttgaacgctataaggctcgccttgtggcgcgtggtttccaacaagaacatggtcgtgactatgatgaaacttttgctcctgtggctcacatgactactgttcgaacacttcttgcaatagcttctgctcgtcattgcaatatatcgcaacttgatgtcaagaatgcttttctcaatggggaattgcatgaagaggtttacatgcggccacctcaaggctatttagttccagagggtatggtttgtcgtcttcgacgctctctttatggcctcaagcaggctcctcgtgcttggtttcaacggttttcctctgttgtcctggatgctggtttctcagctagtgctcatgatcctgctctctttgttcacacttcaccccgcagtcgcacaattctacttctctatgtggatgatatgctaatcacaggtgacgatgcggagtttattacttttgttaaagcacgtctcagtgagcagtttcttatgactgatcttggtcctctttgttattttcttggcattgagatttcctctactcctgaaggatttcatttctctcaagccaagtatattcaggatcttctggatagggcctctctcactgatcaacgcacagttgaaactcccatggagcttaatcttcatctttctgccactgatggtgaaccgttagctgatcccactcgctatcgtcatattgtagggagtcttgtttatcttggtgtcactcgtcctgatatttcatactctgtgcacattctgagccaatttgtttctgcccccacacaaattcactatagtcatcttcttcgtgtcctccgttatcttcgtggaactatctcgcgttgtcttttctttccacgctccacatctttacaacttcagggtaattctgatgctacttgggccagtgattcctccgatcgtcgctctctttctgctttttgtgtttttcttggtggttccctcattgcttggaagactaagaaacaaacagcagtttctcgttctagtgcagaggctgagttaagagctatggcccttttgacagcagaggttacttggctacgatggttacttgaggattttagtgtttctgtgacttcaccgacttctttattgtcggacagtacaggtgctattagtattgctcgtgatcctatcaaacatgagcttactaagcatattggtgtggatgcctcgtatacccgcacacaggtacaggatcaggtggttgctctttagtacgtgccttccgagttgcagttagctaatttctttaccaaggcacaaactagagctcaacacaggttctatctctccaaactcagtgttgttgatccaccctgagtttgagggggggtgttagatgtgtattagataggttgtatttattgttttatgtcttttggctttccatgttcctgtcttttggttctccttgtatctatatatatatttgggctattgccctctgatgtatacaagtcgtattcataacatcgtgcacctccccttcccatcactgtctttggccctctcgttagcctattgttgcatctccttctccctagatcagttatcgttgcctctccctctcccctgatatgtcgccttcgcctctctctctctctctatctcttctcagattcgccaccatcaccctccctctctctctagatctgccactcctctccctttctcaatccctaatgactccatcaacctcggtgcttgtggttagggtcatcagatctggcggcagggccactagatctagatgttgtgccacctcttccattgccgacaggaaggaggccatgggcggaaaagggaggggagcatggtgacttggcaatggcgagaagagggagagtaggcgagacggaaaggggagggtggtgggtcggtgacaatgaggaagctagggaggagggagagcggactacgtgggggcctacaccatgctgccgcagctcaaggcccctgctccgcctaggggcctgcaccgtgctgcccagcacctcattgccagcacaagctgcaacttgcaaggagaactgctgctatggccaccacctcatcaccagcaaaaaaaatacgtgcacaaggtcagtttactatcatgtgctgctcgtttcataatttttactgtgattttggagaaagatgacttttcctgaaatataggttaaaatgatggtgccattgtgtaggaaaatatggaacattatattagatagggcttctccaagtaaagcatttaaagtaaattttcctttctcttatggttctttaccatcataccttttctcctatttctctattttggaccaaaatggtgcccacaaaaagaaaaacaaagtgtcttccacatcctacatgttcgtgagtttatcatcactaggtgtctacctttgcgaatgttaggtagtagtttcaaaattaatgaattgccctttcattgatccttggtatgcaacaagaccaagttaggagtacaaatgctaaaggtccttgagaagagagcggtcaatcatgtccaaatcatgtagtgagcttggtgaaatttcttgcacctccatcaaacaaagtatatcagtagaaaactttgcaaagctgggcatgcgatattcgatagatcaaataccatcatctagactaacaatagtttaggttgaaacaaaaaatgtgtcttccacttctcaggtgattgtgtgcatatcataagcatgtgtctacctttgcaaatgttaggtaagtctttcaaattaaagaatttcccatgcatcttttgttcctcgatacatgacaatatatcacaagcgactatgatgatcagtttgtccaatccctattccattttgaaccttctagagtcctctatattcctatctacattttattgaacgcaacaagaagttcttaccataatgatctcaattgcattcccaaaattagactattgaagcatagttctggctcataccagataaatacaatccaaaattcttccagcaacaaacaaaaatagcactcgcatgtgcctcataattactaattccgcatatcagcacaccgcacaaaatccaaaattttatatatggggactataatctcccttctaatcccctctcacactcacacagatcagctaatgtagagaattttagccataaatccatcagaaccatgaaacaattaaccatcagaaattaaacatgcatgcatgattatctacaagcaaacctagatatcccaaagtattattgttgcaaagaaaatattgctgttgatctggttcaagatcacaacatgatctcctagaggaatacaacactgcagacaatggtagctgacatatatgtgttatcctccctaaggattgctggttggcctccatacatctgtcacatacttacataccgggttgaaaattccggaatgaaaatttggaaatttccgaaacttcgggtctattggtgggtcccgatagacagtgagctccggtcaaaaatttcggcaaaacactgttcatggcaaaatccccaattttctggtaaaaatccccagtgtccgatcccctcctcactcacctttatccgccgtcctcccccaacagctcctcccatcattccagcacaagcgagcagcaccagcggcggttgctcgaaccagaggcagacgggtggctggagtggctggcggtggctccgcggctctccggtgtgacgacgacaacacaagccacacggcagcgcgggcctcgcatcctcatgctggagtgccagcgacggctccgcggcttcggctcgacggcgacacaagccgcagacctcgcatccttgtgtttggttggagtggccggcggcggcgcggctgtcgggcgccgccgcgacgacgacagaaggcacgcaagccgcagaggacgcgacgatacaatccttgcgtttcattctccgatcctgtccaaatttctgtaattttggattggatggactcaatgcatgtttatattctgatatatgtcaaatttcagtaatttttgttgttcaaattcaaattttgtttggaaattttgttcgaaatttccgaaatatttctgaaatcttgttatttcgctgacccccgaaaaatttccctttcccgatagattgaaccctgcttacataccatccgtatcgagaaagtagagaggaaaagttaagcccaacaaagaaaggagaagctgcaaaagagagacagagatagagggcagaggggaatgtaaattaagagagaatatttaatgttggatccatagttggataaaatggattgcaatatatactagtttctatttaaagtatccattttttatgtgccaagtatagacactcttaacagtgtctataattgggaatgctcttatgttgttagatgtttgtgtccttgtatatatcattatttggtcactagtagaaacttagaatacctagagtattatgctctgcactgcaaaaaaatatatatatgttccacctagcatgtgtttgtgtttatggtaagcatgtgcttatgtgtttatggtaagcaactgtgtgtatttgccacatttagttttatttttggattaactcggaaaccacaattcacaggattcaaccacccatcaatcgtgacatatcttcatcccttgtcaaccaggaaagtaaccaaaatgtatcatcctactctcacaggtcgctgcttatgtttaccactggggtggtgcttgaggtgaattagatagcaaagcagtgtccagcacaaagcaagggcccctttgaatcaaaggatttatgtaggaatttcataggattcaaatcctataggaaattttcctatttggccctttgattcaaaggattgaagctttccaaatcctatgaaattcctatggaatgacacattgcatgtagattttggaggaaatttagcaagagctccaacctcttggaaaatttcctttgagtctatctctctcatccgattcctgcgtttttcttgcgctccaatcaaacgaccattcctgtgtttttcctgtgttttgcaatcctctgttttacacttcaattcctgtcagaatcctatgtttttcctattcctccgttttttctaccctgcgattcaaatgggccctaaatgtgtcttctacttcctgactatttgtgtgtttatcataagttagtgcctatcttcgtgaatgttagataagagtttccaaataaagaattgcccttcaattgtttttttttttactggggaaaactaccagggctttgcctagtagtgtaattttatcagagagaaaatatgtacaaggttacatggaaaacactaaaaaattacaaagttttcattgagaagaatgtgatcaatcatatccaaattttctagcgagcatgatgaaatttcttccacatccatcaaacagactatcaatagtagattttgcaagactaggcatgcattgttcagtagatcaagcactattgtgtctagggcaacactagtaagctccaaagtttttaggtacatgatatgtgtgactgaggaacagaacttgttgctgccgatgacactatgcttagtcatggtgttacatgatacatgctatgtctaacttagtagccatatatgcaatagatgtatgttgtagtgaaagggcatagcttagagaggtgtagaatactgtagtctttgttatcattcacttcttcctcttcttcattttcatcacctggtagatctcctacatgaggcagtagagcctcttcattcaccaagtactgagcacctcctactagtcatattccggctcctcgttgccgagatacttggtaggaaggggaccaactctattggggcatccacgtaggagcctaagggcatgcaaatggtggagtgggcgccactggacgatgatatgttgttccagctaaggaggtcaagccacttggatgcagcgagctcacgcaccatgaaggctcctaccatggccatcatcggcaccttcagcttgtttgtcaccatcacctagcaacagcataccgtagggttttcccgggtagtgatggatgtggcaaggacaaattttttcctttttttctttggctctcaattttcacttattctaatatactttttagtctttatttttgttttttctacaagcagatggcaatggcacggtgaccaattccaacccaaagctgagctagtttactccgattactatgcttgtactcacttatatagtgttgcccgcattttcctagcgttgtccatccctccacctaggttgagtctagtctggcttagaggttaggcatccagctgtttggttgtttgcgtgagttagcctggctagcataaattttgtttggttgattgtgtgagagagacggtttagaacatatttcattttgttcgatgcataatgtgtgagtgcagttacctatttagttggatgataaggttactgctaccatttataggccaaaatactttggaaaatattaaaatcaccttcttcaaattcaatcactatatatcatacaaaaacataaactgtagcttccatacatagtactaatcctcttggttactagatatttgaagcaatcaaactagtgacaaaaaaaagagagaaaaggacaactaaaaaagagaaggaaaaagaggaggcttcgttgagttcaccaccattgcctcccgctgtgctctggcccaccgctcgccgccatcgccatcacgacagccagatctggtggtcatgagctcgtgcctgcttgattcggctgtcctgctactggagagggtagctggaggtgttggagggctctagcagggacaacgacgtgaggaccagatggagggcgacagtgtggaactgatgaagggcaatgatggcaaactaacggcaaggttatgtcgacaatgacagcaatgccccttgagcctccagatctatgatcctctcaagccctccttcctctcgccatcctcctttctccatgatctagatgaactagagatcttgggcgccagattttcagcagtggagctcttcgcccctaatccagctcgtcgcagctaacgaaggtggcaggagggaactggttggtgacttcattgcaaaaccagcaaaccctagttttatattttgggggacaaattactaggcggacaatgtggtgactggtgacccaatgtcagcccctggtacgcggtggtgaaactcatggacacacggatgcagggtgggctgtgctactacacgcgtcaggccaggatgagcagtgaagcttgatccggccattcctgatcagtctagctgcgggcattttgaatctgttgggactgtcttggacatgtgcaggcaaccaaacaagtagccagttgcatgcaaagatgcaagtcaggccgatacaaccaaccgaacatgtcctatattcatgtgttttaatccttctttttttgacatgaatttctttcctattccctcgattttcctgtactatatttttccaatcctgtgttccaaacaagcactaaaacctttaagaagagagcagtcaattatatccaaattgtgtagtgaacttgatgaaatttgttgcacctccatgaaactgtctatcagtagctgattttgtaaagttggttatgtgttattcagtagatcaaatgccgtcccatcttgagtaacaatagtaagctctaaattttcaggtattatggtgcctctcgctgctaccattgaaataatacttgaggttgaatagaagagaataaaatggtgctcagcaccaaaaaaaatgtgtcttccacttctagggtgcttgtgtgaataccataagcaagtgtctatctttgtgaatgctaggtaagtctttcaaacaaaacagttgcccttctgttgatccttgatgcatggcaatatatgatggagcgactatgatgatcggccttctagattcttctatattcctgtttccattagactattgaaattagaatatttcttacaataataatgtcaattacatgcccgaaattagactattaaagcatagttcttgctaagaccagataaatacaatccaaaattcttttagcaaccaacaaaaatagcacttgcatgtgcctcataattactaattctgcatattggcacaccgcacaaaatacaattttttttatataacgggattataatcacccttgtaatcccctctaacactcacacagatcagctaatacaaagaattgcccataaatccatctgaaccatggaacaattaaccatgagaaattaaacatgcatgcatgattaactacaagcaaagctagataacccaaagtattattattgcagagaaaaaattgctgttgatctggctcaagatcacaacaagatctcctagaggaatacaacactgcaagcacaaaaagaaaacacaagcaggtccgcctcttttgtacttcgttctcatctttgtcttctttgcgttgttctgtcctcatgtatttgttgccactggtttcttcttcttctttggcttcatcgcctagtagcttattcttctccatcaccccgcagccatgcaccttacggttttatccaagtagatgtggatgtagccattgctgattttttttttccttgtatctctgctctctttctttggctctcaggtttcccatcttttatctactttttaggcttgtttttccattttttctaggatcagctagcaaaactccaacctaaagccgacctggcttgtgccgctcgttgtactcatactcactttatatatggcagtattggcaaataaaaatgtttggaaggcagatagtagtgactaaagatatcgtaattaaaaaataaaatgtctcttaaaaactaatctgatggaagatgaatgttgtggtcctttcgatatactcacacttgtttaccggttttcatcctgtatacatgtataccaactatactgcattaataaataataaagtatgatgaatgtcagtaatcggaataatatatactagttgaatgcccgtgcgttgctacgggaaaaattatttgtatcataagtataaatcacaccatgtcacctactaccttagggccaggattgttttcgtctgccaagacctccgcctaatctctcatcactaccaggaagtgtaagccaaagaggcgtcgtgcttacacattattctacaacaatattatgctcaccctcctgagcatgtgcagtgcacatttgcacaacatatatacactagagaatattataagcacttgtaaaatttggaaatattgtcatatacaaattcatggcccattgccaaaagactcgaaaataaaaacccaacaaaaatatttataaattctatacaatcactttgatgtataaagatctttgcaagtagtacatttgctatttccttaatataaccattggcatgacaaaactttcaattccctataaaaataatttacttcaactatgatggttccacactattctgtcaaggagaacagagaggagagagcagagagatgaagagagggaagatggggagagagaggaggaagaagaggatgggagatcaccggcaccctcaccggggacgagctccctccgcagcctctgctcctcatggcatgtggcggcaggtgggacgtcggccgtctctacacatccccacacgacgcacgcgacaggtaggatgaggaagaaaggagaggggagagaggaggaatgagagaggatgacatgtggggcctacgtgggccccacatttattattattttgtgtgctgctcacatgtgggcccactgtttttattatttttctaggatcgaattaccacctaagcgccacaccaatgcacgtgtcacgaagacctagtcaaaccaaccaagtaggcgccacgttagccaaaaccaccgagaaatcatgtttacactgattttgatagtgaccagttatatctggttttgggttaaagatgaaaatgggattcggtctaaagttaacactggtagagaaaccatctttggtcggtcgacccaaatccataatagtcccggttccattaaaaaccgggactcatttttagtcccgattaataagaggaagatctttagtcccagttgttgttaccaaccgggactaaaaatcatctttagtcccggttggtaactccaacccggactaaaattcatttttagtcccggttgatttcatgtcaggccgtgtcagggctctaggatctttaatcccggttagtaacaccaatcgggactaaaaacgttccgattggtgttactaaccgggaataaaaatcaaaacacactatataatctatagtaccgatcatcttttcccgtccacataacaaactccttcctctatctcttttttttcctctctaacttcttatctctttccttatctctaactcccctcctctccttccttttttccttcaccacacagtgaagaagcgtgcaggaagccggcgcggcggctgcggcgggcggccagcgcggcggcgccgagggccatgcggaggcggcctgcacggcggcgcggggggccgcacggtggcgcggaggggaggaggggaggcggcagtggctgctggccgaattgttttttctttttttttttgagatgtgaatctgtgatgtatttttgtgtgagatgtgaatctgtgacgaattttttagaaccctgtgatgtaatttttttaagagtttgtgatgtatttagagatgatatatttttttaagagtttgtgatgtatttggagatgatttatttgagaatttgaggatttggagatgttctgtgatatgtgatgatttggatatgggaggggatgatgtgaaatcaatattcaatattaaaaacagaaaaaaagaaaaaatatctttagttccggttgatgttactaaccgggactaaagatgctccccacatcaaccgggactaaagatggggattttagtcccggttggtaacatcaaccgggactaaagatcgatttttagtcccagttatttgaactgggactaaagatagcgatctttagtcccggattcgtagtcccggttagaaaaccggtactacaagggggttataaaccgggactaaacaacacttctccataccaaatgaacttattcctttctcctgttcacatcgaagtcgcgcctgtgcatcgcgagctcatgagtcatgcacgagtagttcacgaccggctgaattccaagactcggattcctcgtctcccctctttaacctgaaactaagatgtgtttcctgcgacccttctcagaacctgattagttcccacgcagaaactttttattccgtcatattaaatgtttagacacatgcatagagtattaaatatagaaaaaaactaatcacgctgattgcgtgtaaattgcgagacgaatcttttaagcctaattgctccatgatttgataatgtggtgctacaataaatatttgctaatgacggattaattaggcttaataaattcatctcgcagtttacagacggaatatgtaatttgttttgttattagtctatgtttaatacttcaaatgtgtgtctgtatatctgatgtgacacgccaaaacttttcgttcgcaaactaaagaaggcctcattctcttatccatccaaatgatgctctctcctcttccaccaacaacagcagtctgcagctcatagctgccattcaacaatggagatctttctatcctcttatgtttacttactgctggtcagtcaggatataggtatatcaatgcatctgcttctttcgggctccatcctttttattcgctggctgatttggtttcttgcacactacccaatttcaatccacaaagaaggctctggtagctaatgaatttctttcttttattatagacacttgcctgacaagattgcaagactccagtgtataaacatgtgcaggtcattgcagtagcactcaaagatgagttttatataggaacaaacatgatcaaggtgagtatatatttttctaaaatcatctcagaatgtcaatttcaaggagaataatattcttcagttttctgtccagtatctaagcatctccctaaaattcgtcatgaatgaattggctacagcagtggcaaaagggttcgaccatgaaaattgttcttcttattttattaattgtttttataacctacctttctctaggatattttcatttttcactttgtaatgtgaagcaaagtcaggtagcggtctcaatagcacaaatctatttatctataatagctgaaaaatatcatctgtaatgacttaggcgtccgttatagtacaataggtacataatgtgacatgtcatctgtaacggttggtcgaccattacagatgtgtgtcatatgtaacggctcggaaccatgagtcgttatagatgtaaaaataattaggcaaaaaaaattacggttcacatcttgtgaaccgtcatagatagcccgttacagttgtgagaatctgctagtgtctattggtggtctttttttttattaatgttctcaatctgtcaatatagtcggcactagcgggcatgattcgccagcaagcgtgattattcaatgtacagaacgcaccaactgaagaagagaatgagctgtttggtccagtcagtctcatgctcccattgacacaaagtttattgcattgtataattatttaccgctttcatccaaatgttctctgaaaagaagatctaagtgcatgctatctttatctgttgtccaattacatatatgtacacatgaatatctacaaatctccgtttaatgcgtggtatatcgtctaattcttttataaggataacgaccctccaaaatttcttatttttctttcaatccaaaggaggcacaaaagggcagaaagagcttttggtgtcattggaaaaaaaaactatttcaataggtttgacgaccccacttagattttaattgaaaggagtcatacatagacccattttggaagcttaattaatattctaataagcaactggttggtatttagcttttaagagtttcaaaacactaggtatcccaaattttaacttctagtctatttcatagattttgtagctacgtattttgagaagctaggtaaaaatcggaagtgttgaagccgaagaatttgaggtgttatgttttttcttaagcttatgtttcccagccaaaatttgaacatatatataaaagttttattcacaaattatttttcgtttgcaaatatgtcgtaccacgaataaacccaaggcatgggggctttgagacaagttgctaaaagctgccttaaacaggtccataagtcatatagaagaccaatatgtaggatttgggggggtgcctgcaaatcaggcgcccgattttttttccaaaatcggatgctgtttcaccaagtagataaaaaatgtttcactaaataggttaaaaatgtttcagtcttttaaaaagcaaaaacacaaccaaatcaccttatgaaacattttgctacagcgtatgaaataacggtttccaaaaaaatcggatgttgtttcaccctatataaaaataatgtttcaagtttcaacaaataacgaaacgatgtttcaaatcttaaaaaaatgtgaaacacggtcagatcgttagatgaaaaaatttggttcaacatatacaacaaacgatttaaagccattgcaacacttaaacccatgtatattaacaaaccacgtgtccatcaagatgaaattattaaacattatcaaaaatctgctgtaacatttgatccatacatagtgaaacatcataagaacactagctgaaacattgttggtaaaaaaatgaaacagatcctccttaatagggcgtttccgttatatctggatggctgttgcaaaagacgcgtggtggggcatgcgagcgtgggctgcgcggggcgcccaatctttttgggcacccgagcactggcaatttcgaagatttggtgagtggttattcattcaaaatcctaaggatcttgcaataacgaaatcatgtggaatagaaccctccaaaatctcataaatgtactccaattaacaataatagtacatcacagagtcaatcagtggtgctagtacagtaacattttcaataataaaaataatacaagaaaactcctgtaataaagcacacctatatcactacatgtaaccacttaagcaagcaggtgagcactgcaaaatcgccaatcccaaccgcgccactgtcggtgtcggcatcggcgctggaggacctcgagctcgaaatcttgcctcccatggcctccacctcgaggcggtggtggtggtggccgtgggcgacgccgccgcccttctcctcctccgcctcgcggcaccacaagggggaggggtgggggctgggcgggcccgcgctggtgaaggccgtcgggtggctcctcctcgccggcctcctcttccgtgtgctctgctccttcccctcctccacctcttcgccggagatcagcgaaggtgcgagctctctcgtttcctgatcttgaatgcggatgcagtgggaaaggggattgggagggtttaatgctgtcggtgggtttggggggcctgcgagattcggtgcatttcgacatattttgctgttgttggagcgaacattagtggttttcttgggtgttcttcggttccatgcctccacgagttagagattttgatgccacttgaatcttgctgcgggttggaccaaatgattagtctgaatttgttttgttccgttcatcctatctcgtggaatggcgtgcaaattttgttttgctgtgttagtaggaaaacatttcgaattggtgaacgcttttttcttttttgtttctcaaattctgggtagcgctttttccggcgggtttggtggggaaagctccgaataaactttctctgatggagcagtttggcagttacagatctcatgcttgtgcaattgcgattggacttttcttttttcttatcctccaagtggaaatatttaatctcttctctatggaagactagagattcagttctttttattctttaagaaccagaaatctcgaaaacaatatttcctttatatacgtttgcttcgtatggggaagacaaataagaaagctgtctgttttgatcttgtcaaccactgcttagtaaatatctgtgcaaagaatataaatatgcccttcaaatgtagccagtaaattagttcttcagctaaaacatgaaacaaaattaactcttctgttcatctgtcatatgcaaatgttgtctcactacttttagttcctatcctgtacttattcacattatttgatttgttatattgtcctaagtgggcttctgcaattttaaattgtactgtctatttttatgagaatgatactattcgtagtaatcttgaaatttttttagttcttgttgcatattattcccattagaaatcacttggtaggatctcagtaacacgtagaatgcccatccacagtcaaccatgcatttactcacggcatgttgacttttgacatatgtgagtggtaatttgtaaacaattggctgtagcagaatttgcttatcttgacaagctggagcaactaaagtactggtcgttaaggaaggattgtggctatggtgccaagcatgtgttgcttctccaagttttcttttggttgtgactgaatagttaggatgtaatatttatggaaatagttttgatggcaaatttgtatgaatgaacacttgaagcacaaatgacaaacttcttaaactctttcactagttcgaatgggtaaatgagaaaagtggctgatctatatatccacaatttcctgaaacctaaaatgtagtagtattttgtgaacattgtgagtcctcaactattcaagtattcattcacaagttcaagacctgctattgtaccaacctaattcctgtgataaagatctgccttcccacttttgttccaacaacaaacagatattttgttgaactggaaatagttgatgttttatgaatctattactgcttgtgtatctaaaagaagattttagggctactttccaccacagtacgtttaggatacttgacataagaaacaacgtataaattgtgatgtttctttccgtagtgctcttgtcttgcatctcatataggatatttcttttgtagggaaatgtaacctttttgatggtgaatggataccaaatccctctggcccagcctataccaacaaaacttgtcgatttattgatggtcaccagaactgtatgttgaatggtagacctgacatgtcatatttacactggaggtggaaaccatatgagtgtgaactgccacaatttgatgaagtgagatttctaagtgctatgaggaacaaatcctggggtctgattggtgactccattcttcgtaatcaagttcagtcactgctttgccttttgtctaaggtaaaagttatgaacattacatattttcactaattcactttcccaaccctgttatgaagcaatgttcatgctttccttgaataatcatgttcctctgtgcacctttcctaattcttaaatataacttaataagggatgatatatgatagcaagcaagaataccagataagtttcatgttaccttccatgcatactgaacattatccccattagtgttatacagataaccatcctgagcagacctgcttgctgttttatttaggctgaagaacctattgaagtgtaccatgacaaggaatacagaaacaggagatggcacttccaatcatacaacttcaccgtgtcactcgtctggagtcccttcctcaccaaatctgaggtatttgaaaatgagaatgggcaatccacctctgaaatccagcttcaccttgacatacttgacccaatctggacaagtcagtatgagaccttcgactatgttgttattgccggtggacaatggtttctcaaggtcgcggtctactgggagaatgatagggtgataggctgccattactgtcaggacaagaagttacgtgaacttggatttgaacacctctatcgcaggactctgcaacaaatcttcagattcattgcatcttcaaaccacaaaccagctgttctcttcaggacttgggcacccgatcacttcgagaacgcggaatggttcaacgggggaacttgtagccgggttttgccttacaagaagggagagtacagcggaaaagacatggatcgtatcatgagaccaattgaacttgaggagttcaggaatgccatggcggcactaggtggttcgcggaactctgcgaatctgaagctcttggatacctacagcatttcgtccatgagacctgatggccatgttgggccttacaggtatccattcctgaaaggtgacaaggatgccaaatcagttcagaatgattgcctgcattggtgtgtaccaggccctatcgacgcttggaatgatctcgttatgaagatggtattgggctgatgaagcctctgagataatactgaaagagtaaaatgcaccagcggtccttaaacttgtcaagaggtttcacttaggtccacgaacttgcaaagcgcacatcgaggtccctaaacttggtttattatatcatcctggtctaaagccacgtttgaccgtggtcttgtctacgtggcatgccacgtggacgatgacatggattttttgaaattttttctccctccttccttcttttttttctcttttatgaaaagacgatgacatggatgacgtgtacaaggcattttcgtcttttcgacaaggaagaaagagaaaaaaagaattaagaagggagaaaaaaataaaaaaattccatgtcatcatccacatggcgtgccacgtaagcaagatcgcggttaaacgcggcttggaccgggatgatacaataaaccaagtttagggacctcgatgtgcgctttgcaagttcgtggacctaagtgaaacctcctgacaagtttaaggaccgccggtgcattttactcatactgaaaatgcagggtttgtttcaagcacattctgcaaatctcgaatcagggtcagtttcctgtgctcggtcgtgtactggtttaaccgaaatttgtaactagtaaaacctaaattttgtggttgtaaatcatatttcggttttgggccgggaagtggcttattgtttaatgtgtgcggctgtaacttttggaagtcaaatctgtttgcctgctctcatctttatgtgaaaattcagggcatgcagtaggagaaagttctttttgataataacatatatctggtcaaaggttattacagcattgcaacattaagttgctaagttgaaacaattaagttcagatgtcttgaatcgtccgcgatcgctaatcggcgcgccaccagcgcgcgtttcaggcccataaggcccagcaccggcgcgcgcctccttccacgctttttttttcgtttttctttagcgatttttttcgttttcttttccacttttttctgattatttttttaatctttagcatgttttgagtttgaaagtttttaaattttgagttaaaaagtttcaaatctaaacttgaaagttttcaaatcttgacttgaaagttttcaaatctcgatttgaaagttttcaaatttttcaaatctggacttaaaagtttttgaatctagttgacagttttgaaatttgactttaaagtttaaaatttaaatcgaaaattttcaaatctaacttaaaaaattttcaatctattagtaaaaaaatcttcagaatctttcctaattactatcattagtgttaagtatattaactaatagaggtagttaaatatattaactaatagtgttaatagaggtagttaataggggagaagtgctcgctagcggcgcgcacgcgctagcttggtgccccctgaatcatctgcctcggccctcggcaatgtcagattctcaaaaaggcttgtaatctgttcatagcagtgctggtcacgtgcttgttgggcctaggcatgcccttggaaggataatgccctactatttttaatgggtcccaccagtattattctactcactttttatttcctctctcttctctgcctttcccgctagtggaggaagctgaggctccgggctgaatgccggcccaagcagtgatagcgtcctcaagcacaagcgtcgggcaaagtagaagtatataggtagtacgtggtcgtcctcaccaccagcctaccaccaccaactccatcgattcttctccgctgccaccaccttcccatccccatccatggaatagatcgggcgctacaacctctcttcatcagggccagaagatgaggacgatggtgccgccgagcttgctagatccggcatggggctcggcggatctggccttgagggtggtggagtaagaaaaagctggatgacggcatcaccgagctcgccagttccgccgagagcaccgacttcatttcccgccaccatcttcccttctcctcacatgtgtctctccccaggttgccaccaacgccccgtcgagctcgtggtggtgaccttgcttacaacggccactcgttggatgcctgtcaccgcctacatgtgttgtggaggcgtcgcatggggccacaccctctcccaacgcactgctcgagtcgtgcctcgtcgcgccctaacaaatccctgacaaggaacataggtctcgacttgtttctgcagtcttcacatggtaataggagaggcaaacatggcatgaaatctcttacatgagaggctggggctgaacgacagttaggcacactgtaaaagccctaatgaacacgtaacaaatccccaaagtagtcatttataccaaagctataaggattcgcttaggccataacagaacaaccttagtggaaattcataacttagctacactccaaaattcataaatttagtaagagaaaaaacatcgacacgattacaaatcgagcatttgaatttcctaaaaattgagtgttgtttcactactcgtaaagaaaatatttcacccaatagattagacagtaaacacatttaaactatgattgaaacattttggtgtaacatatgaaacatcgagtttcacgctattaaaacaccaacaaatccatatgaatcaatgacaatgttatgagacaccgtcaaaattttcataacaacattttaatccaatacaaagtgaaacatcaaaagttcatagcgcatccatgctaccggcggtgaggcatcggtgtccatgccgacctcctggaagaagagaaaagaagggacgcaccacctatattcgcaagcttgacacgaaagtcactgcatgctgccgcatccacatcatatttttcgacgccggtcactacgctgctgtcgagcgacgcccacgggaccagacctccctttcccctagcttccagcaacacaacaaccatagatgttcatttggctaagttgtcatgacagaagaagagagagggagggagagagtgagagagatgggatgaaactagtggataggaatgaatagattaccgttcatcgactaaaacaaatctgagccatcggattgaatcggaggcctggatgaccaggatgtgtgtgggtgtgggcatctgatttttgcctagcataggatgcccgggcgggagcattctaaaaaaagaaaagaaaaaaaaagtatctaaagaactttcgtaattttttttgggtcaaaaactttcagacgtaactaaagtataattaaaatgtaattatattttaactgcattgtaactataagtgtaactacgatattactatgtgtagatagcattgggtttttatgtgtaacatgtataaaaatttctttctagcaattttctctcttaatgcatagaataaatctcgaggtgatccgatgtttataaatctgaaagttctagggacataaaactttcataagttttctaccaaatctgaaaaaaaaaatggtataacaacaaaaatcaacaaaaaagatgtagtcagtccaagtcaatctcggatgcactcctcgcacaaagttgatttttcggacaagtttgatacatcgattcggatttaggagcacgtcacgtagcgagaaaatttcgatcgaaataataatccctaaaactttcatagaaaaacaaaagattattttgtgcttcaactcaggcatataatcgctttgtgcttgtctgcttagccacctgtatttagtcagattggcagcagcttaatccgtcggctaaattagtaccagcgaaacttgctggtcatattgttgacggcctgaatctgcagctccaggtcacggatctgcctgcgcttcgccgccgcgagcacgagctcctcggcgcgcgcgtccttctcctcctccgccgcgagcagccgcgcctcggcgtcgtcggcccgggcctcggcatcccgcctccgcgcctccaccgccgcccgctccgccacggccacggccagcgcgcgctccagggtgcccacctcctcctccaggttcgccgccgcctcccccaccagcagcctccgccgcagcagcgccgccgtgccctcctcgccggcgtcgtcctccgccgccgccgccgccgacgccgcgccgcccctgagcgaggccagcaccgacgagaagcatgacagcggcatgtttttgagtcgcgttgagaaaacgaaaatccaaagacggcggcacgtagagaaattaattacgttgggaaaaagtgatgagcccatgggcttttgataggccgattattacgaaggaatacgagtccgattacgatgggaagtaagacgaggtgtcccggtctgaatcgaattacaccggtctgaatcgaatacgttgtttatacgcccgaacaaagtgagcgaaagtggttccgagtcggatagtatcgcggagaaaaaaagagttccgctatacatacgattattttttatacgatgtttgtacgatgaaacgtctctcctaacatttgtagtgacgaaacagatccctccttcactgcaaagcccatatccaaagcccaggctcctcctgacgacctggcctgctttctcgttggtctggttgcacatccaaccaaagcaatcttctttctaatcatatcttaagcaatattcttcctaataatatgttatatagtaattgtactcagcactcatttatcatgtggcaggttaagcaaattactcatacatatatgttccttgcaccttgcactatcaaatagaattcccttctttggttcttgtaacatagcttcctctgttgattgctcatttgaaacaaacttctcaatttcttggtcatctgattcattttggacctcctcaataataaaatcatctttgtctgatatggcaatatcatcttctacttcattggtagataaattggtctccattactgaaacatgtaaattgaaacaatggcatgttttgcaaagcaaaaattcagattcattctataataaaaaagaagcatttcatggccatggacattacccaggaccaaaaaagaaagagagggagactagtgtaccaaaaaagatgattgcgaagctaaaggaattcaggcaaataagatggcatacctatgtcttcgtatgccgtatgctctctggattaaatgcagaattgcagatgcgctgataacatggaatagggaaagtcaggtttagggtttaacaaaggaagatgtaaagttagatgcaaagaggctaattgggctttagggcccatgacgctcttgactgccgtgtgcgcatgcgccgtgcgcttgagttaggttccctgccgtcggcgttgttacgtttgatggtaccaatatcgtacaaaaaattcgtatgcgtagcattttccagaaaaaaattgaaaatattttttagtttggacgcggataggcgcggctgccatgcttgggccgggcggctgggccgagagggaaagagggagggaggcccgggagagagagaggagaggaagaagagagggagggaagagagacttgggccgcgggccgagggagaggagggggactttgggccggactgggcccaaaggaggaaggagggtttatttttagtttttctttttaataaactctaataattgttttttttcttaataactattttccgtgctctgaaaatacaagtaaaatttgagggcaccttttagaccaaggaggatttaacggaaattctccgggcaacacgaatttttcttgtatgtattttagtgtttgtcaatttcttttcgaattttaattaattctattattccttttagagaatgatttttaattcgggatgaatttatcaggacgtgacattggtgataaggtggaggagagaagttaggagagagagagaatgagccacccccttatggcatagcttgtgtgcttcaattgtgcatattgatatgacagaagaaagtgatagttttagatggaactttcatcaaaatggtcaattcacagtttgatctatgtatttagctttaataataatggttatattgagaggaataagattaattggaaacttaagatgcctctcaagattaagatttttacgtggtatctacttaaaggaattgtgttaactaaggataatttggctaggaggaattgaaatggtagtttaagatgtttttttataaaaaatgaaaccatctaccatctattcttcgattgctatttttcgagatttctttggagttactttggtttacatcctccacaaagtatatctcatatgtttgggaattggcttgttggtgttgataaaaaaattaagaatcttattcttgttggagcatccgctttatgttgggttctttggcttagtaggaatgacatggtttttgatatatcaccatcaaaattttatttgcaggtacttttcagggcaacgtaattgctccattgttgggcttaattataaaggtgtgaagaagatatcagcttaattaatgatggcatgtcgtaaacttgagtcaacgattatgcaactctttgttaactttggatggaggttctcaaatagaattaaatagttgtgggatctttatcttgtgtcagtatatattagttgtgcttgtttgaaattttcattggactcactatgtgagtttgctattgtgtgaactatgtaataattggttgtagctcgtttgagcaaatgccgggatattttattccattatcaaaaaaagggggcaatctctatataatctctaagaaaagtgcaatatgttgcacttgctatcttttaattaatgagaagatgacatgacttaaattagatgtggtatttacatctactacaaaacttgtcctaagtactgcacatgaaccaacccggggtattgaagtaataaaatttattgttttgcagacaggtggtaggcattgatggtaggcaagaaggtagaagttggtttattttgggacaaacttcaatctctataagttgttttatttcgggatagagggagtagcaccgtacaagatgacctgggtatgcagacttattaattaacaaagtaaaacacgttagtgtgggcatgtcggatcgtcgcgcgcacacgcgtaaatttatgataacatgatagccggcaggtagatccaaaatataggaaggagcatgtctaaaataattagccatggatggcgcgcaaggtagctgcttcattaattcagttgcgcacccagatcatgtcgtcctgaggcaggaagtggcagatggccacgctcccgggcgccacgccgagcctcttgtatgcctccgccaccgcgccgtgcccgtccacgtccccgtggcacgcggccaccgcctgcgcccttgagcccgtgcaacccgaacacggcgtacgcgtacggcatcccgtggcatgccaccatgtcgccgccgggcaccgccacgggcctcacggcctccaccctgtacgcctgcctcggcgtcggcgtcaacgtgctgatcacctccgtggacacggcgtggacgtcgcgggtgccgaggctggacgcgacgaactcgaccatggactcgagcgacgtggcgcagtagtgcttgtgcttggtcgtctcgccggcgagccgcgcggcctcgcactcggcgagcgtggaccacatggcgtcggcggtcggcgagacggccgggatggagagctgggagaggatctccgggagcctttcggaggcgaacgggacggactcggcgcggccgcgggggagcagcgcggcgccggcggtggcgcgggtgaagtggagcgtcatcttggagcccgggaagaggtccttctcgaggaagaacacgttgcccaccgtgtcctccttcgaagctgagcccactgagctcgctgggctgatgaggtcgcgaatggcgccgggcatcggcgaggtcgggagcgcgatcttccagtacatctccgccggcgacgcggcatggctggctcccgcggcggcgacctaaattgcagtcagaaacaagttgaattgaaaacaatcagagccaaaagttgcaactagaataagtaaaaattgtattatgttcaatctctaaataatatatctctctctcccaacttaatttatctctgttctagctcaaaactactaaaccatacaaagagcgatatatatgtgcttctgctcaccaaaaggagtaggacagcagcgagtgacctagccatgctaattaacgagctatcaaggacacaagtatatgatctaattcactgataagagtgaaactgagcacaagcagttcatagcttttgggagctatttatggagggatgctggaagaatacgaacaaataatacattgcattggccccactggattatgcagaacaaaacaaatatgtcatgtaggaaagatgctatatcgcattcacgatcatgccggatacctctattattgagcaactaagaagttagcccgcatgcatcctaggctgcatttgagacatttataagtaataggttgattgtgttaaaatgtcgtatttgttactatatagcaaaatataggtatatggattttatatcatcggtttgattataaacagagcaatagttagattagaaatcagacctggagcttataattgtaaactatttctcttttagtaatacaaaatagcaacggaagaggaatgaaaagcgtagagctcgagccaaagagggaaggagtaggtgtgtagtgatgggcacaggtgagggtaatgtggaggggattttttctttgtaatttttccaagtgattgaagtgaaagacaattattagatgctattttcctaggatttgtaagattttttttaaagatgtgatacaaatcctagaaaagtaacatctaataattggttttcacttaaatcacttagaaaaattacaaaaaatgaatcccctccacatcacgctcgcatgcgtctatcactacacaccggcctactccttcatttcctctctagctcgcgagctctacgcttctcatttctctccccttcctattttatactccctccatcccataatataaggcatggtcaaacttggcacagtctttaaaagattaaatctttgacttaaatttctcatatactataaggtttattgcaacaaaattataaccatcttaaagtaaatttaaatatcaatctaatgatattaatttcaacaaacaaaacttaatttatattgtaatagttgttggtcaaatgtttttaaagttgaatattggaatgtgtgcatgccttatattatgggatagagggagtataactaaaagaaaaataatctatattataagctccatgtctgatttttaatctaactattgctctgtttataatcaaatcaacgatataagatacatatgtctatattttgctatataacaaatacaaaatttaacacaatcttttcgggagtattgtgtacagccgtgcaacatcgtcgtagtttatatatttcaccggacaagatgcatggatgaatcttacatgcagacttattaacatgctgccacacgtatagtggcatgtcgatcgatcgggccgtcgcacacacatatatgcatgataagacatgatacgcacatagctccaaattgtaggaaggagctagctttgagatcacacaatttttatcccctttcacgcgcgcgcgctcagttgcgcacccagagcatgtcgtcctgtggcaggaagtggcacaccggcacgctcccgggcgccacgccgagcctcttgtacgcctccgccaccctgggcgccgcgtcggtgtggcacgccgcgagcgcctccgccttggtcccgtcggcgccggccagcgtcaccgtgtacgccgccgccgtggtcgtgtggcacccgaacacggcgtacgcgtaggccatgccgtggcacgccaccatgtcgccgccggacaccggcacgggcctcacggcctccaccctgtacgcctgcctcggcgtcggccctgccctgtcgacctccgtggacacggcgtgcacgtcgcgggtgccgaggctggacgcggcgaactccaccatggactcgagcgacgtcgcgcagcgcttggcctcaccggcctgcggcgcggcctcgcactcggcgagggtggacctcatggcgtcggcggccggggagccggcggggacggagagctgggagaggatctccgggagcttttcggaggcgaacgggacggagtcggcgcggccgcggggcaacagcgcggcgccggcggtggcgcgggtgaagtggagcgtcatcttggagcccgggaagaggtccttctcgaggaagaacacgttgttcaccgtgtcctccttcgaagctgaggccgctgagctcactgggttgatgaggtcgcgaatggcgccgggcatcggcaaggtcgggagcgcgatcttccagtacagctccgccggcgacgcggcatgtcggatgcctcatgcctctattattgagcagaggctgatagtgtaacaacaataatcatagtgtggcctggggttacccgactccctatcggtattctttgaatgatccaacatgcatgtctatttctagtaaatttatggattcgccaatagagcaattttagtttggctcagttctatcgatggatgagtccatgagaagttagttttttttacaagctgttcaaatagttatgaatgttttttttttcaaaaaattacagaagtatgttattaattgtatcgcatgtttattgaaaaacacgcatgatcaaattcaatatatgcatggtgtaaaaaaaacaaatcaaatagtaaaagttaccatatatagttccacaattcaatttttttctcgatatagatattgaatttgaacttgtattaaaagacatatataacaggctgccataggcaacaaattaaatgaatcacaaggaacactcgacgaatacaatccctgtcagtatttgttatggccacagataaatccgcaagcacacaaaccgatatagcatttcatctcagagtattgcaagtgtattgaatcacaggaaacgtatgtttataatccaacaaatatgatttttctaaggacaacaattaaatgataggcttaagagagataggatttgatgaggacatcccagctacacttgacgtaaacaagggtgatggtttacgtcatacatcacattaagaaaatgaagatgacataaaccaagttgatagattacgtctcagcaagaatgatcaagcttatcatgatctaattacgcacagccgtgctaggaaaatacaacaagaggtgaactcgctctttgctcaacttaacccaaattttagtgagaattttatactacctaaatgctctacctttgtattgctaaggtttacacccgaggacatcatcactacaccaaggaagatgggttacgttgaggacgacaaggattacgccgaggaggattcagcccattcccaaccagcagctttttacaccaacaagaagatggtttacgctgcaacggctcaacttccaaggcttatgcgacccagccaatcaagagacgggaagcatggaatacatgattggaaagagggacaagtatagtttcgaacgcatcaaaccccacctcaatatcattctccaatcaaaagttatggcatttttactgaaggctgcgcaggagctgtagggctgtgtgcaaacccgagaaaactctttgcattctcatttttgttagccttgaccaccagaacgtggcttcttatgttcacaccttagctaggagggatgttcctagtataaatacccctctactccatccattagacaacttttgttcaattgaaaacctcatatatgagagattcctgaagactgcataagtgtcttacccctttgttcttgtgagttcttttggacttgcgagaaggctcctctggtgccccctagttcgtgctctacggcttctagttcagctgcaccatattgtgtggattagtcccggattgtggttctgtgattgctcggtttgacgggtcggagtccagggggcttcggatcattctcaccctcaccacttggtcgcatccaaccttggtaggtataaagctagttattccggatcgtggttctatgattgctcggtgtgacggatcggagtccgggaggcttcggattgttctcaccctcaccacttcatcgcatccgaccttggtaggtataaagatagttatcctcttgctgctcgtagctagttaccctcttgtgtttcggtttacgccggcactctgtcttgaacctactgctgtgaagatcgggccacccctcgcgagtgtgttcgtatcaggattcctatatgtaaataatcttagttaagttaaggtaaaactctattagtttcttcgagcaacggttcactcctggtctaccaagggactccagcatgtatctctatgatgtacccgaacgtgaaggattaagaaagacggacatgattgtcaccacatgttggctgttgcctacgtttgcattccatggagcacacaataaatgaaggtaacttctaacctagacaacacctctacaacattgattacaactcggccaagaactttcttctttatctacaatcttagtactagagcacttagtataaatactaagcgatgaacctgtcgcaaagataaaaatatatcatacttaaataagaaaagtaaataccaaagaaaatcatgaatacttacttatataaaagacaaaatcgtcgaggtacaagataggagagagtgccgacatctccggcaatcctccagtacaccccatggagagaatgtcgacatctccagcactcctccaaaactcggagagaactccgatattttgggcacttctttcggagcttcccctcattctcttcctatattctaactctactatagagtaggctaaatataaaagtgagttgtactcaactttctggtgttttgagagtgggaacttctcctccttatgtagcctgggaatcaagcataaccgccataggggaggcctgaggaagcgacatgtggaagctgtggcagtgatcagtcacactcttggttcgaccgaaccatggttcagagggaatcactttcaccgcctttcttcctcattttcgccttagtcattgtcctatgggtcctcatgacggtgcatagtaaattggcttcaattatgttagcttcatatgattagttggcccatggatcttctgctagcgtttgagtggccggaggtggttttcttcgcatggcaggtggtttt

SEQ ID NO: 42474 - DNA, 808 bp, Oryza sativa
agatggagatcattccggaaacagagcaagaatcggctaaagtccgaatcggctacgatcaagatcgacagagttcgagtcggagaaggttggccaattaagccgattccgacaatgtgactcggtacacattgtcgggttgagttaatgtgcttcatgaggattgccatgcatggattgagtcctgaaaaggcaattgtatctattaattagggtatttcttgtaatttccttagagataagtttgggcaaaagtctgccgcaaagacttatggtatcttagagtttgttagagatgagagtcgtgtccgacatggacatattttgtaatctcgggtataaatagaccccgagccccatgtaatacaaaaacacacgttcaatacaatctcggcgcatcaccacccttttactttcattttgttttgacgagttcttgctttcgggttgagctgcatcagttgcgatcttcaactagaggtaaaacttgttatggcggcttgcgttctcgggattagtgcttccatcgttatgatactcaaatcttgcttatgtaatttgtcgagttatcatatttcctatataatatttgacaatattgctatttaaccttcaatcggctaacatctattattagaaggcagccgattaggttaaataccaatgttggctcagattatatagggtatctaccactctatgaaacaaccagcggcttgattgtctatatattgtccttcttttcatacttatagctgcatcagttgagtttgaccttataagtcgtgattagaatcttaatctctag

SEQ ID NO: 42475 - DNA, 1158 bp, Oryza sativa
aaatttagttgtttccatgtccaccgttgcttgcctggagaaaatcctacggttcatgtctgctgggcaatggcgaagaagaagctgaaggcaccgacgatgtctttggccggagcaatcacggtgcatgacctcacagcttgtctagctcagtgggagtatcacgccatcgacctgtagtgtccactttgttattttcgtatctctatataaaacaagtatgagtatgcctatcgctgcaaaccatgcgttctttgggctggagttgatgaccataccgtttcgaacagctcctagaaaactaataaaaaatccctaaaaggtagacaagaagatgggaaaaataaatgccaaaaaatagccatcgccacagccaccattgtttgcctggagaaaatcctacgattcatgcctgctaggcgctggcggcgaagccgaaggcacaaatgattggctgtgctaggagcattcgtagtgtgcaataacctcacgacggccaagtggcttgtcctcctcctgctcagtgggagcagcacgccatcctcccatagtgtccactccgtcgttttcgcatccttgggctcctccatgaacacctcactatctacggctcaggtcgtgccccttcctaccaagaatttcagcaacgatgattgggaaagtcatgagcgggagatgctcgggattcatcgaagaacagggctctcacacctcatgtttgagatctaccacgtgatgaaaccaaagaggaagaagaaactaacaacaaaaaagaacatcaagaactcggggacaatgacaaagacagagacatagacatagagaacagagggacctccatgtaactttgaataatttgtacggcgtagctcaagcaggttgtgaccatgtgcttgtgcttgcagtattctttctcgtgatctcgagccatgtagtagaaaaatatggagcttacaattgtttctctagatgtgatggtatttgatttattgaacaacacatgcttgtttgtaaaatctactagtgatagattgtttgattcatgtgcaagaaatttcatcaagttcattacggaatttggatatcagcgaccactctcttctaaaaaggatgtactcttagctttgtcctattgctgtgtgaaggatcaacgaatga

SEQ ID NO: 42476 - DNA, 7143 bp, Oryza sativa
tttgtagctattaccaatattttcaaaaataaaagcctagttatgattgtcacacaaacaaccgaaaactggaagacacatttttattttgtgtttaaaccactttgctctttcttagtatgcttaaaactcactttataaaactgaatgattgtctaaaaaggcatacattttagacaggaagatgcaaaaattagatgccaaaatttagttgttgccacgtccgccattgcttgcctagagaaaatcctacgattcatgtctgctgggcaatggcgaagaagaagctgaaggcaccgatgatggctatggcaggagcaatcacggtgcatgacctcatggcttgtccagctcagtgggagtagcacaccatccaccggtagtgtccactctattattttcgcatctctctatataaaacaagtatgagtatgcctatcactgcaaactacgcgttctttgggctggagttgatgaccatatcatttcaaaccgctcctagaaaactaataaaaaatgcctaaaaggttgacatgaagatgggaaaaataaataccaaaattgagccgtacccacatccaccgttgctttcctgcagaaaatcctacggttcatgtctactgggcaatggcgaagaagctgaatgcatcgacgatggctatgggaagagcaatcactgctaagcggcttgtcctactcagctggagcagcacaccgtcaaccggtagtgtccactccgtcgtttccgcatatctatataaagcaagcatgagtatacctaccatagtgtaaaaagccggaccggtgggtgacccggccgacctctcggttcaccggtccaccaatccaaccgttgacccgacggttgaaccgtggttgtatcttacatgtattatgtgtattttccatgctagtcgaaaggctagtgacttttccctccaactcagtgacctgaggttgaatcctagctagagcacctttgttccctatttttgcacaaaaaaaaaccaaaggggcactctcatttatggcccaacagcgttaagttagtcttggaatggcccaacatcggacctaatgttttgaccggtgccggttttcccagttcatctggtctaaagcggttcaaatgcatgtccggtcttcctatctaaccgaaccgtgattactctgagtctggttttttccggttggaccgtcagtctggtctattttttttgtactagtattacctaccggtgcaaaccaagtgtgctttgggctggagttgatgaccatgttattccaaccactcctagaaaactaaaaaaatggcctaaaaggtagacaagaagatagggaaactaagtgccaaaattctgttgtcgccatgtccacagctgctagactggagaaaaaccgtatggcgtgtgactgctaggcgatggtgaagaagccgaaggcacaaacgattggctttgctaggagcattcacagtgcacaataacctcaccatggccgagtggcttgtcctgctcctgctcagtgggagcagcacgctatccttcggtagtgttcgcatccttgggatcctccatgaatgcttcactatctacggctcaggttgtaccccttcccaccaagaatttcaacaacgatgaccgcaaatgtcatgagcgggagatgcctgggattcttcgaagaacagggctctaacacctcatgtttgagatataccaggtaatgaaaccaaagaggaagaagaaactaacaacaaaaaaagaacatcaagacctcggagacaatgacgaacatcaacaaaaaaccaagctcgtcaccatcactgtttcattgccgtccccgctgctctggtgagcctcgccgccaccctcacctctcccgtgtcgctgcgccatggccgccggtggagaccgactgccatgtcctctgccacctctctccctcttctctgtttttctctctttgctgtttcagcacgcacactcagtaggtttcctttacaaaatcaatccacaaattcgcaaaatgcaattcagacaacatctaaaattcaaatggtcatatattgactatttgaactcggaattgactcgttcaaattgctaattttcccttaatcagtaaagaacccattttagtgctttgtttctgcatcttatatggttttaatttatgttttagccctttttctttgcgtatgcagtgtagacgctgcagatccggagagatgctctacctcgaggttgattttgaagattttggtagcgagcaaggcaagtcatgtcattttgatcatattgttgtcctaatttataaaattatgtttatttaaattattgcatttcactttattaaatttccgcgcttatcactgttttatttagccttaccgattctccttgttttagctttattacttgtattattacgatccttgataactctaggaaaataaaactagtgggaactttatgtatgtggtgcttactagtaaatataaggatatgcttaacctcgcttaaatagaaacaattagatgttttccaataattagactttgggaataacttttaaataatggttaatatggtttagtggctgtttaaccttgacatgatatttccccttcaaaattccccaaacatgttttcggctgggcttggggtgcttggtttcgctagtcgcatctcggccgtcataagtaacagtcttcgggcctctgttgcaaagcatattccgtacaaccacctgtctaataggaaaggcttaatgcatcgtctagtacggtcataaacaaggaagacacggatagggatggatgaagcccttgatggggtcgacgtctctggctgtatgctcgggggcatagactgtttgcttgacctagggcacctggtgggggaagtctatgtcggtcctctttgtttagggcggtaccaaacgatgagttatgtcatagcttatgtcatatgccgcggtggcatgtggcacatggcaacatgtgaggaagacgggtttggtgggtaacgatgtacacctctaatctatttgaatagccacgccctcggttatgggcaaaccaagcaatgtaccctagttagagtttaattctattgaaatttgaataattggagttatcactttttggcctgcataaaggcaagatcgcgttggagcgcggcttgataataattgactagagataggttcgtgttttattcaaatacagttaaatatttacatgctttgaaataatagttttctgcaaaataacgttataaatgaattctttgtactcacttgcattatatttgcattttcccggcatggcttgcaaagtatggtggttgtactcagccttgctccattttcccccttccagcagaggaatactttggagatgatggctttgatgtctagctcgtgcctgccatcaagcgcctgtggtggcccaacatagctttcggcttttatcgtttatcttttagtgttggaactttggttgccaatgtaataaagtactctatttatgcttttgcttatatactttgttatttaccaactttgtaatgtgtaccttgcctcataggacaaggatttatgcactcacaaacggaatatagtgttctattttccgagcgtgacaaaatgccatcatctacttctagcaaggtacctagaaattgcaaggtaagtaagcgagaaccattgcttaattaccacagcaaatttctcccatcctaaagcattccaaacaatgtagaaatcaacatctatacctattttctaaagaagttctgggtcgtatgctcttgtgtgagcaaacggccgatccttgagcatatgataggcttgcatttcccgctcacctttgaggttgaggtctgagtcgctaagcagtcttggcaaagcgtctgcttcctccaacgagacctcgatgaaagaaagtgcactcgactcttcttggtgatggcttgattgacagcttgaccaattattaaacaagtgcgtgattcgtctcttcatgcctgcagacaaaatgagcaagagcacaagacaaactcgagcgggggttaagctagtaacaaggattaattctacccgccagttagccttgcaccaaagccactcgtagatgctaaaaatgtaatcaaaatgcaggaaataaacttgagaccaactcctctaggtttgagatgaatttgagagcgcgagagagtgtgtgagagagtgaaactatgttgaatttggggtgaactctcctccaccagccaattcctttttatagaggccccaaaacggctagaactaacatgtgggacctactagccgttgcccctgaaagtgccacaactgaccgttgcctggccggtttggccgaacaaggcctggtaggcccaactgggcccacttttggccgttggctcccaacgataagttgagtgggagccacgttcaatttggccaaaattttattttatttttgctcaaaatttgatttttataaatttgtctcaaatttattcctaatgcaaaattttgaaaaaataaacatgttttgatgcaaaaggcaaatatgagatacataccaaattacctattggcaagggcaacgtcgtttttagtccgacgagcaagaccatacctccatcatgcttagcttgatgatgcggcaccctgctccggaggtgagagagtgggtgtcgatttcttcacttgctagtcattttacgtcttgggtgcatcctgtggcttcttggcggctggtgtcacaggctttttagcttgcgttcttgatgccacctttggatctggacggtgcctgcccatcgcttccttctccaggaagttcttcatgaatgcaatgaggctatccgtctttgagggtttaacttcgacctctcggatattttgtggatttggcccgtacttgatcttcaccatagagcattgttctattctcggtcggaattcgaacttctcctcctttccattgaggtcgagccggatttctccagctcctacatcaatgttggcttccacgatgcttaagaacggacgccccaagatgagcggcgtctccttgtcagagtttatgtctaagaccacaaagtccaccaggatgaagaaatcccgaatttttactagggcatcctcagcaatacctgctgggtaacggaccgaggaatcggctagctagagccgcatcagtgttggtgcgaacactgtgtagttcaatttgtcgaagacatccttggttatgacactcacgcttgcttcaaggtcgcacaaggcctgttcgtgggacaccccagatctttcttcttctccggaagttggaggagtatagcattgctacactcctccattagtttcaccacttccgcggttggcatcggtcgcttgttgttgagaatgtcctttagatagcaaccgtacatgggtacttgcatcgcatccaaaataggtatgttgatgtggatcttttggatcgcttcaataaagcgagcgaattgctcatcgatggatggcttccggttatgctgggggaatggcagcaggttggtgtcgcagtactcctgcggcgcagccttctcccgctgaattgtctcttcttctccatttgtgttagatggtgaagcctccttattgttctttcttgttcctgcagtgttaggatgtggctggtcgcgagtggattttcctccccttgtggttatcattaaagttctctagagagggctcaggttgccctggaatcctcctagattcattagcagggacaagagtagccatctgagctagttgagtttctagcattttgttaaaacttagctggttttgaaaagcagaggcaaagccatctaacttgttgacggtccttaaatcataatatctgaccatcaatacttgcatataacgaaataaaatatatggtatccaacttagtggtaggtattattactaatcatttccactagtgttggtgaaatataagtatgcatgcatattaaggagaaaacacgtctgtcatgcaacaaaatacacctccggacaatcatgatacatttacatggattggaggacccacatgtcaatcaaaaccacttagaattgggccaaatcatagtacatgatgttgggtgcccattaagcaacctcctagccaaaagagagaccgggaggtggatttttgggttcggccgaacccgttcacctccatgtgtacactcctgattttttcccaatgatcgttggagggtgttttggacaattcccatagttgtaaccgtcatatggagactataaaaggagaagctcacttcacttcaaaacacacaactttgagctaaatcaagaggctctattgtatcttttgtatattagaaaataggtagagtgaggggaagctctggatgagtgcccggaagtttggtgctctctccgacttctacctcgacgagtgtagctttctaggaggaattctagaggagtaccggagctgtcggtacactctactccgggttcggagaaacttcttctattaagtaagcattcgggatcctttcttatgttatttaattaatgagaaaatccatgaaatgccatcaacaaacacccttatcctagaaatgccatcgacaagtgcaacttcccaaaaataccattgtacaagcatatttcttccaaaaatgccatcaccgtcaacatcccgttgattccacaccattacaaccgttatgtttttttacaaagaccaaatttccctcactcacaaatatacatacccagtatttcacggtaaaagggaaaagggagatgaaatggtgaaaatccctaacactagacccgatccaggcggctctcccggtgacagcgcacctctcttggtcggcgactgctgcgagaaggtgatccacagcggtggcgccgcaatgcccggtggcggcgcggtggtccaaggaggtgtcggcggtgacgcggggcgcggagaggaggttgcagcgccaacgcggaggagccgcaggcgtcggcatggggtccgcaggcgccggcgaggaggaggcgcgcaccggtcttcgccgccgcttcagcgtcatcgtcgcccggctgaacctgtccgccccgagccaagccactacg

SEQ ID NO: 42477 - DNA, 10199 bp, Oryza sativa
  unsure (1)..(10199): unsure at all n locations
cgatgttgtgcatcaacttggctaggcatatgctaggtgagtttttttttcccgatgtcaataatgccactacatagtaatcctacggatattaccttagatattaaatttaatctttaataattatattgcacatacaatttacattcaattaccttaagatttttttcgttttctttaccttctcaaatatcaaccgaaataataatttttacatccagtttaattgacttcaagttattaattattataataaaaatataaatatgcttatacaaatccacactagtatattgtcaaaataattacttaaattgaatctatatagaaaatgctccaaataattaagttgtcgcataatttcttagtttattgtattaaaatcgtacctaccttgcaagttgttacatttatacgatcacttataaagttcttatactaaattacacatatttgccaagttgttgccactagaatgctcatttctcaagttcttgcaccaaattacacccacctgccaagttgatgcaccgtgggtgcaatttactctatagataaaaagaaaaattaattgcacagtttgcatgtaaatcgtaaaacgaatcttttgagtctaattaattagccataaaagtactacagtaacccatatgtgctaatgacggcttaattaggctcaaaagattcgtctcgtggtttctagacgagttatgaaattagtttttttcatccgtgtcaaaaaaaaccccttctaacatccggttaaacgtctgacgtaacataaaaaaaaaatatttcaccaactaaacagatcctaagtcacatagggggcatttgatacgcatttttttttgtttaggtagtactccctccttccctaaatatttgacgccgttgacttttttaaacatgtttaaccgttcatcttattaaaaacttctgtgaaatctgtaaagctatatgtatacataaaagtatttttaacaataaattaaatgataggaaaataattaataattacttaaattttttgaataagacaaacggtcaaatatttttaaaaaagtcaacggcgtcaaacattttgggatggagggagtactctactagtatttctctatgttttagtgcagccttacagcgaacagttagaaataaaaaaaaagaacaaaaaagcagacgagaatagtagtagtactactagcgcgtaggaaaggaaagtgcagctttcccgcgagcccatgaccactcgtttcccagttcccacatccacttccacgcgagcgcggagagcagtgtgagcagtgcgcagcgaagatggctatagagtagagaccgcgaccatttaggagcgcgtgcgcggcggacacaggggccggtgggagcgacctccggcggcgcaggatggaggcgaggatggcatcgagggcaaggcccaaatcccaccgacgagcaaacccccgctgctcgactgctccatccgtcgctcagcctcaacatccagatcgtcgagctcagttttctctctcccccgtccctctctctcgcctcaccttagcagcgcatatctaatcggagcaggccgcatagatgcaggcgccagcggcgtggatcgaggcagggcggccgcacggtgagtacgaggttttttgttgcgatttttttctccaataatccggactcttccagataaggtcacacgttttgtaaaaaacccctcttgaaaattgcaatttacatttagatccgccagatgatttttgaccgtcgatgtaccatctaacggctgtgggaggggtgcgaaacgtggcgcatcttcagccgagaatgccgatggagctcaacacgcgatgccacgtggcccaatgggatgcttgggatcggaccctgaaatcgatttataagatatggcacggccccaaaaagagtaaggaaaaatagacttattgtagctatgtataagacgcggttcaaagatgagggacacaaaatagacttattgttatcccacccaaagaggagggaggtgaaatagacttatctcaaagaagcacaagctgccgacctgccgtgccttcgggccggcccggcacaacccgacttgggcggcaagggggctgcatgtaaattttcgccatcctcggtggccagctgtaaagcgagggccaacgaccatctgccacgtcggataaatcgtccactagactcccagagggcaatggggactagatttgtaaatttttcaaatagaaaattatttttgtaaatattttaatagatatgaaaaagtccaaatacccccctaaactttagatagaagtccgtctagaaccctaaactttaaaaccggacatccaaccccctaaacattacaaaaccgttcaaattaccccctacggtggttttggatggtgtttttgcatattttaaaagtttaaatgaacagctttaaataactaatataacatatttgcatatcatcagttgtaagtcattaatttatacttatacagggatattgtcgacggggatacccgtagaccggatatagatgatagtggggtccattgatacgaggatctacgtaatacgacatcaagcaaacagaatacaaggattatactggttcaggcaccttggaaggtaatagccctaatccagttggtatgggattatatgatagaaaccacagattacaaagggaatagcagaactcgatgatactgacgagagcgtagttgagttggttcaactagatctcttggcgacttggctcctgcacgctccggctccgtaggctgtgaggtgtatgtgttggcagcaatattcgatgccttaggtcctgtccagggggtcccttatataccgcgggtcagttgatctccaagtaggactcgaagatatcgaacccctcacgatatggtaaagacccagtctcgtccgagtaggactcctcccatccgtatattttgtttctatcacgtgatagatttcctcatcgtatatggaaactatccgtatacgcgcgggtatgccatatcgatacccaccgtacatccaaggatagagagtataccttatccataaccctgacagatatcatactattattatgttggtacttgtttgtaagtgagagctaacaactagtaaaagaaagatttaagtgaagattttaatacatatgtccaatgtgtatgttacgtgatcaaactcatccaatttatatacaaattagataaaaaccactgtacaaaaccaccttagggggtaatacgtacggttttacaaagtttagggagttgggtgtccggttttaaaattcagggtgctagacagatttatatctaaagtttagagggtatttagactttttcctaataaataaaaataaaaaattctacgaaatacgaatcagcagcaagcggcaacggtgaaaacaaatcgtaagtactagcccagcatgggattggcccttccaacatttcatcttcctaggctcttgggtctgttaattatttcctcagtttcaggttataaaataggattgtccatattcatatactttctccgtttcataatgtaagttgttctaacattttctgtatttatatttatgtcaatgaatttagatagatatatatgtctatattcattaacatcaatatggatatgggaaatgctagaatgacttacattgtaaaacggaggaagtatgtgttaatgaatctagacatatatgtgtctagatatatgtctagatttattaacatctatataaatttaggcaatactaaaatatcttataacctaaaacggaggtagtggttgctaattaagtatacacaattagtactaagtgtagattttggggtcctaatttttgggggccctgagcatgtgcacatgttgcaccggcctatgcatgggcctgtatagtacagtagtagatctcgggaactttttaagtatttttgacaaacgaaatatgtggaatctaatttagtgcgttcatatgaaatcttctagtcattacgaactgaaaaaaaagttaaaaatgtgagtgaaagtaagcaggcaagttctaaacaacagtggtcaaaacataggcctactaatgggcttggatgtctggcccaggatgttgggcccagccagcccaagtatgcaaaatatgactagttcactttagatcagattcaggccatgatagtatactttctatacaggtggtatccactgacttctaaaactcaacatgtaacataatgtaagtataccacatcattacccactagcaattattatctagaatattttagatctcatgaaaacatgacatatcatatcatttgtaattttattgtatttttagaactcagcatgcaagcaatatcaattcactatcttcacatcattttcacattatttaaacatatacgtctatcattttaataatgtataccatacattcatccatatatcccatagcaaaacgcggggtatcaagtagttttcttattagaacaagtttaatagtatagccaactattggcttcaaatcatctatagtcaatttaatagccaatttatataatagttacctataaatatatactacataattaatgtctagtctcacttatcatacacacatgtatcttgaagtctgtgctgcagttggctacaaatctatagcccgctgctcttatctctcatcttttatctccttaaaatatatttatagctagcttatagtctactattgtacctgctcccattgattgaagtccacacaactacttttttattacttgataaatccacacacacatcatactccataaatgcaagtacactccctttaacatatttcggaggaggcatgcatcgttgtatccataaatctcacttaatttataatgcaagtgtatcggcgtgcaaaatttgtaggcaccatagtttaagttttgatgggtaaattcatgcatacacaactccctcacaacaccctctagtacttcccctacatgttctgtattttggtgtgtagtgttcttctcctacggcctattggtgctttggtgctggaaatggtgatgcctagcaggaaatctggacaatttgtttaactagtcagcaccccacgcgttgtgccggggaaaaaggagatctaaatttaattcacatccaagtatttcaaattggcatatggtaaggtctatttgaattatgtaaattgagaaagaaaaacggacaccaaatattaagcatggcacatgaaaattcgtaggcaacagtaatgtttcatgaaaccggaaggtacaccagttcttcaattctacacttatgcaacattctaactaatgtttctcaaatgctataccacaaagaaagattgaagcaagagtaggtccacctacttaaaccatagcccatatatatagcccatatatatagctgcatacgtgcgattgagtttgaaataatgaaactacaactgtttttccttctattactgtcaggtcggcaaaagggaaataacatggctaatgaaaagtagtgttttctgaaaaggatagtttccaatggaatctgtacaaatattattatgcaaaggattgttttctggaagtaaagaaaccggtcaggacacatgtaaatagatgcatcaagacacgatacgtcttagaaaggtttgtctattagctcttgaataaaaagtgaagaatgtgtttgatagaaatgattttgcaggcggattgttcttcatgtacctgtggaaaacagaactggttagacatgtcaaaaatgccacaaaaattagcttacaacagaacatgggaacaaccattttttttatggacactggcatttgaccattacaatttgtggagcaaatcaacacatgaaaaatctctatgatcaaataaattcatatgaaatatacatgaaaccaagaatgcaggttgtaaggtgaacaaatgcacatgtgcccaagaatacagtataacaccgccacaaaaattttccctatatcagaaagcctaaaggtacactgcaacagtaaagagagaataactctaggcattatgttgatacacattcgggtccagctgaatcatctaggcaaataaaaagaatacacagctcattgttatcagttgtaaaatctaggcctaacttttatataagcaaaagcaaaaaaagaaaattaaaggcaagtaaaatcgatggatagttttaattactcgaggccacaaccaagttcactgagctaaccaacaacaaatacttgtagatactatgtatgtacatacatatgttatcatatataggacatgagcgtccagccaatttagcttctagatatttcaaagagttctctttttttatacgatatttcaaagagttctagacagctgatgctgaaccatgattagggtcatgcatcttgcttgtaagattattgcaacgaaaatgaaagcttctgaataattccgaaatctgcaagtacttaacgaaatgatataataacaaagctgtgtacctttgtttggttttagtataattggcggggttgttcacagagtcagtggacaaaaaaaatatatagcagaacacagctgcttatccaaatgagattttgatgactggaaaatagcttctgagcaatacaatgctgcagcgcaaaagaacagaccactcttcaataaatttaccttgtaaacaatgaatgcaaatcatggattgtagagtaaaggatggtgaaaaaaggcataccaaaccaagcattgtcatgggtcgaagcaaatgttagatgtgataggagggattaattttttttcagcagagaataaccaagctggagatggctgcatatccagcagcatgccattggaggagcgcagatggctggacagccacacacctaaatcaagcttagacctaatccatgacggagatgatgggggagatcacagagtagaaccatatctagagacattggttagtggagctgactctgtcatgcacattggccatcacacttgctctattccatacccaaaccctaaccgcagatcgcaaccctaaccacagtggcaactcatattgtgtatgttttacaattaatctatacagattggccattagcaaaaacaaatagaaattaaggtttactgttccatgacccagaactgacgattttatagccaatcctggagatatgagagttcagtattttcgcaaacttgccattaattagcatcaatctattttatagccaccaataataaaaggaaaatagatccacggtttaaccttgatgaagagcatgccatatacagtaatgaagagcatgcatatcccacactattacaaataacaacatgtaatttgaacagaatgaaatagtctgtaatttcctaaagcatgctaagtaatatagcatcagcatataacagcatgagaaagttgaaattacccggactagtggtcatagaagcatcagtgaaagtggcatcacatattcatttatgttagctaaggtccaatgtttgcctcacattgtggtatctgccatgtgcccatgcctgaaaacgaaaatggatgaatgtagtcagtgagatgctgctaaatacaaatattgcctcatgcaaaaaaatatatgctatagtttaaccgaatactaatttatatgataaaaaatagagtagggaaggtcatttatcaaaacaactaaataatgatcatgcataggaatataacgactaaacaacaaataagacatcccaaggaactacccaaaaaactgaaataatatcaggcaataacagttaacaggtagagaaaccctgaagagcaattgccaaccagctggaagccttgaacctgaaatatgaagggcataggaattagcaaacgaagccactcaaagaagcaagaacactattagaaacctataaaggtgaagaagatgtaacaatgtaaaatacctttcatggctttgataataataactgcatgcagcacccaccaaaagtatggtccaacattgttaatattatgataggatactctgcattcagatcaattggagaacacatctcaataacatatggatttagaatataataaattaacatgtcaatataaataattttgatgttgaactcatagagtatcctataagaaactttgatgttgaactcatagagtatcctatgaatataaataggttgtttccctatttttagctgcataagcaactgatagagaggattttgacattaaactcataaatccttccctaagaaatgtgccatcacttgccatataattttgcttgtctgatgcaccctgcatacattctatgatcatatatagacataaaaggctaatgaattaccttcagtcacttactcattgtactttgagatacaggccgatcaatgcaacaaacatttgctcaatcaagttaattaacatgtaaagcaaggcagaatgggtatgtatatccaagtggtgtatatgtatttgcaggaaaaggtagtaacgtacatatgtgatcctttcgtttgtgcttccaagaatcagtgaatgtgggcgacgaagcggcgcaagggagagatgtggaagaatcagtgaatcgatgttaccgatcgatgggacctctactgcactgtagagggggcgcgggctggctgtcgtcgagccgttcctgcagtcgagccgccgccgccgccttcgagctgctgctcccgcagtcgagccgctgccgcagccttcgatctgctgctgccgccttcaagccgccaccgccgccaccgcctcccaaggccagatccggcgaccttaaggccggatctggcgaggaggggcacggagcggccgtcgtcaagccgccgccggtgccgtcgagctgcagatggggagggagagcggcggagctggggaggaacagagcggtgaaggcggagcttcgggagccggcagccagcgagggggggcagcgcggaggaaggcccgccacgcattgtcgtcgccgccctccactcgggcctccgcggcgcccagcgccgtcgcctccgtttgacccacctctggcgccgccgccgtttgggctgcctcgtcacccggcgtcgtcgcctccgctcaaaccgccttcggcgccactgtcgctcgagccgggcggcccccaccgtttgcaccaccccgtcgcccgacgctgtcgcctccgctcgacctgcctctagcgccgccgcctccgcggcggcgcaaaatagtcctgaccccctccggattagttcgctccaacagccgtgcctcggtgagttcgccgtccggccatcatcccctcagttggcgacggctccgtggagcaaccgaagaggagcagcggctgcacaaaaggggatcgggagaggggcttttaactatttgccactcttacggatgttgcttaatgatttgccactaggcccacatgtcatagacacatgagggcccacatgtcattgacagggtgtggcaaatcgttaattgccatgtcacaagagtggcaaatagttaaatttcccatcgggagagggcaaaggaaggaggagtccatggagaagaaaccacacggcagggcagaactggtagagggagatagagggactggatcctgtcacgtggcagatcggacggactaagaaacctgcatttgctgttgattgtaaaacagaaaaagggcaaatgttgtagggaaaaacattaggttttacttcctctatttcacaatgtaagtcattctagtatttcccacgtatatatgtctagattcattaacaccaatataaatgtggtaaatgatagaatgacttacattgtgaaatggggggaatatatgattagttaattgagttatagttttggttgagctagaagtaaaaaacggaacaaaagttttccaatacaatatcctccatttcaatttgcagaggatatatggctgtgagcccctgactcgttttcttcggacacctaaaatccgaaagctgacatttttttttcggttgtcttcatttgctatgctacacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42478 - DNA, 12726 bp, Oryza sativa
tccgttcctgattttaataccactagactgctattacatatctcatttgaccaaattaatacaagctcaaatgcgattattgcacatgacacaaaattaaagcccttttagtttgttcatctgcaattttgtttgctcatgaactgtaaatttatctacggttttacttttaacctcaaagttttgtgttgctgctttttctgctcgtgagctcccggctttttattggtttgtcggtgtaaagatcaatcatctttcgacaaagctcccaacaaacggtacaatcttcgtttcacctagggagtatagactctactctacctgttactaaatataaatatgtacaggaatcaaatacataatataaatatttctgagacattgactccattatacaggaatccaaatatttttaggcaatcaggtgctcagtagagaaatccaagcaactcaaaactcaaaattaatcaataagataaatgcaatgaaatcttttctatctatcttaacgtttgccactgagagaggtagctaggtgggtacgtctgtacccccaaaatgttttacacaatactagtatataattttaatactgcaaaaatgtacttataattcatacacaaataagagctattcaagaaaattaaaaagtcatttgcatgaagaaagatttcaactttcacaaatcaatacaatatatattagtttgataatttattgataaatatcactattttcttatagcgccaccaaatcagagtttgaacccatgacgaaaatcctggctccgccacttatttttactactacaaaataacctataacctaaaagtttatatttaacacagtagctgctgaaggagtaattaccaccctgactgaagactccttgtgatcatctgctccaatgtgttttcaatgcggccaacctagtcgtagacactcctagctaggttcaccacttcaatgaacatctttgacagagagagagggccgtgtttagttcacccccaacttttaactttccatcacatcacatcacatctaaaactttcttacacatataaatttttaacttgtttttttaaactttcaactttccctaaatttttagcttttttcagagactaaacacagccagagtagtagtaaatgcgagcggcagtgaagagggcagtcgcaagtagcagcagtaatgaaaggcgtttccaagaggaaaaggatgaacccgtggatgcaatcactcatgagatgagcaacgtagggccgtcgtcaatgaatgtcctttttctccaagtcgccaactgttttctgctccatcgcctccgatccggggaagacagtacagtacagtacagtatagttacagtcacaagccgccgcaagatcgtcgtcgtagtagttgttgtttcagtcttcagaggccatgtgagtgtggcccaattcgagttagatgaaaataaaaattaagattaagctgaagtaatagtatgcagacgagaaagtatgagttttaattattacaaacttaaagttgaatttaattgataatttaaagcaatttttatatagaaagttttttaacgaagcgtattgttcagcagtttgaaaatcgtgctatagaaatcgagatataatctgcatctcaatcagaaatgaacgggtaacgggtatatgttactactagatgttaatcgaggatttgtccggacctctgtaaattccgaatgtccttgccggatctattcgtttattcctgctacgtttctaaaattacaattttgaaaaagaaatatttgtacgaaatacattgcttagacccttagttctaaactactcgtccacttcagattatctgtcatcctagtattcagatttttttaatcaaaatatcacgttccaaagcattttttggtgtgaagcttgccaaacaacaaataatctgaaacgaaaggttgtacctggtaggtttataatttactctccccttccacttatatactccatgatgatagttagatcatttttgaactaacaaacgtcgtatataaataaaagaagggagtataatgtttatctattttataaacagatcgatcatctgttagccatcgtcctcatttcaccttagaaaaaacatgcctggaaggaatagactgatcccacgcaaaaaagattaaaagaaaataaaggaaatgggctgatggcctgatgggtagaggaagctgcaccgcaaacctgcacttgtttagcccaatcagacaggtagctgtagctcactccattagtggatagaaataagtccacttggagtcccttaattataaagatccataaccctaaaccgtaataccggatatcttgatccatccaactattaaaaccggtgtaatttgactttctcgatggttttgagagtgcttttcattgacatggcatgttgacctagtccgacttgtgctgacatggcaccctaatcacaaaatggaagtgaggcccacatgtaagtcacaaagaagaaaaaataaaaaattgtagggcacatgtgttagtccccttctccactctctagtctctatcttttccccaaccatagcaatttctcccacatgggcggcgcagctgcgcaaccacgtagctcaagtctggatccggcggcctcgtcctagcatcgtcgccgccgaagaagggggagggatccgccgcagcggtggaggatgtggtcatcaggcgacgatcggcggggagcacagcttgtggtaagagtaagtaggggtgaaaacggtacggaaacggacggaaacaacctttatcgttttcgttttcatatttttttcggaatcggaatcggaaaccccagaaacgaatattatcgaaaccgaaaacggagcgaaaacgaaccggcgcggatacggtaacggaaatttatcagaatacaaaaacccctcaaactgagcttcaaacttttgtcaagtccaattctcaagtctcaacagtcaacaattcatcataaaacacaattatatgaaatcgtcacaacagcaaaatatattcttctataacttcatataatttgcataacaaatatttaaaaaaaaaattacatcaaaacaccctttataagatatatagtatacactattattcagtgctatactgctaatctgctatgagctatcactccatcatcagtacatagttcatcaattgtttcggtcatcacacaacagcagcacacatcaatccatcagtacagtacttggatcaatcacaaaacagctacttgcatttgatgattccatcataaatctacagcacaaaagaaatcaaatcaatggtttaggctcgtcggctcgtcgctgggctgctggctgctgccgctgggctgttggctactgccgctgggctgctggctgctgcgactgcgaggcgaggcgtcgtcggctccttggtgtggctgtggcgtcatcgtcagtggtggtagcggcggtgaaacggtgggacggcgccgcggccgcgagacggcgctacgaaacggcgggacagcgtcgcgagatggcggcggtacgagacggcgaagacggtaggggcgaggtcgcgaggagccgaggacggcggaccagcggtgggcgctagcggtgggcggagcgcaatgcttcgccgccggctcgcggtctcgcaaagttgcgatgccgtgtggctgtctctctcctctagggttagccactatttgggtagatgccgcgatttgggttgggcttaaaacttggggacgagttatagactattgattctatgggcctttttaacttcggaaattccgataatttttccggaatttttccgaccgattccgagttccgacggaaactgctattatcatattcgattccgtttccgagaaaatatttccgttttcgattccgtttctgagaaattccgaaaaaattccgaccggctgattccgtttccgaaaacaggcccggaatccgaaaagtttccgtaccgttttcacccctaagagtaagaagggggcgggcagcctcaccctggcatcgtcgtcaattgaggaggtggagggattagctgaggcggtggaggatgcggtcggtgagtggcagaggatgcggtcggtgagtggcagaggatgcggaaggcaggcagcatagggcgtggtcgtcgagcgacagtcggcggggagcactgccagtggtaggaggaagaaggtacaacttctacagtggccactgctagataacaccgctacgcgaggctcgtgagcactgtggcagccatctgccgccccctcgcctccgaaacatcgtggcggcgggggaaggcaatgctcacactagaggaacatgcggaaaccaatggcaaggggcaacgggatgggtcaagggagagggtgggactcgtcggtggggggaggagaagtagggaggagcagcatgcgtggaagacctcaccagagcacgatagcttcctttttgtgttcgcagatccagtgggatctattctctctagctcatgatagtggacgagctcgaggagacttgccaaccgacggccaccacccaactccatcttctcgtctccgtgcgctagtccctccgtcctcccacctcccatgccacgccaccggcaggcgccacggcattgagctccatgatgacggtgcccatgaccatgctactctaggcgaggggcatgctacggcagtggacttggtgacggagggctcattgtagccgggtgcctagaggactgccctaccgtcgcccgccgttgccccactacatcctgcagatgctatgtagccgagaggaaatatgatgattaaaaggagacataagcaaaggaagagaagagtcactaacacgtggcccccacatgctgactctaacatattggactaggtcaacgcaccacgtcagcaaaaaccattgaaagagtcaaattatactggttttaatagttgggagggtcaaattattcagtattatagtttagggatacgaatcagattggacctgtatttaagggagtcagagtggacttagcggataaccgtttctcgctggatcctgggccatcccggcccggcccaaatatcgattaatttagccaaaatgtggcggcaaacacacacgccgaattacagatagtaatacaaatcacaacattatttgctcggaatgagacaacgaacacgaacgccatgaattgccttagctagatgtcgcgttgcatcttctccagcgacgcaaatgcgatgcagcagcagccgcgccgccctctcgccggcgtcatcttgcccggtcgcttcatcctgtctcgccggaggaacgcaccgtacgtctcgccgtcgtcgtctctgaaccccctgaaacctcctcacgccggcacgcggcgtccgatcgatcgatcgatctatcacgacagcgtccacatgaagaacgccgaccacaccgtcaccgcgacggaggcgagggcgtacacccacacgaagatgacggagcactcgctctcccccacgccgaacagctgcgtgatggtccctgaaccaaaaacacacacaccaagattcagtattaattcttcagttgacatgaagattcaagatgagtggggtaagaattacgatttgccccttcgcgctacagtgccaccttgaaacccacaaaatccctcgtctttttcgtgggttctagggtggtaccgtagaacgaaggggcaaattgcaattcttcgctgctacagggggctggctgtaaatgtgttgcctacgtggaatgccacatcggcggtcagctccggtcaaataagatttggacctactatagtccattaaaccaagatagtagaactaaatgtgcaattttcaagtgtatggatctaagtagcatttgctctcaagtttaaggaccggccatgtattttacgtattcaagattattccattctttctttcctaccaatgttcatcgccggcggcacggcgtactgaagcaataggatgaactggtagaggggatcagggtggatgaggcccaggtgaaccgccgatttgacgagcaaggtgcctagcgaagggagaagaatgtatctgacgacgattacgctcgctatcactgaaggctggacgcttgcttctcctcgtaatcctggaaaaaaagagttaatgtttcaggtcatcagattaatggcattgttcttttcgtcagtaaaatgtactggtatttctgtcaggttgtttagtgtgagaatagtagcatgcttaccattgaggaggttccctcccattatcagtgtgacagatggaattgctcctccactgtgcaggaaaaaaaaacacgtaaaaatgattagagatcggagttaatccaaaaggacaaaatgaagagaaaaaggcagcattatcattgatcaataggatttggaacaccatgaagaatgttcagaaaacaatagaaatgatgtggaggtgttaccctattagatcagctgactcatgaatgacacgaagaggagcgttttctccgataatagcatttctaattagaggcgttcctccaattataaacccaataatctatacaaaatgaaaaatgatactcagcatagttttataacacaatgttaaagtttgtaatactcagcataccacagcaatggttgaaggagcaaagatcttcttgaagtcaattgctccgaacattgatgatacaaatcgcttcgctctctctgacaatgtgacctatgaaaatttaaagtttataattcaacaaattgtcataacaacattgtgcactaaaacagtgtacaacttgaacttgtaaaaggtaaatatttcttccagcattaagagaccttagttttgcttgaaggtacacttgaattggatatcaaagggagtgtgcattgattgttatcgtttgggattgataaattctcttctgacgctgttcctgtactgctccctgaattggatacttttgtatcatttgttcgagcattaccttcatcagccacttttgaagtggctcgcataatgttatacgcgacagtccacagaaagacagcaccaagctgcagcaaatcactgacgattgtgacaccggtgttcttaatcacaattacagctcacaaacataagacagttgcatcgactatctgcagaatattttagatacaaaaaacagatatagccttacagccattgagagtgaagaatacgctaatccataagtgtgacaaacatcaggtgctccaaacgggcttcctttctctttgcaaagagcaggaatgatgatgagaaaaatattgccccaattgcctgcatccaaccaagggaaatgatcaacgttaggcaccggaagaaacaaaacgagggttgtagtattctaaggtgtgattattcaagttcagttagtcctctaaattgtcccattcaatgttatcaagtatcaattgactacagactcttagtaaggtgtaactgtccaagttcagttagtcctctaaagtgtcccattcaatgttggcagaaaatattgtacaaataatgttataaatcctcgacatgttcaatcatgatcttgtcctaagatctcctttttgttacatgtacggttcaagtccagcagaggtggttggttatcagtattatggctagtacaatggtccaacaggactacctgatctataccatctgaaatataaagacagccttgtctgttgtactcatattggctgatttgaattgtgtcaataatggcctagtgggatgctgggacaccttaagattggatcattggactggtactggtaatgacttactgtatacatacaattgattctcagcttttccatttggttatccatgaagaggtaatgtttttgacaatgacacttgcatgatgcgttgcatactcagattgacattgatttgtagtagtactataaactccagaggaataaccaacagaaaataaatataagagttttataactataagtggagctttgcataagcatgagaagctagcacttcataaagcaaagagttttccacactaacatacatgggcccaaacatccacacaataaatatgtatgtgaaggatttgtactatgtttatctactataagggcatgaattttaaaagatatgtgctgtcgatttacaagagcagaggaactcctagttaccagcagaacagcaacccaaaatgaggcctcttagcctagccggtgctctggtgacatgtaccacgatccatccaaggattaacccaaaggtacaagcaagaagaatattcacaggcatgaaccacctgcattgtgggtaaaaagaaaataattgttttatttcagttgttcaatgacagtttggcaaagaaacatgggagacttacaatttagccaagccttccaatgtgattgtttgtgctaaataggtcgcaacaagagatggattaaatacataaaatactatctgcaggcaaaaaagtttatttattcagagatgatgtatggcttgtattagcaaaatatttactacaattttgcacaattgaatttaccccaatcaccacaacttacattgtttagatatttccgtgcatctttgttcagtatgccaacaaaatcagttgccaggaatgatccaacaccagtaaccagaagcatgttcagaaccggcacacatgctgtaataaagagctccaggaggcccatgattgttgtagcttagttcaacaagcagtcactgttccctgtcctgaaaagtaaaaccatcaaacatgctaagtgcatcgcaactaataatagttctcatgtttcatgtcgagaaatgcgtatttgatcgtctaaaagataaacttctaaaataaaaaacgtttttttttgctacaatgatgagaaaggaccattattggaccaaatgtcatgtccatggtacagagattgcaaattgtacaactgttttacttcttccttgtctccaataattctactacatgcgaaaccaaacaagttttacttcttccttgtctccaaggattctactacatgcgaaaccaaacaagaagaagggcgaactaccagtctaccacaaggaagaaaaactaagggctagaggataaataaactaagaagttgattttttttttattttttagagaagggtattttttacccggcatctacatccaaccggatatatgcggccatttaaattaggaacttaaccccgcaaacaacttaatctgaaattcaacccaatctgaaattcgcttctatggagatttgaactcaaaaccttaaggtactgctcaggtcactgcaaccactaggctacaagaagttgatgcagcgaagtatcacaagattagcttttaaaaagagcaggtaactgagattctcccaaaggagaagaacactacaggagcatgtgaaatgagcttcagagtttcagacttcacatggtttcgatccacccctatatcgatatgctcatccatgcaaagtgcaagatcaaaacagctttgaactgagtcaatgcaaagcgcaagatcaaaacaactccaaggagtcagtcaactgtacaaaatactagagctcgactaccttatctctaaacgacttacagaaacagaatcgggagaatagggaggaatcctaaattcctagcctaattcatatggaaacttaattttaacaaactctaacatcaactccaagtgcatgcagctaattcgcacagccgtgcagcaaatgccatcagtagcctgatctgatcgtcgccgacgatggagcttgcactgtactatactatttactgacaaactaaactgtagcttacatctgccaatcatctagctctgactgatgactgatcgaatgagcacactccaatagggagagtactatagctttgactgaagaacaatttttcttcttcttcttcttctttttttttttaaaaaaaaaacagatgcagataggagatagcaacgcgcgcgggcacacgtcggaatcgagatctcctccgggatcatgcggccgaggaggaggtcgacgacgggaggagggcttggaacgcgtaccttagcttcgttcttgctggcctgcacgcgccgccgcaaaaccgccgccgccgccgccaatgaagaagatggagggagatgaagaaattaaagcgcgcgctcgccttcgattccgagagaggagaagagccacctggccgataccggcggagctctgcgccggcggcggaggtggcggcggccgacgattccgtggccgccttttcttctcttcttctccagctcgggctctcgagggtgtggttctgaggcttttctcactgaagattatatatatattgctcgttcgagttcaaagtcgtcgaagcttgtcttgaagtgtgggatcgatctccgcagaaacgtgccgtgtatgcgtgccggtgactcaaggagggttcggcttatctgatacaggtgattattatcttgatatcttgtcatgttttgtcttttattagtattgatattgttgactttttttcatatgaggtttgtccatttgcgtcttattattactccttccgtttttagctagtcaaagttatattaagaaagagattaaaaaatactatatatatgtaatacgaagagaaaatgagaaacttaagttattggactaaaattatattatttagagacaaagatagtagtacaaaagaacaatgtaaatactctatttgtccaaaaaaataataattttatctttaatcataggtgttcaaaaataagatagagtaaaaaaattgtctctggtagctaagtgataggtaagggtgtcctgaaagaataaaatttatcgatttactagtcaagggtagattaaagggacgagagcaaacttattttgggacaaagcgtagatgctaagttatttttgggacagagagtactgtctattttgttgtgacttgttttataattaaatgtattttacatatgacttatattcttattatatattttctttgaataaaatgaatgactaagtgctcattcgaaatgcaagtttgaaaaaacataagaatatcattaacacaaaactatgctatgaatacatatacagaacatgaaaacacaagaatcttcgaatagagattcatcaagcaggatcacaaagctactcaagcgaacaaaggaaatattatttcatcaataaaccttcgaatattttaaattgtataatactatgatatagaattatacatgctagggtgcaaaaatataataatacaacgaactaaaaaaaaagaagtttccaatggagaaagtttgaataataccagaaacgcttagtatcggacgtctgacgtatcgtgaaaaatcggatggacaaactactatccccatatccacttcatatatccattacatgacataatgatctttaaaatatttttttctcctaaactacttatccaatcgatgatatgatcacactattatattttttataattaaatctttacaacaagatatcacatcattacattccgatgaaagaaaagtatatgtttcaatccgttaaaatttaatgtttcagacacgatagcaatatgtttcaacacatgttttcattatgtttcataaaaaaattttaaatgttttgataactgaattttttatttcaccatatataacctaatgtttcataaatgaccgagaaaaagtatgggatgtttacgccactactctctcatgccattcgattggctttctccccacaccatacatgtatgcatgtatttagtgatcttaaaaatactttttcttccaaactatttatgcgatgagtgatttgatcataccgttgaatttgttataattaaatctttacaataagatatcacatgactatattttgatgaaagaaaaacatatgtttcaaacaataagaacttaatgtttcatacgtgatagcaatatgtttcaccatgtattctaattgtgtttcacaaaatttttatatgtttcagaggttgatttttttgtttcaccatgtataacgtaatgttgcaccaacggtcaactgaaacatttgaccgtcctattttttttatatcatcgggcgtccgatttgtagctctctccgaataatactcacaagaagtataactactttggctttaatgggctacaaagcctgaacatgtcaaagcccaaaacttctaccccgaatctttcagaaccggcccagcccacgagcttaacccaaaaagcccacaacagcaggaaccttctagtattctcccgtccagcgcatctggaccgtccatacgacaaccgacggctggatttccctggaaggcctttatatgcgcttccagacgctactcgaagcaggaaacccaccaccgaattcgtccgtactcctcctcctgcttcccctccggcgacggcggcgcagatctccggtaagcctcctccgtctccgtttcccgcgtccgattgcgtatgtcacagcggttagcgtagtagtggtagatttgattcggatttggattgactgttcctctctcggttgtgatggatggattgattgatgttgtatttttgcgtgtcttattatctatctatcgattcttatcaggttggaagttagggtgttcatcttgacacaaaatcatgccgaaat

SEQ ID NO: 42479 - DNA, 7216 bp, Oryza sativa
  unsure (1)..(7216): unsure at all n locations
tgacaacttcgccgaccacatgatcggcaatgtgtatgttcaattcagggaggaggatcaggccgccagagcgctgcaggcgctgacggggcggtactactccggccgtcctatcattgtcgagttctcgccggtgtccgatttccgggaggccacctgccggcaatatgaagagaacagctgcaaccgtggtgggtactgcaacttcatgcacgtcaaggagatcggcagagacctgaggaagaggttgtttgggcacctgcataggtcccggagaagccatagccatggccggagccgcagcccgagcccgtaccattaccggagggactatgatcggaggagctcatcgcggtccagggaccacgacgattactaccgtggaggtagccacgattactaccgtggaggtagccggaggagcagcgagaggcaccgcagcagctacgacagcgatggcagcaggcggcggcacaggtccaggactaggagtcctgtcagggatggtagcgaggagaggagagctcaaattgagcagtggaaccgtgaaagggaggctgcacaagtgtgatctctggattagttgctgtttgcaatggcccatgtttctcatcttgtactggtagccctagattaaattagcatcatatcttatcttaatgatctgagcttggatgtactcgagattttccttactgaacttgaattttctgtcagatgcatgtgttaactgaacctatttggtgttaaattatatttgtactgatggttgtgtgctttcggttttgttcagcattcggtatgtttttgtgcatgtggtcaggactagctgaatggttgagtcaatctcgagtgatcacgatccacaatgcattccccattcggtagtttgctatggggcttgtaatcaggtttacttgcattaaatttggtggcttggtatggatattggcacttggaacaaccaattgttttttgttttcattcaaaggtttcagcacgttgcatcttttaccacctgttagtgagatgaaatgatttacaggtgaaatcattttaagtaatcattcaaatgtagtagtggatcatacaaacgttcaagtatgtgcgtataagcgcggtaaacctaatacgcgggtgaaaagagcgacgtaccagctatatttctgaattttctgatatttcggatcttttcatttgtaacctctgaacttatgtttcgcatattttagcaccgtgagttgttatgatacactgccgaactacacatcttcagcgactaggagcaagctagcagcggcctcgtccatgataccagtatatgtttcctacaactgattgttccactgataggatatattgcctatttctcatatctcagacaaccgaagaacccacaaagaagacatctactgcaaataacaatcatctgaacgaaagagctcgataacagatgacaggaaaaggaaaaagaaaaatcatgaacaaaaggaacatgagaaagaaatcagggagcacaagcatgcacaacagattaacagcactgcaaatactgagcaagctggacatctgacgaaacataatgaaatatttcgtggatggctcaattaaccaatgagtttgttcccgctcacaatttatcagcgattctccgcccaaaaaagctacaggtatagcaaccctcttagaaacctaagaaaccaggggtgggtaagatgtcaacttcctattacatgaacaaaaaaaggtagaaactagatgtagatcaaatctacatcttagcttccttagcagcatcctggtattcagcctcaggagtctggtcaccaccactgctgctgctgctgccgccgccactgccgccaccgccaccttgttgcatgtgctctccaatctttgaaactgccttgtttgcagcctcaagcttctgcttgatcttctccaaatcatcctcagccattgctgctcttagatcagatacagcagactgaatctcattggtgacttcagcaggaaccttgtccttgtactcactgacactcttctcaatgctgtagatcgtggtgtctgcagagttcttcagatcaatcaatgatttcctttcctgatccttctgagaatgtagctcagcctccctcaccatcttctcgatatcactttcagacaaaccgcctgaagactttatagtgatttcttgctctttgccagtggacttgtccttggctgacaccttgacaataccattggcatcgatgtcgaatgtgacctcaatctgaggcatacctcttggggctggtggaataccttcaagctggaactcaccaagaagcttgttgtctgtggccatctccctctcaccctggagcaccttgattccaacctgggtctggttgtctgcagcagtggagaagacctgactcttcttggttggaatggttgtgttccgattaattagccttgtgaagatgcctccaagagtctcaataccaagggagaggggagtgacatccagcaaaaggagctccttcacatcacccctcaagatgccaccctgaatggcagctcccatggcaacagcctcatcaggattgacacccttgcttggtgtcttgttgaatatctgagaaacaatatcctgaacctttggcaccctcgtcataccaccaaccagtagaacctcatcaatgtcttttgcagatacgcctgcatccttcaggcagttcacacaggggatgcgagttctctcaatgagagactgcacaagagactcgaactttgatctggtcaaggtaatattgaagtgttttgcaccagtggcatcagcagtaataaaggggaggttgatttcagtctgcatggttgaggaaagctcgaccttggccttctctgcagcttccctgagcctttgcaaggccaacttatccttgctcagatcaatgttgtcagacttcttaaactcactaaccaggtagtcaagcaatgcaccatcaaagtcctcaccaccaaggaaagtatctccattggttgccttgacctgaaaatggtacaaaaagttatgatcagcacacatgtggtacaaaaagttatgatcagcacacatgttcaacagatatgcttaggtttagagtatatgaacatgcaatgagaaagaaaattacctcaaaaactccattggagatctcaaggattgatacatcaaatgtgccaccacccaagtcaaatacagcaatcagaccctccttgttgttcatcccatatgacagagctgcggcagtgggttcattgataatcctcatcacctctagcccggcaatcctaccagcatccttggtagcctggcgctgagcatcattgaaataagctgggacagtgataacagccttgnanannttttgccaaggaaagcctctgcagtttccttcatcttggtgagaacaaatgcaccaatctggcttggggagtactgctgcccacccatctccacccaagcatcaccattaggtcccctgacaatcttgtaaggcaccatcttcatttccttctgagtctgtgggtcatcaaaagttctaccaatcaagcgcttagacccacggaccgtgttctgggcattggtcactgcctgccgactcgcggttatgccaaccaaaagatcaccattctggttcttggcaacaatggagggtgtcgtccttgcgccttccgcattctcaatcactcgtggtgtctgcacaaacagattcattacttctataacaaagcatggctagttcaatattaaccgaatatatagataccaaactaaaagaatgtaacagtaagtcagaacatcctgttaatcacaaattaattccacacaacaactatattcatcactactatactaaagcatccataattcactaataactgaatgtatcactatccaattaaaagaatatcatgactagtcagaatatcctattaatcacaaattgatccaattcagaatatcctattaatcacaaattgttccaattcaacaactatattgcagttcaagatatgctactgaatcaggcaccaattcaagatatgctactgaatcaggcaccaatcaggcaccaactgttttacaaacaagaaaagataacaaatttcgaatggaacagggaaagaaaaaaaagaccacaccttcccttccataacggagacacacgagttggtcgttcccaaatcgatcccaataacatccgcggcggcaggctttgagctgtacacagagcgaatccaatcaaccacccatcaagcacaaagaagagcagttgagatcgacacaaaagacgactactaaattacctgaacgcacgagccactgatccaagcctggacaacagaggagacgccgccgcgtgacgggccatcggagcctggtcagatcaatcaaacaaacaaaatacattacatgagatcacctcaaccatcgcacgcaggcaaatcaacactacagatcccaaaataatattaccacttcaccaagaaaagaaagaagagcagagaggggtggaacctgagaggcggcggaggcgagggcgtggccggtggacctggccagcctcgacgcgatgagagatccgatggccatggcggcggcggtggtggcggcggaggtggagaggaggaggaggaggcggcggcgagatccggaaaaaccctaggcggggtggcggcgagggcttcgctcttaaacccctcgcgggatgcggctctggcttgcaggaggggaaagaaaggcgcggccaggggcatttccgtcatttcggtggggtcgggttgtgtgactgacggtgggcccgggggtcgggggtcgtggggagaaggttctagaccgcatcttagctctcgataggtggcgaagtcagaataattgtttgaatttgttttttcttcttgcgaaggaatactggtagtagtgtttttcttgatgaagaatgcaacaaaacaaatcaaatgcatctagcgaagtttgatttcaatccgcagatattacggaagaactgaaagaataccctgatcaggttataccgaattcgggtctagccgcttagggtcagatcggtagaaagttgatttttttttttgaaaaaaaatacattttttttggatgctctcaccgaatcgaatagcatgaaaattccgagctctattacatttgcccaatgatgaagatttcaagcaatgcagcccattaaatctcctaggcccagctcaacatttggcccataaattccatgatccatctcactatggccgactttcttgtgctcacttgcaaggcacacgagatgaacctctgctttctgaggcctccaaaccctctcttctctaactgaatttttgtttaccagcattcgagggtctgtttggaaagctgaagattatgaaagaagttgtgattgttagaagcttttccaaacaagatttgctctggtccaataaaaaatatctcgagatacggtacctcacgctaataaatcgtttccgatcattggatctacctggacaggacattgttagatccaacgatcgaaaacgatttggtacctcgaggtaccttttgttggatagaagcaaatctcacccaaattactctgcagctatagaattcagaaaatgaactagaaactagctctttcaaaatctcataagctatttatcaaactgtttctcagaaataaactctccatccgttagttaccgtgctggagttttaagaccataggaattaacacttctcttgaagaagtgctacctgctgctgcatagagcatcagaaatgactgctataaatcacaagcagttttccacggatcaacaggttgagatgaaagcctgaaacggatgcatatacactgagcacaaagctgcatctgaatcctgaatggagcagagcagctgagaatgaggacagaaaacacatttactgaaaaaatgtgtttcagtgacaagttcagtgttcactcctgggtatcaggcatacggtaaacatggggaagccggcaaggttcatcgtctacaaggcctgccttcttgtaggattcgacgctgtcggcgagcgtctcctcaagtttcctaggtttccagcccaactttgtcggtttctccgatgtcaattcgaccttgttgcccacatcaaccaatctgaccaaggaaaaaaaaaacagagagagaggagctgctcaaatcgtgttcatgttttgagcacaaaacacttagggcttgttcccttcgttgagaaaaaaacaacttacaaaactatggtaataccaaattttggtaagttaaagttaggtggtgtatggcctgaggttttggcaaaatttggcaagtagctgcagttacttaaacgagtagctgcagttagggtacatgctcttcatcaaatccaccaaatccttcatgtccatttggtcttgagcacatatgtacctctcacatggccctgacttgtcatacatgatacactagaagtaaagaatcagtgacatcacggacatccactatgggccaaaaattgttgttcataacatcagggcgtcctggattgcaaccaaaaatccaaaactaatttagtcagcgtacaagaggaaatacgtattagaaagctagaaactactccctccgtcctaaaattaattgacttttgtacacgaatctaaacataggatacattcatattcctttacacaaattgatttatcataggacgaagggaggagggtgcctttgagggtgaacctttcatgatgtagaggagaactctgctgctggtgttgagttgcatggtatgcaacagtgggccaaagacaagggcagggcaaactgtaatgacatgcagtccatttttctctgaatattccagggctatctcttcagcttcggtcttggcaaagctgtaccagttctgccaacacaagaatatatttggaggtcaataaattagtccccgaaagataaattaatgctgcacgaagaacagtttaatttgcaatatctgaccttattttctctgcagaactccttgtctgaccagcaagtctcatctctcaccctgtcttgaggccagctcgggtaaagcacacagcaccaatggaggagaccatgacgagtttctgaacaccggaagctgagcaagcctcgagcacatttttggtgcctttcacagcaggaaccatcatct

SEQ ID NO: 42480 - DNA, 2689 bp, Oryza sativa
cgtctcctcgagtttcctaggtttccagcccagcttcttcagcttctctgatgtcaattcaacactggtagttatatccacatcaaccactctgcaaaaataattgtgttcatcttgtgatactgatgcaataacctgatgtcatttcagtttctctgtcatgaataggatagttgatgatgataatgatacaaggcaaattacttggctgtgtagcgtagttagggtacatgctcttcatcaaatccaacaaatccctcatgtccatttgttcttgagaacagatgtatcgctcagatggccctgccttgtcgtacactagaagtaaagcatcggcgacatcgcggacatcgactatgggaaagaatttgttgcttagtgcatcagggcctcctgcgttgcaaccaaaactgatggaatcagtgcaccaatcaccagaacaaacaaaaactgtagaaactataaaccattgagaaaagctagaaaacagataccgtttgcacggtatagttaggcccggtttagttccccaattttttttcccaaaaacatcagatcaaatctttagacacatgcatagattaaagaaaaactaattgcacagtttgcatgaaaatcgcgagacgaatattttaagcctaattaatccataattagccataagtgctatagtaacccacatgtgctaatgatgaattaattaggctcaagagattcgtctcgcggtttccagacgaattatgaaattagttttttcattcatgtccgaaaaccccttccaacatccggtcaaacgtccgatgtaattcctaaaaattttcttttcgagaactaaacagggccttaatagaacctgctccctgcttgcatatgatctgacacatgcattctcacaaatcacaagcaactttccacttctcatacggatagctcgggaagataaaaaatgacgagaagtagggtccatgttgaatatgtgcggatgagatgacatgggccctccggatttccattgatgtccacatataaaatggaccctagcttggcatgcagctacaaaattttttagaaatttgttacgttgtactattgaagcagcaccgatgaggggaaagtcactaaattgtccccttttctttcttattttttgattttgtttttttaagatgaaaccttctaattttcatctcaattaatcggtacctaggtaccaaacatgatactatacctatattactatctttgatatatatctaggtacctagtctgagacccataagtatcatatccgatacaataagtgccatgtttgatacctattggtaccatgttcaatacctacgtacttggtctgatactcgtgggtatcacatccgatacttaggtatcaagtctagtattcgtggataccatatccggtacctaggtatcaggtctgatacctatggtaccatatccgatacctagtaaccaagtcccatacttatggtaccatatttgagacctcaggtctgatacctatggtaccatatctgatacctagtaaccaagtctaatagtacttatggtaccatatttgagacctcaggtctgatacctatggataccatttccgatacctagtaaccaagtccaatacggtaccatatctaggacataattaccatgtcagatacccatgagcaccaacaagtttgatacaaatagacatgatatgtatctccaaatattagtatcatcacatgtatcaatctaggtgactcaacctaattggtcagcctagctctcattccctattttataaaaaaaaagaaataacgaagagcatctatccattacatattggcccgactccatccaagccacctagcacataggcatgtcagagcatgtggcctagctctgtagtcgtcccatctatcaaaattatacatgaagcttgaaagttagggagtgtttagattcaggggtgtaaagttttggcgtgtcacatcgggtattatatagggtgtcgcatggggtgttcgggcactaataaaaaaactaattatagaattcgtcagtaaaccgcgagacgaatttattaagcctaattaatccgtcattagcaaatgtttactgtagcaccacattgtcaaatcatggcgcaattaggcttaaaagattcgtatcgcaatttcctggctaattgtgtaattggtttttgttaatccacatttaatactctatgcatatatccaaacattcgatgtgatgggtgaaaagtttttattttgggaactaaacaaggtctaactatgccgttcggacgggatagcgtgctctagtttctctccattgagaaaagagggtgaggtgaacctttcatgatgtagagcagaactttgctgctggtgttgagtagcacagtctgcaacagtggcccaaagataacgccagggcaaaccgtaatgacatgcagtccatttttctctgaatattccagggccatctcttcagcttcggtcttggcaagacagtaccagttctgccaacacaagaatttgaggttcataaattaatcctagctactattaaccaggaaatccaacgaaaggctaaaagagctttttttcccccttttctttttgcagttgtctgaactctgaagtgttaagctgctatctgtagaacactagtttggcaacat

SEQ ID NO: 42481 - DNA, 2797 bp, Oryza sativa
  unsure (1)..(2797): unsure at all n locations
ttctagcaatcatccctaataactaactgatgaatcaaggaaaaactaacgatagagaaaagcaagagaggccaatttctgacctcattttctttgcatgacttcttgtctgaccagcaagtctcatctatgagcctgtctcgaggcaagctcgggttaaagcaaacagcacagatggatgagaccacgacgagtttctgaacgctcgcagcagagcaagcctcgagcacatttctggtgcctttcacagcaggagccagcatctccttctgaacaatcgtgtttagcaaacataggatcagcagaagaactgcagattgcagagaagtgtgtgtgtaaatggagtatttacctccggatcgaccgtcttgtgttccggcacgggagtggccggatggaagaccccctcgcagccggcgaacgccgccgtcagcgagccgccgtcgagcacgtcggccttgaacaggcgcaggttctccggagcgttctccagctgcttcagaaacgcgttcttgggatcatctgaaaccaggaaaaggataaagaaacccacatacaagaagatgcagcacaagaggatactaggaaagaacagaaaaaataagaactcaagaagagacctgggtcgcggagggtggcgtggacggcgtagccacgggagaggaggagcttgacgagccacgagccggtgaacccgccggcgccggtcacgcacacggggcgccgcggcggcggaggcggaggcgtcatctccggttgccaccacctccgtatccactggaccactgctgcaagcctgcaactgtgcttcgatgtgtccattaagagcaagtttaatggtacagccaagtatgaatctaaatcaggctatattcaatttaatagtcaatttatacaataattatcaataaatatattctacataattaatgtctggtcccacctatcatacactcatgtatattagagtccgtgctgcagctggctataaatttgttggccgctactcttatctctcctcttttacctcctttatagccggcttatagtttgttattgtacctgctctaagcacttgtttaatcagcagactgcttttcccccacctttccgacgatgttcctcgtgttcagcacgtactttttttaacggttaaatgatgtattttttaaaaaatgtttatatgcgaaaattgctttaaaaaatcatattaatttatttttttaaaaaaataataaattaatcataaaaaaaattgtgtcgcttcattttgcgtgggtagaaaatgagttcccaacctcacctcccgaacatagccaaaactcgcgcgtagccgccacgacgagcatattactaagagcaagtttaataggatagccaaccactggctccaaattatctatagccaatttaatagccaatttatataatagttgcctataaacatatactatacaactaatacatgtttccacatatcagagcaagtttaatagtatagcccactactagatccaattcatttatagccaatctaataatcaattcatacaatagttgcttactatactattaatatatggtcccaccagtcatacacatattgcgtcttagagtccgcgctacagctggctacagatctgtagcccgctgctcttctctctcatctttttatctcattaaaatatgtttacagctggctaatagtctgctattgtacctgctctcatacacatgtatctttgagttcgtgctgcagctggctacaaatctgtagcatgttgctcctctctttcctcttatatctcctcaaaatatgtaactgacttataggctgctattgtacttactctaattgtacttgctctaagagtgagtacaataaggtgatataagcgggctatacaagttgccacattaaatttgtgcttgtgtggaagagagatgagaggagagaagtgggctatagatttgtagccagctatgtgaaagaggtgggtggattatacattaatgatttactccctccatctacaaaagttacacctatttcacattctagtttttccaaataagttgttcctatttgtagtctttatgcattaaagacttaaatgaagagataaattaaatgttttattagaacccaagaagtcatctaaatactcattggttgcatgcttgcattcactacttgattttgtaacatccaaggtgatttaattttttcttggtcttggtgtcgaaagtaatatgtgtaacttttgtggatggagggagtagtatgtttctacagctaactattgtatgagcgagttattaaattgactatagatgatgttttaaattttggagctagtagagggctatattattaaacttgatctaataattgaagggcggctggtagaagggcggctggtagtgtgctgagtgctgaacaaatcttatattctaatgctgacagtgcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42482 - DNA, 33758 bp, Oryza sativa
  unsure (1)..(33758): unsure at all n locations
atcttcctatttaactttggttgtgtgtaaaattggaagttggaggtacttaggggtgaactaaacacggcctttggctactttcttaataatcgtttttaactctaaaactttttatattaagaggaagatagtatcaaacagtaaacaaattaaagtttttagaatgaaaaaatctacagacggcgataaggacgatgcaaacgacacgtggtggacaagtttgataaagagtggtggtataaataaagtgcagaactttattcgatttgcaggctaattcttagcaggcactcaatctctcctgcttaggccctcctctttctttttctttttggtaattccaaataattattattcctctagtgactgcaattatttcaaagcatcatggacatgagaaaattcatgtaaatatactccatttactttgccgtgaagatggagcattgcatgggacaagaaaagctagaaattttgggtgcaaaaatgggccatgcctagcaattggtactgcttgtgtttggatctttaggggaataaaagtgctcgacttaatgatgccgtgtcctatttcgatttcgtttcttcatcaaaaattaaatccggatttgttgacctggtccagggttgtggtgccgactttttctttcttttttctttttttgtgtcacctagcaaaatactagaatggctcaggctagaatttccttgtaaattcgttactggaatggtctttgtggtctacacactatgattatgttatgtgtgaggaggaaactacatcaatgatgtttttaggactgcataacttggttggtgattcatcttctttaatttgaagagtattgattttacaaattacagatttattatgtcacaacaacttttccaaaataaaaagaattggtgcgtttgtaggaatctcaagtgccttgtccagttcatacaattacagactccgatggtttcactttaatatttttttggaaaacaaaatgtattggccacacgatttttttttctgttttaattttgaaatcgagagcggatgctcagaaaagcgaatgcctaatgagcatatgaatgtgtaatgcctaatgagcgaaaatcattttaagttttcaaatgatttttagctattcacatcctactattttgaaacatagagcagttactaaaacacatgaatgcgtaatggctagacacatttggttggtacaaataacgggttatgagcttccttctttggtgaatcgataaaatcgaaacgttcatatggcatatatccattcacatactgctattttgaaatagggagagggtaataaaaaatatgtgaatacgtaacggttgcacatatccgattggtacaaagcttatgggttaagagcttccttctttggttatgtaaatcaacaaactgaaagattcaaatgatatataaccattcgcatcccactatattacttcaccattccacccacattcttcatctctcccagcaaattccatttcaatctatgttactacatatctactttgtagtgtcatagaaacctgtggttcactttgcaggggatgttacggagaaatcactaatacaatatttatagacttttctaggtatctcttatctcaccactatataatattattgtatcttgttgttataaccatgtttttatcataactctgctggtcaacaacgatgttagaattatctatgttttacaattattttcataggatctaaggacgagatatagtggtttctaaggaggatatgtgcgactactgctccctatttcattgtcatcattagtattcttggattttttttctcatagtcgtgactttttcatgccatatgatttataattaaatgataaaaatattaaatcatgtgatggtaaaaaatattaaatattacctcctgtatttttacaagcatacaaagtgtacatgtgaaggcatatatatttacatgtaatgacataccagtttaaaacatcaacttatcatgtttttcacctcaatatgaatctgttcaaaacaaaacttcaaaaggcatgctcttttgttttatgagatgttgcaagacagttggcatgtgcttggctggagtttgtgggcagattggaaatggttttggttaggtccatgagcacagtgaaaaacaaacagaacaaaagaggaagataaaaaaaagaagaagaaatacataagcagataaagccaagagcaaaggaaggacacaaagtaaataaaataaagtcccctggggtcaaataaggtagaccctttaccaatgcaatcctgacgtgcttcacctcacctgctcattttttatttcccaaattataaaaccttttcttttttgttccccaaagattacgtgctagtaggggcgttaagaaaaaggaaaagaaagagaaggaaaaaaaaaacggagagagaaaaattggagaggcgggcgagttaggggaatttacgtaggagacaagcgaaatccctaaattttctctcctctcctcgcgagttgttttgagtgagtttctgcgagtgctcttgagcttccatctttccgcataaggctttgcaagctttgctctagcctttttttttttgttcagattattttcttgcggtttgttcttaagtactcgctagtgtccctaatttcctggtaatttcttggtaatttttggctgcttactttgctcgagctgggatctgtgtttcagtgctcacttgctaaatccgaaccaaattaaaccttggattttaaaactccttccagctatttttccgtttttatttgggaaattgtgggtttaccatttcttcctccgattttcttttccattttctcccctcatttgagcttccttctcacccattccaagaaatcaccatccttccgctgtaaaatcgttgaaaaaaaaattgttccacagctttgagcagcgcggggtttatggtggtttttgcagctctcgtcttcttcctcagctcgccttgaaatttcggtccaagaaatcactgagctgagtgagctgctgagctgagcttctgcgagagaaggtgtgggaatgatggaggtgactcaggtgagggcgtcgtcggagatggcgggaggaagggagccgttcgtgctgcccaagagcccgccggcggcggcgcctgcgccgccgccgccgtcgtccggcggcatgcagagcgtgcgcatggcgtacacggcggacggcacgcccatcttcgctccggtgaactccgccccggccccggccccggcggcgacgtacccgcccgcaggaggcaatggcgcggcggctctcgacgccggcgagccggtggtcaagaagaagcgtggccggccaaggaagtacggccccgacggctccatgtcgctggcattggtgcccgtgtccaccgcggcggtggcggcctccgggcctttctcgccggcggctgccgcgaagtcgccggacgccgtgtcgtcggcgccgccgccgggggcgaagaagagggggcggccaaagggctccacgaacaagaagcacgtgccctctttcggaattggagatatcggtatatcactatatctctaaacctataatactattccattttttgctaaattttttgttattttgttatgttcaagaagaggagatgaagttttagaggaaactcatttggtttttcattttgttattgtttgtttagaggataaaaagttactgtcaggagtacttaactctgcacttgctcaggttttgctggctgtttttactagatctgagatgatttactgtatgcagattattggttaagtggttaggaaaccttttcttttgtttctagcatggaagggaacccttctttagtgcaaaatttgaataggaaagtttggttttattttttcagtaatttttgtgccacttcgtggttactctttagctgttacattactgaactatgatttttatgactggtgttttggaatgtgtctttttcacttcttttcgaggtcagtaaatgtgtttgatcattattggttgaattgcaatttgcagggtcagcaggagctggattcacacctcatgttatttttgttaaagctggagaggtaaagcaatgttcagtctttgctttctgtttttttcttttcatccatctacttgcttttggatgcaacataggacatttggttgttgttgattgtgttgctgtcttgatcagattactggtttttattgtcacttgagcacatactaacacctgggcatttttttatcttgtagctattaattccaattaaatgtgtgaaaaaaatatggtctcatgctaacatagttccattttacatttctacgggtgagctgtgtctttatgcatggtgtatgaatggaattctatcttgtgagatcttcagattttttttaactacagtacccattatcttagttattgtactttacatatcacaagattatatgctatagaagcacttggcaagttttggttgtgtgtagatacaaggataagggtgcagaaatcaaatatggacagtcttctaattggaaatgacttgaattctacatttcaggatgtatctgcaaagatcatgtcattctcccagcatggaactcgtggagtatgcgttctgtcagcaaacggcgccatatcaaatgtgacacttcggcaagctgctacttccggtggaacagtaacatacgaggtatgtgcttctgaccgtcagaagatatcgagaaaatctattttcaacatcaaatgcaaccactgcataagctgtaaatactaatacaagagtttgtatatggtaaaactgtgggtgttaatgaattatctagctcgagttttaggtttgtgtagaattaccacagtggaaattcttattcctccgttgaagaataaaccaggaaaccttcttattttctgtgaacagggacgatttgagatactgtcgctgtccggttcattccttctatcagagaatggaggccatcgtagtcgaactggtgggctcagtgtttctctagcaggccctgatggtcgcgtcttgggtggtggagttgctggacttctgacagctgcttcaccagtgcaggtattcccccttacatcaaccataaacttctagaaaatctctctgtatgtaagtttgttagttatagttttatgatcttgtctatttttactaactactatagtatatggtttgctgaaattcattcattgtcttggacttcctttgaagttttttggctttcatgtagttttcgaaaaggaaatattatctgaatgatgctaggtggacatctttggattttttatagaatatttacttttgaagctgtagcttatgtcaggttgttctatcttctaaagtgtgtgacacactactacagaatgaacaattatgtgttacacactatgtataatgaacaattaccattcctgtgtccacagattgtggtgggaagcttcaacaccgaagggaaaaaggggccaaagctgcatgctccttcagacccaatgtctgcaccgctaaagatggtgccgatgagcgggacggggccaagcagcccgccatcaaggggcacattgagtgaatcatcgggcggcccggggagcccgctgaaccaaggtgtcacggccagcaaccatggccagccagggctacccagcttatcctggaagtgagctcctcctcctcatcatcatcagtgaccagaccttggtcccgtctgaccgccgtagaacttgcgaaaggaaatgtcgtggcggtggtactcgaggtactccggtgcgacgccatggatcctaactagcccccctatctagtgtaatgtctgaacctgaatcagggaagaaaactgtagccgttgcatctctagctagctcttctggtgtaggtgctgttactattggagactagactcaatgtgttatttaggtggttaaattgtttttttatcttccagacaccgatgaaaaagctcattgcttctatgtaactatgttggcatgttgcggttagcttgtggctcagttcttttaccttctggtatgctctctctgtgtgaagctgaaaaatgttctgcacatttttcatttttctctgttgctgatgctaacccatttgtcactgtatgtcttgcattgtgtgactgtctgtgaagttgggagatcatgtgttttcggttggcaaggacatgccaacagaagaggcatctcttttatgccgcatctcagatgctgatactttggattctttggaacattagaaattagctcaatttctaccaaaatcctcaaaaatgaaaattttcaaaggaggtcataggtaggatgaaaatagtcacgaaaattctcaaccgaccgactaaagcccgtttcttatttgtacctaccaaaccgtcggaaacggtaaaagaaaaaggaaaatgaaaatggtaaaaatagaaatgaatttatgtggttatattatatagccatgttaaattaaatatgtgattttgattttttgatattttctatttttctaaaccatttctgtttccgagaaaagtatggttactaaaatggtcgaaggacgaagatgttttcccaaccgttttcatcctgctggcttgttgcaagtttacaaagagtacgtgttcacttgatgattacggttttctggaatacgttttctgcgggctttcgcagtcgaaagcgtacggacccaggagagttgctgactcagcagaggctgggctctctcccacgacgaaacgagcggcccacgaaaatttcgccgcgccgcggccgcatcggagccctagcccagccgccggagtccggcgccagcggcggcgaggcggcgaagtgcgggggagggagatgtcggtgcggatcaaggcggtggtggacaggttcgtgaaggagctgcaggaggcgctggacgcggacatccaggatcgcgtcatgaaggagcgggagatgcagagctacatccaggagcgggagcgcgaggtcgccgagcgggaggccgcctggaaggccgagctctcccgccgcgaggtcggtgatgatctgatgttgatgatccccttcctttgcttcccccatcactccaaatccgcccctgttctttcttctttgtttttttttcttttctcagtttttggcttaaaaacaagtcaaacaactaagcggacaaggatgtaatgccttattagattttttttttcagtagtttagctcctatgccgataggaatctgactacactgctaatggtgaagaatttcatttggtggaactgctgccaaatgtgaagaatatgcatatgtagactagagtgtatgagtaggattgccgtattatttatgaataccttctcaaggtttcaatttttaaggatgaataggtttgaatcatgttgtgagagaacaaaatctttcctagataatctagacctgtgggttagttcgtggtacatttgggatctttcctcaatagtcatacctgcttcatcacatgacatgtacagttacatgaattatattatgtcaaccgaagtttattgcatacattttggcttgtttcttctttacatgttttgttggcgttcctattatcatgtcgttttgtctcagtagtcagtatgttaccctcctcctgtccatcgattatggtgtgtcagcaagtcccaaaaatggctgaatcctttcatagttccattcagagactactattgagatataagcaatatggctgtgttggcggattctgatcttaattcatttggataaatgttttgcgtatggaaggctatgttgttggttaagagatttgttaaatgttgttgttctgactgtaataaggtaatcctatttgataggggaaatttaaactcccagtcacttgattcttgcctatccaaaacaatcacttggttccattctggttaattgtcaatttgtcatgccgagtgattttggaccctgtattagtgcagagtgacctgttaccattatatctttgccagattagtagaaataataagttgagaacacattcctctttcagatggtttgaagcttgaacaaacttgttttcacatataagagtgaactatgcttgatgattttactcatatttatttattcgcaaatgaaatgacaaacttgttttgacagatagagtgaactatgcttgacctgcagcatgacttgatccaattgcatgtttcacaggctgagattgcgcggcaagaggcaaggctgaagatggaaaaggagaacttagagaaggaaaagagcgtgctcatgggcactgcttcgaatcaggacaaccaagacggtgccctcgagatcactgttagcggtgaaaagtacaggtgccttcgtttctctaaggcaaagaaatgagatatgaacttaggcatcgagaagtagttgtgtaagacagattcatggtaatggtaaaaccttattttgtttcaaattggattcttttgtacagggaattctgaaacgtgcgtaaactcagtaaaatatccatagtagtttggctacatgcctttcatactttcatatttgtatgcattttgggggtagttcccttaacagctgcaatcaggttaagatcatggaagcttgctttgccagttgatgcctactactaaatcccagctactatgttgttaacaggtgattgccaattagagcagctatatatccgtttatgggtactaattgtctaattggccagaacatagaactagtcttgtgatactgtgtcggtattccagcactctgtagtctggaatcctggctgctgttaagaagctgtcatggcccctcattaccagatgccaacttctgaaatccaaagcattgccgttcataaccaatgatttggaagaacttgttctgatactatattattattattattattattattattcatctcccagccttttttgttcctaacaaagatcaagcccagcaactggcacactaataggtttgatttgatcaggtcaccaaatgcaatcaaacagcctgtacttctgctctttcccagcttgattatacgcatccggaaacaatgccaatatgcctcccatctcggataacaacgccgtgtttagttccaaaataattattcaaactttcaactttttcatcacgtcaaaatttttctacacgcataaacttttaacttttccatcacatcgttctaattttaaccaaacttctaattttgatgtgaactaaactcaacccaaatcttttgttttagcagtagtactaacacggattagagctcacaataaaattattaaactgcctctggtggtggacccacctggcagctggagtagcaccgaacaggtcctcctccccgacgggtgggtcccacatgccagctggtccggaaaaacacatttatgatgatgtgaagagtttataaaatggaaaacacgcgcgcacgagtcggaagaggagaggcgcgtttttggagatgggtgcgatcgcgtaccggaggctgacggcgtgcgagagccggcggcgaggaggaggggacggcacggcggtggcggtggcggtggcggtggcggcggccgccgccgcggcgagggcgtggtgggcggcggtgaggcgggcggcggccgcggggctgtactgcgcggcggggcggcggcggcgcgcagcgaggaggaggctcgccgcgccggcgaggtacgagtacgactcggacagctacgcgcgcaacttcgacgacggggtgtggaaggcggaggagggcgtggtctggagcgccggggcggcggcggcggcggtggcgtcgtcgtcgttggcggcgtgcaggcacgccgcgatcgtgccatgcccagtgaactctgaattgttgatccctctgtaactgtagcttatgcttagcaattggataatttgaactctgaattgttgatccctttgtaaatgtagcttatgcttagcaattggataatttgtttaggattgatttcctggaggatgttaggccagttttgactgcaccgtgtaatgcattttcagtttttcacccaagaaaaaaaattcagttggatggccaaggtttgaaaaatggatggtttatagggaaaaaaataataatgagatttagatttgactatttgagagtacaattttgggcctaaaggccatatcaggaattaatgactggacctgtcattaggctttcttagaccatcatggagggatgtactcacgaactaagaaggtggtgatgtgcacggtagagtccaaaacaacaaactaaacaattaacttatgcacatgtggattattacgaaaataatcttctgagaaaacaagaatttgcttcgcaaacggtggattatgaacatatatgtttctaaaatataaaagattctatatctttttcatagaaaaaaaagtctaagaaatgtcattgacaatcattcaatttcaagaaatgatatcgacgagtgtgagtgtcatgaaatgtcatcgtacaaacaacttgttctataaataccatcatcattaggattccgttggtagccctccgttaagtgctataggatgaatgatgtatttaacaacgcggatggtcgacgatgacatttctgagaaaagtcgcttatacaatgatattttacagaactcatacttatcgattacattttcttgaaattgggtgcttatcactaacatttcttggattttctctttttataaatcaaactattataagtgctaccaggttttgttgagaaaaatattatcatatgctatataaaaaagtaaattatgaaatatatttcacaataattattttcatttaataacataaatattattgttattttctaaatttaatcaaacttaaaatagtttaacttaaacaaacataaaaacccttatatgaaacggacgaattatattataataaacctgcactagagtgagtagtttgggcagtcaattttatcaaatcccaatacaacatgttctcattttacctattttcaattttaataacttcatactttcctaaactccaatgcaatagttattttaaaaataaatttattttgaaataaatgtaacgaacaataattactttaaaataagtttattttaaataaatgtaaagagcaataattgctttaaaaataaatttattttaaataaacataggagctaaaaataaacttattacaggtaggaaagggagtaaggaaggagagtaaaaacggtccatccagctagagagccatccaacccaattccgtcccccttccatttccgcttcctccccacaattcaatcccgccgccgacgccccctcctccgaaatggcgtgacgacctccgccccatcccccaaatccctcacctccgcacttcaaaattccccacctccactgccgctatcctcccgcaacctcaccaaatccggcgaattcccccatcgaccaaaccctaaccctaggtggccggccatgaaggcgtcgatcaagttccgggacgacgaccggccgctggtgcgcgccaaggtgcccgtcggcgtcctcgggctgccgttcctcaccggcgtctcggccggcggcggcggcgactcgcgggatctccgcttcgacctctccaccgccttcgcctccggcccggcgctccgcctctcgtaccgccccaacgacccgctccagcccttcgcgctctccgtccgtaccggcctcggcccgctcgggtcccccgcccgcgcgccgttcgccatatccgccgagttcaacctcctctcctccagcccgccggccttctccctcctcttcaagccccgcatcggcgacttctcgctcgccaactccgtcatctccccgcccgcgtccgcgtccccggccccgccgctgccgccgccgccgccgtcgcacaagctgaccgacctcgccaacggcggcgacgaccacagggcgttctcgttcagcgggaacgggttcgccgcgaacgtggccgccgcggggaagagcggcggcggggtcggcgcgctgctgtccgggatgcgcctcacgaccaggagcgtgctgccgctgtggagcaaggcgagcctgcggttccagtgggggctgcgcgtgccgcccgagctgaaggccgccctcgccgacgacgggtacggccgcaaggcgggtaacctggccatcaacaagttgccgctgctggtcatgaacaagatcacaattgagcacacgctgcggaatcctccacattccgatgccgacaaggggaagaagaaggatgcgccggaatttcagactgaagggttctcgctcgtcaagaggcagctcgaggtgctcaatgcagagagcatcatgctgcggcgtaccgtggaggacctgcgtgccgagatcggtggaaatagagccgcctcaatgcccggtaaaggcgacgcccgaaggatgccgtcgtccctggcaccaccaccaccacaaccattcctggcgaagccagatcgccacgggaacggcaaggagatggtggacagtggaccgaagccggtgtcgaatgaggcgagcgaggagttgaagaaggcactggaggctcgccggaagtgaagaagtatcagaatttgctgaaattgcaaccccctgcaatactgcaacttgacatggctgcttggttaaaattttgcgctcaataatacatttggtaggtgcagtttgcttccccagggaagcaaatggaattctcataaggtgatgtaataatctcgccttattttccaggccgttgcttgtgctagactgctactagtagtattatttatctccaattcgccatgtataaactcgctcttttgttagttgaagtttcagctccattgagatgtatgaaacgctttagttttccagatcatccttattacaatttcaatccatatgatcattatctctgtgcttgtacctttgatcaaagttcctaaacaaaaaattgatgataaacagagtgccagcttttgcattcggcatgaatgaatttgagaatttagggaatactagtttgaaactatgaattctgacgagtggcatgccctgttcgttcaaatctttttcttgtaaccgcacagtgaagacacgggttcagcacggaagcaaggacaggttcattggcgaatcatcaaggaggcccagtcaaacagttcacccgtaccaatccaacgcagccgataatccgggccaaaattattcagatcccacgtgtcagctcacgggctaatccgcatcctgatgaattcttggcatactttataggatcatgcaccttcaggatcaagcattttgttgccgtccgtgtcaaaaaagaaagaaagtgcacggtctgactttgcttagatcgtttacacgtttactgtgaatcaatttttttctaaaaaaaacttactccctctgtaaaaaaaataataataaacctcgtactagaattggacatattacaacgaattggatatagagatatatcctagtataacgaatttgtacataacgagtttattttgggatggaattatagtacaacaaatctggatatgctgagtttttttttatagagagagtactgcgtatcaaatttgcggtttggaattagagcaagaattttctcctataaggccttgttcaatttagaggggattgaataggattgtaggagattgagggagaataatttcacgccacaatagatgtgaaataaatctcctctaatcccttacttatagggattaatggaacaaggcctaacaaataaacacggtttgttgcgacatttgcgtctcatatatagtacgggataatagtatgcgcaatcaggggcaatatggggatcgtacaataaaaagaaaggcagaaggtgggccccagtttgaaaacagcacgctcgccttctccaaaacacccccctgagaaacgcgaaattgtcttttgggtgcgcgaggccgccgcgcgctcgaatcacagaggcagaggctatctatccatcccatccatctctccgagataaaaatcgaacaaagaagcgtgcgcgagcgagagagaagaaaaaggggggaagcagccgccgacgacgagagcacatggcggacggatcggacggccccgacgtgtctccggcggcggcggcggcggcgggaggaggaggtggaggtgagatctgggggacgttggaggagctgctcttggcctgcgccgtgagcaggcacggcacggggagctgggactccgtcgccatggaggtgcagacgcggagccccctcgccgcgcgcccgggcctcacgcccaccagctgccgcctccggttccgccacctccaccgccgcttctccgtcggcggggcggcggaggaggacgacgacgacgaggaggcggaggagggtggccccgacgcctccgccgcggacgggtggatggacgagctccgccgcctccgcgtcgccgagctccgccgcgaggtcgagcgatgcgatctctccatcgggtaaaaaacactaaaacaccagaagaaaaaaaaaatctaatcaccaaattctctttcaaaaagcctctaaaccgcgcgtttcatgagccgtctgatgctgatctctcggtctccaattattgaattcttattaaataaataaataactattttattattattattttcatgtctcagaacgctacagacgaaagtgaagcggctgagagaggagagagaacaaagcatccacggcggcggcggcggcgaggggaagccggagacggcgaacggcgacgagcggctgtcgagcgaggagcccggccggtcgtgcagggagtccaattccacagatctgaaacccgcggcgcgcgccggtgaccatagcgtcaaggcggaggaggaagacgaggacgcggcggcggcgaatcaacaggcctccggcgagtcggtggccgcgtcgaaggagagcagcgacctgcggagctcggccagcctgcgccgccgccgccgctacaagcccggcgccgacgaggacgccgacggcgaggaggcctccgcgctgcggccgccctcgcagtcgccgtcgtcgtcgtcgtcgtcgcagccgctcgccgcgctgctcgacacgttcgccgccaggttcggtcccctgctcgagcggctgcacgaaagccaggtaaaaatgaattttaccgctcatttacaatttaccctttttaccctttgttttttaccgccgccggtcaaaagttaggggaggggtaaagaggggaatttcaaacgatatgtcagagggtgggacccatccgtaattaacgggggtcctctagattattatggattagattagggccacgcatgtggcatgatgacatagcactagcactaatccgaattacgtgaccagaaaaattcgtgtgcgtcatcgcttgcttatgaattcgggttggtttgttgtgtggtaggtaggtgagacgcatgtgcacacctcatattttttgtgtccttcgaacgaacgcgaaagtttcaaatcggattagctcatggtgaatttgaaagttcctagttttttgttcgatttttggtttgaatcattctgcgtggttggttgggtgcagcgtagcaatcagttgggcgggtggggtgccttccagccagatgcccccacagatattttctcctttttttttcctttttctttttcttttttttcattttttttaaaatccacttgcaggagagcgacgcgtaccgtggcgcgatcaggcgccacgtggacatcgagatggtgcggcggaggctggacgcgtcgccggccggtggcggcggcggcggcgccgccgccgccgagttctaccgcgacctcctgctgctctgcgccaacgcgctcgtcttcttcccgcgcgccgggccggagcgcggcgccgccgcggaggcccgcgcgcttgtgtccgcgtcgctccgcctccgcgagccgaagcaggagcctggcaccgccgccgccgccgcggtggcggcggcggccgggtcccctccggctgaggatacgcggagagctgagggcgtcgtctccgtcggcggcggcggcggcggcgctggcatcgtcgggtcgctgatcgagaagggagggaagccgctcatcgtttgccggaagcggagctccatcgcgaaggccgcggcggcggcgaagaaggaggagagcgcggagaagggtgaggccgccgaggaaggggaggggagcgacgacggcgagaagaaggtctccgtgtcggcgtcagcgagcaaggacaaggcgtgggggttgaggacgaagaaaggccgcggccccggcaagaactcggccagcgtcggtggccggaaaatggccaagctctcggaagcgacggaggcagcgaccgacggaagcaagaagcccgacaagaagatcgccgccgacgcagccacgcccgccaagaagcggaacgccgtggacttcctcaaacggctaaaccagggctcgtcgccgtcgaagaagaagaagaaaggctcaccaatggggacacggaagcgtgctgcggcggcgacgtcgccggagcagccgcagaagacgcgtaaggggcccggcaggaaggatgccggccgcggcggctccaagaagggcggcaagagcgccacgccgaagagaagcgtggggcggccaccgtcgaagcgaggtgccgccgccgcaacgacgccgccgccgtcgaagagggccaaggtgaaccggtcggagaagacggcggcgacggcgacggcggcgaagcggggtgggaggaggtagaaatttgccaatttgggggcagtgtagtgtaagctagtagaacagatgtgacctgtagcaagtagcaaaggtggatagttcaaggtatgagtaaattacgtagttttgcgtctgcagcatttggaggctaatgtattgcattccgtagtcgactaactgatcgtctgtctttgtagcaacaccattgatcacttgcaaattgctgtttgaatttgtcgttccccatcaccatgtgtttgaagcaacaccattgatcacttacaaattgatggtttgaattgatcgttacccatcaccagggtctcactctcacatcgtttggtttattcccttctcaatctcaaaattttgggttttttttttgaaagaaaaacaaatcggcttcaacagttccgtatgcccaaaattgaaatccacaaccacattcatatttctcgctctctacgagtttagtcatggttgctccctcccactccatcaatctcaaggtgctaaattttagaaatttttttaaagatcggctccaacagttaccctatgaagaaatttaaaattgaaatccataaccccatgcttctcagctctccacaagttaggcgtgcccgctctccgaaggtgttactgttcgcgggaggggatcggggacaactgcgcccacgcagggatgggagtaggctaacggttttgttggtgtgaaagtcgacctactttttttatttattactggaagataatttttagttatcttataaaggagaatatattcacaccttgagaatgcaattcgttatccttctttaaatgagagaaggaaaaacacaaaatggtgcattgaatgaatgcagttaaaaaaaatgcaacgttgaaatcaagatgagaggaaaagagaaggaaaaaaaaataaatggtgcattcaaagaacacaattcagaaaaaaaaatgcaacgctgaaaaggaaaagaaagttctatgcacaatgcagaaaagaaaatgcaatgctgaaaaggaaaagaaagaaaaaaaatgcaatgctgaaaaggaaaagaaagttaaatgcggtgagcgtggatcgaacacgcgaccttcagatcttcagtctgacnnnnnnnnnnnnnnnnnnnnnnnnnnnnnnngtgccctaagcattaaatatggtctctatagttgtttacctatcacaacctgatcactggaaagcaagatacagtcttcgttttcacgttgcattcaggtggagtttacaaatcctgcactagagagacaagaagattggagatggtggcaaagggtttaacagttttggaatgttaatagtcagattagagttccttcaagtctgttagggggcaaatacagccaccgttatcaccgaaggaaaagcgctctgcgccttgtgacctgaacttttcgcagcctaaagaagaggccctatcagggacatgttcagtacatccacttttggcatgccaaattgccaatgccccatcgatgattttcctttgaccggtgatctacacaggcgcttcacaaacacaatcttcaaaatccaacactttgccagttgttaccaacaagcaacgccgttcctgcccatgtgatcaccagcagaaaccatttgggccccgacagccatatcttctgtcatatacaatgactagttagaataatagttgatagctgtaacaaatttgaggcatcagacaaggacgacacaagtgggtggccagtactacgaaagactgacaaattttcgatcaaaacatactgagtcacatccaaaatttctcaatgtttgggcagaatttgaagttccaggtttcactctttctaattatttggttgtgcattataaaaccaaatatactaatgtggctaatactcatcacccttcaaagatactgttaacagtgcaagtagagtctgccagtaacttaccactttcactatctgatgcatcgtcaagtctggctatagcatcgagtaatgactgctcctggtcctacaaggacaaccatttgacctcacaactctcagacgaaggatatctataaggagcttttctccatcatacataattctgtagaaaactgcataacaacagacaagccaactcacttgcgaaagtttcttggccttttcgatctcacccacatttggattgggtgagatccacctcattttgtgtataacacttaatcttcatcttcatctcacctacataagttttaaacaccaccaaaatctgtatcttattgagaaaagaattttgttcttgcactgcttattatctgatgaatccaattgatctctggatggcagtaactgatcgctaactgaattctggtttgtgtaccttgaggcacatgttgaggcaatctctgcagaatcctgcacggatttgagcggttttattgctgctaacacatgcatgttgaatgcagaacacaagaacgtcctttacatgaagtgaataaacgagaatctgatgcagaagctagcacacgaatttcatggcgatttctatagatatatgcaggtggtcaagttcagtgcagatcatcacagtagcttgcattgctgccaaaaaaaaccctaaaaacccaagaaaatggccaatgcaacagtagtagcctcgtcgtggattccactgctctgcctcgtcgtcgtcgtcctgtccgcctgcaccgccgtctcgtcggcggtggagtgcaacggcgacgaccgcgccgcgctgctgagggtgaaggcgcagctgggcgaccccgtcaggctgtcgtcgtggcggccgtcgaccaactgctgcgcgtgggagcccgccgtgttctgctccggcgagcccggccgcgtcaccgggctggcgctcttctccctcgccggcgtcgccgcgcccgtgccgccggcgctcggcgagctgacggggctcgccgtcctccagatcgcgtccgtccggggcatgtcggggcccatcccgccctccttcgccaacctctcgctgctcgaggacctcgacatcaccggcacctccatctccggcccggtgccggcgtcctacctcgccggcgccaccaacctccgtaccctcgtcatcgccgacagcaggctcgccgggccgatcccgccgtccctcgccggcgaccaccccaacctccggtacctcgacctcagcggcaacttcctcaccggcgccatcccgccggggctggtgcacggcagcttcaggttcttgatcctctcccacaaccagctcaccggcgagataccgcgctgctacggcgacgtggacaccgtcgacctctcgcacaaccgcctcaccggcgacccgtcgccgcacctgttcgggatcgcggcgccggcggccaagatcgacctgtcgtggaacgagctggcgttcgacatgaccggggtgaggttcccgcaccacctcaggtacctcgacctcagccacaaccggatcaccgggaaggtggccaagtcgctgatggacgtcaggctggagcacctcaacgtcagcgacaacgagctctgcggcgagattccggcggggaggttcatggcggcgcacggtgcggattgctacgctcgcaacaggtgcctgtgtggtgccccgctgcctccctgctgcgacggcggcctgtagagtttagagagtagagagtcagagagatggtagagctcgatctacacagtgtgacaggcattgtacgtccattgctgactggctgttgttatatctgaacttgtcgactgcttttgtttctgtgcttttggaagaataattaactatttgccacttggtgctaaattatttaccactggatccacatgtcatagacacatgagggctcacatatcatagacagtgagtgacaaataattaattgctacatcttaaaagcggcaagaagttaaatgtccctttttggaatgatcaattaggataggaaagcccaaacgtggctgttgaaaccgttcgtcgtccgcgaatacttacatagtagactcaccccaacgcggaggctctttcggtggggcatttaactttttaccacttttaagatgtggcaaactggcaattaagaatttgccattcatagtttatgaaatgtgggttcctatatgcctataacatgtgaatccagtgacaaattattaattgccacttgtaggagtgataaatagttaaatatctcccttttggtctctctcaaaaactatgcgactatcttataaagctaccataaattcttttaaaagaaactttcaaatgtaatcataaaaagaataaatttcataaaattacatgtattttgcacaaatctatcacaaaacaaacttatctcacgaaactatagattgagtatctcccttatcacataattataggttttagcctcttgcttgtaaaagatacactttggaaaaacaaatggcatggacatattccacaagatcaatttcaaatcttattctattttgcaaaagaagacgacatgtctgcactctttaactcacacgacatatctgagctctttcacctccctctctcaactcatgctgcacattagtggtctgagttacattgcatcataccgaacacctctctaaccagcaatcacgatcaatgggtatacaattggagcaatacgaaaaaaatatcaaagaaggtccgttccctcctcttcgctcatctacagccagaaataccaatgacacacatctgaaagagtaaatgtactgcaaaacttgaagtatttctctggctactcttcatggatcgcctaaacacaagagatctgcttcaaagaaaaaaaattcaaactagagtgataattgtgatagtttataaaattttgccaaaaaaaactgtgtttaaaagataggagtataccataaaaatgaaaaggaacgtggttcccctacatgtaggcccatggggacattgtaggccggaagcccaatgccctttcagctttgtcggaccctcctcatgggcttcatgaatcatcccccagtaaattcctgtgatcctgtccttcctttcacttcacccccccccccccccccctgcatccgcatgtgaccgtgacgacgacgactgcaaaagaaacgagacgagagattagctagctcctccgtgatttcccctcctctccccactgtcgtcgtgccgaccaaactgacagatcattggagccctcccctcctcctccactgttcgaacacgggcgcgcgcggccacgcgctgccgcagcagcagcagcagcaaacccacaccacttcacgtacgcgtacgtacgcgcgcgcgcgcgtatgatggttggtttgaaaccgggaaagcgaatcggcgatcgcgcgacgagcgcgtctgcaggcgttggcacgaggctgtcggccggcccggcgccagcagacgcggcaggcaggcagacacaccaccaccaccaacaccaccaacgctgccgcttgcctgctttgctcgccactcgcgctcgctcggtcgctgtacctacgtagactcgtacgtacgttctcgatatcttctgcgaggctgttgagtcaggatccaaattcattttcacacggcagtatgtatcgtcatacttttagaggttttacctttatatatatatatatatattgtaagtcgccgttcaacgttgtaatctcatctgatatagtgaagatttgctggctggtatccatggctctctctttcctatcttagaatggtttttcatgttaaatctcgtatcttatgtgattaatctgttgttattcatcgtttatctgccgatcgttcctaacggaggcgagaaagggaaagcacgtcacagcagccagcgccgcccacacccacacccacacgagctgaagctgaagctgctgctgctgcccctgtacctctcgctgcagcatgtttcaattggcatgtcacgatggcaggcaggcaggcagcggcgtaaatgaatgagtgcatctgctgctgccgcggcatgggctcggcagcgcagcgagtgagtgaggaggaagccaccgcccaccggcggcgtctttccgtgcgccggacgcgaccgtcgcaccaccaccagcaccagcagcagcatcgcatgatgcgtcgttggtgcggtgcgcgccttcgctgctgctgctgcctgccggccgcttccctttttctctccaaaagagaacgtttttttttttctttgactcgcatgcgagagggaatcgcgtttggtcgggtgttggagagaagtggttcgttccgttgatattttcatcttccgtgacaggcaggaccatcaactaaccacaccgtatcactgcactgcacatctgtacatcattcacagagaaaatcaccaagaaatagccaaaaaagtggcccataattagcataagttccactacatgcaatttgcaaacagccagtgtacctgcaccagtgcattattacacagtacactggtgtttctgtgtggctgcacaaggtggcccacaggtctgtgatacatgcaataaacccggttttgtagcagcaccaggtattgctcgaaaccatcaccgattcgattcgtccatcgggcagagatggtaactggcttcttacggcacatgcatttggtgggtgtgtaccacctaggggtgaaaacggtaacggtaattaccggccgaccgacgttggttttcgactttctaccggccgagctatatagaaatggtaatcgaccgaaacaaaaatgaaaatggtaaaaaatatggaaatgaaaatgaaaatggttttgctgttataccgatcgtttccgtatttaccgtattctcgcggaaattatcgtttcttataatatggtaattaccgtattctaaatatgtcgatattataggacatgtctatacttgacccatagcttatagattgaatgactcttcaataaaatctctaacttttgtacatggctaaaatgaagttaatttataatttatatagtataagcttgaatttatgtatatatataacatacttatgtaaagttaaatatatgtttttatagtttaatgtttccgtatttgttaccggtttccgatctgtaccgacatgtttccgtccgtattgttccgtttccggttttccgatatttccgatatcgttttcgtttctgactttaccgtttccgatttcgtttccgagaaaaaatatggttacggaaatggttgaggctgttttccgatcgtttctgaccgttttcatccctagtaccaccaaattaagatgccagggttagctactgtttcttcaccgtttcatcgatctcgccctttcaccaaacaagaaaccagcaggtgtatcagcagtgtacatatgtactgagccagggggtgcatttcataatttctgtgtctgtataagttagaactcgccattgtacacacacttgtactcttattacatctcgcagtaaatcatcaatagtttaatagggccagacactggagctctacgaatttcatcctggttgtaacaggaaaaaacctgaaacagagattccactcccaaaaaaaaaagaaagaaagaaagtaagcgagcatcagaaatgctttcactgtgctattgctgtacctgagggccgtacattcctgctgcacgttgttaccaccggcagccaaaccaagcaagcaagcaaactcccatctccatcttttctacttctcctatctctttacagtctctctctctctctctctctatctgcagaaatggtgtagccagttcttcttcctgctgtctcttggttcctctcttttctgtgtgcacaaactcgtgtagtcttgtgcacgatctcaagctctcgactcgatctcgccgccttcttcttgatatctgaatcccctctgttctttctctctctcttgttcatgtcctggttggtggttcttgcctgatagcaatcgtagaatagctcagctagctagtctctgaagatctctttgctgcaaactgaaaccctcttattaatcccggaggaaaaggcttgtcgagggaagttttcggattgccagacatcataacaggtcagtacatatttttgttcttgttcttgatcgttcttctgatttccaatctctacttacctagttagtactcgggatgctcatgctcttgaggtagttatgactttggattgaagttctagacagtggatagaagattacaggacatgaatgagtctgttcacatggttcttgcctttgtgttaggttgttccaaacttccaatagtatttctgtggttggttctccttttgtatccatcaaacaaacttcttttcccactgtaataataactggctcaaatctttcaccccacaagcctcaaacatgtgatgcttataggcttgcagcttttagctgtaagaatcagttcttcgtattctttcacacgagcatagatgcaaatctagtcagctatttgagtttgtgagttgtgactagttgaaactagcagcacacatattacagataagtagagagagaaaaaatatatcctaacttcgatttgtttatcatattattttgcagttaccaacttaaacatcaccaccacctcatcccctgtttgtttggttcgcctggatgggaaggccgaggggtgggaaaggcaggaaatccaccgaagctgcgaaagccgacgatggcagcagcagcggcggcggcggcgaggaggtgatcccggcgtacaagaggaggggaaggccacaacaacagaagcatcaccacctcaaggacgaccacgccgccggcgacgacgaggacgaagacgacgacagcgtcgccaagaccgaggaggaggaggaggaggaagaacacgacgacatcgccaagatcgacgacgacgccgcgaagacgacggcggcggcggcggcggcgccacaagccagcaaggcggggtcgtccaaggccgcagctcagaacccggggaggaagaggcggcggcagctgaagcgcggctccgacaacagcaacagcaacagcgcctccgccattgagcggcgccggaggaaggacggcggcgagccgtcgtcgtcgcggcagcagaacgggttccggcaacacgggagccggcggaagaactccacgccgcggagagccgccgaggccggagtggggtgcaagtgatggaagtttctgaaatctttgatcggtgatcaccatttgttacatgtagatgaagttgtccatggtgacatctctgcattagcgcacaccaacatgctagtactatgtatgtatggcttgtgagaatgtgtgcgaatgataagctgcctaatggcagtaggtagttatatatattatagcacctagtttgtttactagcggtttagcctaaaattcagtagcttagtcctagtgtttaagattttttgacagtatgaattaaagagactttgatgtcagacaatactatattaaatggtaagtactagtgtactccctccgtcctagtataatatagcaacctattaccggatgtgacattttataatacaacgaatctagacaagaagcatgttcaaattcattgtactataaagtgtcttatccggtattagattactatagggactacctatatatttgtcgacaaatttttccccaaaaatttgacagatgtaattatagtacaatcgtagtgtaattacactgtaacttatatgtaattacactgtaacttacacgtaactacagtgtaacatatatgtaagtttcacataattttgaatcgttagatctattacaagatttattttggtgaggaagaaaacaaatcatagcacacacatgtgtgaaagaatttgttcccacgatctccattttaccgaaataacatgttacggagagatttttgaaagttaaatacaagttacactatagttacagtgtaattacatgtaagttacagtgtaattacattacgattgtcctataattacatctgtcaaatttttggggaaaaatttgtcgacaaatatatagcaaaatcgttactatattataggacggaggaagtatcaattaatttcggaaatgctaaacaccggtatcccgtttgggcacggtcgggacgggacagattttctaggaatcaccagaaatcatcacgagcttatccgagtcccgctctcaacagagacacaacgtttcttgtgcttatccgagtcccccactcacagttctctcaccgtgggcatggcgcgtgagatctcgctggcgccgacggcggcggttgcggcggtggagccggcggcggcacctgctcgcgtgtaacgctccgcttttcgtgagtcattaaaaactaactcggcaaaatcctaattgcgaaaatttccgttctttgtgtgagagtctaaattgtgccagggatctcaatttaatcccgttgttccctctcatcggaatcaaaatcctccacctcgaaaattccttttccgattcgagtctctgaaatcaaattctgaaattcaaatccttcctttgaaatcctcgccaacttctacgaatccagaattattcaaatcccgcctcgaatcctttctttgactccaccctatgttcccgagaacaaatacccaagtattccttttgaatcctttccatgacttctccttgagtttcccttgatacatccctaaaccctcgagttcgaatatcaaaatagaattcgaatccaaaccctaaatctctccaattctatccaaatcagttttctctgtaaaagtctactttacctccctgtatttttggatggaccgattttcctcccccggcccatttcccctcccagcccatcatctcctccccccccccgcacgtgcgctgcacgcgccgagagagagaggcatcgcctctcttctacctctatctttcctcgctctctctctgcttcctttctctctcccctctcgccgcgctatgcaccgctgcttagccgatttcccgccgtcgccgcccaaaacctccaccgccttcgcccattcccgcgcgcgcctcgcgaggtggccgaccggccggtcgccgccgacgccatgcgctgccgccttgcccccgctccatgccaaaccgaccgccgccgtcatcgtcgacgtcatccttggcccccgccactccacgccgcacccgtccaagagtgggagaagcagctgctctccctctcctcctcctcctcactctccctctcctcattatggcaagggaccaagcccccttttccctttctttttccctttcccgaccactgccggcgtcaccacctctgcgccgcttgaccgctcgcgccacccgcctcatctccttgaccgcgccagcccgcgctccagcggttcgatttccgctgctcgatccaccgccttcgccgctcaacacatccacaccgtcgccgctttcgcaccgcccacgaaaccgccgctaccgccagccgagcacttgaccgccaaggtcagttctcccctccccaaaccgacctcgcctccgctataaaaccaagccacccctatccccttcctctctcgttttcactcgcctcagtcctcacacccaccgcgccattgccgccgaaccaccgtcgccgccttgttgctgctcgtcccgctctcgccgttgccgtccgttgccgagcaccggaggagccggtgcgtgcgtggacgcgtgacgaggagctccgggcaccacctctccctcccttcttccccggccgcgccctctcggtgccgtgccgtctcggcgtcgcgaccacctcgccgcgacaccgaccgcgacgccaacgctgcttcctcttcgttggtgagatccccaccataatactcctcctgccgcgcgatgcgccgcgcccgccgccgctcgccatagctcgccacgcgctcttgctctgccccggaggtcgctcgctgtcgccatgactccctaggctagctcgtcgccgcccgtggcttgaaacgagttcccggagccgtgtagaagctccttccccggtgaattggactcccgttgccccggcgagattttccccttctctccgccggcgaaggccgccgccgcaatctgccgccgtcggcccttctctcgccgattccttgcgccgtgacccaccccgtgtcctcttgaacctccccggcgcgccaccgcggccgcccgcctcgctgactgcggccgcgccgtgccacccatcccgccgccgcacggccgccgtcgtcagccgccgtgtcgccgcctctccctcatccgcaccgttgaatcatcccaccttgaccccctctcacttccggtgcccgccgcccactccggttcgccgccgctcgccggaactcgccacacgccgtgagccgtcggattggccgcccggcctcctctctcgccgtgccaacgtggctgtccacgaggacgccacatctacctgcccggccccgcggagaccggtcaaaggtctcccggtccaccgatccaacgcgccgccttgcgtgcaccccgctcgcgtgagccgtgtcatcgccttgtgggtcccgccttgcgcccgactcggtggaccgcgtccatcggcttgcgtcgcgtgggccgcgcctcgttcggccttgggccgcctccctcccacgcgccggcccgctcgcctcggccgcgcccgcgcatctcttcgggccgcgccccttcgctcggcccaagtccaattaacatccctccatccttttctttttccagggatttgataaatcctttttcctttgtcccataaatcaattccctattccaaaattccataaaacatttcctttggtcccgcatgacagtgactgtcaataatattcttgagaatattatttctataaattccataaaccatttctcctattccagaaactccaattaaacttccaaaattcatatctccccaaccgctcgtccgattgactccgtttcacttccagtaattccgtgaaattgagatctatttaatggcactactaattagtctaaataggatctttcttttggtcctttgtttaggttttcgattgtttgcgtatagtggcggttatcggattttcgtcgatcgcgggttttctcgaagattcgtgaagcttcgtgaagaccttgagcaaggcaagtcaccctttgatcaattgctcctataattggaaagtcattattattttgtttgcaacttgcatcattagaatcactcacgtttaacttgcttggcctcggtttgcatgccaaaccgacggacctacccagtagtcgcactaattcctgtaggttgtaccaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcacgatgcgggggttgtgcctatgtggcactgtcccgtattcgcatataaggaccgattcctgtgggaaactcatcaaacataatcaaagtgcaaccacaaggtggaatgggacaccctggctaggtaactagtcggttcagggaaacctcgcatgccaatagttgggaacgccggggcgaggtcggacaaaccgggttcctggtaaggcaaggacgagaagcttgctcacttaccgatcaaggtggttggagttgatttgtgaatgcctaaaatggcctatgcttacgtgaggatttgatccttctatatggcatgaggtaaccctgggttggcttgggaaaggctttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggacgacctgagtagtcagaaacgaatctgtgtgattcgggatgtctgcgggcatcatagactaggcttcccgagtggaagcggattgttgtgctgctgggcagctggactctggaagtccgagaaaatgaaaaaggctctgggagccgattaatcaagtggaatggctctgggagccgagaagtaatgatctgactcgggaggtcggtacattactaaatgagctgttgaaaaacatcccttaaagtcgaatcgagacgtaagtctcttttcagcccaaacttaggaagaaataaatcacttagtgatttcaaaatgtcttcaaataaaagatttgctaaacaaccttgcctctcttccaagcttgcattaaacacctaagtttccgtgacttgctgagtacgaaagtactcacccttgctctatataaatatatatatatagttcctccgccctgaagagaagataaagtgaagattagggtttcgtcctggttcccagccgtcgcctgtggtgttgggtgttagaccgttggttccgctgctgctgttgttgttggtgttcgcctcgtccgtgtcgtcggttgtattctcgggctgtctgagctgcaacctaagttaaggtaaataaatcctctatctattttaaggattcctatgattcatatttgtcaccgtgggtaccaacactatgtcctgggactggtaccgagatcgcggtttcgtaggaagcggttcacgccgttttccctacgacacgctcctgtcaggtgccgttgtacggcggtatcagattggggtgtgacatcgcgtccgccgacgacggcagctccacctcttcagtgtcgccgccgatgcacacgaggtcagtgcgggagagcggcgtgagcgtggtggtggcagctccacctcttcagtgtcaccgccgatgcacacgaggtcagtgcgggagagcggtgtgagcgtggtggtggcgccgacgctgacacccaccgcgttttctttggttgacagtctccatcaacaggaggttcttcattttcttgctctaagcagtgtcagacgatacatcgatcgaatcaaatgatatgaacttatccatgtccactccatgtacatatatttgatctggaagttgacggaagcaaatatcatttccccatatatgaacaaatgaagtgtattacatgggtgtagactttttgtggagtaaataccagccatgataccgaggaggatcatggcacttcccaagtatcacatgatcgtacttagttataatctgtgaaacccacaggagccatgataccagtcatgatattgagcagaatcatgatacatctcatgtatcacatgatccttctaaggtatcatctatgaaacttgatgataccagacatgatatctgagaagaatcatgatacctcccacgtatcacatgatccttctaaggtatcatctatgaaacctgatgataccagacatgatatctgagcagaatcatgatacctcccacgtatcatatgatcctcctaaggtatcatcagtgaaacctgataataccatacatgatactgaggaggatcatgatacatgataccatacatgatacatgatcatgtgatacctcctaggtatcacatgatcatcctcaagtatcatacgtgaaacccgtaggaaccatgataccatgcatgatatctaagtaggatcatgtgatacatcataagtatcacacataatgatacttttgatgtatcatgtatgaaaccttcaggtatcacacaagatgatatatacctagcgagggatcatgcgtgaaaccttcaggtttcatgataccgagaaggatcgtgaaacctcccaagtatcacatgattctactaatgtatcatcaatgaaacccgcaggcaccatgatagcagtcaagatactcactgtcttgatggtgttactctcattcacagatttttactgcctatcacctcgattcttaaaccgggccttctcagcatgttgtcctcccactggtgtcaagttcattgatgcaagctttctctgtcaaaccttgtactattttgattgtaagatcatatccttgcaaaacacgattctgaggatgtttcaccaggaagcagaagagccgacggacggcgagggtgccgctggaaagaagcaaggaatggcgcgcgattccgatgaggtttcaccgggatgcagaggagctgatggacgatgctcgcggcggtggaagaaagcgaggaatcgcgcgctttctaggaggattcgccatgatggggagaagccggtggatggcgcgcgcgctggcgggaggaagcgagtaatcgcgcgcggaggcgagcgcttccgaggaggtttctccaagatgcagggaagccggcgtttggcaagcgctggtcgtcattctcattttgctgcaatgcacgcaggtggcggatgacagttgctcagagcgatgtcatatcggtattagaatcgtcccgtttttgaacgggattccggtatatagcatcccccattaattttgtgaagggacttcaccttgagagattggttgcttccatgttcgttgttatgcacggcatctgtgtgactgtgttttttaattcaaaagaaaaccacaactgcagttagtcaaagatggttttccaccggacttcagttttttaaaaaataaacctccaaaaagctgaaaaactagccttccaaacaccacttgcaagaagaggtgcgagagagagcgccattggaaaaaagatccacttattctttgtataacccaccgctgtgaaaaagtgctggctcaattgacagaagaggtagatat

SEQ ID NO: 42483 - DNA, 8213 bp, Oryza sativa
  unsure (1)..(8213): unsure at all n locations
tcatatcgcagcttgaaccgtcacgagggtcgaccacaagcacccttccccagtgttggtgtgtcatgccaacatcaacattgccaacaggaaccatcatatcgctctatggcggccaaatcgtggtagagccgagcacatcgctctcctcacgcgtgcatttggtccatcacctttgacattgtagaccgccgccacctaaaccgccatcaaccatatcatcttaggggccaggcacacccgtccttgcctagcaaggatttggctcacaccgccttcgatggcccacctctctcctccttcgcgtgctgtggagggttggacgctaaatccaaatccatccacccatcatcaccactatcgtcgaggtctatgccctgtcgtgcgttctgtagatataggtgccaaatccaaatctaaccacccatcatcaccaccgtcgttgaggtcgagaaagggcgtaacatccctttctccatggtcacaggatgttgcatcgcctcactccaggttgcatgttgcgtcgtctaacacaggagaaaagtccctaccagatatatcattcttgatgttgtttgtggagagaatgttttaatcagatctagtgaaaataggtaaattgtgcgtaccatggacataagagcttttatcgatgactacattacaagttagctttcgctagcggttttcttttaaatgtcggttcatacgacttccaaaacatcctaaattgatcaaatattaatagttcacaaatcgtaaagttcagctagggctgatgtttcgtaaatccataggtctatgcatagtactctctctattataaaatataatctaaaaaaacatcctggttttccacaaagtcaatatttgaacattttgactaataattaaactaaaaacatattataaaatgtagtatcattatgctcgtatttgaaaatattttcatatctagtaattttgtaattgttgataatatattataaaagaaattaataatcaaagtattggaaaccatgcaaaaagagagaagaaatatgttgataattaggagagttgaccgaaattttctgttagtctcttaagaaaaaccaccacatctcacttcttaaactgcctttctccgtttgtttactttgttttctatctattgcaatacaaaatgaattgcccacattttcttatcagtttaagcttttgtgttgaaactgatcggtgcatacaactcaatatggtatcagagccaaaggactcaagttagaatcatggctaatgcataattaaataaaagttgcaacccacttctattccacgctagaggcttgagacggcctcgcatgagaagtgctggaatataaagtgaattgcccggatttcttcatcatcttaagcttttggattgaactggtcggtgcatacaacttgatactaccattcacattcatgtaggtatataagtgatagagatcatagagtaggcatttacacggcagtaagttcagagaaaaaaaaaagaggagcaaatggaaaaacgttacatttgggcaatctgatctagtggcctttaccaattgggccaatgcaccaagccgcttcatgctggtgcgagcttaaaaagcctgagatcaacagttcagagacccaataagctttttctttcaaaaagacattaacaaacaatgaggctattgggcttgtccagacatgggctacttcattcgatggacatggagttttgtacaggaacgacagatcaaagaaagaaaaaaaggacacacaaagattacaacatatggctaattaccgcacgaccaagctactacatacattagggcagcaaaccaacaatgtactatagcaccgtgatggtggcctccacgcgcttcagcagccgtgctcgcttcttcgcgccaggatcgttgttgccgattgaacaatctgttgtccctttttcctttgagatcgatatgctccggtgctgtagtgctctctgttaatgatccgaaccggttcattattaaaataacttttaacagtgatttggagtagctttgtcatttacgtttttcttctgtctatcgtggtcatccattccgctggcatcgctaatttaccatcgaaaaagctaaaaataagaagaataaggtttagtcaatgcaaaataacgattatacccttttcacacatattttttaaaacaataatgccccttcatatttctactaccgctaactggggtggtagtaaaagtagatccaaatctttgattaaataagatcaacggttcagattactttctactaccagtaaagagcaccatattcacgctaaaaaaacacagagagaaatcgaccaagttgcgaggatggccactatgtcgggagccgatgccatatatgtttggcaatattttcttttcattttgtcgcaccaaaggaagctagcttattggtgaaaatctaaataagttagattttttagattaaaattttataactatatattctcataatatgggcgagaatatgaactgtttgaagtacgtggagattctggtagaagttgttgtagttcctaaacactccccaaatagatcctagtatgatccaccaaagttagagggatttcgagcatgctataagaatgtggcggatggttttcttttgttgatcatagagtatgcaattactgagattaggtaatcctctccttctcatcctatcgtttgtcacagatcatcggcgtgcaactagcccaagtgaacctgcagcgtgaggcgctagtcaagtaggctttctctcagattggcatagccggaaagtctttgatcctatgaacagtgcttaatttgtatgtatgccgaccctgacgcaacaggcatcgatctccatagcaaagcatctcgttgattgtgagaactagtcttgtgccgttccgccttgcccagagattcagttattcaatgattgcttcgactcatccatggtaatctgtgatccaacggtgatccagcaaaggttcggtatccgtcctttgaaaacatggcgccctatcggaataatggtatcgccttatacattctctccctgttgacaaaattttggcaccaaactcaacatcacaaaaccaactttaaacgattttccattaaaaaaaacagtgaaactcataagttcaggagaggccgagcatgatgatggatggacgacggagtccttctcgctcccgtcactgctactattactgttccccgtcctcccacaaggtacaggcccaacaggagtaacagaccgaaaagaaaacacgcagcccagaaaacgtacacaaacaacaacacacgtagtacgtgcacgtaccccctagcccaactgtaaatgcgaccgaaccggtaaccccttcacttccgtgtgccatccaatccccgtagtactccgcagtagtggatggggaccccggccagccgccctccgctgggccggccgcacgcacgcacgcacgcagtagcatcactgcaaatgggaagcccaaccaaccagccagccagccgggacagctagcgcggnggggggggggggggggggnntnnggaagctgcttttccacgcgtgcgcgtggtcgcgcggggacaccggcgtgtgcgccatcgcgcaacacgggctacggatacgacgcgagccgggcgtgcgggcgatgatggggggtgggtgggtggcgtacgtgtccgcgtcgtgggcgccgccgggctcagcacgacgattgagattgggaggagtgggatcatctggctacacatgtggatgtacgcatcacgaacaggggttaagagagtgctacttgtgttagacctatctctatctggcacgtaaacatcgttcgtgagttggagaaagcgagcgccgaggctaacgtgaaggacgatggaaatcccaaaagtacctctcacacacatggtctgtccttaaatgttcgtggtcgcggcaactactgttgtacgctgaattctcagcctgtgaaacgttacacaagattatcctgatcaaacaaaaaaaaaactcttgcatttatcagtggaaaactctcggcctatcaaaatccaaaccaacccgaagtcacagagctacagtactcgtgagggatacagtcactgcaggagccatgtcacagcttctcggcccaacaagcaagaagcaaagcaagcacagtcacaggcacacagtgggagacactgctcacaggcatactccagtctcacagccactcaccccgtccgtcgccagcatacacagctacacacgcagcagcagcagcagctgctcacacacagtacgtgtcaccggtagcatcagcaacagttcgggggagcaccagcgtccaacgagagcccacggcctcctcctctcgtctcgtcggcctgtctcgagtagtagtggagtactcgctctcgctctctcggcgatccgtcacgttctcctgtagccgcgacttcgcgatccggccgatgccgacggccggcgacccggccaagattcgtgtgcatggtgctgtccccggcactgcactcccccgcgccgtattacgtcggtgtagacgacgtcacggtgagtagccaatcaaagtagggatcgcacgtacacctgccatggcaccactgtggagagaaagttttgatgcttgctagcggtagcatgtatacggccgggaaaccggaggatcacgagttcacgacatgtcgatcgtccctgcaaataggattagtctgggccagtttagtttggtgaaataaaaatttttagttgtcatatcagacgtttgatcggatgtcggaaaggtttttcggacacgaatcaaaaaattaatttcataacttgcctgaaaaccgcgagacgaaacttttgagcctaattaatccgccattagcatatataagttactgtagcacttgtggctaattatagactaattagactcaaaagattcgtctcgcgatttccatcataattatgcaattagtttttttatctacatttaatgcttcatacatatcttcaaagatttaatgtgatatttttaggaaaaactttttagtaactaaacagaccctcagtcagtccgtcaagtcgatcagtggggggcttctgtttgggagtcgtcgtgagtcgggtagctgtgtagtacgtcggggcgatagttctgctagttttctgttgtaacaggagcatatgcgttttttagaagggcgtgggtgatgttctcggaagggcgtactgtgcacacatctgtcctaaaatgttgttgtgttacatccagaactaagtaaaaaaaaagttattggctaggtttgaaccgagatcggtgccttcctcccagcggctccctaccagctaagaagcttagggcttatttaggggagtttaaatttctgagaaacagctggttggtaacaacttctgagaatctggaaaaaaaattaagttttcctgcttctgacttctactccctccttctacaaaaaacctcaatctaagaggggacgtgacccctcctagaacaacgaatctggacaaagggtagtccagattcataatcttaggaggggtcacatccctttctagattaagtttcttttggatggagggagtagtttattgtctggattctacaactatagtttctcagaatctgtaaaaaaaaaggattgtttggagggattgtttggaggagttgtatcaactagaaactacttcaaacagaccctaagcattgttttatcaaaaaataagcaacactaatcctgtctagaatttaattttagtaggtggtgagctcatatgaattctaacccatgtaagtgactacgctagtagctctctatcggctaagctatgcaccgttctagaaagaactctaacgaccaacggaaaaacttagtacggaatattgaataactaaaaaaaatgagtgtgtaaaaaatcgagcactagattaaaatgcacaccccgacactatatacgagcagcaagtaaacttaaaatatgtataagaattccgaggaagagcttatttttgagacggtgagcacctggcttcaaaccttggtcagtagcttactgctggctgctccttactcactcgcacatacttcctcttttggctgctctttactcactctcacaggttgtgtttatttcgtatgtcaatttttttaattatatgaacacacattcaaagtattaaacgtagattaataataaaacaaattacagattccgcttgtaaactgcgagatgaatttattaagtctaattaattaggctcaaaaagatttgtctcgtgatttacatgcaaactatgtaattgatttttttttcgtccacatttaatgttccatgcatgtgtccaaatatttgatgtgacgaaaaaattaaaagtttgaagaaaaaattttgaatcttaacacggccacaatctttctgtatcaaaaaaataaataaatcctagagatttgagttttttttagagagagtagataatttttacattgattttaattttgcccaccaccaggatgtctcactcacacacacgtaaacccaaacactatatttgttgtgaggaaactggatatgatgtttccattaatatgtactacagactatgactaatacagtattctcacaagtgaatggcctatatcatggactcaaccttattttcccacctgccgcaactcttctatctctacctaattgaaacattgatactcttactttcgtcatccaaaaatatttggtctgtcgtatacgtactcaccctcgtccgtcatcttcggccttgtttaccatgtcacatcaaacgtttgaacacatacatgaactattaaatttaggctaaaaaataactaatcgcatagattgcgactaatttgcgagatgaaacttttcggcttaattgcttcatgatttgataatgtggtgccatagtaaacatttagtaataacggattaattaagcttaataaattcgtctcgcggtttactgatggattctgtaattaattttttttattagtgtcgaacacctcagacgacaccttatataatactcaatgtaacacgtcaaaactttacacctgatctaaacaccccctacgagtccgaagcacgcgcgtcgttctgtctgtcgttcgggccaaataatttgtgcactagaatctgtttcgttttcagattgttcgcagtggggagatcttgcgcaatcagctatgcgccatcgcgaggccaattgcgggcggacctgtgcagcggctgcattcgctaccgctctccctcgtcaactaaccgatctgctcctgccggcccagccaacgaccttgcggcggccgtggggatgcaaaagcttttcggtttctgtcatcatcgtcccttcgtccatgtacccggagtttaccacacacaatttttcatctgttttccaacttccaaaccgacccgacacaaatccattccccagtggaacaagaatggggtcgccgaacacacagtcaagtgggtttatgggtgatgtcgtctgtgctggcggtcgacgggatcgaccattttcaatcaagtgggaggtaagggcgtttatccgtttgctaccattttcaactatgtcaaattttagcatttgtaaattttaataaggcagcaatccaactaaattccaaatactgtaccatacctactgtacaaatatttagtgattactagaaacttcttcacataatacaataatatttgacaaaagtagcaaattaactaaattttggtgttgataaaagttggtaagatttattttacattaaaataacgagccctaaagcaactagccatcatcaaaatgcgtacaacctttgacccttactagaatgtgttgtcctgaaacggaacatctgggtagcgacaagagggtttgcatcggaactttaataatatacacatcatcacaaaactaaattaaaactgccaacttttgttattagtggtgtccttgcattgtgttttagagcattttacacatgtctttgttgtttatacgtccccttgccttcggagcgtacgactgtggtggtgtttggatccagggacttaactttagtctctttatttagacactaatttagagtattaaatatatactacttacaaaactaattatataaatgaaaacta

SEQ ID NO: 42484 - DNA, 1214 bp, Oryza sativa
ttcataatattggactaattcgcgagatgaatcttttgagtctaattacgccataattttgacaatgtgatgctacagtaaacttttgataattatggattaattaggcttaaaaaattcatctcgcggattagctctcatttatgaaattagttttttttattagtttatgtttaatactctaaattagcgtccaaacatccgatataatatgggctaaaaagtttttagccccatctaaacacccctcagtaagggtatcaaactgtgatgcgtgccatcatcagccttcgtttggacatgacgggagtagcgacgggagcaaggttgccagtagtacaacttggttctgaagttgcaacaggggagcagatctcagaactaaaacttggtccctgtctggagattctgaggttgcaataatagggggaagatatgagaaccaagtgttactacgtacatttatctagccgtttcaaactctaaactaaaaatataggccgtttgagagtgttaattattctcagagtaaagctgccagaaactctctagggccttgtttctctacgttacttaattatactctcttaattctaaattgatctacatatttatatttatttattaagtctattcgttatttgtgcattggagtaaatagacattgatacatgcatccatgctcacaagcatttataacccacatgcaatatcttgatttgctattggctactacatccgtcctaaaataagtacagccataaatatccataattagcgctttgaccatccgtcttatttgaaaattttatgaaaaatatttaaaaaaattagtcacacataaagtactattcatgttttatcatctaataacaataaaaatactaatcataatcttttttcaaataagacgaacagtcaaacgttggacatgaatagtgctaaaactgcacttattttaggacagagggagtagaaaatagtggggatggtgcatgcattgagtttattgctagagtaaatatagtatgagagagttattaatttttcttgatcttggtgtacctacgaaatatgtagatcaatttgaaatggagggagtagaatagtttggttcgtttcatactaaaaacttcggtaacaagcctggagttactaaaatattggtaataccaataacttatttaattaacgcagattctagtatactctct

SEQ ID NO: 42485 - DNA, 10348 bp, Oryza sativa
  unsure (1)..(10348): unsure at all n locations
aaaaagtcaacggcgtcatacattaaaatacggaggaagtacatgttttcttttgtgctaatataaaatcatgattatgaaaactaatactctaaatatcaccaaaattttataggtgtagtttattaatgaagtgtttgaattttaaagagcatatttagtttcctgctataagtcgccacgagaaatactatacatgtcatatattattaccatgtgttggttattacaactataacaatcaatactttactaatttatattgtcctagtatatgatatactatcatacactcagttttgagccaaacttaggcactttgagtcgcgacagccaaattaaacaacacctaagagcatcatcaatgaaggttgcccaaaattataacccctaaatttttcttggaaatctataatgagaatttaaagattaaaagttatacatctcaccgagagagagcatacactcagctccctaaattaaaaagaataagttttactttgggtcatctttaaccatttttttaattttgaactagaaatcttatctttgtaccaccttggatcactctcaactcttttatctatctacatcaaactatatcatatatcaaataaattttctatgtaaaatggggggagttcattgacaatcggagctagcatactcgaattcgtatatatacttgagaaatgagttagggtagttcaaactgcaaaaaaaaagattacctattctaaaataaaaacattggttaaagtgtgatacaaagcaaaacaccggtatgaaaatatggcctaaattcgttgttcccctcttcccacgagagcgcatccctctcttcgcacaatcaggactaagagcaagtgccctccagccgatgtagagagcgagaaatacatatttggggattttaattcattggcatctacgtaggaaaacttttagaggttttcttttacatagaagcctagttttaggattaaaaaacatattaagtttatgctggtaatgataaaacactcagttttaaaacactcatgtttataactaattattataatttctcagtggtagaagtctatggagaatttgtgaattttaagataagctgactcaatttttagatttattcatactgcatatgataggggcaaaaggggtgtttataaggtggtgtttggatctagggacttaactttagtctctgtatttagatattaatttagagtattaaatatagactacttacaaaactaattacataaataaaagctaatttgcgagacaaattttttaagcctaattaatccataattagagaatgtttactatagcatcacataagctaatcatagattaattaagctcaatagattcgtctcacgaattagtccaagattataaatgggttttattaatagtctatgtttaatatttataattaatttccaaacatctgatgtgatagtgacttaaaagttttagtcccaccaagacaaaacacggtctaaatttatagagacgacagatgagagcgtgtgcgtgagtatcatgtgtgaaaattaacatccctaatgaattccgaggcaattccaaaacttcaccaccagtggaaactcgggctcaagacgaaagattcttcagcaatggtaacacgccaaaggcgtaactcggccccaggcaaaggaccaacggttaaaagaaaacccaatagccgtcttgtccaactcaaaagtggaaggctagagaccaattaagcaggcaagcacgtgcatgctccatgcctccacgcatgaaaccctacgcttcgttaatttcaaccatttctcccaacaacactgcagcccctatttgtccacatgattttagcttgagggaagggaggcactcctagtaccagtagaccactgaggctaattaaagtgattaaggaatcaaaaatcctaaaatgtcagctcttatccttgtactggtaagtacagtacactagtataaaaatatatataaggcatgcatgcttgctagtaacacattgtataacaccatttttttaatctgtgtagtactactctctctgtcccggattttgagtttttatttgcattgtttaaccactcattttatttaaaaaaaattgtgcaaatataaaaaacaaaaaattatgcttaaagtactttgaataataaagtaagtcaaaaaataaataataattttaaatttttttaataagacgagtggtcaaacagtataagtaaaaactcaaaatcccttatattatgagacggagggagtaccttggatatggaaagaaaagaatatggcagataccaatatacgaaatactgttaccttatttcacgcttgttaattcatacaatctcaattatttttactattgattaatctgttgtctaaattattttctctcttattttatagaaccacgtcacctcaatttcttttttttacatttgataattaatctgtgatccaagttgtttttcatctctcgtaaaccacatcacctcaaatatatatacccacaatattagatgcgtaattttgttataatttgatcatatcatatgcacttatgcgaaatttagtcaaacatacaacttaaaattacaaataatttctcaaaatatacaagcctttttacttagataatggaattgaacccaacatatgcatcaaacaaaagatacatatgcatgagctagaactatatgtgtatgttttatgcgcgcgcacacacactacactacaacactaaaaagaagacaattgtctgtcggtagaaaaaaattatactatgccactttatctttcccaacagatagtttgccactaaaagctacttattccaacagatcaaagtatttatgtacctatatcttggtgtagcgacatcactacatatgcacaccacactcacaaacacatgggtgtgcactcttaatacaggctaatgactcagaagtaaatccataaaaattatacttacatgtgcgtaattgtaggcactaggaaaaacatgcttctacaaatccactaacacatctctagtgctttgaagcaaaccacgtatacctagcactacatttatcaagtactctcgattaatgggttatatgctagcattgtttggattatcacgttgttttatggtgacataattctatactttcttgataattttctaagaataattatttttgaaagttgatataaaattatgatttttctccggacgttaatagcgacaaacatatacaacaaacgatataaatccacctaattatgataccgtttagatctttctctgatatgtagtagtacatagaacaactcatatcttcctcgaataacctatggttcgtacctgtgctaaaaagaaagaaaggacgctaaaaagcagccactgaatcaaaaccaacctgagtggaaacctccggaaaagagccaccttttttacacgcccaacccttgttcggttcttccccccttccaacctgtgatgaagcacgtctccccaatagcccggaaccgcccgttccaccaccaatcgccatcgacgcgcgcccccaccttcgtcgtcccgcgcccaatgtagctgcagctgcagctgctggtgtggacgtagcgggagcggaggcaggagcgggttggctccatcgtcacatcgatgtgagtcgtcagctactgtggcccagcgtccgtccagcgcggcagcgggatgcacagcgtactgctggcctctgtgcttgctgctgctcttgtcactcgctctcgcccgtggccgtggccgtggccgtgctcctgttctctgccgtctcctctaccgcagtactccctcccagattttaatatttttaaccatctattttatttaaaaattttaaaattattatttattttttataatttactttattatctaaagtattttatgtataactttttttatatctgcataaattttttaataagacgagtgatcaaacagtgtaaataaaatattaaaatctcttatattacgggacggagggagtactaattagagcaagtttaatagtatagccaactactagctccaatttatctatagtcaatctaatagctcattcatgcctccatcggttgactttttttttctaataagccaaaacggcttattagggaataaaaataaatttgtaggtaaaacttttatatatgtgttctttgtaacttaaaagccaatgttgaaaaaaaattacgttgaaaatatttcaaaattaagtttgaaaattcaaaatttggcttattttttggtttattggaccattggatggaagcctcatacaatagttacatactacaaaattaatacctggtctcatctgtcatacacactgcgtcttaaattctgtgttatagctgactagaaatctgtagcccgctgcttttctctctcttcatttatcttcttaaaatatgtttacagctggcttatagactgctattgtccttgctcttagaagtaagagtatagtcgatacgcgagattcccccatcggcgacaccgccgcggccgagcccccgacacggcacaaaatttccacgagagcatgcgcgcgccgctgttccacaccggcctgtggcgcctatatatggggtggagccgccaacccaagtttcactttcacccccagaaaccccgcaacacacgagttaaaccgctactcctcctcctcctcctactaccactagtaggcagctttgagctttgaaggtggtagctactcggagtagtagtactagcagtagcatctgggagtgtgaagcggtagtagtagtagtgcactagtgcgtcacactcacacacacacacaagcagcagcagcagcagctgagcttttattttactactccttttaaaagaggggtgtgccaccactgttgtcgcctcctcagctcagctcagctcgccttccttttcactcacacgcgcacgctcgctagctagagagagagagagtgagggagcggcaataaaaagaagagagagagagagagagagagaggctagcagctagcaggaggaggaagggaccgaccaccgcctgccgcaatggcgaccggcggcagcggcggcggcggcggaggtggaggtggtggtgacgatgtccacgggctcaagttcggcaagaagatctacttcgagcaggacgcggcggcgtcggcgtcggcggcggcggtggagtcgtcgtcgacgtcgtcgggcggaggcggcaagaaggggaagggcgtggcggcggcggcngctcccccgccgccgctgccgccgaggtgccaggtggagggttgcggcgtggatctgagcggcgtcaagccgtactactgccgccacaaggtgtgctacatgcacgccaaggagcccatcgtcgtcgtcgccggcctcgagcagcgcttctgccaacagtgcagcaggtaaaaaaccaaaaaccaaaaccaaaatcttcttcttcttcctcctcctcgtcgccgtcgtccagccattgcccctgcttcctctgctgctctactgttccacctgtgagcgcgtgagtgtgacagacactcaccaatccaccgtgtgattcgcccaactttcaaacggttcctgccaaaattcaaaaaaactccccactagatttggctacctcagcaagctctgattttaggacaagaaaaaagaaacaacctctgcaacttgcaaaaacgtagcagcaacgttggatttcaggcaaattaaattttgccgttttgtccctggccagattgagagattttcatgccctgtgtgtagtgtactgctgctgggtttgatagtagtagcgatcaatgtgaaatttaggacatgtggaacctgactagaatagtaagggacataaaagtgtccatccagaatatcttgtctgaggagcacacatatagtaagtctagatctcctttttttctattctagtagtatgtggaatgtggtaggatatgaagtatatatggggtagtagtaaggtactacactgtactactatgcactatttaatgccctaaaatggaagtagggcagcagagaaattgaggtggaaaacaaatcggatgaaatagtaactacaaaaccttgctaattaggaatgtttgctgacatggatgagagagaagcaaggagatgcaaacatggtagcttcgattaaacaaccgcttagcaacgactcttaacctctatagaatggaaacttttctgcatgagggttttaacaaggaaataatagtaataattttgtttttatgaatgcattgtttaaataaagtctttgttgtcgatctcaacagttgtaaggacatagtctctgaataaacatgtattatttaaaagactatatgggttctacctttgaacatgcccagcaataacgaagttggtcaatcatgctaaccaataattctcatttggttcatcagaaatcccatatacttactctaattttgtcctatatgttttcattttgtatagtagatactagaacacaaacacttatgcttatgctacataatctaaaatatcaaaatgaaataacatcatctgctatattgcatccaacaatttgtttggaaaaaatgcatactatttcatagttggtggcttgtggagttgtggacatatgcattaccggaaaatagaaggttctgactgttgtgttatttataaatctgctctgccgtagataaaacatctcttgactatttgatgtactaactaaagcctttgtttgtgctaaagtactatgggaatgattgcaggtgctctgtccacatggttaggtaacctttttattttcccggtcgtggtgtatgtgtatctaatcatgaaaggcgtgtctttggttagtgttgctacttagaacaaatacacattagtctaggattaaaaaaaagttgttatgcttgcatcgacgcagcttttcacatggcatgtggtttgatttatttatctgatgcacgctccgtattaagataagcagcaggggtagctgattcttgattacagagttggcactcctacttttcatgtgcttgcaattttctaaagtaaggtcactacaataagcaatagccccaccaaaaatgctcttcagcgtgctttttttttattgagttaaattgattattgcttttcattgtcagtgtagagtattttttatagcatgacattcttcattaggaaaactccttgtattcaattatatcctgcagtgtcactacgcttgtggtaattcactaatattttggccacttcaaatcacaggttccaccaattacctgaatttgatcaagaaaaaaaaagctgccgcagacgccttgcaggtcacaatgaacgccggaggaagccgacacctggacctctttcttctcgctatggccggcttgctgcatcctttcatggtaaaatgtggctcatgtttgtcctgttactctgaacttcagatgagtgtattgacttgttgcccctgcaacttttgtttcagaagagccaggcaggtccagaagctttgtggtagatttctcatacccaagggttccaagcagtgtgagggatgcgtggcctgctattcagcccagcgatcgcatgtccggttcaatccagtggcaagggggccatgaactccatcctcaccgcagcgcagttgcgggatacagtgatcaccatgcgttcagcagccatggtggctcagcggctggggcaccaatgctccaccacccagcctttgagctcacctcaggtggatgtctcgcgggagtcgccaccgactccagctgtgctctctctcttctgtcaactcagccatgggatactacccaaagcaccagcagccacaaccggtccccgccaatgtcgtcaacggccagcgccttcggaggcggcaacaacccggtgtcgccctcggtcatggcaagcaactacatggcggcgagccccggctggaacagctccagccggggccatgacggcgccaggaacgtgcacctgccgccaccgcacggggttgtgctgaacgaggtccctccgggctctgtccaccacggccatttctccggcgagctcgagctcgcactgcagggaggtgccccgtccaaccggccggaagccgagcatggctccggcagcggcgccttcagccactccaccaatgccatgaactggtctctgtagagaccattgatcatcttcttccccaccgtcactgcgccttcatgccaagagacatggaacattgggcagcctagttttgtgctccttaacattgccatttaggttttcaggatggagagggaattcgtaactgattaggccagtaatttcctctcgttgagcctgatgtgtccatgaattcaaaacacccgaagagatccactacctgtagaactccataaactgggagaattgatgtgttttacttgacctattttaatctcggattcatcttaaattggtttttgaaatcggtacgtactggaaaacattacgagaaaggtaatcggggcctgtcttgggactcttggtctccttcctctggttgagaatccttctccgacacggacacacgcctcggtcccgtgtcgaacacctcgtggcgcggcgcgatatgtaccatcgtgagtctccgtttactccgtgtgagacgcaactcgccatcacacgacgatggattccggcggtggcggtggcggtggcggtggcaacggcgacacgggcggcgagggctcgacgtggacgccgtggtccggagtggacgcggcgccgccccggcgcggtggcaacggcgacaggggcagcgagggctcgacgtggacgccgtggtccggggcggacgcgacgccgccccggcgcggtggcaacggcgacacggccggcgagggctcgacgtggacgccgttgtccggggtggacgcgacgccgccccggcgcggtggcaacgaagacgcgggcggcgagggctcgtcgtgggcgccgtggaccggggtggacgcgacgccgctccggcacggcatcgacgccaccgtggatgagatccgcgaggcgctggggctggcgcccgtgtcggccgccatggcgcgccgccgacgcgcggcggagcacctgcgccgcgccgcggagtacgtggagctgcgcgcgcgcgggggttgccaccacgacgacgcgcggtgccgccgggtgcagtcggcgctggccgcgcaggtgcgcggcgcgtgcgcgcggtgcgggtccaacttctgcgtcgtgcccgtggtggaatccaccaacgtctcgggcgaacagtgcgttcgctgcggctgctgcggcgagcgcgtggatttggcggcggcggcggcgctggtgatggctccccccgcggcgacgaggcggcagcaagggtggcaaccgtgtcaccaaggctacaacatgtagcagcgattctctgacttactgacgtataaaccatactactgacggacataatccctccgtttcataaaaaacgaatctagaataaaatgtaacacattatagtaatatgaatctgtacagatgtatgttactggagtagttagtagtttttaatagaacggagggaatacatttcagcgatctgcgtcagagaagtctcgttgatggttttgcggtggagttttacgtgcacagcgtgagctgaccattgttcattgatctatcgacatgttgcgttgaagtgtaattattttgttactgtgaattgcattgcttgttttaagatggtttagttgaggtgaaaaacctacggcaatgtgccaactaggaatacaagtagctgactgtttgctttgtacaatagtttgtacattgtggcaggcattgtactgcaggtggatctgggcttggatctacgttttggttgggctagattatttgtaggccgtgttcaactagaggcatgtgttgggtgggccggcaaagttaggcctcaattcctccatcaccttgggccaggttagtgggctgtagggaatcgacaatgcgattggtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42486 - DNA, 9086 bp, Oryza sativa
  unsure (1)..(9086): unsure at all n locations
atgtatatcgttctgtggcttagcttagtgtatgcctttgtaggtatttgatatggtgatccgtgagacatttgtccaatctcaaggcatcaatgtgactggaatgcgtgaagattttctccaattagctattggtcaggaatgttcattgtgcctctcgcttgctcattctggagatggtagtgactcagaaatggtagaccatgaagaccatgccaattcagaggatgcctcaaatcttgtgttggtcactatgaatgggaagctggaccctttaagaaaagacgtgacagggtttcctaatcccagaagtctggaaatttacttgctacaattgtttcatgagaacattcttaggaaggtcagggagaaatcccttaacattggtcgctaccaaagtcctgctcaggttgcaggtgatgattatgccctgctaggtcatttctgcttgacagtggctcacaggatattttctaacaaagtactcgtggagcttgagagtgtggtatagctcctataagcttgttgatgctacatatttgcatgtagatcattatttaaatttcctttctgtattgcaggtcagcagggttccatatctccatttgcgttctcttcctacttggcattctcgaacttcctcctggtctctatgcttgaaagttcctcagcctatccttgctgcagatcggattgcaaagccttctgataaccatgaacttaagtacaaatccaggtcacagttcaatactaaggtgatcgtgaaagatagccaaattagtctaatgggtgaaggctccccaagcattgctggatcattgactgggaagccctccgatggatatttggtaaatagctacaattgtgacttggaggacctcccaacaatgcttctgcagcaggtaaacttctgatgatactatttaaattatttcttggtagatcatgtttatgaaattattaaagttattaccattggaattcattatggtccattgataatgcaatgagccagactatttcttgcattgcaaatgtgtaacataaactccttgcatttgaatgtgaaatgcacaatggtaatgcatttttcttagtttttttccctgaggaaatcttcatttgtgcctattgacctacaggattagtttgcttaacagttcaaaatgaatgtggcatgcatgttgagttgaacaggacaccagtacaaacattctagtgccttgccatgcttccacatttttttaggttaatattgtcccacataagaggtctggaaggcagtggccattcatgtaatataaaactgaaagcactgaatacagtgcgagaaagggagcaagatgtttatgctttgatagacctgtcattgttcaactttggttgtcttgatgggctatttaatttaatccaagtggatcatcataaggatttgtttccaagtaatactgtgctgcccatgaatattacccatgtcacaacaattgctttttaagtctattttgtcagaatgatgtgctcactgttttttctgttcaggttgctagtcaagtaatccactggcttcatgaagaagcattggttctcggtatgaatgtgactagagatttcctgtgcctttactttgatcttgagcaaggtgaaacgcttggcctggtggcgaatgttgacccggacgacacctgtggatgcatttcttggtaccttactattgatcacccaacggaggatgggaagatgtcagcagatagtcaggagtttgagaagcgtaggtttttgggctatgtttctcttgaagtattgtactctacccttatggacctgataaatttgtgtaacgctggcgcccaccactgacatctatctgaatatccatgtaatatcacttactaccttgtagattggtcctttgcttaggcgaatggaatcctgttggctgttgcccgctatcattcatattgttgtgtcttttctttctggccgtaaacaaacgaacccactgaacgtatcctgcgtttggtgggagtttgatcggcgacccgctgtgatttgtttgatgcttggtgctgaatctttgtggttttattcatctcgtaatttttccccgcgtgttgccttagtgccatgtgggcattccaaactgcttgcatgagatttgtagtagctggctattagagaatctaaaggtgattgtacatttggacataatgctcacatcacatgcatgtatagtatacccagtgttatgaatggatcgatcaatcaaccaaccgtatagttcatcatcctcatatgatgatatgaatatgagctctatcggcctggtaggctatctcatctcgatgacagcgagaaccatgtgatccaggttgaatcttattatcattaagatgatgattggctagctagggaacatctaaaggagattttgggtgaaattgaagctgccttaggctgtgtttgatacttggggttgggaacccaactccaccgcacggaaaacggagcggtccattagcgtgtgattaattaagtattagttaattttttttcaaaaatggattaatttgtttttttaaagcaactttcgtatagaaactttttgcaaaaaaacacaccatttagcagtttgaaaagcgtgcacgcggaaaacgagggaaaggggttgggaaacttgtggaaagaacgcagccttagtgtgtgtacgtacacaggtgcatgtgtaagatgcctagctccaagatctgaaacattatgccttcattttttttccttttatttatttgttagactttttagacagtgatttgtttgttacataaatcgaacacatgagttaggaataggatgctttattccaaagtgtactctcctactctttggctgaaattacatcatttaatttaatgcgatctgtccatcaaagtaaagagtcctttctgaactcccttatttcaccttttctgtctgaaaggccaacctccatatccggtaccacctcttcattgttgtcataaaagtatgctcacaagttacatgtttggttcattttcatatagtagtattggctttcttttagtgagagaagcctgaaagttgaaaatttatcttactcctttttggttattactcttagtcctgatatcatgtttgattagccagttggaattaattggtttggtggctcctagacctcaggcaaaatgtttctttgggtttcagaaaggcatttaacagtatgtgtccttttgcattagtcaagacactgagaggaaataaataaaattaattaggattatgaaaaatggtttaacttgaaataaaagaaaaggatgagaccaagtcaccaagaatgaatgcatggttgcaaaagtaaaacagaaatggtacccccaagattgctacctcctttgcacgcatgactgtgagtgcaccacctaaagcagattatctttagtttcatctttggttcttgctttctggaaatttttatcctgctactatttgaaaagaaggaaagggaaaagttgtgctcttgcttttctgaaaagaagagggaaagaaagcaaggacagagcctggccaagtttgttctcccttcttgcttagtatttttattggatcgtggatgcaaccttgcaaattatgatgtgctgtgaccagcaaataactaattcatttgttggtttattacttgtgtgattggaaatgtatccagcactccagcatgcatgcgttctataatttatgctaacagaaggtctattgtgcttctggtgaacaactttgaagagaaactttttatgctaataagcatgaaagtagcggcagacccaaggatatatatatatatatatatatatatatatatatatatatatatattttcacttcagttctcacagatgattacgtgctcgatgattaaagttctcagtatgattacccgccatttggaagcaattctatctggattacctaattactccaaatggaaaaaaccatcaaattgttctgaactccaactggacaacttgccgcatggtgttcaattagtactcagatttcatcagtgattccttccttaagagtctgattaattagtgattaggttccaaatgacacacgagaagaagcttgcttttaaattatttcgttctctcttaaattattggcatctcattatttctaatcgtccagctcttttcacaatctctgtgattttgtttatggcgtacatgtcgtaccgacccttttctttcatccaactcttctagtcatatcaatcaggtacaaatctaaacatgctaaacactcgacacgcacacaacattccgtttgacaggtaatctaattgaaggaaaggtttctttcggtgaaccactctgtaatcatttcatatcattgagacaacgatgtcaaaatgacatagctgcatgttttgataaaacggatcagatgtagaacgaaaagaaattagctagctttgatgctgggacaatatattcttttttctgggaggattcatatattcagaatccgctgatgttttacccagccagattaaatgtagggagcctgcaaatttactgcacattcattttccatggacagttgaacggagtcacctaattaacctaaccttacctctagatgaaacaaagttacacctctccagtctccaagtaacaaccgaaccttacctgacaacaatttttgtcttgactgactgattattaagaccgtgattgaccaaatatccttcgggaaaaaaaggcgattgcattctcaaaattttaaaataaccgaaaaataacaagggtaggatcattttgagctcatttagttgaacagacaaactagtgtgagatttcaaatgagaaatggtcaggaagtaggtcagatgtgtgaaaatgggattagctgtaacccaagcaagcattggaaggttcattttcaggataacccacaagtacgatccgtacagggaaacgacaatagtcatgcaatcagcaactggatgctgacttgctaagatgaaacttgacaccgtttgctcacctaacctaatctccttcagattgttaattaggtatacatacacagagttctaggcagaatccctgttcattttcagtttaataatggaaagtatggcctattgcctcgatgattaccaacatcaagagagatttacacagaattaatagcatattgttgagttgattgatttgttggtgctcaagcatttttagcatccatttttttgatgcttcatggactggtaatgctgggttttttttggggtgcaaaacatgcttttttaattttatcaacggttttatttttttctaaacaagaattcaaaccttgtcccttagatgttgatatgttgaccatgccatttggataaaattagttttttttcctcgggcttggttaaaagttaagttacaaccaagcagaattaaatagtttttttcattatttttttaacctttttaatttgttgttttaaaaataaactcttttaaaacttatttccaaaaatttgaactttttagctacgccaactcacctgacgtggcaaaataatactgtcacgctacccacaatggacatgatagttttgttttgctacgccagtaagaacaaataacacttccacgtcagctagctaagtaatgctctcaggttattttaggttattttagactgacgtgatattgttgtttggttgatcttaaaaataagtttctaaaatgtttatttttaaaatagaaaaacaagaaagttcaaaaataaaaaataaaggtaaaaccacatattattaggagttattaattgtagttaaaaggctgacacgtgggagcatcgtctagcgacaatgttttaagctagggagtggactatattttttcttattgccaccaactttatatataattttgatagcaatgtctaacatatgaagtaattttttgttcttgttgctaacgattttatacatgaactagaaatgtggagttagatttatgttgcttcacgactccactccagatccaacttcttaagttaaatttagaagttggagttttagcaaacgagttctcggaagggctacaaatctacaataaatcccatccaatccaagggacaatttgaatcatgccacacaaaatttgcaaaatttgtgatatgccaccctgacccacatgtcattgactcatatgggtcatacatgtcattgagatacgggtgacatatctcaaattttacaaatatagggtggcatggttccaacaaaccctaaatccaaatgcagcacgagataaaaatcccccttttcttactctgttccagaaaaatatcccttttttttttctgtttcattcctcatgtggctttttatccacaatttattccatgtgtatttgaaaaggttatgtttctctgttcctccacattcctctctacctcctcattcatttgtggagtggagtcccactcctaccactcctctccctgtgactctccacaaccatctcatctccttcaccttcaccttcagttacccccatccaattccatccagattgcaattgcacaggtaaattatccatatactaactttcattcgtttgcaagcaagatttcctttgcttatcccacatataaataaatctggaagggagccgaacaggtgggatacaggtagagagaggtgagaaggcagtggtgggagatccatctgcgaggtgcctccatggctgagaaggagggcaacctcgacgccgtcctaagnaggccgtcgacttggtaaggaactcactctcaactctctactctctactccggcggcgccaaaatcttgcgtctttgtgctctcttttccgttcttttactagattggtgctccttcctgttccgcggaattcgggcatgtgctcctggtttcttgggttgcaatcactcacgagtttcctgttttcttggcgtttcttgtgactggctagcgtttctttagcaccctgcatggctgccgttctttctttccctttttcgttctgtgagaattcgtttatttgctcttgtaaatctgggtttctgcggttcgttctgccaaataattccatggtggcgacattggcatctccagctccagccttgtttgcttctggctcagccgttctcgaaatagtagttgtagtggcaatggctgcatgcattaataggtgacggctgacaattcggtgggcgggctgatgcttcttgtgtttccgttttcgtccatggagttggattggtgaattcttgtttgtttgtttttttcctgcaggagaatattcccctcgaggaagtgtttgagaacctgagatgcagccgcgagggtctcacaactcagcaggcgcagcagcgcctcgaaatctttggccccaacaagcttgaggagaaggaggtttgctttgttccttatctactgtttcagaaaaaaatgcatctgagatgtctgaaaatgcttaagagttgggactttgatggtggcactggcaggagagcaagttcctcaagtttttggggttcatgtggaatccactctcatgggtcatggaagctgcagctatcatggccattgcgctggcgaatggaggggtaggcagttagatatctgagccaattccgattttgcctagcttgttggttagaattcaggagttgattacataacacatttgttgtcttgtgttgtatcatcaggggaagccaccggattggcaggactttgttggtatcataactcttcttgttatcaactcgacaatcagtttcattgaggaaaacaatgctggcaatgctgctgctgcactcatggcccgtcttgcaccaaaggccaaggttttaccttttatgctgttcactatgttctcaaggcaggtttcatgtgcctgtaaggcccattcacaattctgaatccatgagacatattttgtgttcttcaggtgcttcgtgatggccgatggactgaggaagaggcggccatccttgtaccaggggatatcgtaagtattaaacttggagacattatacctgcagatgcgcgtctccttgagggagatcctttgaagatcgatcaggttcttcccattgctcgacttaaagttgccttcaccttttgatgatccatcaaggcttctcctcactatctctcatgttgtagtctgccctgactggagaatcattgcctgtcaccaaaggtcctggtgatggtgtctattctggttcgactgtcaagcaaggtgagatcgaagccatagtgattgctactggtgttcacactttcttcggaaaagcagcacaccttgttgactcaactaaccaagttggtcatttccagaaggttagtttgaaatgctcacctcacatgtgtgtattcttcatcaaactatcatggtaattcactcatattattatctgattatcgcaggtcctgacggctattgggaatttctgcatttgctcaattgctgtgggaatgtttgttgagatcattgtaatgtaccctatccagcacagggcataccgccccgggattgacaacctccttgtccttctcattggaggcattcccatagccatgccaacagtcttatctgtgactatggcaattgggtcacaccgcttgtctcaacaggtttgcatctgttgctttatgtatgtcacttttcagttttggtttgtataatgtgctaaccacttaaaatattcagggagcgatcacaaagagaatgactgcaattgaggagatggcgggcatggatgttctttgcagtgataaaactggaactttgaccttgaataagctcaccgtggacaagaacctcattgatgtgagaaaaaacaaatctctattctattaacactttcatgtctaggttaaaaagcatcaatttgttaatccaggtctttgaaagaggaatcactcaggaccaagtgattctcatggctgctagagcatcacgaacagaaaaccaggatgctattgatactgcaatagttgggatgctagctgatccaaaagaggtata

SEQ ID NO: 42487 - DNA, 1869 bp, Oryza sativa
attcctgcagccctttttcagctattcatatcttagctgctttatgagagacagcattataatcagacttgaattttgtggcatagaatgttatgatgtaaactcaaataattgactgcagattctccaccttgctcataacaaaccggagatagagcggagggtccatgctgtgattgacaaatttgcagaacgtggacttagatcgcttgctgtagcataccaggtgagaagggttacagtacaccatctatcataacctgattttcactgtgcagcagcgatggtatcatttcatgaacaggtttaaagtaattgtagattttagtaactaccaagtcttgtccatgcaaaccatgactttcctctttcactgtttactgcgtacgttatcttagtggtgtgttactctgttgttgaatgtaggaagtaccagaggggacgaaagaaagccctggtggcccatggcattttgttggtctcatgccactttttgatcctccaaggcacgacagtgctgaaacaattcggcgggcacttaatcttggtgtcaatgtcaagatgatcacaggtgcatgctcaaatattctgtattgtcagttttttttcaggcttatgcaggaatacagaattctggagactcgatttatacaatcaactttaaacaaaaaaaagaaaaggaaaataggattcacatgagaaccaaatagtacaatgtaagaacatggtcgtgagcacccagacctcaccaggaaattctgttctgctgttagctggccagatttttcaaccctagttctgtgctttccatgggatgatccaaattatccgtttgtctgtttggtcactttatttttacagtgaacatggttttgatgcagtcctattgataaatagaacataactcagattaaaaatagtatatttcctggaggtagccgttttcattacattcaaaagactgctatttgcgttcttttgtcctagtttattaattggtctcctaatgttcaggtgatcagctggcaattggaaaagaaacagggcgtcgcctgggaatgggtacaaacatgtacccttcatccgctttgctgggacagaacaaggatgagtccattgccgctttaccagttgatgatctcattgagaaagctgatggctttgctggtgtattcccaggtatggtgataaggagttattacactgcaaagattgagagttgggaaagatgaattgtttaattctaagttaactgagtgaatggcttttgtccagagcacaagtatgagattgtgaaacgtctgcaagcaagaaagcacatatgtggaatgactggtgatggtgtcaatgatgctccagccctaaagaaagctgacattggtattgctgttgctgatgcaactgatgcagccaggagtgcttcagatattgtgctcacagaacctggtcttagtgtgatcatcagtgctgtgcttacaagtcgtgcaattttccagcgtatgaagaactacactgtatgttaaagcggaatagtgttcaagtactcttttatatgtttattcccctaatttatctttctaatgcattttcatgttggcagatctatgctgtctcaatcaccattcgtatagtggtatgtttatcttgcttttacttctgaatgaaaacttttatatccatgcattttttaattatgtgatttaatgtgttggtatcaagctgcatcaagtctctgtatttatttatttatttgaacaattatccttgatgcgactgctagggattatttttttatgttattcagatcaagttacaaatactacgagatttcaatccataactgtccgctatgatatatatccatcttga

SEQ ID NO: 42488 - DNA, 6932 bp, Oryza sativa
attcctgcagcccgtaaatctctctctctctcacacacacacaccggcacacaaccactgcacatgttcacacttgctttttgacaatagaaattatgagcatataaagatattcaactatgtactgtgatcgataggtaccatcatgactatatcaaaggatcgggtaaaaccatctccactacctgacagctggaagctggctgagatttttacaactggagttgtcctcggtggatacttggcaatgatgacagtaatcttcttctgggctgcatataagacagactttttcccggtaaggagcactgtgttgagacttgagacatttgtttgtgatgatttttaagccagctatgcaagtattcttggctactaacgatggttaaattgttagtgaactacttttaggaccttatttgctttactcgctgaagcttattgtttataaaatttcagagaatatttcatgttgaaagccttgagaagacagctcaagatgatttccaaaaacttgcctctgctgtttacctccaagttagcaccatcagccaagctctcatctttgtcacaaggtcccgcagctggtcatttgttgagcgccctggatttctgctggtctttgctttcttggttgcacagctggtctgctcctactctctcactgtctccctcttatattttgcttcaggagttaaagccgcattgacgtaaacttttggtttaaacaaatacagattgctacactgattgctgtgtatgctgactgggcgttcacctcaatcaaaggcattgggtggggttgggctggtattgtgtggctctacaatctaatcttctacttcccactcgacattatcaagttcctcatcagatatgctttgagtgggaaagcatgggatcttgtcattgagcaaagggtaattaataatgcatgctacacaactgtcttggcccctcacacctattaagtttctgattctcactaatgtttgtctacctgcagatcgctttcacaaggaagaaggactttggtaaggaggagagggagctcaagtgggcacatgctcagaggaccctccatggactgcagccgcctgatgccaagatgttctcggagaaggctggctacaatgagctcaatcagatggctgaagaggcgaagaggagggcggagattgccaggtaggaggaccacactacacttgcaaaacatcatgctttcttgcgtatacgatttcttggatcctttagtattgttccacctgtccctttctccatcagtgcattgttactcatgaatccatttttgaatatgaaaagtagtatctttttttggcgccaataggcaggcaacagttacattgaacatataagttggttgataacgatgtgaagctaactttgggatgatttgttacaggcttagggagctccatacgctcaaggggcatgtagaatcggttgtgaagctcaaaggcctcgacattgagaccatccagcagtcttacaccgtgtgatccagcctgtccataaagaaagaaaaaagaggattattttttttccagattttcctgtttcgctttaacttgactgcaattctgcaatcacctacgtgtacttgaaccgaattgctgtaatctttgtccctcctgctccagctttctactacatggtagtgttatataatttttggtcacctgaaaatatataagtgtttgaggtgaagcacaatggcaatgccagagtttttttgctcggttactgagaagcatgttttcataatcaatcggtcaattgtatggacatattatagatgaatttggtaactgtttgtgtgggggcagctggcagtatgtaacatgtgggcttcaatgtatccaaccaagaggcaatgaatgaatgaatgaatagcggtgactctggtcctggactggaaacggatctgtttgttgttgggttccagccagatctgtagtgaggctctggctggctgatattgttgtctgccatgttgcctgtcaagtttgcaaaaactgtgggcacatcacatgagatgagttgagagcttttattttctaagctgcttgctgcgttgcatgcaggatctcgaatgatgcacgcttgcttgagctgtgcctgtaccaaatgtatgtagtactagattgtgtatgtactatgtattctccagctgccgtactgtgcacggataattggtttgtctcgtctggtctggtaaatagagaagtccaagtgttcaattcacagaatcttgttttgtagcaaaagtaatcaaatgtcatgagatttttcctttttcttgaataacaaatgtccgtcctagggacaatgtcacatcagtttggtatatgtagaagtgtagtaagaatcaatagattacagcacattcagaaacggtgatcccaacttaaaagaaggccacggcccacggcccacgacccactgaaatggcaaagcccaaagaggaccaaagaggcccaaataaagatgaggcccagaagcagaagcaaacaccatggttagctcagctggaggagagccaacaagcaaaaatgccgcagtggccgtcactccagctgcccgccgccgccgccgcccgccgcgccactcccttcgccttgtgcaggagctcgtcgtcctccgtttctgcgtcagcgtccaaccaggacctggtagcgtgttcttggcaaaaggaggatgaggccgaggcgcagtcgttggtggtggtgggcggaggcgccgccggggtgtacgcctccataagggccaagtccctggctccccacctcaacgtcctagtcttcgacaaaggaaggttcttgtccaaggtatagaaattctctttgtttgttttaatttctattttccatcaggcactacttcctttccaccgaatatatcattgttactgttgatttgttgccacttccgacgaggctgctgtaggtcaagatttctggtggtggccgatgcaatgtcaccaacgggcatcatctggagccattggtttgttcttgtccacactggatgcatatgctctatcctatcgtctcctttgttcactttcactgtaacagactgacagttgaattcttgttcaggggatggcaagaaattatcctaggggacacaaagaactcagaggatcgttcttcaaaaatcatggccctcaggatactatgcgttggttctcagatcatggtgtcgagcttaaggtatcatagtcatgacaccaagattattaaataaatcttttacatccattgatcatctattagtctgaacccacccggtcaagttattgatgtcgtggctgtttctattggttcgatttcatatcagacagaagatgatggtagagttttccctgtcactgacaattctgcatcgatagtagattgcctactgaatgaagcaaggcgacttggaggtatcttgtcctaattgactctgttgtttattcatttgtcatctgaaatttaaacaacaatcgaatggaagtttccctgcaggctggtaaagctgtgactggtgcatctgtcactgaaaatgggaagtttgttgtgaaggttgagaagcgtaccgttgattttgtggatcatgtaaacgctaaatatgtcttagttgctacagggagcagccagcaggtttgagaaaagatgtttggctcctcccttcttgttattgatgtataatacagcataaagttctcctcctttacatttttcttacctgcagggttattcaattgctgcacaatttggtcactctattattgctccagtgcccagccttttcacatttaaaattacagacaagcgattggctgacctctctggggtatttatccatgaatacctttgtggctcttatgttatgaagtagcaaccaagacttgtaaatctcgttttcatcactgttatgcttttgacaacaaaacaatcatgtattgcatatgaagagtctggagttaacatgtttttgtgtgcttccatggtctggtctaggttccatccgagtttaagcatctcatgtgcatatgtatcctgttttctgtctgatatctagtggaaatcacaaatcaagtggaagcatggaaaccctttcagaattcacgttagcttgctgcctcaatggatttttcatgtttctgtctgtgcttttcactagaattgcagtaaacattactatgaaacttaaaacacctctgagtttgctcctaaaaggaggaaagctgatattgtagattttttttttcaagtcaattggacaagagctattcaccccattatctcctgccatgtaggtcacattcccaatagtcaaagcaaaactgaagctagacggcattaagagaagtgctcctgaattaactcaggtgaacatgtcaacattcaattgtttcatagatgtttgcttacattaactgcttggtctttacagattggacctatgttagttacacactgggggcttagtgggcctgttgttcttcgtttgtccgcatggggagcacgtgaactgcatcagtacaactaccaaggtaagatgcaatggaactatgcaggaattgcactacattcgcagcctactggtaaatggcaacacaattttacttgccatgtctgtctgtttccgtacttgcacaagttgcattcagtagatccacaacagagcctttttcttatcagattgctgttttgctgggcatccttatgaggtcacttctatgtagaatgctaaagtcgctgagttattattcaatgagttacgcatggttgcaagtttcataacaaatgagactactggtatctcatattaggaatctttatgctgtcagtggatttggacaaacttaccttcatttgaaacacttctcttgctgtttgttctcttggatcatatgattcttcgatgtattgttctaacaaacagtaaacagctaaagaatggtctctccaccttctgagccaattagctttactgtttgactctttggcagctgcattgagaatttttatgtttcatcaagtatctgaaattttccactatgataatattttacaattatatgtaagacagaagtaaatgtctatattatccacttcactgatacccatacatttcttccaacacagcaaagctcaccgttgacttcatacccgacattcatattgaggacgtgaagcgcatccttttcctgcacaaagatcaccatgcggttcatttctcactcttgtgctattccctttacatgttctattttttttttataatctccttcacgcattcatctaaggatctgaatttctgatgactaacattacacttgattgtccttgctttaataattcagaacgtgtgtactaaaaatagacacgtgtacaaatctctgttctatttgacatattggggtgttttaatcaagactttagatggattctgtaatctgttgcagaaatattccttgtgttcctgtgaatgttctaattgctgaataaaaaaattgcaatgatgaagttgaattaacaagttttagtccttgcagaagcacaaaataaacaactcttttcccatggagttcgctctggtgaagagattttggaaattcttgctagaacaggaggtcataatattactgcggtgctctttactcattcctctattttaattgatggtttcatcactaaaatcttctcgcgcagagtttagatggtgatatgcactgggcgtccataccaaataataatctaaacacagtagcccttaggttaaagcaatggatgtttgaggttgtcgctaaggtatgtgatatcttaatataccaattgaaaacataatgagcgcaatcatttaggtaagaatattttttgtctgtccaaactcacagactgttatctcatcatcatttgtagggtcaattcaaagatgaatttgtcaccgccggaggtgttccactttcagaggttattagtcttaattggttgcagttttcatcaaaactgaatcaacttgcatatatatatgtctaatttgctgccctgttctaaagatatcgctgagcactatggaaagcaagaaacagcccaacctgttttttgcaggagaggtatacatttgttcttgaacttgcaacactctggatcagcaagagaacaattgaccttagcatgaccgtggtgcaggtacttaatgttgatggggtcactggcggattcaattttcaggtacgcattacaagttcccttaaagaatttcacctattttaaaagatcgaactgttcattagagacttggagatctttacatacgacaaagcaaatttcaatctcatcgatcaagtatagcacttgaaataatagaatattattttgattaaaaatgtttcacttattttcaagtagaaaacatggtttgtaactataatctattctacattctccacagaatgcatggaccggtgggtatatagctgggacaagcataggaacatggcatcaagcaacatgaggcagcaacagccatatttgcaactggacggatcatgaagtatcacactgcaaaaaggactcctgcctgttcttactactgaagactaacattgacaaatgacattgtagatgtacatagaggtcaatgatcgattgtagagatgtacccgtgaaacaatctcttgttattagttagcaaacaagttcagaagtagtggattgtgtactctgcacagctgtgagcaaatctagttgtcatttctccaacataaaatcagatataaagttacactcaaggttatctgttggcagtagcagctaacgagtcattcaagctcccagaaaaggttggaacagcaatggacgtgctggaacacgaaatgattctaattggctatcaattaagacaggataatctca

SEQ ID NO: 42489 - DNA, 1234 bp, Oryza sativa
ttcaggacctcctgctatggttgctaattcaccatcgcaaataaagaatcaaagacatcctggtcagcgccacacaaattatcattctaacaatttcagtacagatgctaggtgggatgaagttcaaacccaaaacttgtcagctccagctatgtatactggttctggtcacaaatctcaggcccttgcgggaacaataaagagtcatggtggaggacctcagtctaacttaagatcattgaagtcattgcgctcagttgaacagtactaccatacactgcagcaaatgaaatggggtcctatgacggaacacgttctggataatctccattgcaagatagatgcattccaggcaaaccaagtactcaagctgcttcatgaccacaccattgcacttggtttcttccagtggttaaagcggcaaccaggtttcaagcatgatggtcatagctacacaaccatgataggcatccttggacaagccaggcaatttggtacgatgaggaaacttcttgatgagatgaacagtgttcactgcaaaccaactgttgtaacatacaacagaataatacatgcatatggtcgtgcaaattatctaagagaggctgttaaagtattcgaggagatgcagaaagccggttatgagccagatcgggttacatattgtacattgattgatatccatgctaaaggtggatacctggaatttgcaatggatttatataccaggatgcaagaagtagggctgtcaccagatactttcacgtacagtgccatggttaattgccttggaaaaggtggtcacctggcagctgcttataagcttttctgtgagatggttgaaaatggctgcacacctaacctagttacatacaacataatgattgctcttcaggccaaagcaagaaattatgaaaatgttgtgaagctgtacaaggacatgcaggttgccgggtttcgtcctgacaaaataacatacagtattgtcatggaagttcttggtcattgtggtcatctggatgaggctgaggctgtgttcattgagatgaggcatgactgggctcctgatgagcctgtatatggtcttttggtggacctctggggcaaagctggcaatgttgacaaggcactaggatggtatcatgcaatgcttcaggatggtttgcagcccaatgtgccgacctgcaattccctactgagtgcttttcttaagataaacaggttccaagatgcc

SEQ ID NO: 42490 - DNA, 1434 bp, Oryza sativa
cattagctcgagattggcagctataattgatgacagcgacaaacagcatagacaataagacatctaactacggatggattagaataatccatgcggtagggggctaatgaggattactagcagtagcagaaggcccggtgagcatcttgtcaacttttgccaaaagcccctgcatttccccaagaaggttttctggcatttgctttgatccatctgatggagttgccttcttgacagatgaatggccagccagggatgagatcatcctctccaggtttttcctaatatccgtaaggggaggctttgaagctggcgaaggcacgctcaacttgattggaggaagataatgaagccttggtgtagcaaacgggggaccaaacataccaagagtttctgcgctgttgtaagccgcctcagcttcagcacttttcccaaacacaacacgagcgctatgggtatcttttacgatgtccgtctcagactcaatcacgagaccaaacttaccaaatgcagagagcaattcctctttggagggcagaacaacaccctttgcaaagtccaaaagaagggctgctgggtttccaaagtgctctgcaattttcttcttctttttcttaggagtagaataagctatatcagggaaagcactattggtagcttcaccagaggaatggtttacattagctccaggaaccatcttcttcaggctaggctgatcggccctctggccctcatctttgagggaattgcttgctgctgctacattagtgccattggcgacctccgctttcataagcatttccggcaccatcgcttcaagggaagcataagattcttggaccgtacgcacttcggcgcttgcatgttctttatttccatctgtcggctgagatagggatacgtcttcacttttaggaagaggtgcacttttgtcagtcacatctacagcagcattctgcccatctctgtgtagaggaatattagcttcagacttcactgcttccaccggaacacatctgacaggcacatctactacaatgccttgcacacctggatctgcttgaatgttggtatgcaactgtcttgcttccagcatacctgcatcattctgttttgcaggttggtcagataaattcttgcaagcattggctggggtcttcaaaacagatccaccatttgctttgtcctgctcctgtcctggttcttttgctaccttcgctgaagctaatgtagggctcttaaagtctggcttgatcttctcaagctgcacaccaactgccataccccttgcaccattctctggtttcgtcgggcttcttatgtcttctgccctcgcttgcctgataggaatagcaggggtaattgttacaccacagcctagggcagccgcaggagatttcttccccctcttctcggtcttggtcgaagaactcc

SEQ ID NO: 42491 - DNA, 9833 bp, Oryza sativa
tggatttccttactaggcttttcttttctttttcttgacaggcctctgttccagtagagcttgggcttctcctacgattgtcatatgggccgttggagtttgggcttctccaatgcaatccaacggcctcttctccctcttatctctgcaactttaaaacacagagtcatctttctttcatatgttttattctcaatcatcatttcagtacatttctatttatatagccctgcctcgttacgaacattacaaattacattatagtatgttcttatttgtatgcaaattagggccatattaccggtactataataatataagaaagcaaagagaaagaaagagagacaagtgttgtttggttcacttgagttgggttgcacaccatgccatatatacgtggattagtagcactcaccaaattcaatcatttgcagcatccatacatgtaagcttacaatacaatatttatttgaccgagcacgtacgcaaatgcactctttgacaaattaagcaagatccgagtgatcgaccatgttttccggaggacttaactgaagtagatagatattcagatactccatctaactactactagatgatactatatgcgtacgtcactcagtcaatgggacgatcgactagattaaattattactttcaccatcctaattaatcctatcttagtataaaattatcccccactaactccttaagcttaacatgcaaagatgtcacatcatcatccactaacaatcatcacatttaaatatcatgcaaacatgctatatctttatagtttttataatttaagagatttcaaatacaaacatgttaaattatcatccaacataatttacataatgtttcaatgtatatctttattatgttttatgatatcctatatagttttatagttcatccttatttagttagtgcttaaatgattaatctatggtccaaattatctttctcattttttcatctaattaagtcatatcacatcaattatttttaacctttagatgattaatctactttccaaaccatctccttatttttcttcttccaaaaagtcataccaccttactttttacatttgaatcaccattgtacatactatttaaatttaaattatcataaaccacattaacttacttcttaaactgatgttatctagctatcttacaggttatttttattgtttccatactaaattttccacagcaatacgcgggatttcacctagttaatgagatatgcataccacaatcgttcaattcagtcatatttttactatcaatcacttattaatccattcattttaaattactaatcgttacgttatatattagtttaaatcaaacattttaatctttaacgttaatttctataaactcatacagtttaacatcataaaatttatatttttatataccatagaaataatttcataatatatgaatcacatgctaaacaacacatatttttaaaattggcatatatgtagtgctacataatatttatagttttcatagaaatattacttgtcgcatgtacttctagcaggttttcgggaggaatctagaaattaatggtaccactgtacgacaataaataaataaataatgctattgataggccactcggccagatgtcaaaaacctaacgctactcttgatacatgtgggaatatgtgtacatgcataaaatatttcacgcgagcttcaaataatattttatcctaaacaacttatctagcgcccgtttcgtcatggcgcctagtgggaaaactatctcttaaaaatcctaaatgcaaaaattgtttccttgattattgtccagtgtccgtgccattccagatctcaaatctccaatccatcgtcgaatccaaaccctaatctcaaatatgtcctaaatcaaatcctctcgaaaagtctactttgcctcccttgagtctgtgggccgatctcttctccccggcccatttcctctcagcccatctctccctcctcctccatccttgcccgcacgtgcgaggcacgtgcgacgctcgggcgctgagcacgagagagagctcgctctctctttctcttctccttccctctctgctcccgctaccgcttcctgccgacgccgcccaaatcgccgcgccgttgcttcccgcgcgcgtgcgcgcgccatggtggccgacaggccagtcgccgccgccgtcagcgcctgccgcgcctgagcccgcgcctgccgccctgtagccgcgcccttccaaaccgcccccgccgtcatcgccgtcgtcacaacccggccccaccaccaccgtgcatgcttgcaagggttggaggcagagctcctgctcccactgtctcgtcgccctctctctccttccttcttttcccaaagtggcaagaggcaagtctcctttccctctttcctttcttctttttctcccccgccggcgtcatcctccctgtcgccgttttggccgctagccggagcgctagctcgctggcttgaccgccaatgtcggttccgccctcccaaaccgacattgtcgcccctataaatccgagcccctttccccattccaaactcccttgttttcgccttccgtctccaccgcaccattgtcgctccgccctacttgcacctccgccattcgttgccaaagcaccgggagagccggcgcgtgcgaaggacgcgtgaaggggactccgcgcgctcgtcttcttcctcttccccggcccgaggccggagagatcactcccgtgccgtcggcctctcatcacagcgccccgcctcgtctcggtagggcatccctccgttctccctcctcgctccatctcttccccttagctttgagtagcagctcgagtagtaccccagtagctagttggcgccgccccaagccgcgccgccgctcgcagtaagctcgccgccatcgcacccgcgctcggtagtagccgcccgtcgccggccttcctcggcgatgacccgtccaatccgacgctaaaaacggattcccggagtcacgtagatgctctaactcgcccgaatcgatctcccgtcatgccgtcgccgtttcccccttctctcgccgccggttgccgccgccgcaacccgccgccgtcgagccccctccggcgaatccgagccgttggctcgtctccctttgtcccgtgcaacctcccggtgcgctcgcccatgcctgcatcgctgtagatcgccccgccgctcgccgccgccgtccgccatccgttccggccgacgtcgtcgtcttcctctcaccagcccacgtggctgccacgaaggcggcacgtcggtgccacctcggccgcgaccgggtcaagcagacctcggtccgccgctcccctccgccccgctcgcgcacgcggtccaccgcgagccgtgaggctgcgcgtgggcccgccgcatccgcacccaccgcgagccgcgcgcgtgcatcgcgccccgctccaaaccctagcgccgcgtcgcgtgctcctcgctcacggtgagccgagccgccgacaagcaggtcccactcgggatcacgcgaggtgagcccggtccaccgactccctctctcctcccctcccgcgtgcctttgggccgccttctcgggccggccggcccattagctcggccgagtcgcgcctcttctctcgggccgcgccctagccgcccgagggaagtctgtttcccctccctctttcgttgctaattcaaaaagggtttaaataaatccttttcttttagtccaaaaatccgatgatcttagaaattcaatatcttttcaaccatacatccgtttgactccgttcaacttccaaaattcctcaaatctcgagatctatctaatggcacgcttagaggtcaataatagggctttaatttcgccgtttgttgagtcatctcgttcgcgtgtagcttcagagcccgaagacccggagtgcgcggatttcgaggatcaagctcaagatctcgagcaaggcaagtcaactttgatcatcttgcacctataatttaaagggacaattcgaaccatgccacacaaattttgcaaaatttgtgatatgccaccctgacccacatgtcattgactcatgtgtgtcctacatgtcattgagatacgggtggcatatctcaaattttgcaaatatagggtggcatggttccaacaaaccctaatttaaatctaagtatttcttttccacaaatattgcatgaataggattaacacaagtaaatcggccgcggcttgcgagatagcctgccggcccaaccctaattgttgcaattaccctccttgaattattgaacacttaaacctcctttgtcgactgttgtgcttcgatgcacgggacttcgggcacgcgcatcgggacacctcccctcaaatttaaaatatccaacgatgggtaaaacttggggttttacaaaagacttggaaaaacccgacacctgggtcggtgcttgcgaactaaatgaatttccaaaatcgcggatcgaggaacgtaccgggagtacggtttcccgctcttgcacttaaggaccgttttccttggaatttcatccgaacataaggcaagtgcgaccacatgggtggaatgggatgcccctggctgagtaattagctaatcgaggcagccattatgccaagagacatgtggattcaacggggtggtgccagggagaacccccgggcttcctggcacagtatggtctgggacctaacctaatgtcggtttgggacccctctcgttggcatatggtgaacctgtgtcagctttcgaaatgccttgtcatgaaagcctcaaggtctctagacgtggccgttctgcacgggctgggtgatccgggttagtaatgtcgtgtgggtaaagtgtaccccctctgcagaggttattaaactattcgaacagtcatgcccacggtcatgggcggatgtgaggtgattcctagcgtagttttgtttgactactgcttgtgaaattactgttgtggaatgggttcgatgtttggaaaatctgcggctgatgggatcagccaggcccgggtgcccgtttgaaagccgttggccgggtgccaaccttgaatcaattcaaagactgatacattgcacatactccgaccggacgagacgcactacctcatccgtgtcgtttgagaagcactcacttagttgtttcaaaaaggagtttaaataaaatcaattgcaaaaacaacagtctttccttgaagcctgcattaaacacttaattcccatggcttgctgagtactcctgtactcacccttgctctatataaataattcccccccagttgctgaagaagatgaagtggatcccgctgacgaggagttcttccaggagcaagtcggctacgatgagttttagggtttcggtctagttcccaagtcgcgcctgtgatgattggtccaagtcttggcttccgctttcccttttgtaatgcagttgtgagctcgggatctgtccgcagcccaacatgactgtacttctactctgtaataaagagacctctgttgctgtgatattctgtcttcctgtgataccagcactgtttcctgagactggtatcgattaacaggttaatttggagcgtcacgggctagttccgttcggggcgtgacaacttatccaatctatgatccaataacactgttatactcattgcaattaaatgtttgcaacaaggtactatagttaattctttacatatatattctaattaaaaaaatacatgtttttatcatttaggtcggatgtttcacacttcaaactgaaatctttcaactggtctgttactatgttgcacattttaattttgttttataatatgtctttcttaatgttgcatatgaaattatttggatgttttaataagtgcttttcccatgtgttactagttcatttgaaaacattacatggtaattatattttagttaaaatatacatgtttcaattatttgaggtcggatgtttcacacttcaaactgaaatgtttcaactggtccactactgtgttgcacattttaattttgttttcataatataaattttctaatgttgcaaatgattttcttggatgttttaataagagttttctcatgttttaccagttcatttgcaaatattacatagtgttgtttgaatgtttcagcagatattttgtgatgttcttgatctttcacgctttatataaaaatattttaactacaattataatgatatactatttttctccagaacataatcatatgaggtcttactgtaatcatttaattgcaacaaacaaacgatggaatcgatcacataacaaataagtagtttacaagaaaatatattgatacaaataaccgtaataatcaagaggtccatatatgatatatggtccataccaagtaaatatatcacacgactatatatatccctagcagccacgaacacacttcaactaggttattgggatcaagatacttaatgtgttgggcttttttttttccaaacaattatagaatcagttcgtaggatcaaagatactaattttatcaagtatatgatttatgtaaaatttgcaatattgtaaagtttgaagatgataatattagtttggtagggatcgagctaataaccttgagtccaactgcgagctactaaggagtactccctccggttctataataattgacgttttggacaaggttgagatcaaactttaataactttgaccatcaataacttcaaaaatatttagtttgaagaaactagaacaacatatatagatttatctttcaaaacactataataaaagtaaacatgcatttatttattatgtatattataatagaaaaataagttcaatggtatattttgtagaccgtgtcattgttcaaaacgtcaattaaaatgaaacagggagtacttattaatcgtgacgaatatttgcatgtaacagtaacaaccaattaaggcagattaattagtaggactactgtacatggtgtatacaatttattaatgttgttctaggatggatcatttgcatgaatggcagcaaataatgaattaatcccctagctagtagctagctagctgcctactccatgtatagtcttttatacggagtaacaaattaagatgacccctaatataatttttccgttaaaaataaccatcttttatatgaaaaacttgacataggtcccaacacaagctatatctacttaactgtcaagtactgttcatcagccaatatatcattgcatttaattatatatattcgtgatgtgtgtgtacctttaatttgacgaacgtatatatgttgctttctagttgatctcctcgccattagttatgattattgagatattttaaaactgcctttactttactgataacagagttaatctatattgtttatttctttactaactactatcttatgaatcatatttatttatagcagatctatatacagtatagatatcgactactagtagtatagtagtatagttgtatgtatttgttgtactgtattatgtctcgtctcaattctaagaattttttgaacggtgagaatatgcactttcagcacgatgatcactaaaataaacagggaaaatatgtagtgcaaaactaactatgtatcgaaaaaggacgttcaagattcgtccacaccaaatcctggacgtacatttttttgattcagcgtgaattttcagacttccacaacatatatagtttccaccatttttccaaataagcagatactcgtcagtaatgatgttttgatgattgatagataaagagagcaaaaggctagctacatccaattcgctagctagctagagtatatacacgcgtaccgcatttatatggatctgcaattaattctacatggagatggatgtaaatgagtgcttgatcagttacgttaccaaaacgatcttttgataccatttggcgaattaaattaaatggagcagatctaatttgagaatgtatatatgaatggtcgagggacatgcatgcatatcattgtctaaaataaagatggaggtagaagcggtctatctcgggcgccctctgcctctggtggacaaggacgatttgaattgatcgatcgattaattattgaacttttgtcatgactcgagacggcgacggaaaaattgatctgcaggtacggtatatgtatatatctcgtctcagaaaattaattaactaattaaccgcgtatctatatctcattcgatagagatatatatatcgcaaaagtacatgcaatttgtcagtcttgagtttacacttgactacacacgtatacgtgcaagcggtaaatggacgttgctctcagttagtgtatgtggcaacgtgacggccggtaatctagctagctgctttcttactagtactagtactactactttagctacaactttcacaagatagctaataagatagatagattcttctcacttgctcttgtgaaagggagaaactgaaggcatcgagcatgtacatacgttcagattgatccatacaaatacaagtacagctagcatgcatgtatacatatgtacagatcgatcaatataatgtaattaatgcgtatatatatgcatggcgatcgatcgagactgcagacaggccggcatgcctgccgatatccagcttacgactcaatggccagcagtgacaggttttgactatagagacgatggtcaggagagagtgactgtggcagtggtgcacgtaagcatgcggacaagtcatgtcgatcgagtcaaagctagatctatctcatgaaaatgccaacatgcatgcatgttcaaccgccgtatcaacacatagggaaaaatgtttctatctcccgcgacgtcgtatcatgcatgcatcttaataatattcgttaaaatatttaagaaatatcaagattaatatgtgatatatttttttctcaacaaacatatgcaataactataacttacacaaattgaatttaagcttcgtacgtttatagaataatatatctcatattaatttatatatattttatataaagatatgatacgtaaaataccaagagatgtgtctggagacatgcaaatctatctctgtatcgatcgtgcatattgatcgacgacgacgacggtgatgtgcactagctctagtgtactgtacatcatgtcgatcgatcgatcaatcggtagtctatatatatcgatccggaccatcatcctcctgtccactgccacgcgcgctagctacttgttgagtatatatccatcgatgatgcatgtatgataggagaaaattaaaagctactctaggtttgttgttatcctgcagtacgtttattggggatcgatcgatcgacaggccgccgcgcgtacacacatatactaactccttccttaaatgtttgacgccgttgacttttttaaacatgtttaactgttcgtcttattcaaaaaacttttgtgaaatatgtaaaactatatgtatatataaaagtatatttaacaatgaatcaaatggtaggaaaagaattaataattgcttaaattttttgaataagacgaacggtcaaacatattttaaaaagtcaacggtgtcaaacatttaggatggagggagtatatactccatcgatcgatcggtggcttggatatataggatggatgcatcatccatcgatcatgcatgcgcacctgggctagctgcatccagaagctactcatcgctttcatcctgcgggattcctgcccaagagtagctaggactcaactcatatataatttgttcaatttttaa

SEQ ID NO: 42492 - DNA, 11274 bp, Oryza sativa
aataagtatatatcttctgttcttttaagtatatatatattaagttgataaatggctatagcgattgagatgtatctttccattttatcgactaacttttatagcacgcatgatataaattactactcaatcaagagttccgtagaattcttcacctcaaattttgtttgtaattggcaaatataaagaggaagaagtactgtagcagtatataattaagttaggaaggagaggactcatcggatcgatcgatgaccatcgagtcgcgtcgatggatggatcagctagcgtcagacttaattcggccgccgcatatatatgcatgcgacaaacttaatagctactccatccgtttcaaaatatttaacaccgttgactttttagtacgggtttgactattcatcttattcaaaaaatttaagtaattatttattcttttcatatcatttgatttattgttaaatatactttcgtgtacacatatagttttacatatttcacaatatttttttgaaaaagatgaacgatcaaacatatatcaaaaagttaatggtgttaaacattttgaaacggaggagagtactatccagttgcactgtatactccatatatagtggcagtgctagcaaagtcaaactaatttaattaattattaagaagcactcgtatgtatatatacgtacagttgccgcgctcgctgcagcaagttgatgatatcgactagctaagctacccagttagcagccggcaggaccgatatatccgcaggcggctaaagactggagtaattagcaagccagtttgagtagtaactagagtaactaataaacacatgtgcagaaactgagattttgtaatgagtagaagtatgtatctagcttcacgagcaagctaatttaattaaggtagcgtccatttttttttaaaaaaaaagaaatcgtagctagagaaggaccggccgggaaaacaaaatcagctgattaattgacagtatatacagtatagctactgtagtaaattgctttgcattgacgttgaaatctgaaagcagaataatctgcagtccatcggtactctctagctagtctgtacgtagtaatatctctctctgtctactactagtactgcaacttgttttgactgtcattgctggagtatactatatatgattgataataggagtagtaattaataaataatgtacacttgccgccggaatacatccatccctacgtactattcaccagctgcggtcatcttgactccacacttgatcagtagcactcatactcaaactaaccaccatttgctagtacttcctctgtttcacaatgtaaattattttagcatttttcacattcatattgatgttaacgaatctagacatatacatctatctagatttattaacatcaatatgaatataagaaatgttagaatgacttacattgtgaaacggaggaagtaccaattaagccttcttttcctttggtcaaataaagttaactgaaaatgacgttgtacacatacacatccatatacagtttccggccaaaaaattactaacaccgttttgactaatctatgtgtatatcctgatactggccgacatcaacttaattacatcatatcgacccccctgcccaaactatcggacgaactaagctagagtgtagcaaaatcacacggtacagctaccatatattagcttgatccacaagctccccaaattcccattaattaattaacctgcagcctcaattatttggtctctgactcgtgcttaagtatacactatcatgcgcaggaagacagatttacaggtggatggatgatttgtgatgattattcgtgatttgcgataaatggtccctggtaattaattatttgagagtacagacgaaggaatgaattaaaattattaattatccaaaaaaagtagtatttgtaagaaactcatgcatgaaaagtctttttaaaagaaaaatggcaccattatttaagtacttttgcagtgagcatatggtacttaattgagcactgtgcatgtggaaggaaggcaatctcacaacaattaaattacactctgttcatgcagttcagtcgacgttatacatgcccttgaatcgaatcaatatctttgtgtctgtctgtctcttgctggactctgcttctgctaagcttatttataggcctccactcactcatctctccttgcactcctccctgcatgcaagctcctctatctagctagctactctactctactcgatcaagatcaagatctatcatggacgcagcagcagccatggagaagcagcagcagccgggcgagaagaagatcaccggcggcgaggaggaggaggaggaggaggtgatcagcagcgtccggtaccgaggatggaagtcgatgccatacgtgatagggaacgagacgttcgagaagctgggcaccatcggcaccaccgccaacctgctggtgtacctcaccaccgtctaccacctccccagcgtccgcgccgccaccctcctcaacttcttctccggcaccaccaacctcgcccccctcctcggcgccttcctctccgacaccttcctcggccgctacaccaccatcgccgccgcctccctcgcctcctgcctcggcatgcttgtgcttaccctcaccgccgccatcccatctctccaccccccaccttgcactgcctcctcttcctcgtcgtcgtgccagggccccacacacggccagctcgccgctctcctcgccgccttcgccttcctcgtcgtcggcgccggcggcatccgcccctgcaacctcgccttcggcgccgaccagttcgacccgcgcaccgactccggccgccgcggcattgccagcttcttcaactggtactacttcaccttcaccgtcgccatgatgctctccgccaccctcatcatctacctccagagcaacgtcagctgggcgatcggactcgccgtccccgccgccctcatggccatctcctgcgcgctcttcttcatgggcacccgcctctacgtccgcgtccgccccgagggcagccccttcaccagcttcgcccgggtcatcgtcgccgccgtccgcaagcgccgcgtccccgcaccggcctccgccgacgacctgttcgacccgccgcaccagagcaagctggtggccaagatcgcgtacacggaccagttccggtgcctggacaaggccgccgtggtgacgccggagtcgagatcgagcccgtggcggctgtgcacggtgcagcaggtggaggaggtgaagtgcctggcgcggatcatcccggtgtggtcggcggggatcgtgtacttcatcgtggtaacgcagctgggcacgttcgtggtgctccaggcgctgcagatggaccggcggctgacgaggtggtgggcgttcgaggtgccggcggggtcgatggtggtgttcaacatgatggcgatgacggtgtggatcccggtgtacgaccgggtggtggtgccggcgctgcggcgggtgacggggaaggagggcgggatcagccagctgcagcgcatcggggtggggctggtgctgtcggtggcgacgatggtggtggcggcggcggtggagcagcggcggcgccggctgggcgcggtgggagtgaagatgtcgttcctgtggctggtgccgcagcaggtggcggcggggatgtcggaggcgttcgcggcgatcgggcagacggagctgtactacaggcagttcccggagaacatgaggagcgtggcgggggcgctcttcttcctggcgttcgcgctggccaactacgcgagcggcttcatggtggcggcggtgcaccggaccacggggtggctggcgcaggatctgaaccacgcccgcctcgacctcttctacctaaccgtcgcggccatcgcggcggccaacgtctgctacttcctcctctgcgcccgctggtacaggttcaagaacaccaccatcgccgaccacgtcgagctgccggattatcatcatcatcagcccggaaccgccaacaccatagcctccaaggtttaattaattttattatcacaatcgatcactctactgtagatggtagatagatttagaggtacgtcatcgatcgatgcatcaccatacacagtaggagtataatatctgtatgtatcagacgcaaaaacactataatctcttcttcctcctcactctcacgcgttccacggcaagccaatagcccaatactacgtacaatcgccttcctattttatgttaacaagaaaaatgttactaactcactttataggaaaaaaccggaaaataattctaaagcgaggagaaccataaaaacaactatatggagagaaaaacagagaaaaaaaactctgatggcatcaagtccaccactactgcaagcagatatttccaatggcttttcgtagacctgccacaaacgccaacagccaatctatctatctattatattattaaagaaatagaaaaaagagcctccacgttcgctctcatggcctagaaattctcacattaatcggagaaaaagaaaaagcagagtctatatagaaatacaatttaaaaataacgaaaattcggaattaaaaaaataaggaatattagaagaggagactagagtagttattacacattagtagtttcgtaaagttattgcaaaatttaaaattatgttgtcattgtaatatattttaataatataatgagaaaacatatatgctattatatgagagaaaatataatgatgttagccgagcaatctgcgcgggccaccatgctagttatctttggatatcacaattttttacaagcgtgcaccttaaccacgcgtataaaaaatgatttttcatacgacctccttaataaggcgaaaaaatcgatttttttcaagcatgtacttaaagacttaaaacaattgactacacaagatatttgagagtcccattggtcggtctaataagctaaagaaaaactaaaatttaaattttttaacttgattttaagatatttttaacgtaattttttttagcactgactcttaagtcgctaccaataaatatacaaaagttttacctacaaattaaattttattccctattaaatgttttggcttattagagaatatgggcaaccgatgagacactgaaagaaatggtaaaagaaaaaagtgttttggcctcgatcctcatttgcaaaatacaatgataaagtcatcgtcgttgccacgacaatctagtgtcgtggttggatcccccaagccctgtcgggactggcggaactgccaggtcatcatcgtttcgccggtcccaacgaccgtggtagattgaactgcttcctaggcccacgaccattaattcgccgcctcccaagcatgtcgccaccatcgattcgcggcacttggcgaccgccgacgtagtatccatcaggctctgctgcgcctgtcatcgatccaccacttcccaagccggcctccatcgatctatcgcacctggcctccgaggacgttggatgcgccactcccaggtcccatggatgcctcctcttcatatcaccaaccgatccgtaggttagagagaggagaggggagaggtggttgctcctattgttgagattgacatttgagacggatgggggggagctagtgaggagaggagagggagagaggaccggtggattcgatgtgtgggagagggctggggatttggtgcgtgtcactacccttgcgtgcacctagcccgattttatatcaatagttgtttatttctagcaggcagacgtgtattttcacgtgttgttgtctaagagacccgcatgtaaaaatggatctatttttacaggtggtcctcgtaagacgaacacctacaagaaattattttcactagcgggtcttgacagggatcccctatgtatttttgcaggtggatttgctttttttaaaaaaaaacacatcaactttattaagcaagaatagaattaggggataaaccctgttacataaccaaggataaaaattgaaagcaaaagagccacccctgagaagggagggttaactgaactacagaagcaatcttcctgaaataacctaacagcagaaaaaggagcaagtcaacagggatctgtggcgaagccgcgacgactgctatcctgggcctcaaaagatgtgcactccgcttggcaaaccgttaatccccatcggctgcatctacggaaacggcacaagactgaggtttgttgctgagccgtagattttggtgtgtgcgtcaccggactcagcgaaggatccccatgaggctcatcattgaatctaaggagctctaacatcgaccctgtcaaccgaaattgcgcaggtggtccgagctcaacccgaatgacaaacccggtatggtttcttctgttagggaacaacaggaagggtgaatccgaagagcaaccaaccttcaacgatggagcacttgaatggctgcaaatcaacttctgtcttgctgagatgatggagatggttgaggaagaggtggatttgctttcagcccgcgtgcaaaagtcaagagatcatcgggtgtccgcgaaaaccatttgttatagtgtattaagacccgacatagatcatcactgcaccaagctcatcacaatagacaagcaactctaacttattatgacggacaactgtctcaaaccacccaaatatcccaaccgtggagtagaaacttcaaagtgaagtccaccttccatagagaatacaaaaaaaaaaagagaatacaacatcgatctaggatgctggcaacacccgaacactgaacctgttatttacccgaagagagaaccaggccacttaaaactcctccatcatcgctaacaccagtcagagactgggaaaagctagctttcacccgcctaccacaattgcttcgtctgaagtgtagcaataatatgtccctgtttggttaactgatcagtgccaaactttgtctcgatcacgtgtgactagctagcaagtttgatcaatcgaattgaagttaattagcgtttcatgtaacagatacgatgtgccacacggtcttaggctgcgtttgacgtaacgatttggtagagtaacttggtggcacgtgaaataagataaattgttagtatataattaattgagcattaattattattaacttaacaataaactattttttttaaaaaaaatgcatcatgtcgtttagcggtttggaaaacatactatcagaaaggaagtaagttgtcgttttgtgtagctggaaagaactcggtcttatccaataggctcatacgtcgtagacacgttgctttgacgcaacttaacacgagtgtcttggcacattatacagaagtttgtgtggcaaagtgtggagatgtcattaaagcagagtcctaatcttgggatcgatggaatatatatggcgatgagatcgactagctagtgacaccatcttgcagtgaatgaccgatggtgatcttcatcaaagatcacaattgggaccaagatactgtggtccgaaattaagcaggaaaatcacttgccaacggacaaattattttatttaagcaagaaatttcaatccattcctgcctaacaactccacccaacactgcaatctgcacttatgcagtggagatgcgacgtggctgcaatcataaagctttattgtagctaggggtcagctttgtgattaagcccatggttgtctgtagcatgggcacaccatggttgctaggatgggactcaactattcattccccttttgcgtcaaaaagaaaaaaaaatccagtcaaatacttggaccacaataaagtgtacatgaatataaaaaatggatttttcttttacactttaaagtgtaaaaactccaagtatttgaaatactaactactactagtaaagtgtaaacactttatataattaaaaaagagaaaaagaaaaagaataatgggcagtagacgggcccctttggttggcccagtccagtagtacaggtagaaactaaagcccattccattgaacaagaaggagtagaaaagcaaaattgaaggagaaacgtacgagcgtgcgaattggatgcagctgagaaggtgttcgtccgctgcatccgcatccaatccttcccggcgaccgaataccggccgggaaacctccaaaatcgagctggccggcaaggccgaatttcgctacatcggtttcatctatttaagttgagtaagagggaatcatgcgctggactttgaactatgtaatgaacttcattatcattattatgacgatgaactttaaggttgtggagtatgtaggactttagatctgatcgttgttgatggctaaacatatagtttctcaatatttattcatcaggacaatatttcgttagaatattctactagtgaaaaattttagtcttctcaactgttcattagtaccaactaggaaggtggcccgcgcgtatgcgcgggcacttatattattgaaaggtaagatttttattgtttgttcaaagattttgtctcatagattaagggaaaactaaagttcggataatgtaattttataataatttaaggtttctatttttcttaaagtatcttaaaaatccattcacaaatttttaagtaggagatggattaagtacttacgacttttgaatcatgttattttctcgagtaaataataaactatatattgcttgtagtatggctacaaattaaaaatgtgagagcaagatactcaaaattcttgtgattaaatcgtctcatgaaggcgcatgatatagtaagaaagagagggaagcgtatacatgaagaaaagaagaaagggaaaaatgataaaagggaggggaagcataggtacccacgcgtacgtaggtgcgtatcgaaggtggagaggtgggaccttgtagtatttagtttcttctaagatcaatttaatctaatggtttataatattgaacccaccgatttaagtgaaaatcaagtaatagataatttgctttttttcttagaatttctaatatgttctctaatttattagagcaccaagtggtagcttgagggtatttgaaattttaatggacttaccacatgtaatgagaatattaacatgtaatatatatgtatgggatatatgttaatattcattctagctttgtccatgtttatatacatgtagagagaaattaaatatgttgctagcaaaccattagatgtctaattaatagcaaataattttgacacatatttgcaattgttcatagtagctcttaagattcatgttaccactttgattattcgttgatcaccatgattcgcacgaaaaaaatatgtactacttagggtttaggacaacagaaattgatgaattatctgatttatgtgatagctatttgagattataaacaaatgaattaacttctaaatagttaaaaagtcgtttaagaaaagcaccatttataaacttggaaaagcgtggagcgtgcaaatgaaaatgcaaaagatggaatcaataaaaaaaatagggccttaaaactcccttattactcttatcctagtacgaattctattaatatgtgttaatattatgctgaaaatagggaggagattggagaggaatgaatagcatacaactcgagccagagatgggttggcagtgtaacagtgttatgcacatgtgattggagagggaggtggaggggacattgtttttctaatgtttctaaataatgtaggtgagaactcgttgttttctcattctaaaaatctttaacagttgacatatatgtggtggcttaagattttttattaacaaaagcggtagcgttgcagcgatcgtgatcacctaagatgcctcagacacgatgctttgtcacacgtgcgaaaggcaaaggtgtagacgtgcattgtgcagcggaccaaaaagagaactttggacactttagttattaacaatagatatgttgatttaaataatgggtccaccggttctagtgtaaatgtaaattagttaatatatattttaaattgttaatttaatgggtacacaatatgatggtgtagaatttattttaaaatagtacattatttgagaataatagtccaaattaataaaaaaaaagatcccatgatttaaataatgggtccatctgtttaagtgcacgtataattagttaatatagatcttaaattatttatttgataagtacacattataattgtgtaaactttattttaaaatagtgtattatttgaaaataatagtacaaattaatgagtacaccggtttaattggaaattatattgatttaatgggtaaacatataatggtgtaaattttattttcaaagattgtagagctaatttagttaactgtgtttataaagaattatatgatggtatattctttgtttgtaaattatgtttatttagaatatatatatcaattatataaatggaaaaaagaagagagaaaaaggaagaaataattggagggaggcgtacatactacataccaaaataattggaaggaggcgtacgtactgcatacccatgtacgtacgtgagttaggtgggacccatagtatttggtttattttaggatcaattttatctaacggtgtataatattggacccaccaatttaagtgaaaatcaaggggtagatgttttgcttttttcttagaatttacaggattttctctaatttattagagcgccatgtggtaacttgagagcgtttgtaggaagtttaatggacttttagtatataataatagaagatagataatagatagatagattctacctccgtcctaaaataatttaaaataagtacagtgggtatccgtatctaacgtttgaccgttcgttttatttaaataatttgtagaaaaactaaaaaaattagtcacacataaaataatattcatattttatcatctaataacaataaaaatactaattataaaaaaattttaaataagacgaacggttaaacgttgcacattaaccgtgtaaaattacacttattttaaaacggaaggagtactggtcctaatgaacagttgagaagactaaaaacaatctgctacattctctcattcaagctagcagtgtattcatttatgattatgaggtggagtagctacctacagtttatagaatattgtccatatatattgaaattttcttaactaagggtgcatttgggaggaaaagctcataacttttattttctcatttttcat

SEQ ID NO: 42493 - DNA, 4292 bp, Oryza sativa
acgtacaggtacacacacttccttccttgaatcatgcaagtatggcaactacagatgtacctctgcttccgggaaaaaacgagcaattgccaggtcaatcagcaattacaatcgcaaatatatgaaagcattgaattgatgtcaaatggattagcaagtcatcaggatcggagtacagtagcagtatgtaatgggtagttaatcatcatacatatgtgtcaacgttgtcatctcacattaacatcctgcaaatatggagggtttgcctctgtcctattttaagtgcagttgatcttatttaaatttttttattaatatttttattattattggatgataaaatatgactagtattctatgtgtggcttattttttaaaatttgtttataaattttttaaataagacgaacggtcaaatattaaaaaaaaacccacaatcatacttaaaattagactgatggaacagcatcttgttggctacgccctcctactcctgccggccttcaattatttgtccatgagttcctgagtagcattgctaaattactgttactcctctactgtaggtagatcctctgctcgtctattcattcccattcatgtcatgcccccataaatacttgtatacgtacgtacgtacgtggcacactcgtatacatacatatacgtacgcacgcatatatcatacgtgaaattatttggatttggaggtgagatatactagtccagtaggtttgtaagtttgtagttgtagtatataaatggcaggtggaggcagggatgagccggcgcccggccggccggagacctcttcttcttcatccatcctttctttctttctttctttcctaggcctaatcttacataaattattcacacggacaaatctagctaagcacaaggtatgccgccggcgccgtcgcaggagcaaactaagctggcgccggagaagcagcagcacatctccggccatggcgagcaagccgtccggtaccatggatggaaggtcatgccgtacgtcataggtatgtactactgtatcttctagctcctccatggttatatatatatatatatatatcctcccggcctccctagctcttaattagctcctcaccctcagctctgttcttctcctttaactctctccggtttggatcctactcttctcttctttgagcatgcatgtactgtatgtttttattttgaacacaaaaaaaagtaagatggaaatggacatccaacatggctgcagctagctatagcagatgatgacctcctgtagtttagtgaagtgcatagtctcctacatcactagctagatctcttccttttagttagttgctggctccaaatctcagctatcaattcatacgcaatttgtgcgcatatatgcttcagctcgctggatttgcattattgcttcatccatacaccaaagtacacacttcctcttttttttccatctcttttttcccaattaaacgtcaatgaaaaaataaaagcttagtagagaagttagatggtaaatgtggtgaagttatacaatcaaggaagcaagttagtccaaaggcaaccgatgaagcaggcagatggagaggagccatggaggtagaaagaagaagaaaagaagaagaagaaagcaagaaagaagatagacaagatagaagcactgtgcactgcagctgcacatgcctgatggcaccaccaacaatcaattgcattaaagttacccaactgcactacgctagggaagtgtcctcttctcagcccagcccagcgtggtagtaccaatctcagcacctctctctttttcgttttgctttttcaaccacctactggtttcaaactgatttttcttttctttccccccattgaaaccgtttcaattccagtagaagtagggaaagggttcatatgcgttccaaagcacccccaaaaaattatcatctgcacggtgcagtttttaagaccttggaaaacaattatcatttgcatagaggagtatttctctactattatgtcatccatatttaagttggtttttaagttttttcgtttttggaaatacatatccgtgtttgagttgtattttaagtttgttttctttaattgaagatgttttttgtggtattttggtatgccatctgtatttgagccggtttttaagcttgtttccttttggaagcataaaaggtgtcgtataacaaatcttttaaaaaaacttgcatgctaacttgagatgaaatatggactaataattgcaactcatgattttctgaaaaaatatcaagagaattcctaaagtaaattttatcctaactaaaacgtatagcaataataaaattttaaaaaaatatttacatgttgtaatgcacggacattttttctagtcaaacatatataaaagaattactgacaactccctattcttttaaaattatttaccggattatgaaataaattattcgctgcacacttcaatttttctataaacttttttctactgcattatttagaccacttattactaaacggaggagtattttgttaagtttatttattacaatatttcatccatccaaataataagtaaataatgtgcgataattaattaatccactcactaatctatatcaaatggggcctttaagatgatgccatgtctagtagatcttataataccattttgcaaataataatttgtaaataaaaaaagagaaaagtacgaattacccctgaactattggatgagtatgaataacaccactaaactcgaaaatcaaacatcgctcaccccgaactttcaataccggacaagaaaccccctagcactattgcgagcagtttagagttcgtatagcacacgtggcagtccagttagtaatttttttctaaaaaaaatagcgggcccacttgtcagaatccccacatctatttctctctcttctccctctcgttctaaagagcgcggcggcggtgggccggccacgcgtttctgaaggagagggggaagagaaagagggtgtggattctgtcaagttggcatgctattttttagaaaaatattgctgagtggactgtgccacgtgtaatattcgaactccaaaccgctcgcaacattgttcccggggagggtgggggaggggggtttcttgttcggttttgaaagtttgaggtgagcgatgtgtggttttcaactttagaggtgttattcgtactcacccaatagttagggggtaattcttacttttctcttaaaaaaaagggatggagtttgacacgagacgatggatcagggaacgagacatgcgaaaggctggggacgatcggcacgacggcgaacctgctggtgtacctcaccaccgtcttccacatccccagcgccgccgccgccaccctcctcaacgtcttctccggtacctccaacctcgcccctctcctcggcgccttcctctgcgacgcctacctcggccgctacgccaccctcgccgccgcctccatcgcctccttcctcggcatgcttgtgctcaccctcaccgccgccatcccatctctccaccccccaccttgtgcctcctcctcgtccacgtcgtgccagggccccacgcaccgccagctcgccgcgctcctcgcctccttcgccttcctcgtcgtcggcgccggcggcatccgcccctgcaacctcgccttcggcgccgaccagttcgacccggccaccgccgcgggccgccgcggcatcgccagcttcttcaactggtactacttcaccttcaccatcgccatgatggtgtccgccacgctcatcatctacctccagagcaacatcaactgggccatcggcctcgccgtgcccaccgcgctcatggccctctcctgcgcgctcttcttcatgggcacccgcctctacgtccgcgtccgccccgagggcagccccttcaccagcttcgcccaggtgctcgtcgccgccgcccgcaagaggcgcctccctgccccggcgtctcctgccgacgacctgttcgatccgccgcaccggagcaagctggtggccaagatcaagcacacggaccagttccggtggctggacaaggccgcggtggtgacggcggaggacgcggtggtggacggcatgagcgcggcggcggcgacccgtggcggctgtgcacggtgcagcaggtggaggaggtgaaggtgcttgcgcggatgatcccggtgtggtcgtcgtcgatcgtgtactacgtgatgctgacgcagctgggcacgtacacggtgttccaggtgatgcagtcgga

SEQ ID NO: 42494 - DNA, 6785 bp, Oryza sativa
gccggcggggtcgatggtggtgttcaacatggtggcgctcacggcgtggctgccggtgtacgaccgcgcggtggtgccggcgctgcggcgggtgacggggcgtgaggaggggatcagccagctgcagcgcatcgggatcgggctggcgctgtcggtggcgacgatggcggtggcggtggcggtggagcagaggcggcgcggggcgggaggagggtcgtcgtcgtcgtgggcgtggatggtgccgcagcaggcgatggcggggctgtcggaggcgttcgcggcgatcgggctgaacgagctgtgctacaaggagtcgccggagagcatgaggagcgtggcgggggcgctgtcgccgctggcgctggcggtggcgagctacgcgagcggggcgatggtgacggcggtggagcgggcgacggggtggctggcgcaggacatcgataagggccgcgtcgacctcttctaccttgtggtgggcgccatgtcggccgccaacctggcttacttcgtggtctgcgcgctctggtacaggtccaagaacatcgccgaccacggcggcgttgagcttcttcagaccagctccaagcacaacgccgacgcgccgccggccatggcggtctgacgacactgacagctactacacacgtacgctgacttttcatacttactatatactacttgatgcatatgcatgtgtccactccatgatgaacacaacagagacagaaagaagagagatgatacttgtacgatccagtttggaattggactacattaattacattagggatgaatgaatgtaattgtaaatctgtattatgaatgtatgggccggcccatatcatttcttcttagggctgaaacgagcccaccgaaagcccaaaatcgccccgtaacgaagggactcatgtcggcaacactgacaggagcaaaacaacacgtttgggagagctgtaactctaagataatgagaatttccgttccaatctttgcttcaaataagctacaacctttgcagtcaacataacttttaattgcaaagcacaatttaatgaaaaacgagagaactaactgaaacactagcctaaagacagataattgctaaaccttcaccctgattgacaaaatgctacttacataaacaacatttagtttttgtcatccacaaacctttatagcaaggtctcaaagttaaagcccaagttctgaaaattgaattcaaaggtgcaagtagactcaccgaaatttaagcctaaccgttcagtcgaccagatctcgcgcgcaccaaccctcgataaaattgtcttcgagccgtgtgaaacatattactctctctatttctaaatatccgacactgttgattttttatacatgtttgatcattcgtcttattcaaaaacttatgtgaaatatgtaaaactatacgtatacataaaatgtatatttaacaatgaatcaaatgataggaaaaaaataattacttaaattttttgaataagacaaacggtaaaacatgtttaaaaaaaattaacgaagtcaaatatttagaaacggagggagtatcaaaaagtaactactaactgcaaggcaatgtctctcttcaccggggagagggagaattggatggtgtcgatcgccggcacgacctaacgagtacacgacacactaaggtgtttgaaactaatgaagataaataaatttatttgatattttaaagcaacttttatataaaaagttttcacattagcagttagaaaaatgcgctaacataaactgaaagaaaatcttatttgatagtgtagatgagtaagatgaccgcaggaggtcaccactgctgcactgcatgcaacggcccaagctaggacggtaacgaggagtagtagctaatggtaatacgtactgtataccccttgtgatgattaatccaacaaaacattggattctactagcagtaacgaagaatttaatactcctgacgatgcgtggtgcatctagtacggctctcactgcacctgcgtttgtcttgttgttgcaaaatttaacgttgggctcagatgagtttcaggacagatcgatcttgtttgaacttattttattttaaaaagggtgtatgtggatcgaatcgaattggagttggtatgggcgtgtctgtggttttgaaacattcatcaaatgatcaacaagttattgtttgttcttcagctactgtttcaagtttacacgtactagtagtattgaagtagcaactcaacgggattgtgttggtggtggtgggccatcgtcattccattatcaacggctactccagttgctaacattatttttgtcattttgtattttgttgtctctgtcttgctgttccctcgatcttgcacacaccaaagttaagttaatgcatgcaaggagtactatacttacatggtgctcatcttgttagtacaggcaggttactatgctagtgatgctcatgtagtaattatcttcaatggcaatgcagcagtatttgcagtcagctagctgtctgtattttttgacaatccggcctttcctcctgatcctcatcgtataccatcgcacaaccaacaagcttacgtaccgtagctcacatatttacatctccaacgttacgtacctacctggcttgtagtatctgtatctacgtatttaagtctgtctttacatacctacatacgtgtatttgtatgtatatacaggcggtacaatttgtctgtactgtacatacaggaggagtgctgaagaaagaaaaagaaaggaaagcaaaattcagtgtagcttgcgcgtgcgaccagtgtcgtgtttggcggcttttggagtagaaaattgctacggctaccaccacacatccttactcgccgacatgtgggcccgggagtcaggctggagtcccacatgtcagatgacagcagctcagactagtcctcggctcgctcgctacctttcaaaatccaaccagcaaaagcctccctcaccctcactctcactcccactacactctagagagagagagagagagagagagagagagaccaagccaaggccaccatggacagcacaagcaacaagatgaagaagatggagccgacgagcggcggccgccacgggactccggggcaggtggtgggcctgtgcgctgccctcgtcaccgccatggctgcctcactgctctgctccacctccatggccctcaccccggacggtaccctctctctctctgcgctgcactacgcatccatggatggatggatggatggatgagagaacgcttcctccaatctggctgtctcaccggggtagttgtgttttttctgctccttgcagggcaggcattgctggagctcaagctctccttcaatggcagcagccagcggctgacgacctggaagcccaccgaccctaacccctgcggctgggagggcatctcctgctccttccccgacctcagggtccaatccatgtccgtctccaatttatctctatctttccttccttgcatttctccattttgcacccagattaattagccttatctttcatttttcttttcccttttgcatctctctctcaagtctcaagcaaaatgtttcatggctcggctacccatgtgctcattggattcctcgccccctgaataatctcttctttcatgttttccttttctaccagaaatctcccttacatgcagcttgggggcatcatttcacctaacattgggaagctcgacaagctgcagagaatgtaacattttttcttcttcaccacttttgtgcaacacttcccatttcaacaccatcttcatttacactatccgcattggtctttctttaatttctaaccccttttgttcagagcattgcaccagaacagcttgcatggcccaatcccttctgagatcaagaactgcaccgagctcagagcgatgtatgtatgctgctacgatctagtacttgtttggttccatctccatctgtctgctaatgactttgtagagctgaaatgcggaggtttaatttactctgtgtgtgtgcagttacttgagagccaactacctacaaggaggcatcccttcagagattggcgagctcattcacctcacaatcttgtaggttcttagcaaaataccctgatctgattcactgcttattcttggtctaatgcgtgccatctgcagggacttgtccagcaacctgttgaggggcacaataccggcgtccattggaagccttactcaccttcgtttcctgtaagtttcttgctgtataaatttccttatgccatcttgtcggcattgctaaaaccagacgagtaaatgctgttgcaaatctctgaaagaacatatgcttatttgcattgcaggaatctgtccaccaatttcttttctggagaaatcccaaatgttggtgtccttggaaccttcaaaagcagctcgtaagcttttagatttgggcccatcttcctttctactttctttgatgtgtcattgctctttatgatgtgggagcataactgtagcaaacatgaacaaatttgtgcatttctgctacttcttgagcacaacctgtattcaatgccatggtgcatttcttcacatgacaattcaatggcatttgcaggttcgttgggaatttggagctttgtggactgcccatccagaaggcttgccgtggaaccctcgggtttcctgccgtgttgccgcattctgatcccctctcctcagctggcaagtcttccatttctaagccatcttctcagtgttgaagctcttctcaccaaatttggtgcaatgtgtgtgtgactaactgatggtttcatctctctgtcgcaaacaggcgtttcaccaatcaacaacaacaaaacatcgcacttcctgaatggcattgtgattggctcaatgtcaaccatggctcttgcattgatcgcggtactaggcttcctctggatatgtcttctgtccaggaagaagagcattggtggaagctatgttaaaatggacaagcaaactatcccagatggtaataaagtcgacacagctgctatcactcgttccggcctgtccaggccctcacttaatggaaactaattgctatctgtggtgttctgacttaggtgcgaagctcgtgacataccagtggaaccttccgtactcatcaggtgagatcatcagaaggttggagctgcttgatgaagaggatgtggtcggttgtggcggttttggtaccgtgtacaagatggtgatggatgatggcacggcatttgctgtcaagaggattgatctcaaccgtgaagggcgcgataggaccttcgagaaggagcttgagattctgggcagcattaggcacattaaccttgtcaatctgcgaggatactgccgtcttcctacagccaaactactcatatatgatttcttggagctgggcagtttggattgctaccttcatggtaagcctattgtctttcttgcatcttgctgcatattgtttcatcatcatggttacaactgcttcaattgtgcaaaaacttcttacattacctgatgctcaaaaacgccttgtccctgatttcaggagatgctcaggatgatcaaccattgaactggaatgcacgtatgaagattgccctgggctctgctcgagggctggcgtatttgcaccacgattgctcacccgtgattgtgcacagggacatcaaagccagtaacatccttctggacagaagcttggaaccccgcgtatcagattttggccttgcaaggctgcttgtagataatgatgcccacgttaccactgttgtcgcgggtacttttggatacctagcaccaggtacttattctctattccacactgtgatgctttcaatcaaaacaaaagatcatgctgtcctgcataattactgctcccccttttgtattgtacagagtacagactaacagtagaagcttatgactgttaagcactttctccgtcctaaaatatagtaacctaatattcgattagacaccacctagtactaaatccagattcgtagtagtttgtactactttgtagtcaagctactggagataaatcgagacaaatcatgcttttttaagacaacaccaatgctgcctgtttaaatctgtgttgagcaccttccatccagactgacattggtcatttttaactttatatggacagaatacctgcaaaatggccatgctactgaaaaatctgatgtgtatagctttggagtgcttttgctcgagttggtgaccggaaagaggcctacagatgcatgcttcctcaagaagggactgaacattgttggctgggtaagaagaacctctctatattccctccctcctatgaatcttacaagtgacaaaagtaatctgaattgccaactttcttctgcagctcaacaccctgacgggggagcatcggctggaggagatcattgatgagaactgcggtgatgtggaagtggaagcagtcgaggcgatcctcgacattgctgcgatgtgcaccgatgcagacccaggccagcgtccatcgatgagcgctgtcctgaagatgctggaggaggagatcctgtctccctgcatgagtgagctctactacgagcagcacctggaactctgagtgagtacctcctataatggttgctactactcatgattgcagtgacaagcaacaaattttgtagatacatgatgatgaaccgtgtaggagtgtagctggacaagtgcagcttcacatcttcttcttttgtgcccagctggttctttgggc

SEQ ID NO: 42495 - DNA, 18340 bp, Oryza sativa
  unsure (1)..(18340): unsure at all n locations
attcctgcagcccgcactagttaccagctgcaaacaaacaagatatacagtcaagcaagcacgggtgcaaaacttgcacaatgctccaggaattgaagaaggtgaaatgaaagaaaatatactactgggatggcaagaactagtggagttttgcacgcttccattcttccatggcacttgagaagtgagccaggcgggcctcatcaaaatctccatccctttcgaaagctttcacaacagactgactagaataatgaggagcatcgtatcatccttcttctttaatccctaatatatgcagattaatggttgagatctgaaccctgtcaatgtgctactagcatggtaatagtatagtagcttttcaagtaactaggtactcaaggatcaagatcaagcatgcgaaatctaatctttcagaatcagagcaatgttaaaatccaatctttcagaaccagagcaatgtgaaatcgctcagatagaagctaataagaaaaaaaaaggaaaagaaaaatgtgcattgtcattgccattttgccatgacattatggtggagccacccagtacatgtcataccgtgtttagtaaagcgctaataaagcctttcaaaaggctggcctgaagtgacaaatgcttccagacactggtatggtagcaaaacacaacacatgcatacttttacatgcatctatcagctgctgatgctgcatgctactacagcactgcactgatcatcactagtggatggtagtagtgagagaacactgtaatggcatgaattttttcttctttttttatcaaaggaatggagggacaacgctctccatttctattagagaaaaaacaattttacgattcttgagaaggtatcattttttctattctaaatttaatacctattgatatctaggtactataagataacaaattttacattaaatttttgataccttctcaagtactgtaaaattacttttatagaaatggtaagcttgtacggtacaaaagagtctttgcctgagacaagtccatggtagcacacacccttgaggctagttatggtagagacgagagatggggacatggggtacatgtacagtaataatattgcacagagagagagagagagagagagagagagagggcatgcatactccattttactcccacgagttaaaattgttggagtggtccacatgtcgatggcctttgctgtgttgacagcctggtaactggaaaaagggtagtacagtaagcaggcagagtaactgtagttcagattttgggacccacaatctgaattgtgaagcgaggcatgagacacgcgtgaaagaatgattggacggaccacatactaattgtcactagctagggtgtgttattcttcacttcttagtggagtactatgaaatactcataacttctatcgtcggtttattgtattaggagggatcacatccccttctagaatacattttctttaggcggagggtttagaactttaaattagaaagcaattcatacaggcatgatgagtattaattccacataaaaaaatcaagggacagaattgatactactactaacttctcgttcaataaaagaacaacttttagaagcgattgtaggacgagtttgtataagcatttgtttagatttgtctgttaataaagttgatttttttttcgctaaagcacgattaaaagagctataaggaatcaggccaaccatgcactgacctgaccttggtaaagcactcttgcagttgcccttgctgtcgtgccggaggcgtcgatagttggtcgccggcgtgatctaagcctaatagggttagagtcaaactgagttgtgatgtgtttgtgttggactggttcgtcatgggctggacgtatgtgcgctagctttggtgggcctgcagccgaccaaggcccggcccactatgtacgttgtgtttcaactgcctggtactactagtatagataggtgtacatttactgcaaccgcgagatcagcggagttcgtttctcaatgtcgatcatctaatctcatcgatggagataagaagatgaaattcagcccttccttcaccgaaaagaaagaaaccaatcatataatatactgtatcttcgtcgttaattaattcgttatctccatatctctctctctatatatatactcgcagccctatgctctgcccgcgcactgtaaacaaattactaatagattctccgacgatcgtagttgattgttcgtcaccgagatccgacaaacgccatccatgggtcgcggcggccgcggtggaggttagattcttcgatcgaccttaattttgttcttcgatcgatcagtcgtgcattatttggtagatccggccgaccgatcactgggtcaatatatcgctaataagtagtagcaacagcttaacttttgtgaattaaattattagtataattaagctagccagtaactaaattgaattaattaattggtgcgtacgtgcaggaggaggagggaggtcaagcttccgcggcagcagcacgggcacgaaagcagtaccccgtgctgctccggcgaccacgccggcggcgaagagcacaggcacagctccggccaccaagaatacttcctccggcagcaatgactccgtcataggatccatcggatctgctttctttgatggtcagttagttattcaatttgcttactaaggctctattcactttgttgcaaaaaaaacattatcaaattttggtattttagcatagttgccaaaattttagtaatttgtcaaaattttggcatgatttcttatatagttatcaaaatttggcagcaaattaaatgtagccattttttttgataactttatcaaaatttagtaaggttgaaaatgcatcaaagtgaacagaccctaaatttctagctagctccacaatgctatatactgctatatatacacttgctctccatgcatagatgcaaattaatctactagccaaataccgtgctttaatttgctaccgattaaacaaagtaatagtaattttttttagaataatttcatttatattgtataatactgatgaaatgtgatagaatcgtacatgtgcagagattattttataacattaaagtacattattaggtagttaatggaaaatatgattgagtaggtgataaataaaaaaaatactatactaaatggagtatagatatttgaccttagtttttttaatcagatttttgtcactggattatttgcttcgtgcttctgagaaatatgcatgatttatcaaaatacttttgtacctattgtattggtcgtacacctaccacttaattgcgaaatttattttccataatattaatttttcatgttaataagtaaataatcgagccgctctcaaactggacggcataatcatgaagtgaaaatgcagggtggggatggggcacgggttacgggatggtgcagagggggatggacgccgtcttcggccctcgcaccgtcaacgtcgtcgacgccacgtccacttcgtcttctccggcgccggcggccgccgctgcggctcatccaatgttggatgcgtgcggcgcccacaagaaggcgttccaggaatgcgtcgcccagcaagggatccacgtcagcagatgccagccctacctcgacatgctcaacgactgccgccgggactccgccgcctccgccgccgtcggcgttgccaccaccaccagaattctctgatggatggatcgcctgccagcctgatgcatcatatccatgatagcaatgcaatccatcgattgattaaattagtttgattgcttgtttatttatatccgttttgcagccacacgtaataataataatcatgcgacgctgtatgctactgcatggatggaccttaataagttaagttaatttatttgcttcgatcagcttgaaccaacgaagtaggattacgtaggctaaaactactacaccgacccctctgtttctcctttttaatggtgcattcttattctactgctactatcgttttctttctagtgtttgttcctttttgtttaattagatcaccttgaataaatgaactattacactagtttcgattatgaccgtatatatcaaccattactgttggcagtcaaattgagagtcatagcttctgagattagtattgtgttatctgacttgtcttgatggatgagctggaccgatggacatcatttgtgatggatagatggatgatgcagaaatgtcaaacgtacagcaattaaactggacaacttaaaagaaaataccggaggataacgtttacagatgcatgatcgagggggttcgnanattaaaactccgaacccctctggaatctggatattcttttctttttaacactgtgtgttactctctcttttttttttcctcatgttcgtcgcgtgtcgaaacacttcattggcaactggcaagcgctaaccagctgacagacaactagcaatattcactgaaatcttaatttgttggcctttggtaaaaccattcagctaattcagtgtgcctatgctttgagcctacttactactcagttagcatttctttttgataaaaacatacaactattcctttcaaaaagataaaacatacaactcgaccagtagacggcaatgtcatctgatcatgcatatttatcgtcctactcggtcccctgaatcagacattcattcaattagatatctgatcatccgattaaagcacataccaaacacttttagaacaattcttggactgcatgtgaagttgggcctcggaattatttagtcggctcatgcatgcattctccttagggtttagtcaccagggatgtgtgagttgtatccctacttctgatcttgtgttattggttttgtcattgatggccttatgatgcgaaatgacatacaacaattaagcacgattaagtggaactgaagagaaaatagctgcgataacgcttgcagaagcaaggttgaggggttcggagttanancgacgaccctttgtttcttgttttttaacggcacattttctactatatattctctttattttttctcatgttccttgctttcaatcgccttgaatgaactattactagtttatgcaattatgaccggagcaatgaaccttgagtgaactagtattattttctttaccttttttttccttctatcttaatactaacatgcatttggatattgtctgggtaaaagaccgtatcaatggccatgtattaatggaaaattattgcaagcaaaatgagagtagcttgtgattggcttgtcttttttatgggctggacctggacaaatgtgatggatgatgcagaaaggtcaaacaatgattaacctggacaaatgaagagaaaatactgaggataaggcttacatgagcagcatcgataggttctgcgattaaaacgccgacccctctggatcttatgcagttttgttttgttttgtttgtccttatatatatgttcctcgcatgacgaaacacttacaagcagatagtcactggcagtgagctagcgatattcactgatatcttagttggcctttggtaaaatacttgtactaaaattgttcagctaaatattaagtgtgccaaggctgctagcctttaaagcctactgcccaattaccgttgatactcaatgaggttacgaaccgggactaaaaacgatttctccaccagtgttatttcgtcttaaaggatttagctcgatagatagcgacaataacttccatttattactagccacgtagttatgttttgcgtgacttttaatcccgtttaacaagttctgtatctgatctattagtttatctcagcttttaagaaagttataacattagcacagtatcaattagtctagcaaattataaatttagctaagttatacttatagatatatgagagaaatcactataaacctctttttttttcattatcttcgtctcctctctctttatatcatctgtccagtagacagcagaaacctctagagatacatgttcagcctatttatgattttttattatctatatacccttttatccaactatcagtaatttcttttgcgagaaatgctcagtattgtttacacaaactttctattcggctcatatggttttggtaaaattggttatataacattaaaagttcacgttttttttatagcaccaaaaaataccggttcactttagtagttatccgttctaatttttaacacttccgtcaattctcgatcatttttcatccgccttgatcgctattgatctagccacacacgcgatataatatttttactcacaagcacaggtagaatgcagaatgcatggcaataagagataaaaacgtcgtatcttgaaaaaaaaaagtttattactactctactttcacgcgcgttcgacatcacactacactgctgcctggaatcatggcgcatggagccaaatcccaaccttttgtaagcttttttttttctcttcctcctgtagcagcacgtgcatcaagaccaaactaatcagctcactttttccctttcaacttaataataataattcagtctcatatactgttcctagtcctagaataacagaaaattaagctaccggtcaaatcactgagacaattaaatataaatcaatcaaatactactcgtcagcttgtttaactacatttcatgcattgcctagtacattagaattagctactcctagattgcactgggttactgacatcttgctctgttttggccctcgcagcatgcattttgttgttaaaaaataagctattcgatcctacttcttgtatacttttactgttaatcacatcctttttatccaccacatctcccacgcgcatgctgtaagtgttcactttcattggactactttccaactgatatcctatactcagatgtggctgcctacccaaacttttgaactaattaacttaattaactgcattttttagcctcacctcaaaggcaatctaaacgggagagagaagaaactaaaattgtactgctacggtacctcttgtacgcttcccactcttggatcaaagttactgcatctgttctaaaacgtaaaagatttttatggttagacatggttactttaaaaaataggtgaaattaaaaagaaaaaatattataattggatgaaaagcaaagtaggtgaaaaaaatgaaatgatggagggctataattaattgggaagataatattgatagagatattgttatttttttcgtgaacacgcaaaatgattgcacgtcaatatattagaaggaaaaaaggtatttttttacacaacgcaatcagtcagaccggcttatgccaggggaaggaagaaaaaacaaaataaaagctgtagctaggaagaaaaactactacagcagctatacgtaactccgatcagcaggaagaggcggtgccacactacactcccaagaaatctttaaaagcaacaatgccagttaaagaccacagatggccctccgagcggatggactccagaaccactgagaccgaaggaagtgcggagttgaaaaccctggagttctattccttccacagctgccaagtggccaggagaactagggagtcgaagccgacatggagatgctcagataaacaggccctagagattggctaccagtcctggatccatctcagcgccacgtcaactggtgctgaatgttgtgccaccgcggatgggaggctagtcggcgtgccaatgtgcattcagcgccgtgttattcggtgctaaggtgtctaagttcagcgccacaaaaggttcgtattttaaataagttttggccacgattcatttgtaaaattagtttttgtaaagggttaaattgtcaaaatttgtgttgttgaagagactttctaccgtcttcaaactgtcttaactttttttacaaagtagtgcaacatttttttttgagaactaggttatatcatccggatccgggaggcaatcacacgacgtgtctaggagtagtatattcctatctacgtactccccttgtcgtcgtgtacaaacatttactgtaccagctagcgctccagtccagcctccaaccggccatgcccatggcggcggcggcggccttcgcggcgcatgtgctgcgaggccggtggttcatggcgtacggctccttcctcattatgtcggcggcgggggcgacgtacatcttcgccatctactccaaggacatcaagtccaccctcggctacactcaggagcagctcaacaccgtcggcttcttcaaggacgtcggcgccaacgtcggcatccacgccggcctcatcgccgaggtcacgtcgccatggttcatcctcgccatcggcgccgccatgaatctcgggggatacctcatgctctacctctccgtcaccggccgtgtcggggccaagaccccgctctggctcgtctgcctctacatcgccgtcggcgccaactcgcaggccttcgccaacaccggcgcgctcgtcacctgcgtcaagaacttccccgagagccgcggcgtcatactcggcttgctcaaaggattcgtcggcctcagcggcgccatcttcacgcagctctacctcgccttctacggcggcggcaacaccaagccgctcatccttctcgtcggctggctgccggccgccgtctccctggcgttcctcggcaccatccggatcatacgcacgccgcgctcgccagccgcggcgcgccgcgaataccgcgcgttctgtggcttcctctacgtgtcgctcgcgctcgccgcctacctcatggtcgccatcatcctccagaagaggctccgcttcacccgcgccgagtacggcgtcagcgccgccgtcgtgttcgccatgctcctcctccccttcaccattgtagtgcgcgaggaggctgctctgttcaagaataagtcgcctgaagaagaggaagccgacgacgtcccgcgggcgctgtccgtggtgaccgcgcccgcgaagccggcggcacagccttcgcctgaatcccagagaccgacgacggcgacggcgaggatcctccaggcactgaggccgccgccgcgcggcgaggactacacgatcctgcaagccctggtgagcgtggacatggtgctgctgttcacggcgacggtgttcggcgtgggcgggacgctgacggcgatcgacaacatggggcagatcggcgagtcgctggggtacccgcagcgcagcgtcgccaccttcgtgtcgctcatcagcatctggaactacctggggcgcgtcgccgccgggttcgcgtcggaggcgctcctggcgcggcaccggctgccgcggccgctcatcctcgccgtggtgctcctgctcaccgctccggggcacctcctgatcgcgttcggcgtgccggggtcgctgtacgcggcgtcggtggtggtggggttctgcttcggcgccgcgcagccgctgatcctggcgagcgtgtcggagctgtttggcttcaagtactactcgacgctctacaacttctgcggcacggcgagccccgtcgggtcgtacatcctcaacgtccgcgtcgccggccggatgtacgaccgggaggcggcgcggcagggacatggggtggccgcggccgcggggaagaaggcgttgacttgcatcggcgtgaggtgctacagggagtcgttcttggtgatgacggcggtgacggtggcggcggcggcggtggcggcggtgctggcgtggaggacgcgggtgttctacgcgggagacatctacgccaagttcaaggacggaaaaacggagctcggagtggacagcaatggcagtggcactgccaaggaataatatactaggatactgtactcgtatttgtttgaggaaaccaaggaatatactgtacatattacaaactttatggaataatggtcctgtgtgtcgtcttccttcctggaagggacgactcaccactctggccggccgttctgttttggtctagtctgttctctcctccattccggtccatgtgtctatggcgatcggccttccagcctgagtgatcaaggccattaataagaagcgtcgcgccttcttgtggacgggcatggactcggctcacggtgggcagtgccggttttcttggacgaatgtctgttgtcccagagctttcggtgggttgggaattcatgaccttaggttggcaggtttttccctgcgtgttcgctggctttggctccagcgctcagcgcatccctactgggacggcctgaaggccccagccgagcaagccgtctcttacatgtttgaggcgttcaccttcttcataccatgtgatggtgagacaattcttttctggtctgaccaattgatctgcggccgctcggtagcttccttggctccggatctcctcttcgttgtgcccccgcgtctgtgtggttcgcgcacggttgcttctggcctggcaaacaacgcctggatttctgacatccacggcgccctcactgtcccggtcatctcccaatttctccttgtttgggatgcggtactccacattcagcttatgccgggtgtcggggatcatcttgtctggcgttggacgagtgaccagcgctactcgacgcattcggcgtaccaggcgttcttctttgaccagcactcctttgcttgtgccgattttctctggcacgcgaagggccctgctaagtgcaaattcttcctctggtttgcatttcagcagcgctgttagacggctgatctccttcagaagcgcggcattgatagccactcggcctgccccttttgcgctcaagagcttgagacgacgaaccacatcctccttgactgcgtgttcgctcgttaggtctgatgacgggtgttgtcgtctcctggctgggctgtcctctctcccctccgtggcagctggctgcaggattggtggccatcttctagggcatgtttaccttatcatctccgtgccagcttcaactccctagtcctcctagtctcatagcaactgttgaaggaacgtaactccagggtctttgactctgtgttctcttcggtcacagtagtcgtagagtccatcctttcggaggaccggctgtggtcgttagcggccgttgcttcctttggggaattgttgggagcgtagagtggctctaccccctccccctgtttggagtagagttaccgtcgtttcgagtttttttcctttcctttctttgtttttcttccttccttggcataggccggtctggctgagtgcgttgtgtatcaaaactctatttttctaatatattgacgtgcaatccttttgcgcgttcgtgaaaaaatgttcatttttgcacaaattatttacacagtttttttttagtgtagtacgtagaagattaagtatatcacaaactcatcaagtggatttttaagcttggggatttgaatttgtgtaactttaagctccaaaatttaaccatgcaactaaaaaactgcaactttgtagacagggggaaagggaaaatgctgcatagtccactgggataatatgaagttgatactgtcaaatcacaacagtatctcccaaagaagtggtcttcggacttactaaatggcattgttagggattgagatcctctaacttctcggtttcaaaaataaaagtttcatgtcaaccctctactcaatgatctcacatacccacataccagtgactcaaagttagagggaagtaagtaagagaatcctctctcaattgttagatggtgcgatctcattgaggcctctttagagcgtaggatagaaaaacagctgaacagaaaaaaaaatgcagaaatcaaagtgacatgttttttttatgatacagaaactgagaacacaagaagagaaaccttttgattgcatcacgggaaaattgaaccacagaaaaatttaagactaccaaatcttttgttttttccctttaaattctaccataggaatacaatccaatagagaacattctattgttttgctatgaatgaaagacgtcttttggagaaattcataaggaaattgatcgttgaaaagaagtcctccaacaatccttcattttaaataggccctgaaatggagcaaactcactcaagattcccagctttcgctctctgttattttagttcaagttggaaatttcaagttttcaacgccaagttgatactactacgtgttagttgtatcccatgagtaatgtacgagtacaaccccaagagatgagcacaagtgcacaacagtaacacaaccaactcaattgacagcgagctgtacacaacgtccacatgcatatctgcttgcttgcaagcgacaaatttgacagcctattataggtcatcggacacatccaagattcatatgcatacagtatgcaacccaaagctaaccatcaattgaactagtatatccaagttgtcaaacaagaagaagatccaagaagaagaagaagaaattgggtgttgcaatgttttttagaggggaggccagatggcccagctttttatagaaagcataagtcttacaaaccgttttacataatactggggctgccagttttcaattaaaggcattaccatcaggcatcagaacataagcatccaaagaaggatgactctaagaagaaggatgactctaagaaagggtaaaggataaaggttatctagcagaacagagacgaaaactaaacagatgggagcagaattatccaatcccagctcttcgtaaggacaccagtactccttgcatagcttgagtcttcatttccaggtcatgggccttctccggctttaatagaatcttccactgtaaaagaaaaccaatcaagcggaaagagataatcaggggtgaggagattagtttgtttctaaaaatcatatcattgcgagcagaccaaagagtccaaatcaaagcagccaaaatcatggtattaagtctagaggttttagaagtatcaaaaccatagagtctaaagaagtcctcaaaattaaaagggatccttccccagtccaaagcatcccgacatacacaccaagcaaaagtcgcaataggacagttaaaacagatatgaactgcatcttcacttctatcacacagttgacagaattcagagccttcccaattaaatttcttcagttgaacagccgattgaatctttccccttatagccagccataaaaagtgtttttgttttggaggaatcgggctagcccagataagttgaaaatgtgggtcaattatccctctaaatgtgggtgttgcaatgttgtagtatagcacttcttaaaaactaaaagaacagttataaagaaaaaaggagtcctttttgctcctctatctctcagatcttctgatcgagcagcagaattgcagctcaggtgctcgtcggcgtcatcaccgccttctcctccttggattccaccttctcatcttctccggcgccggtgccattgccagcgccaccgccaccggcagccgcctcctccctgaagcgcgcgtagatgtccccggcgtagaacttcctggtccgccacgcgagcgccgccatcaccaccgccgcggccaccgtcaccccggcgacgatcaagaaggaatccttgtagcacttcaccccaatgcacgtcagctccttcttccccgccgccacggccaccgccccctgccgcctcgcctcccggtcgtacatcctgccggcgacgcggacgttgaggatgtaggaccccacggggcacgccacgttccccacgttgtacagcgtcgagtagtacttgagcccgaacacctccgagatgatggccaggatcatcgggtacgccgccccgaagcagaacccgatcagcaccgacgccgcgtatagcgaccccggcacgccgaacgccaccagcaggtgccccgccaccgtgagcagcagcacgccggtgaccaccaccggccgcgagatgccgtaccgcgacagcagcgcgtccgacgcgaaccccgccgacacgcgccccaggtagttccagatgctgatcagcgacaccagggtggcgatgctgcgctgcgggtaccccagcgactccccgatctgccccatgttgtcgatcgccgtcagcgtcccgcccacgccgaacaccgtcgccgtgaacagcagcaccatgtccacgctcaccagggcttgcaggatcgtgtagtcctcgccgcgcggcggcggcctcagcgcgcggaccaccctctccatcgccgtcgctggtggcgtctcggcggccgcgggcgatggtttcgtggccgcggacagcgccgggacgtcgtcggcttcctccttggggggcgtcttcctgaacagggcggcctcctcgcggaggacgatggcgaagggggcgaggagagccgcgaacacgacggcggcgctgacggcgtactcggcgcgggtgaacttgaaccgcttctggaggacgatgaccaccaggaggtaggcggcgagagcgagcgacacgtacaggaagccgcagaacgcgcggtactcgcggcgcgccgcggtcggcgagcgcggtgcgcgtatgatccggatggtgccgaggaaggcgacggagatggcggccgggagccagccgacgagcaggatgagcggcttggtgttgctgccgccgccgccgtagaaggagaggtagagctgcgtgaagatggcgccgctgaggccgacgaaccccttgagcaagccgagcatgacgccgcggctctcggggaagttcttgacgcaggtgacgagcgcgccggtgttggcgaaggcctgcgagttggcgccgacggcgatgtagaggcagacgagccagagcggggtcctggcgccgacgcggccggtgacggagaggtagagcatgaggtaacccccgagattcatggcggcgccgatggcgaggacgaaccatggcggcgtgacctcggcgatgaggccggcgtggatgccgatgttggcgccgacgtccttgaagaagccgacggtgttgagctgctcctgggtgtagccgagggtggacttgatgtccttggagtagatggcgaagatgtacgtcgcccccgccgccgacatgatgaggaaggagccgtacgccatgaaccaccgcccccgcagcacctgcgccgcgaaggccgccgccgccgcgcccgccattgccgccgtctaccaagctcctcgcttaattagcttgttggatagataggagtgtgtacggtcggtgagatcgcattaattgcagacttgtagcagtaggaggagaggaaaatcgttgaagatgcatgtgactcactcaagtccacttcactgattgagtacacggtttgagataattttgacaaaagttttggttcagcgtcaaattgccagcatgatattgacctttgctgcgatggtttgtcccaaagtctgatgatcctatccaaatccccaattcccaaaatctcatcttttatgatggatattcttcagcattgaggaactctgctgtcttgccagttgctactgtctgaaaaatgcagataattcactaatctgattctgttctattccggaaatccggatttgatacttatctgttccagtctcttactcctatcaacattgacatacagattatgccaaaactaaagaaaagatcaactctttcttcagacggtatggcaccaatttgttcaagctggtagggataggaccagcggcagcaaggcagcaagcaggacagtttttgttgactttggtaatgctacttcattattgcacctctagtttgtggaagtgcaactataactgaaaatttatgtcggtaatgaagaaaaggttgaaggggcagctaaagagtactcctctgttcaaaaaaaaaaaacacaatcctagaattggtttttttattttttttttacagagggagtacccctctgcaaaaatgttagaattattttatatttcagtttttcttaatatgttagttatatttgtagtattcaagtatctaggatataaataaaaaaatatttgatcaaaacccgataagttatcttaataatcattggttgcatgcatgtattttttaatctatgttacatataagatgagttaattttttcttaatcttagtaatgaaagtaatatgtctaagggcattagtatagtatactcagtaagtaaggtggggtctaacaaatgtagatttttgtcgttggaactttcataatgtgtgaggcaataaggcggtcccatgactatataaaaatccaacggtgtgcaatggcatggatggaaaggagagagtcaacacataggtgagaaaatagtgtttttttattccttactattctctatccaaaagtctaagatatattttattttttgttatttcaaaagtctaagacctatttgtaacctttacatatccaaaagtctaagatatattttattttttgttatttcaaaagtctaagacctatttgtaacctttacatgctaaatttctcttaaaaaaatctttatgtgctaaattaaattgttgacggaacacaagaaaccatcttaatacttattggttgcatgcatgtgtataatttattggttttgtcacatggtggatgtgataattactcattggtcttggtgacaaatgaaatgtcttagaattttgaatatagcaagtactagggagttattgttgcttactacttccacaatgtttgtattattgcttactacctggtttttaagcatattgtggatgccataactcttttggatggagggaatatttcatacttcctccatccaaaaaagtctaagacctatttataatctctatgtgctaaattaaattgttgaccggaacccaaaatgtcatcttagtacttattggttgcatgcatactataagggttattgataccacatacccaatagtaatcgactaagctcggtgaggcccaccacataccatgttctatacggaaacaaacctcgtaatctcgtatatagaaggagttccggataaggaataacaaatagagttctatatggaaacggcaaggactacttggattgtattcattttggtctccctagttttatttggacaagaggacacctatggatataaatacaaaccccctaggaggagaggaaaaagaaacccacaatacacaagccaatacgccgctggatattaacatcagagataagcctagacataccccatctggtgcctacgaaagccggcaagagggatctagcgccatctctgatctcgacgagttcgtacttgaggaggaagactaccctgtcgtcgactacgagttggttatctagccgccaagtcgacgacagctagataggttatcccaaatattatatttgtgtgatccagatgaataaagagtaacaccggctttggccaacaggatgtagggctattacctaccagataaggggcccgaacctatataaaaatccctatctccatctctctttacctcaatcccgcatataccctggtgccaacgatccccataccatataaataccgtagtcgcgatctcaaacgtcaacacatgtgtatagttcattggctttatcacatgatggatgagttaattactcactggtcttactaacaagagaaatatgtcttagatttttggatggagggggtaccaggctaccagctactccctccgatttcattttaattgacgttttggacaatgacacggtctacaaaatatatctttgaccttatttttctattataatatatacaataaataaatgcatgtttactttattatattactttgaaagacaaatctatatatgttgttcttgtttctttaaaacaaatattttgaaagttattgatggtcaaagttataaaagattaaactcaaccttgtccaaagcgtcaattattataataccggaggaagtaagacacaaccaccactaacacaaataaaaagaaataattgttatcaccttctcgtttcgaccgcctcaataaacacgatgcatgcaccaatgagattagggtggatgattaacagaaaatttatggagagagaagtattagtgaattgtatgtagacatacgcacatcatattatgaaatacttaaaaaaaagtggctacaccttagtatattttaggatggatgggtataaagtactagctttgaaacccccaattttgaaaagatatgtgtttttaagtgtggctgggaatcaaaagaaaagtaaggttttggtgtacatatccatcgtgaaccggaaat

SEQ ID NO: 42496 - DNA, 21634 bp, Oryza sativa
  unsure (1)..(21634): unsure at all n locations
tttgtttagttggaggacggaatggatcggattgagacgaatttattttctcagggtgtttattttgggatacgctaaaccaagcatacgctaagaattactacttataactgtcatttgattatgtagcaataaggtatagaaaatccaaaggaaattaatttccttttctaacagttgtagagaaaaaaacataaaaaatttcccatctactcataccttttttttaattagtatggatttgtaattatgcattcctgttcctacattattttctatttctgtggagttgaaatcccggcctccaaaccaaacaagcctgcgctgttttgagtatctttataccttacaggttcttatatatgtctatatctcttagggctcctttggatgcaggggaggaaaccccgggaaaaattcccgtacagagatttttccctgcaccaaccgatccccttccacctccaagggaatcactcctgttaggggaattttccctgataccatttgggagtagggggagagggttgatgggggaagggggatttagacaggcaaactgctaaacagtgtttgaacaacatgtctctagaaatattatagaaatttcaggaaaaatagaaagaatatagaaaatccatataaataggaaacaacctacaaaaattccagaaaaaaatataaaaacataaaaaatcaacaagtattagaaattcagaaaaatacaaagaaatataggtgagtttatgtggaaaccaacttcgtgacatgacataagttaaactttagaatcatccatatcatacaaaatttaaaatctttggaatcatccttgcatccacaaatatagaactgtacattatatttatatccacaaatgtcttgatcaagaatgagacatgggtccatttaaatctttatctcttctatcttcttcatcatctcttcaacaaatcttcatatattctaataaatctgtcaggatgaaaaagataatctgaaatttaagtaataaatataaaatagtgatacttcagcaatcaaatttgaaggatggccattgatactagcttaggaaaaaaatgcatgcacatcaaccaacatattgcaattgtcagctacatcagcgtaaacaaactcttggtataagcactttctttttagatcaaacatcctacatgcagatacacaccattatttttaaatcaaacacatttgaagtccatgtttttgtattgatagttttccaacaatactctatttcaagtccatatttgaaagtaagttgagcatgcaattcaaattgaatcctggcaagaggaagaatgcaagagcacaattatgaattatcattatggacatgataaggaaaaaaaagtagtagtagtagttgttgttttaattaatcggtactactaggtcactttgtttggccagtgtattgtgcagtgagtgagagagaggagattgaaacatctgtgtgtgcgtgtctttgtatataggttgctgccaaagcttgtgtttttttgaatgcacaatgccaccttgctcattttctgctagtgatacatgacatgaaactaaagtttggactaatgtataagtatagagcataaaagacttcattttgtagtaagtatgagttcctatcaaaaatatgattgttaccatttatttagtcccaacatgtatgctaaattgaccactaattctacagttccctgacagagactacaagaatggatcagactaaaaaatacctccagaaaaaacaaaaaacttgatgctagcagctcaaccagtactgagatctacctctaggttaacagagctgacagcatccaactaaaagaactgcatctctaattaactacaaaaaactgttactggtttgcagactaaaatttctcatatacctcactagttgaatgatcctcactgcatgtgtgataattcctcatttcttgggattggcacattgatctcacatatttagactacactaagcatgataattacactgcagaaaaaaccagagcacaacctactccatcaaattagaacatcatcttaccaaaactcattcatgatctaaaacaagagcaccatacgcccacccatatccccttctgaatcgcttccataacaaaatgaaatgctactgcagggtacaatatcacaatgtattagaaagaacaggagaacagattacaactctcccaaaccaaatcaagaaacatgccatacatacaccaagaaaactgaagtactgaacgaacccccaagaatcaagcagcagctacaagggcacgcacaaacctagccgggcaaccgccggcgggcgtcgcgcagcgaggaggaggaggaggcggatctgcgcctcagcgcctcctctaccggtgagtcgcgccgccttggatcccccctgtccccgcctgcttggagccgtgtgcccgcgctgccggctcgccgcctcgtcgtcgttgcaccggctgccgcggtgccacccgccgcgcccacgcgtcggtgcctgcgatacaagcgctgagaccggagagcgagattgggagctaactagaggaggcggaaaccctagaggaggaggagaacggaaacccaggaggaggagaggatgggaataaggagaagggcgacccttctcgccggaggaggagtcccggcggtggcgcgtctcgccggagaaggaggcgcggcggcgcccgctgttgttcgcgcgagagagaagcgactccggttgcgcgagcgagaagcagtggcggatcgagagagcaaaaattcccaacctccgaaggtcggggacctttccctagggtttccccgtggattgggccgggaaatccctgcctcgtgggcttccaaatggacatggaataaaacccgtgacaatttcccctgcaggcctttctcccagggaatgggctgggatcccggtgggatcccgggctgccaaaggagcccttatatgattcccacgccccatttaaacggtcattgcttaattttcttgtaagttttcaatctaatggatttgaagcgatatgacactttaatcctgtaccttttcagaaatcagaacctgtagtgttccaaagagccctagatcggtggaggctggagggagagaaacatcaatgaagtgttcattatagtattgcacaacatgatattttttttaatgaaagaatcgagtggcatatgtttttacacgtttgtttgtagctttactagtactataaaatgtaccactagtatataggagtaccaagtcactgaaatggacagacgacagttgcgtcttgtccgtatacattgttacacacacccgttttgttcttcagctggtagttgttgcaaaatgtgcagtgcaaagtaaggtgtaagttaatctcaagaccctagcttggatgggtacagcgtgtgaaaacagacaaaataatggatgatccgaaacgaaacggacagacatgtcactagctctgtcgtcagtgaattaattatcacaaacacgaataatgtggtacaaaattaatcgtgacctcgatcgtgtgtgtagtactgtagccgaccgtcgatcgatcgacgatgaagatgatgacgaggatatcgtatatatggatctcctgcagcccaatctcaataatatgcagaagatgagagtacgatggatgcaatgtcaatctcatctcatcaatggtgtcgctattacagcacgtggttttaataataatccacggtacgtacggtgtctagctgctacttgcactgtgcccctcctctacttaaacgcgccatcgtctggatagctagctacgtactgagctcgagcttaattagctctagctagctgcagcaatggccatgggggctcgcctctgcagcagcagcattattgttgtggtggtcgtcctgattgtggcgacggcggcggaggcgatgcggtgtccggggacgacgagcgtgtaccggcggccgaagaagaaggcggcggacatggtggacatgccactggacgccgacgtgttcgcggagccggcggggaggaacgcgccgcagcaggtgcacataacgctgggcgaccagacggggacggccatgacggtgtcgtgggtgaccatggaggaggccggcaacagcaccgtcttgtacggcctcgccatggacaagctcgacatggccgccgacgccaccgtcaccacctacacgtactacaattacacctccggcttcatccaccactgcaccccactactaggaaaatgatttgttgccacgaaaaaaatcgtggcaatagatacatattgccaccattttaaaaccgttgctagccgtggcaatagaaacagtagcaataggttattgcaacaatttttatctagtggcaacaaactttgataatgccacaaaataatcgtggcaaaaaaacatattgcaacacttaacatcgttgcaacaaataattattgccaccacttcgtgcgtggcattagttgtgcttgccacaaaatagtttcgttgcaatatctaatatatgttattgccacatagcattaatcgtggcaatatatcatatgggttattgccactaaaatatttttgtggcaataagtattattacaatgaaatgaatttcttctagcttttatagaaaagaaattgtgttacatcagtaattggatggatcatttggtactattgcaacatgagtagaaatatatgttaaatggcaaaacccttgcaactcatgcgcacaagaattatgatgtctgatatttccgcgaataagacataatatatttcagatacccaaagtaatgatgacaatatgagtatgttaaatttccaaatgctgaaatacaagttgtctgataaaactaaaagttctgaaactaatgagtttgtaacattgttgtcgaaactagcttttctagccatcacttgtttgattttgtcgtggtttgctccagccattcaacagtaacagagttgattgttcctcctgtacaaatgtatggacatatagttacaagtcgtatttaaagtaaagaaagtcaccatgtaaaatgcagagctattttatctagttttctgctagcatgtatagttaccaaaacttcataatttcttcaaataaaggacattgccagagtctgcagtgcaactaattttagtatctaacatgattaaattgagttagaagtcatatgccataactatcatgccactgtatggacatgtgtgttctttggattgatggaaacataaacaaatgtgattagtgctcactatatctgacattttttaagccatgcccctgttatttactgacttgtgagacccactgaaatatatatgctttgttacatatgtggtggctatatatagtactgtgttgctaatcatttatatggcatgcatgcttatcttagttagctcagataaacaaaacaaaggcctatggggcagtaacagaagcttagatgccccatatactaataaactaaacaggcaactgtttttgtcagcaaaggggacgtgccaaatactaatacaatccaatgagttaagtagcaaaagtaccagatcattacctggatgctacaccaaaccccgagctgatttagatatttctttcattcattcttccattttctcctctggcctgttacaggatttggccatacacaataagaaattattttttttacaaacagaccatgagcaggaaaacatattgtaaaattttttgcaaaagatcatttcaacatagcagcttgctgaagatttgtaattacctgatcagttcgggaccgtacaaaatttctagcaacattcctaagatgttgtgaagaaatattttgccgggtagtacttgttgttccttgcaaattagcgctgttaaaaagtgctttcacaactgtgttgttctgaatgcttcgagccttctttgttgtgtcatgtggttctctattctcagttggacaatctattgccagatcagacttcacaccataaaacaagaaatatatatattatgattccacatttgacatatataagatatcaaatattggtgaatgtgaacattttggcaatcattacctgttgttccgatgctacgctttgcgtagtaatcattttgagaatatcctcccgtagcatttccctttccttacgttcttctgaatcttcccgtgacattgtcatcatctgaatcttcaccgtggtaaacccactgtatgtaactttcatcgaatccattccttagcaagtcactttgcacttcggagcgtgttttgtgtaccacattaaggcatcttctacatggacagggggcattatccccaggattatcatcttgaaatgcaaaatttaaaaattcctgcaaccctttttgccactctgcagttgccctactcatgcgcatccaactcttatctactgacatgcttcctgcttatcactatacaatattactaatagtatcaaaccacccatttaatgaaaaaaaaacaaggaaaatatggttggcactttatgatcttaaggaaaatggagaaactgtgtgaacataaactcaccttgccagaacttgtctctgtaggctgaccagaaaaaatattcctgtacaaagatatgaacagataaattagaactaaacaaaatcatgaggatttgagctgaaaaatagacattggacagtaacagatatattggtattcccatggaaggtgtttcttatttttcaaaattcatatgagaaattggacaaactgaagaaattaataaatatgagagaccgtgtatagcaaatttggatattgtgcagtataaccaaggtaaccttgtgggagacagaaattcagaaacaaagacagaaattcagaaacaaacataactcatctgagctattctacgctagcaatgctcgccctgcctgctctgcttgcctactaagatagctaatctgaagttctaaactactcactgtcgctgccgctgcggccgtcaccccatctgcagcaagcaacatcctttgctctatgttaccgagatacagggatacggatatggataggatacatcattttctgaaaaacatggatacgggatacgtctatatatgtatacaaaaataatatgaatttatgcctgggaaatcaatagcactagtaaaaaaaataaatcatgtcttccagtctgatttctctctatcttctccaataactcaatttaattacctccacaacccattggatggcagctttgtgccctggcctacgtggtagtgtggtggcgatggcatagggcgtccggcggtggaggcagtgctacgcccagcggcggcggcggcagcggcgcgacgcggcatattcggcatccgacgatacacccggcttccgtcaacggcagcgctgcgctcggcttccatcgacggcggcggcgctgcgttcaacttccatcgatggcgccgcggccgacccccccatctgcagcaagcgacatcctccggctccgcttcctcgtcgacgccggggccgaagccgaccctgtgtaccctcgcatccttccattgtagtggctctctcatgcgttgactgaaccctcgtcttccccagcgaaccctcgtcttccccggcggatgtggcgcctctagccaggcacctcgcttggatccctcccgcacacatctccggcatgttgcttgtggaactagggctggaggatcagatcgggatgaggaagatgaattggaggggatgcaggcgtcatccggtcgccggcgcaagtgaggcggcacagaagacggtgagcgccgacggattgggaaatttggctagaccgtgaaaaaagaaattgtgtattcgaggaggatgaggggatgaaaacggaggatacctgaaggctgaaagctgaatcactgaacggagtggaggaattcctcgtgacgcggttgacggcggcaccgtcgcggtgaaatcaccaggcgctgctcctccgtgagactttggaagtcacgggagcactgcccagccgtgtgaatggaatagattagattgataaatagtactaataactgaactaactttttcgggagttaatcgatcttttcacgcgcccaaaaccgcgaaacacagaaatatttcgcgctaaattttgggaggttcggctgagtcgtggcaaatattgtgtgcttattgccacaaaaatcgaagtcgtggcaatagggcttgtacgttgcaccgatattttttttgtggtgatagcttagtttttattgcaacgatattttatttgtggtgataacttatttttgttgcaacgaaaataaaagatattacaacgattatacatcgttgcaacagaatatacttatttgccacgaaaagttttatcgtggcaatagtatgatatattgccaccaattatttttcatggtaatactttcgtggcaatagctaatttttcttgtagtgccctcaccaacctccaggtatatatcaccagtttaccccccacacacacttgttccaccccaaccgtttcacctccagactacggtggtgtttgaatctcccgaagatgaagataaagataaagattaagtgtttcatataaaacgagatgataataacgtgtgattaattgagttttaattattacaaacttgaaaaatggaccaatctgatattttagaacaactttcatatataaagttttcgtacgaaacacaccgtttaacagttcgaaaagcatgccacgaaaatccaagagtttgtcctaacttttgttggagaaaagaacaacttttatattattgattataaaccgtaacgcttattaacattaatatataatttataagtaaaacttttgtacatatgttcttaacaccttaaaaacaacaataaaaataaactaggatttaaattataaattttggttacaacttataagctgaaaaacaaacgatagagctatatattatgaatattactgttctattgacaaaaatatattatcaaactctgacaagtcacaagtctaccagaaaatgtaattgaggaaaatttccgtaatgctcctgttcacatatgtataagtatttctaactagtaattgaaatttttatataagtatttacccaccgactccatatatcaaccaatcaggtgatgaaaaatatatatggtataaaagtaattttacctcaatcttaatttctcctaaaactccagaaatatttagagaccatgttcataaagaaatgctccattagctatgaaatatatactggatcgaacagtggtgcagtgtcttgatcagtcgaacgatatactggatgtttccaaacatttatacattctcaagcaagcggatcgaatggagtggccctattaattaattttgtttgcaaagttaatatattaatatgaactatcaaaatatgataggtaaataaattattggcgtttcttccaaaaaaaactattggcatcaaacaagtggatattggacaggcatatgtagatgtatgtgcagtacctgcctcaaggcaaaatgaagtactccctccgtttcgtaatgtaagtcattctagcattgtccacgttcatatagatgctaatgaatctagccacatatatatgtctagattcattaacatctatatgaacatggacaatactagaatgacttaaattatgaaacggaggaagtaccacctaaaaataaattagaaaaatatttatatgcaagcgtacattcatgtcaagaaaaatatcagatgcaagtgtccaataagctgacataattagctgaacattatatgtatatggattaattaattaattagagtggaattattaattacgctttgggacgcagtatggcgtaaagtactattacgccatgggtttcgggttcacggtgcgcagcttctggttcacgacgccgcctcggccgggtcccgacgtggccttccggctggggctcatcggcgacatcgggcagaccttcgactccaacgccaccctcacccactacgaggcctccggcggcgacgccgtcctcttcatgggcgacctctcctacgccgacaagtacccgctccacgacaacaaccggtgggacacgtggggccgcttctcggagcgcagcgtggcgtaccagccatggatctgggtggctggcaaccacgagatcgactacgccccggagctgggggagacgaagccgttcaagcccttcacccaccgctacccgacgccgcacctcgccagcgcgtcgccggagccgtactggtactcggtgaagctggcgtcggtgcacatcatcgtgctctcctcctactccgcgttcgccaagtacacgccgcagtggaagtggctggaggcggagctggggcgggttaaccggaccgagacgccgtggctgatcatggcgtcgcactctcagtggtacgacagcatctcttacataacatggaggggcagtcgatgcgtgcccagttgtagaagatggcggtgtacgacagggtggacatagtcttcaccgtccatgtccacgcctacgagcgcagcttccgcgtctccaacatcaggtacaacatcacagacgggctgtgcacgccggtgcgcgaccgccgggcgcccgtctacgtgaccatcggcgacggcggcaacatcgaggggctcgccgacgagatgacgtggccgcagccgccctactcggcgttccgggaggacagcttcggccacgcggtgctggacatcaagaaccggacgcacgcctactacgcctggtaccgcaacgacgacggcgccaaggtcgccgccgacgccgtctggttcaccaaccgcttccacatgcccaaccacgacgactccacccccacccccaccaagcgccattattatggatgattcattcattcgcatccatccatcgcttcctcttcatcgtcgtccatgcctgcctacctagtgtgattttgtacacgtacgtacgtgtgattttataataactatatatataatcgtgccaatcaataccattaggtgtgtaagtagtaacagtttactgtaatctcttcctgctgctgctgttttctgaataaagaggaggcaggatatatctatcgatggaggagcacagagcactgcctgctgcttcctctgaaaatatatctgaatatatatatacacatctgcagtttgcaggccaattatatatcatcgatcttagctagttgaaatccgaccgactcgactcgactcgattcataccccaagatcgctttcagtctctggcgcaatcattgtcatgcggaatataatcctctgccatggactattggactgagaagaaaaaaaagatcaatcttttcgggcgactcacacctcacatgtagagccactgcgagctgtttctttctccatcgctagctgctttttctcagctgaaaagaacatgttcaagatgccaatacctttcacgctagcctctcactcaaaggtacttcataaacactggaatatcaaatttacgaatccggattttccgtacgaacatcaaatgagccgagcagaatgaatgactgactgaatgagtggttccagtcattcagatggatcgagtcagttcactaacaaaagtaaaaaagaatcgaacatttgaggggcatgagggagtcttgaatatatatcatgtgtggttagccaaaacttaacggtggtcgcactaggcagaatcgacacaagcaagcactgaactgacattattgatgaaagggttagggcctttttgaatcataggaatgaaaaaacagaggagtagaaaaaacataagattcagataggaatacaagtgtaaaacagaggattgtaaaacacaggaaaaatataggaatgaccgtttgattgagtcgtaggaaaaacacaggaatttgaggagagataaagactcaaagtattcttaacatgaggtagaacctcatgctaaattttctccaaacttgcatgggaagtggcattccatagaaattttatgggattacatatgattcatttctttaattcaaagggctatataggaaaaattcctataggaatgaaatcctttaaaattcctatgaatttcctttgggagcggattctaatccctcgaggggatatcccatcgtatatctttttcttttaaattcgatgtaaatagttgtgaaaaattctgaaaaaaattgacaatgtagagtataatgatacctactaatccaccaaaattcaagttcaaattcgatttacacgtcgagaaacaaaaaagacaaatttagatataaacagtacgctactatttatatgctgaatttgtcttttttatattttgacgtgtgagttgagtttggacttaagattttgtggagttgtatatatgtattgtatgaatgttgtcaaatttttctagaatttttcataaccgtttagatggtttttaggtaaacgaggaacatcccctcgaggaattagaatagtttcccatttcctttgaatgaaaggggccttagctagtagtgagctactagtactagttgccatcgagaggtcatcttctccttatctttctcttcttcttctcctctcaattaagatacatgcatcatgtgaaagcctcatgataataccaggtcaagcagggcaacaactttatttctgttgattacaagttagtacaatgcgaactaaagaaaatttaggcattacttattcgagtcaaagcttgcccgtccacgacgccgatagccagtgagcttgacacgcgacctgccattgccactgccaaattttatggcattattcagaaaacttatactatatgctagttgattcagggaatgaaagtagctagactgctcctaattcagagttcagaaagttaagatgaatgggtggtcggttttcaaaaaaaaaaaaagatgaatgggtggtagcttattcagatttcacaaaagggaagagcaattgtggtattttaactcggatcaaccctctgaatgatgctgtcagttactggcactaacggttttacacagaaattaaacaaaagtagaatctataaaggtgaatctgctgtctagtgcagcacataaaacgatatgaggcaatcattttgggggcaaatctgtgaacaagtggttaccaaatcgaccaaaaggtggcagcatgcttctctgtggcatgcttttggctagatcaagttgtgaaattgcgatctcctagctagctttttcttcaaggccaccactgtgtttcaaagatgtagcgagtgatacatggatgggcaagtaacagtatgtgcattatactgaattctactagtaaaaaagtagagagctaagtttcctttgttgaagaggtctgaatgatatgatatctttaacatatcttaacggaacaaatataaattgtgttatgcttaatatcatctggaatatactggcatatgataagcagttcacattacatcatttaaaacgatatccacgggtgatgtttcgacaaagaagaactgcaagcctgcaatgccagcacacatgtcgcaatcttttgtgaattggtggtgtgttttgtcagtcaaagtaggcgcccatacaaatcagtagaaggcaaggcaaagcgatgtgagatttgtttgtccctcccttgcttggttggttgtacatgctgcgaatcgaagaataaatcagtagggatagaagagtacttgtgttcaaagtcaacttgcaagtccttaatctccaagattgatccgcatctccaactaaaccctctcctaatctaatcacggtctaatggcaccatctatggatattccccacaaaccattcagattagttcaagtcaacattaagatgcacgcaacactctcctatttaagagatgtatcctttcttgcttgtccaacgaaacagagtagcacaagaagcagagtgcggctagctcacagtcaccatggggatgctgcggtggggagctcacctcctcctcctcctcctcgccgcggcgacgtggacgtgcgccggcgccggcgccggggtgacgagcgagtaccggcggaagctggaggcgacggtggacatgccgctcgacgccgacgtcttccgcgtgccgccgggctacaatgctccgcagcaggttcagtcttcttcagtctccacaaccacacaacgcgcgaccatctctcatctctttctttgtcatcaggtgcacatcacgctgggggaccagacggggacggcgatgacggtgtcgtgggtgacggcgaacgagctggggagcaacacggtcaggtacgggagctcgccggagaagctggaccgcgcggcggaggggagccacacgaggtacgactacttcaactacacctccggcttcatccaccactgcaccctcaccggcctcacccacgccaccaagtactactacgccatgggcttcgatcacaccgtccgtaccttctccttcaccacgccgcccaagcccgctcccgacgcccccttcaagttcggcctcatcggtgagtaacattacgccatgaattcatcaccatttcgttcgtttcagttcatcatctcatcacatcaatttaaacaagtcattaggagttgtgaacaaagtagatcgatcacatatgcaaacaaaaactggttcgataggatttaggttaggtttagtctcacagtaatccgttgcattcaatgttgaatggtttcttgtcaagtttttgcattaattatatatatcgggagactccaaagtcgctgcaaaccgccctcatcccaacgtcagtcagtgtcattactcaagtctgaatttcctctcgagtactcctacagtaccgtactcaatcaagtaggtcagccgtgttgactatacatgcttcaaagtcatcaaaaaaaccaaaaatgtacgcagctggaattgatgaccatttgactgtgatgatcgtatggtatttgaaaccaatgaagatgtagattacgttaacgcacataaaacaaaaggtcattattatataattaattaaattttaattattataaaattttcaaatggatatatttgacattttaatgcaatttttatatagaaagttttgcatgactatttaatagttttaaatacatgctaacggaaaaaactattaaacattttgtttcgtgtaaaaaatttctacatataggccgtgtttagttcacccccaagtccccaactactctaaactttcaactttccattacatcatatcacatccaaaactttcctacactcataaacttttaattttttttcaggaactaaacacactcataaattgctttaaaatatcaaatatgttcatttgacaaaatagtattagtaggagtactcccctacctcgcagtaaccgtttcagcgtgttactaatgtatgttagttgacttttttggaaaaaaaacaactgtacgagttctgtcaaatgtagtacttagtacaaatacaaacgacgaaggacctgtttagttggcaaaaaaaaatctctacatgtcacatcagaacatcggatatacggacatatattttattaaacatagtctaataataaaataaattatagattctgtcagaaaactgcgacatgaatttatcaagcctaattaacatgtcattcgtaaatgtttactgtagcaccacattgtcaaatcatgacgcgattaggcttaaaagattcgtctcataatttcctgccgaactgtgatattggtttttttttatatttaatactctttatatgtgtccaaacatttaaaaaaaattgtttggaactaaacaggccctaaattaatgaaatgaaatggatgagtgcacgcaggtgacctcgggcagacgttcgactcgaacagcacgctggcgcactacgaggccaacggcggcgacgccgtcctcttcgtcggcgacctctcctacgccgacaactaccctctccacgacaacaaccgctgggacacgtgggcgcgcttcgtcgagcgcagcgtcgcgtaccagccatggatctggaccgccggcaaccacgagctggactacgcgccggagctgggcgagacggtccccttcaagcccttcacccaccggtacccgacgccgtaccgcgccgccggcagcacggagccgttctggtactccgtcaagatcgcctccgcgcacgtcatcgtgctggcctcctactccgcctacggcaagtacacgccgcagtggacatgggtagcggaagagcttgccacccgcgtcatccgaaagctcacccaggggttcatcgtgctcatgcactcgccgtggtacaacagcaacaactaccactacatggagggggagacgatgcgcgtccagttcgagcggtggctcgtcgacgccaaggtggacgtggtgctcgccggccacgtccactcgtacgagcgcagccggaggttcgcgaacatcgactacaacatcgtgaacggcaaggcgacgccggcggcgaacgtggacgcgccggtgtacatcacgatcggcgacggggggaacatcgaggggatcgccaacaacttcacggtgccgcagccggcctactcggcgttccgggaggccagcttcggccacgccacgctggagatcaagaaccggacgcacgcgcactacgcgtggcaccgcaaccacgacggcgccaaggccgtcgccgacgccgtctggctcaccaaccgctactggatgcccaccaacgacgatgtataattattaatcgactccaaccatctcaaacttcttaatttgtatcactgctatgctattgccattcttcttcttctttagctttggataataaatactcctactatgcaataacaaatactactagcagagtctatcttgttaagccgtgagataattaatccccaaatgggacacttgccaacacatttggctaccaaattggatataattaaaaatgtttatattttggagcaaagagagtagtacaatctaaaagggagtcacaaaaggattggtttctttggaatatttttcatgtggctttgtttgtaacaaaagagattgcatctaaagttctcaaggaaagttgagaatttttgtacttcaatggaaataaacagtgagattatccagaacagagattttcttctatttgattgatttgattgttgtctcccttttctctattcttaagtttcctgttacttttccaaacagagacaccatatataaaaaaaaattaagctgaagttttactaaattttagtgataacaaaaagagaaaaaaaagtctttatgcagagaaaaaggagaacaacctaacaagttcttatctgtaaagttctctcttgaaagttgctatttatgttatgtataaggtgaagaaaatattattttaatctttttaatccttttttctgcaatttttttgctttccttttttttgcgcttttttattacttttttaatcttcacgcatgtttttcaaatgttttgtattgaaagtttttaaatcttgacttgaatcaaatcttaacttttaaaaaaataaatctcaagttgaaagttttcaaaattgagttgaaagcttttaaaatctcgagttgaaagttttcaaaccctaattgaaagttttttaaatttgagatgaaaagttgaaagttttcaaattttaacttcaaaattttgttttcaatctgttacttaaaaaaaatcttccaaaaaaagaaaaaaattatcttaattaccatcgtgatctaaaactaacatgttagttacgttagatatactcgtcttagggaaaaaaccacggaaaaaatccaccggtatacgcgataataaaaccacagagaaaatagaactccggaaaaaaaataaatctactgtggtgaagaaagggaaaaaagaaaacccacccccaggctacgtgcgtgttgccggtgtgcacgcgccaagcggcaatccctgcaactgcaactagtggaattcgagaaacgcgggaaggttgttgatggatgaatcgttcattccatccatcgtattcgtgaatgccgttgcatgatccagtgcgtgacccgattatcgtgaaaaaaatgcagcatgcatgcccctcctctccaactgatcgatgtggacttggactaatctatttgctgctcctccgtcaagtggcaatccctgcaactagctaagctagtggaattcgagaaatgcgggaaggttgttgatgaatgccgttgcatgcgtgcgtgatcgatcccgattatcgtggaaaaaatgcaccatctgcactatatatatactcactcctcatctagaacacaacaaattcattagattagattagatcatccatggtaatggaggcggcgtgcgtgctcgccgtggtggtggtggtgatggcgttcttgtccccggcggcgcgcggcggcgtcacgagcacgtaccggaggagcctgcaggcgctcccagacatgccgatcgacgccgacgtgttccggccgccgcccgggttcaacgcgccggagcaggtccacatcacgctgggcgaccagaccggccgcgccatgaccgtctcctgggtgacgccgaagctccccgacagcaacgtcgtccgctacggcctccgcgccgacaacctcacccacaccgccaatggcaccttccggcgctactccttcgggcgcaagtaccggtcgggattcatccaccacgccaccctcaccggcctcgactacggcaccaagtaccactacgccgtcggctccggcgacaccgccagcgccaggtccttctccttcacgacgccgcccaagcccgggcccgacgtgccgtacaagttcgggctcatcggcgacctcgggcagacgttccactccaacgacacgctgagccactacgaggcgtgcggcggcgacgcggtgctgttcatcggcgacctgtcgtacgcggacaaccacccggggcacgacaacaaccggtgggacacgtgggcgcggttcgtggagcggagcgtggcgtaccagccgtggatctggacgacggggaaccacgagctggacttcgcgccggagctgggggagacgacgccgttcaagccgttcacgaacaggtacccgacgccgttcggggcgtcggggagcacgcggccgctgtggtactcggtgaggatggcgtcggcgcacgtgatcgtgctggcgtcgtacgcggcgtacggcaagtacacgccgcagtggaggtggctggagggggagctgaggcgcgtggacagggcggtgacgccatggctgatcgtgtgcgtgcactcgccgtggtacagcagcaacggataccactacatggagggggagtcgatgcgcgtggagttcgagcggtggctcgtcgacgccaaggccgacgtggtgctcgccgggcacgtccactcgtacgagcggacgcggcgggtgtcgaacgtggcgtacgacatcgccaacgggatggcgacgccggtgttcaaccggtcggcgccggtgtacatcaacatcggcgacggggggaacatcgaggggctcgccgacgacttccggtggccgcagccggactactcggtgttccgggaggccagcttcggccacgccacgctgcagatcgtcaaccggacgcacgccttctacgagtggcaccgcaacagcgacggcgtcaaggtcgtcgccgaccatgcctggttcaccaaccgatactggtttcccaccgacaccaactagctacccttaatttcctacggcctacttcctctgtcacgtaaaaaaccaatctagtataggatacggcctactttctctgtcacgtaaaaaaccaaatcagtataggatatgatacattctaaaccaatctagtataggatacggcctactttctctgtcacgtaaaaaaccaaatcagtataggatatgatacattcaccaaatcagtataggatatgatacattctagtactccgaatatagatatacatctattcagattcatcgtattagaatatgtcgcatccgattttagattcgttttctgtggacggagaaaatacctgcttaattttttctttattactagtacttttctttttctagatttcgacctgaattctatttagtacgaatgcatcaacagcaaaacagattagcacactagagagggagatggattaataaaatcattcggttctgtttggagtttgctagtataatatattcttggttctgtttggagtttgctataatatattctttcttgacgaattatctccattcgtaagcgtgcgttatcctcgcctcaactaatattggaattacagttcttctgtccagaatagtagcttggctatccctttgtcttttgctctgccgaataaaacagcaactgcagttgttacacaatttttctaaaaaaatcttagtccaaattccgaaacaattcattctactacttgggacctgggagtggaaaagcagttctgactgaataattcatacgcgtgataaattgggatattgagagccgtatagcgaatcagaattttgatataacgtactgaatgaacaagaatgacctctgtattgggcatatccgcatatggcaatttgtcgaccatcatggaacagtttgatcaagttgatggcatgcgtttttagagaaagttgatgcaatgcactggaaatgtaatgttgtactccaaacagaattgggcaagccctgatatgctattccgccctttgcacacaattcggccatgatagtatgccttgatggtgactcctatatatgcaaagttcatctcttttgttttctaatagtccccttcactgtttttttttctgtcgtcctatatatgcaaagtcctttttttttcttacctcttaattaccaaaatccaaaaaaaggaactaattgaggtttctttctatacaaatttgacatccaaaccatctactttgattttgactattttcaagagatgtaaatttttttttcacaccagttaaagaatagctgcacaaatttatttggtttcaagatttgctatttgacattcgaggatgctcagctgacttcttttgactataagggctgtaaatgcaacatatattgtaggagattcctgttccgcgcatacgcgccgccaaacgaaatcgtgcgcacgcggtttcaataccatttgctataggacttcttttattttctgggagatgcgcacatctaacgtaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42497 - DNA, 2542 bp, Oryza sativa
tgttcagggctaagcattttgtgcccagcttgagaccattttacaggtatgcaaaccctcgcgatgatctcttcagccttgcatgggacattgccataccatgtggagcaatactgctgtcggttcttctgttccttcagcagcggtttggaggcgctttcttatttgttcgaagaacaggaaggcaagtgaatatgaaatggtttccacagttagctcttaacaagttttcatctgtgcaagagaaatatagagaaggtttctataggctaagaaataggttgcttcttatgtctatgtttgctttacacacttacatacctgccttgttgaagcaaaattacatacaaaagaagctattcaggttgggcattcagcaataatgtttaaaatgctccgttcatttctatgtgctactagtcagtttacaattacgctgttattattctggtattcagaggcagtcgaggtggatttctgacccatgagaatttacatctgcgtgaagttatggcaaatgctgtttttgggtagtcattgcagatcttgttcagttgtccgggttgcaggccatgtgatgcatagtcgattcggtagctcactgctcaccattgattttgtttgccgttgtccgtacgttgcaatgctcaccattgatttgtttgccgttgtccgtacgttgtaattcaccgtacgagtatgtagtgttttaaagcaacaacatttgttagaagcttgacggttctttaggagcacagaaattaggaggttcagccagcgacgcacacgcagatgcttttggtctttgcatgataatttagtgagagagaagaaatttaccgttagcctccgtgttccttttcttttcatatgttaaagaggcgcacatgcgtatgtaagtcgttttcatattttttttagttaaacctatttaagtttgatcaagtttatagaaaatatatagtgacattttcgatacaaaacaaatcaagatattaaattttagttttaaagaaactaattttggtgttgtagatgttgtcaaatttttttatagatttatttaaatttaaaaagttttgacttgagaaaactcaaaactgattataatatgatgaaacgggagtaatatacatacagacaacggtttcagcatcatctaagccctaattttccctgtggtgaaagctagtatattttttattgggcccaacgcgtagtgggctggcccgaagcctagcccaaactatatcagcccgttagtccatcctatctttgttaattgtaatggtaagtttgtactcgctcccttccaaaataaaaaggatattggatagatgagacacatcttaatactacaaagaatttggatagagtctatcaagattcataatactagtattatatgttccatctattaaaaatctttcatattttaggagtggaagtaataacaattctactcgtttgtgtccgactctccgtcaacgagggcttaggtttttaaaactaaagcatattcaggttgatatatgccttcttttttttgttagtcgactagtgtgaattaatatcatctaatttaggtgaatagttaaacgttataagaaaaatttaaacaacatctgatttgggtggaggtactagaaagaaagaaagaaagaagaaagagagatatatatatcatagaaccgcgcccatctctacgccaatccaacgtgcacgccaccatgtggtgaggcagaaacacagtcgcatcgcatggacatgacaacatccaccacattccattccaacctgaccccgtctgcctcacggcccctggactggaccgcgccgatgcacgcataaacccctcgccctcgcccaacgcgcggttttaccctcttttttttttttcttttggccccgtttcctcccaaacttccccttcctccgcgtcggttgactccgaccggcagccaggccagccagagatatttaaccatttgccacatttagatgtggcaattaactttttgttacttgaccccatatatcataaacacatgtggatccacatgtcattgagataggggtgacaaatagttatttgccaaatctaaaaatgacaaatggttaaaagccccggccacccaacccaaaccccgtcgtctcctctcccgctcgctgtccaatcattcacaagcgaaagcgactagccccacctcactcctcccctcgcgaccgcgtcaatggccgcacccacgccgcacgtcactccactgacgacgacgtcccgtccccgcccggcagccaccaccggaggcctccttgactcggccgtcgccatcgttcgcctcgtcctcctcctcctcctcctccccgcgggtagctttcgctgccacacacacacacacacaaacacaacgacctcgccctcgcgaagacgacggacggactagcactagcgtggcgggggacggggccacgccgtttatagcgcgacgcggacgactcggtggtggtggtgatgatgatgagggtgttgggtttcatggga

SEQ ID NO: 42498 - DNA, 10025 bp, Oryza sativa
caggtaacgacagtgcctcacaggtgttcgatcgggtgatccctttcagttcactcggaattgagcttgagagttttgttgtgttgggtggtttccctgccatggcggttcgcagatggcggagcaggtgaaccagacgatgtcggtggcggggaagatcccgtcgggcgcgttcaacgccatgttcgactaccacgggtgctggcacaaggacgcggccgccacggggagcctctgcttcgacggccgcttcatcgagctctacgccgtcgaggccccccgcgcgcacctcgccctgctcgaccgcgtcaagcgcgacgtcccgcccttctgggaccccgctgctctcgccgagtcagtacgccttcccccgtcgcgcgccgcgcgcccggcgttcgtcgcgtttgctgctaccccagtggccactgactctagtgtactgacatggtcgctgccgaattttctgttcagattcatcgacaagtacgggacgcacgtcatcgccggggtgaagatgggagggaaggatgtggtctgcatcaagcagctcaagggatccaatctcacacagagcgatgtgcagtctcggctcaagaaactctccgacgacaagctcgctcaggattcacctgaaagtttaactgcaagagacgacaagttcttgctgggattaaacgtgagctctctactctaacattatatggcttcaaaattagctttcttaggtggtgtttacatccagggacttaacttaagtctctgtctttagacactaatttagagtattaaatacagactacttacaaaactaattacataaataaaagctaattcacgagacaaattttttaagcctaattaatctataattagagaatgtttactgtagcatcacataggctaatcatggattaattaggctcattagattcgtctcgcaaattagtctaagattatggatgggttttattaatagtctacgtttaatatttataattaattttcaaacatccgatgtgatagggacttaaaagttttagtcccatctaaacagggccttagaagcttcagaattactgtattggactttcataacccatgattcggtttctgaagatacaggcgccattaatgattgtaagtagccttgctaattgctgtgatgttgtgcaggggagtttattattgggtcctggatctgctgcttggcggtcgttcagaccatcagtcgtgtcacacaaagatgtaaggcaatcacacatgtactgacgatgttcattgcgtgatttatcactccaacagcaggaaattaatgagagagccatgattaatttgtttggtcgcatgtcctttcgtttcacaggacatcctcagtatccacatcagaagagggggcgttgataatggccaaggccacagtaattggctttcgacgatcagcggttcaccggacgtcatctctatggcttttgtgccgattacttctctgctcactggtgttcgaggctgcgggttcctgaatcatgcagtgaacctctacctcagatgtaagcactttgttagttactgctggtgacaaacaaaaccatgccagttcaaggatcacatcgtatctcaagtactgacatagctaaattactcaggttacaagtctaattatctgtctgttttctgctggtaaattcagacaaacctccaatagaggaactccatcaatttctggaattccaggtgccacgacaatgggctccagagtttggggagctccctctggctttgggcccgagaaagaagaagaacagcctgccatctcttcagtttactctcatgggtcctaagcttcatgtcaccactgccaaggtaacaatcaataccggcattctgcattagtgaaattcgtcagtttgattccatgttgtttgtagtagaactcagctcacagtgtgttccgttttgtttcgtgcaggctgattctgggaatcgtccggtgaccggcattcggctgttcctggaaggcaagaagaacaaccggctgggcgttcacctacagcatttgtcagcgacgccgggcacgatcacgatcgccggcgaggtggcgtcggcggaggacgccaccgtgagggagcgcgactacatcgagcccatcaagtcgccgctgctgtcgcacgtgtgcacggcgccggtgcagtacaacggcgcgcggatcgacgactgcgcggcgatcgtgacgagggcgtggctggaggtgcaggagacgtgcctcaagaaggtgctcttcctgcggctgggcttctccggcgtggcatccaccaagatccggcggtcggagtgggatggcccgttcgtcgtgtcacgcaagtcgggctcgctgtcggcattgttcagcgcgcggctgtccgccgccggtgccggtggctccgcgcagatgatgcagcagcagcagccggtgggggagaaggtggaggtgaactccgccatcttccccaagggcccgccggtgcctctcccggtgcagaggatggcgaggtacgtcgacacaacggaggtgatgaggggccccgccgacttgccggggtactgggtggtcaccggcgcgaagctctgcatcgaaggcggcaaagttgcactcaaggtcaagtactcgctgctcatcgcggaggtgctagactaccctgagtgactgttgagaagaactgcacggtgtgtgcatctttttggctcgtttgtgatgctgttgtgtacagtacagtacagtacaggtaaggtcggctcagctcagcgtatacttgtacagattgggcacacgctagtagtcaggtatactatttgtatgtataaaccacagagtagagcagtacactaccagcaggcaattgttttggtttgcacttggattctagcaaaactaggagcatacacagttgttgaaattggtttccttaggcatgcagctcaaaaggttatgtacgattatttctcacctctggtattgccctgagatgggatcatttttactggcaatgttgagaatgtgagacggtttggtaatttggcatcagcaatcatccttgttcccaacagtataacaggaggccttttacattgtttgcgagttacttagagaaggagctgaaccgttgattaataaaggggcaagataagaaataaaattattgtaatacgatagcaatggaataattaactagtgaaatatgggcatttcatgtgaattgaatacctgctagctccatttatcagttttgttatagagaaaaaaaaacataaatcatagatacttcgttgatttagcgttcaatatgatccgtactgatgaaaaagaaaatcaaagatcgtgtctcatttcttctttaccttcacttcattcttgttctaggatgtaactggttcaatggaaggagagagagaagacaccggcatggttgagggtcgaagaggagacgagatcgtccaatcgatggctagttgcaagcgcatgattagttatttatgtagttcacaaatttgttgaataaggggttgaatcgagatctcctatatgttttttgttctagggtttgaatggtgcacccacaaggagacacggtcgtggaatatttcatctttctaggaataaatcgataaaatgtgtaacttaaatcgatgcaaatcttcggtgatattttaaccaatcatgtttgtgaaacacaatataaatctcttcttgtaaaacaaaatatatatctcaaaagaaataaagggaggagttttgacatgttctttagaatatagagtaatatagagaaaataacgcaaataataaaattttacgctagtaacgtgttcttcgaaacaaaatacaaatatagagaaaatcacgcaaatgagaacattaaagtatacgacataaatctagaaaaaatcacacaaatgagatctactaatctagtactaggcaaatgacttaattggttgattaaaatttagagacaattctaccattttctctcaactagcatatttgtcataaatacttaactagcacataattaattaagttttaatatagagaagcttaattgttactaacatatggctatatgaggaaacttgatttttactctagttattgatacgagctatgctgaaaactacctttatttatttacaaagtgcatgcgcaagatttacttttgaatttacaagataatcatgtgtatttaggcctgcgccactgaatttgtcggagtgtgaaggattcaatactaacctttcatacttcaacctgcatcacacctataaacactctagtcctgcgcgttcttctcaaacttccattatctttactgaggaatacttttggcatttatgtttcccatttaaggtgtttataagacatctgatcatatgtgttagcagtacttttaacaacaaaatatgttatataaataataagcaagaaaatatttgcttaaaggaaaaatagtgagaattcttggagttggtatgattgactatacatttaagaaagcaattagtaatttaaacaatgttgggttttttagagttttctaaagcggatggatttgcagcagatttgaagctagtcatgaaaaactctgttgcgattataacatgatcaagaatttatctgttggagggatgaaaatgaaaaaaaaaatcatgtcattaaggatctggtgggtaacttaacttgaggttggttagtatttcctgctttcaatgtgtggatggataaatttgaacagaaaaaactttctttcgatgattgttagggttttcaatttccttaaaaataaaacttaataaacagaaaaactttatttcgaggatttttagtgttttcaatttgcttaacaagaaaacttaacgtagacgtagaagatttgtatgagataagagatttgtatgagataagaaccgacctacttatcaatatgaatcatgacaaacatttagctgactatatatacagtggtaggaattactttaaatctatctacaatgtggtgaaacatttaatataaactccgtttgaaaagttatatataatattctttcagttttgtaaacagtaataaccttaacttatatttaacttaactcatatttttatgttttataataaataatgcttacagaattgtggttttatatgtgtggacagttacaagttggttggatgtgtgtctcatagtttatttatatgaggaattgacaaatgtatatttaccataatgtaattattgttaataccgtatgccaagttaagttttcgacctaatttcaattgtatgttgctaaaataaggttattgtgatctttttcttaatatttcttttttagatgtacatgagtagtcactgttgcatataattaatatctttatgcaggattttagtaatgtacttagatggagaagcgatggctaactgttgtaacaaataatggacactttctacttgagttggtgtgttctttataaagtagtagaattagctaggatgatgttttaaagaagtaagttagctaggaggatgtttcaaaggtactaatcaggaataacacattgacatatttgttgttgatggactaaaacgtctatcgaaaggtaggcttcactcacaaggtggaatataaagcaataaaaatgtgttgatttatatagtggtaaaaatgtatttcttaaaaattggatccccaattacacaccctttggggtctatttatagctgtgcaggcttacaaccccaggggctagggttactgttcactcgggaattaacttaactatccttataatagggacatttataggggtaataatcgtcttatggcccatcctacaggcccatgggccctaaagggtccttgttgggccatttgttgggcttccagtgtgaaggccccaccgaggaatttgtccttcttcgccattcgatgcccctttgttgcatgcttggtgaagacgcttgtcattggcctagcgaagttacttgccgcttgccttcggcatttgtgcgggtcacatccttcggcgtccgacttcgtgacttgacgggtgtttcaagagtccggtcgaaggttctcatgacatggctccaataatatttttttgcaattagttggaaccctgataatcttggaagcaagtggcgtgtgagtcggttatggtgccaaagtttcaccttgttggcctggcgaagctacttgccgcttgccttcggcatttgtgcgggtcacatccttcggcgtccgacttcgtgacttgacgggtggaaggttctcacggcatggctccaacaatattttttttgtaattagttggaaccctaataatcttggaagcaagtggcgtgtgcgtcggttatggtggcaaagttgcactcaaggtctactcgctgctcatcgcgcaaatggactacccgaagttgagaactgcacggtgtgtgcatcttttttggcttgtttgtgatgttgtgtgcggtacaggtaggggtgaaaacggggcgggtatttcccgaccgcccgcctggccgtattattttgggacaaattcgggtcagaaattcgggtacccgaaactttatacggatatagggttcgaatatgggtttttttggaggatatgagatcgggttcaagagcgcagtatctgacggatacggattatccgggaaaaatacggatattacccgattatatatacggatagtaccagtattatatgttacagccgtacaggcttgaggctagccagcccaaacggccaaccactagccaccaggcgccaccagcccatcaacccactggcccaataggccaatactaagagcaacttcaatagaatggccaaatgggtggccaagctaaattttagcaaatatgaggggaaaatattctccaacagtctctccatccggttagccaagccatctggatggcccaatcgcacctctcactggccaaacttagagtctctctgcctggctattcgtgggccccaccactccccctcccgcaccatctctccctctcctagctagagcaagaaggcgtcgacggtgctgctcgtgaacggcgatggcacagaggagagagacactggagccagctgcgaccaccgccgccgtcctcgccgtcccagagccaactgcgaccgccgccgccgtcctcgccatcccagagccagccgcgactgccgtcgccgtccgctgccgtccccgcgtggatttgactgggcggcgtggattcgggagaggaagagtgagaaaaagaggaagagggagagaaagagaaagaggaagaagaatgggtatagagggctaacacatgggtcccgctatcacctgtcatagactcaaaataaagaggatagatggagaggctgttggagtaaacaatgaatttgacttgacaaatgaaatgaaaaattagctaaatagacatctggagagtcgaatttagagagactgttggagatgctctaaccctaagaaataggagagagcttgagggagatcgagagtcagagagagaggtgtgaggccgtgcggcgtgcgcccgtgcgtgaggggatttccgccgccgctgcccgctggcctgccatgcccttgcgcaggctgcgccaacgtcacctgcgccaggcgccaccacgcatccatgccggctgcgccaccctcgccactacgccggctacgccacctgcgttgttgacctgcatcgtgcagcttgagcccgtcgccatcgccagtgctcgtcgcgacggcgctcgtcgccacctctgctgcacggcctgcaccggtgcccgtgttgcctctccctccatcctagcaaacttctcgcttcattggccgttaaatcatcaggtagcgaatagtgttgaggctgaaaacaactgatgatttaagtggcgctggtacttgtgaatttgtgatatgtttcctggttggcaaggcttatgttgtgagcgatattatgatgacatagtgtactgataagtgatatcaggggcgggcctacaagtctacaacaattcaaggtattcaaattgttagagtgtataaagtgaattgctcgtctttccctatcagcttaggtttttaggtgtaactggctgatgcatgcaacttaatatggtatcagagccagaggtctcgagttagaatcctagcagcccactccaatagtccacgcttgagacttgaattttatcaagaattttggtaaagtatatatacccatatgaatacccaagaattttggccaaaaaaaagatatatatatatatatatatatatatatatatatatatatatatatatatatatatatatatatatatatatatactatgtattttatatgtgtattcaaaaaattaaaaaaaaagacatcaaacagcccatcaagcaaagaaactatccaaccgtgtcctccctcttctttattggcccattagcacaattgattcactccattttacccaaccaaaaactctatatacatgaaattatgctcaattttgtgttatatatgttatatattatatacaactactagtatgtgatattatataaaccaattattatcattttttagtgtagaaatttttttccctctttattttgaatacccaaccttaaaactctgggcccgcccctgagtgatatgcttggcaagactattgttctgagcagtattatggtactatgtattggtgaatggtgacattttggatgatgctatggtactatgtattggtgaatggtgacattttggatgatgcctacttttagcttgtggctgtgaggtacatgtttcctaagcccctaatggcttaatataatcgcattatggatatttaggattgttgaatgcttattgtctatgtggtatttatgattgttgcttcgacttgatatccaaacaagtattggtaaccgatagtgtacatatccatttttttgtacgtattcgtcccatatttttacccgatattatccgatcttatatccgtattcgacactatccgtattcaacccgattccgtttataaaatataggttaggatatgagaagggtgagatccgacccaacccaacccgatttcacccctagtacaggtcagttcagctcagtgtatactgtacagattgtggcattgcgcacgcgagtagtcaggaatgctacacaacaggtcagctcagctcagcgtatactgtacagattgcggcattgcgcacgctagaggtcaggtatgctattggatgtatgaactagactatatcagtacactacacagcagacaattgttttggtttgcacttagattctagcaaaactaggagtatatatagttgttgaaattggtttccttaggcatgcagctcaaaaagttttatgtatgattattttcactgcaagtgcaagagatgggatcctttttactggcaatggtgagaactgagaatgtgagacggtttggcagtttggcatcagcaatcatcctcgttcccaacagcatccactgagttatattacttagctgaaataacagtatcttcggtcgtcaaagacatgtttagcgcaccaggaacacaggtggtacatccatcatctctatttttggttaaccatatacaaaaagccagctgcataggcatcctcagttttctctgggttgcaaaggttagacggcctgtgcttcaggtaaagagttaaaacctctctgccgggacaaccaccggctgtggctccacacgcttcctctcagaaagataaggaccccttttaaccgcttcattcaactgtcacaagatgttttccttggtggtcagcacctcactattcacaatccaacagcaagatcagaaaacaatggaatttacgaggatacctttccaatgagttcagaaaggcttggttcatgaagaagatgtgatgatgataatgccttgctgatcgccagacaacaatcatgccgtgcttccatgcctacaaaaatg

SEQ ID NO: 42499 - DNA, 5966 bp, Oryza sativa
aacaaatttccattaggcaccattctctggcaacaaggccagatattactctgtaaccctgcagacatccaaaggcaattagcatagcctcactatcaagggacagcaattcactttctcactcataacgggtcagcaactgggggatagaagtagatattcagtataaaataagttaagagaactgcttggaatacaggagttccacgggaaatagttaagtcccagctgaaatctgggatgcttcctgtgttccaaacaggttctaacttcaacaagcatgtgctgcttacagttatccttatgtctggatcttgttgtaacaccgacagaagaagagcctgtaaaaatatgaagcaagaaccgatataaacaaacctaataagaaaggaaaactataaagtaaagatacatggaatggaaaaaaatataaagttactactaaccgaaggtgtcagttttggactgtttcttgctgtggtatagacaaaacgcttcaggcgttcttccgcttgattatccagttttatttggtcttcctgccgatcaacaccagatatgcttccaaatgcatgcaaagcagcctgaacatataaaacaatctcacattagaggaccgatttctggtaacttgattgaaaagagtggcaatagaataaactaggcaggcaacttaccagctgtttacctctaccctgccgaccaaaggatgcctctaccacatgtctggcagcatttgatgaatctgtgagcaacaaacatgctccagcagatgctgttataccaatagagccaaataaacagtacgcttagttaggatgatgacataagtttctagtaaataccccaccccaataattgatgaatatttcattattgtataacagaagggtaatggacgcataaacttacttgtaccaatcaggcctaaggcctccaatgcactctcagtttcatctgtattttgactttcttccatcttcaataatttgtctatagctagaagcagatttgcaacacctaacatgaacaaatcttgataagaaacttatctgtaattttttttaaaaaaaaatactgtaaatacctgatagcattaacacgaatatgatcctagtaaaagtgccaagaacaatccaataaataggttatcaaatagcattcctcgacacttcacatgaaagatctgttaacaactaatgtacataccatttagtacagtttcattataattcaaagaaacccccacaaaaaaattatgatgcgaagttgtcataaatggaggaaacagtataaatcatagcgattaaaaaactgtggattcgaaaatcttcaatgctcaaaaggaaagattttagcacatctggtagaatagaaattccatagctgcaaagatttttagcacatctggtagaatagaagttggatagctgcaaataaacctgcttacagtttcgatctattgtcgtgaaagcatcagctgaagaaagaagcctcccactaatcaatgttgcccttgaccgtacaatagaatcagccgatgaatcgctatacatgaccaaaaaaaaaatcaaatggatgaaaattgcaagacaaaacatagttacagaagcattaggggaatacttgatcacatcaaccatgagttgaagtaaattagtcttcagcaagaagatattgctgtgagggtgttccacgagctgcattacaacacaatgcattattagctgcaacaacgaaacatatagctacccttagatataacagaatctccaagtcattgatcttgatcaccaaaatggaagggggaaaaaaaggcatccaaagccatattctcctcactgcttctattctgaggattttgctgcagcttaactaggtactccctctgttgatttttataaggcatattttttttattttaaaatgttagtacctcgtagattataaccaatgattagtcaaattacaagtacatttagtataaagatctaatggcattggtctggtttcatccagacattcaacatatgatgaattacaactatcaatgcaacttatgcaaggctcttgcaaatgaagagaaaagaagaatcccaccacactattgacgtaaagccagaaataagccaatttgccataagtactttctttcaattgtaaagctttttcagtaactaaaagcaaaagggcctatctacttagaaaccaagttgatggaaactatcatgtatcaaggaaaactgagggatgcaagccaaagtgccaaacatttagcaagccatgaaagtcaaactggagtactgcacaaaaaatactagtatattgttacctcatagaggacctctagtgcactcagggttttaagcatgtctcttctatcttttatctcatcctcaaataagctgagaagatttgagtcgtaaatggcagtagcagtataggttgacacagcaaagagcttagctatcagtgatagaatgcgaattcgtgcctacaaagaagaggaagcaaggaacattaacacaacttaaacatgtgtattgataaattcagaaaaaaaaaaactttgacaagaacagaatcaagatgtcataccatggacgatgactgagctgccactttgtggagttgcacagacccttgaccatttggtggaaatatgatctcctaaaagccaaagcaaaaattagccacagtgataaccacaatgcactaaaggaatatatactcaacaattcaaaaacatgattatactcacaatgcctttaggaatttgtgctaaacgttttatgccatccagagaaattgctgaaatctcctcatctctacaaaaggcaaacagaattaataacaggtatatctccaagaacacgtgtcatccaaccaacagaacttgctatatgtagtttgtgatgtcgaaaataattacccctcagttaaacaattcatcagaagaggatatagattgtgctgaacaaatgtgtccacaacaacagcactatctccagccttatcaagaagatgtatcacctagtaaagaatttgaaaggaattatgtgaaaacgtttatttcaacgggaattctcagcagtcaaaatatttatatatattcagggacaataggacatacagctttgcaggctagttgtctggtattcttcgagtttgcaagcaatccagcttgaataaatgcctgaattatcaaattgaaaagttgaacttcaggtagacagatgtatatagttatagattacttaaggaataaaaagaaacagaataatgtagttggtcattttggaatatgcttcaaagaagcacaagcaattgaccaaggttaacaggtgtatgtgccaggtttaaaaattaaagagactatttcacacatacaccatagcttggcagaaatgatgctccatatctcgaagaaaatactttgtccaagcatgcggcaatagtttcatccatcccaggtacatcagcctcactctgcaatgcactacaggaccaagacgaaaattaaaacgaccactcgataactaattcattattttgcacaacaaactagtataagcaccatagcatttgtggggactagagatgtaaatagatgacttgaacaggtcggctgtaatttcatgaactcattttgaggaacaagcagtttaccctaacagcttgggcagagggtattgctccaggaactgcctcacggtgtcatcaccatgcgctcctgccacaaaggaagtaatgcagtgagtgcctaaacaaattgtgccttctccaaatgcaaacaagtccaattgaaaattttaatacgcgccacctgagtaattagcaggggaaaaaaaccagtcattcacaaatggactgaagagaggaaccctatttacagcaacattgcaaaaccagcaagccataatataatccaaccctaacgcatgagttacaaaagttactgaaagcaagcgcgatcaggagtgcggaatcagatgtttgcggtgatatgcaacacctactaagcaggctcccacctagcaacatgcaaagcaagctaatcccatcgactcttacgcgcaacccaaaaccccatccactgatctccccccccccccccccaaaaaaaaaaaaaaaaagagtaactcgtgagctagaagctagtgcgggccaaaaaatgattcgccctgagccagatgagatggaggaggacgaggaggggccattgcctgggtaggacgcgaactccgctgccgcccggagcatcgcttccatctcgccgggctccatcgccggcgcctccatctgcgacttgcttggggggaaaccctagttgcggatgcggagagcgagacgaactcgagcactgactggcaaggcaaaggcagaggcagccgctctgctcggaactccgcttgtagtgatctccaccgagtcggttgcgccgcgtgtgctcgccgcgtgcgacggcggcgtggcgtggcgatcgctggcgcgcgtgggccccacacgccggccgtgcctatccaaatccgagagcggcctgagccgtccgatcatcctcctcctcgagcgcacggatctcaaagagtggatgacaaccttgttgggccgagcccaagaatcttttcagtttgacttgggccctctcgaacctcgcactacttcgatgcttggcacaattcggcagagcccaatttcatgtttgttcgtgctcatgacttcaaatatatgcttctgaattttcaaagagaaaacttgtgagatcctgcagagaactgaaagtgcaggtagcgccttacattctcttttcctagtccaacagttgaagcagtcgaggcctcgagggcttcacataattctgcagcctacctattagagcaagtttaatagtatagcccactaccagctataattcatctatagtaaatctaataaccaattcatataatagttgcttactatactattaatatatggtcccacctgtcatatacacattgcgtctcgaagtccgtgctgcagctagctacaaatctgtagcccgctgctcttctctctcatcttttatctcattaaaatatgtttacagctagctaatagtctactattgtacctgctcttacaatgcagcatttttcatctctttagttttggtaaattttcaccgaatttcatgttttctcatgtcattatgtcatatgtatacttgtgatttttcaaaaaataaaacttgtgagagtgatagatatgcagcttatatgcacaatacagtaattgtacgccaatgaccacattcatcggctgatggagatggaacactacagagaactgaaagtgcaggaagcccttacagtcttcttctcctgtagtccaacagtccaagcactcgaagaacagctctatcacaattcacaagccctgtgcatccatatccatgcatcatgcatggatacacgatttgcttctctcatatactactagtcaactgcaactagatcaagctggaagcaactttctgcaagactgtgtataacccttgacctgttcccatgtttcctgtctgaatccgactgtgctcaagacagcaacattgcaatcctgtatcttcatttttctctgttggatactgaaagtatgaaacttgatgacaagtgtaacaacagtagacagcaacagtgcaatcctgtatcttcaaaaacaatttcttggatactgaaacttgatgagaagtgtaatagcaatagacagcaacagtgtaatcctgtatctttcaaaaaaaaatcttggatactgaatgtctgaaacttgatgacaagtaataacaatgcaggaagttgaatcttgaatcttcagatagtgtcacagtgcttcctaatttggaaagttctaggttgacagacctctacatatatatggatcactctgggttcattcattcattcactcattcataatggatcaatctg

SEQ ID NO: 42500 - DNA, 1211 bp, Oryza sativa
aagtgagtgagaaaagcattgcaacacatgcagattcggctgaatgatcagcatagaaagtagtagctgtggttcggctgaacatccgtctagcacctcttccttctcttaatccttttagtatgtttcaatttgcgttttgaggaggttgtggtgaccatcgtttctgctcttgtttgtaatccctccgtgtattctccactttatcctctagagggcttgtgcacttacgcagctaaaacctgccctgtgtaagacgtttagtttgtagtaatattttttttagggaatacgtaaaaggattgcgcatttttatattaagaggaataaaatttatacaaacggcaaacacagaagtgagagagggggaagaaaagggaaaaagaaaaacaatgacttaagcctattctcactattacagtgtgatgactgaacgactaaacacgctaattagggagcgctggcgacaggagatgggcaagacaccaaagggtggcctcttgcgccatagctgtgacaaccttaggccaggacctggaacggttgttgaacacacgattgtttctttccttacaaatagaccaagcgctaagagtcacaatcgtatcgaaccaacgacgacgctctctcggaactttgagccagcaagaacagcgccactcatggaagaaatcaacaccagaggtaaagtaatatatttaggtgagcatttcatccgcgatgaccattctagaaaaagcatagaaagtagagcaaagcacaactgcacaagagataacttgttcatctcctagcttggttgactgaatgaaatgtgcaaggaagtggaaagcattccattcgatgccaagggaagtatatcaaactgtttttctaataatggaagcttttattgaactcaaaattctgagaacacttccaatctatgcacaacagtgcacacagacaaatgaaactgtttgcaccgatcagatcatgattaattctttcgtagcatctagtgtgcatagtggttgatcatgagtgataatgagaacaacaagatcaagctttcacttatgctaactggaacagggcctagtgtttaacacctaagcaaaattatggcgattgatgcatccaatgatgaaagcggttagcaggccaggtggatcaaggcgactagttaacagtgtccaaatcgaacccagacatgcaatatgttacggaaa

SEQ ID NO: 42501 - DNA, 16171 bp, Oryza sativa
  unsure (1)..(16171): unsure at all n locations
cctcactctgtccacacgcatcagcaaaaacacggccacgtggaccaatccaatacctaaactgccacgtggcaacagtatgagaaaaaaacattttgtactttcctagttggctctgtgtttagttggatccaaagtttagattttggttaaaattggagatgatgtgactaaaaagttatgtgtatgactggttgatgtgatataaaatgattgaagtttggatctaaacatagcatttatttccttaagaggtggatagaaaattagattagatcaaaatcggcaacgtagtagaacgtacgtgtgcatgcttcactggatcggcaacggatggccggcacggctggtagtgagatggcgtgcagggttcagcgttattccgagattttccaggcctgtgatttgatttgattgggacattatggttgtgtttgttgaaaatcagtgagtttatatacacaccaccagaaaatcaagtgacatgtcactcccatgtggccatgcggcgcgttctgatccgtgagagatcagaacagttcgatcggaatggaagaatcatcgatggtttgtgattggaataatcatcggttaattgcacagcaacatccggcgggtgagatcgtgattgatcctctcctgctgggtcggcacagaactttcggctccatcgtttcacttatatgacatatttacaaacgaaaaataatttgtgaataaaattttatatacgtattgttagtaacctaaaagaaaagtctaaaaaaataaacttcgatgaaaaaaatcctaaaatcaacttcaaatctaaggttgaaaattcaaattttggctgataagtataagcataagcgaaaagatgaggccgtgcgtctaaattaatttcgtgataaaaacggcagcaatatacagtcaccaatgaatattcacccaattatacacggatgtttaagaatagtgaattctttaccatgtagaaaattgtattatactcctcaagaaataaaaaaaattatcccttgctatgtaaaaaataagaaaccggcagccaaatagttatacaatttaaggagctatacaacttttgaaaaaaaaaaacttcaaaatcattcaaatataactatggtatcatgggaaaaatatccattgaaaacttgtatactcactataagtgaatcaacttattagtgattaaaaataatttataggtaaaactttatataaatggttttagtgacttaaaacaaataaaaaaaataaactacaataaaaaaacctaaaattaaccccaaaattgtgttttaaaattttacttatgcttataagttgaaggctaaagtgcaaacgataggcttaaacgatgggcttaatagtgtaaatatactgtaataacttatacatatataacttacacataactaacaaaacatgtttacgaacaggaggtcatgggttctttctcctgctaatttctatcaacggaaatttcgcaaatctatttaaaagtagcatacagtaccctttactatgtgaagaaattattttactccatgcaaaaatttatataaaaaattggataggagtatgaaccggaggcgatctgccaacgcagcacgcataaaaccgaccgccgcagaagcgcgttctatccatgatcatcagtagccgctgcacggcaggtcggcttttataaaagacgacgtcgtctcgtcctcctccatcgccgtgccggacacagccaaaaagcggcctccgcttagctagccgcagctgaaaatctcctcctccatttcgaagcagagcagagcagccgccgagtgtttgattgctgcagtgtgtctcggcaaagcgcgacggcgacaatggcagctcgtgtcgtggtctaggaggagggagcaggagcaggagctgcgtgcgtttcttggtttcttcttgtgcgtcgcctcgcgcattggggacgacgtgaggtgatcgggcgaggaagaaggaggaatggcgcgcgggaaggtggtgttgatggtcgtggtttgtctcgccgtggcggcggcggcggcgtcggggcgagcggtggggggcacagtcgcggacgcccgggcaagtcggcgaggctgcagctggtcccggctgccccgggcgcgtcgatggccgacgggcgagggatgacaggcggcggcacgagtacatctccgccaggctcgcggcgtcgcggcggcggcggcgagcggaggagacctcgtcggtgtcgtcggccggggcggtggcggcgtctgcgttcgctatgccgctgtcgtcgggggcgtacaccggcacggggcagtacttcgtgcggttccgcgtgggcaccccggcgcagccgttcgtcctcatcgccgacaccggcagcgacctcacctgggtcaagtgccgcggcgccgcctctcccagtcacgccaccggcaccgcctcgccagcggcggcgccgtctccggcggtggcgccgccacgggtgttccgtcccggcgactccaagacgtggtcgcccatcccgtgctcgtcggagacgtgcaagtcgaccatccccttctccctcgccaactgctccagctccaccgccgcctgctcctacgactaccggtcagtatcctctcctctcctcgccattgccattgccattgccatgattccatctccattgacgcgcgcgtagatctcatctcacaatgcagtgatcctcgtgctcgtggctcgtgcgtgcgtgtgcagcgcagccgtagtaagtgccgggttgttgggtgggtcgggatctcgcttgcgcgccataaatttcgcgggttttttccttcgtctccatctgctgctgcgctgatcgaaaccccattaactgcgcgcagctgaagcaagcaggagtagtcctagttctacagtagcacgacagctcgtacggagcgtggtactctgcaatctgcagtaattttcgcgtgactttttttatggtcttcttggtcggagctgagcccgattttaatgtcacacatttactgagctcatctgctggccgcgcacgacgccgcgccgcggcgtggcgtggcgtggcgagagcgcgcgcgcgccgcgccgggcacgtcgccgcacgatcggctacggctggtcgcgcgttcgcgttcgcgagcgccgatgcgctgtcgcttctcgtccccggaagcgcaagtggggcgagttggcgcgcgacaccgcgcaccgaacagtgggcagtgggcggccgggggcgcgcgccatgtgcgcgccgtacgcagcgcctcgggctctgcacgcgtcgcggagaacggagcaggaaatattcagagaaatgctgcaactgtaaacgcggctgattgactgaagcccgtattgaattgccaacctttgcagtttgctctgaccgtcgtgaacgacctatatatcactgtcgtataatagtgtaacggttaccttaaacccaaagttagccggtgtactaaaccaggcacgttagcagttaattcaacctgtctgactgaccatatccaaattgtggccatgttctgtatgatctctgtatatccaactgagttttttttaatagtttgcagctgttttacactaactgcagtggctgtactagctagtactcctagaataacccaactccaaatatgaaaacggcaaagctactgctcaggagtcaggagtactaccgttctgctctcctttgctggatgcttatcttgaatttttaaggttaaaaggcataataaataactaattataccgacttcatgatgttgatactgccagtcagattcattcaccttactgttctttgtcgacgacagactggtcatcacttggccggcgtagacgatgtgaatgagctgccgagataacgctgcaatctcggctagtcttttccctgtgctttacagttcatgaaaagatatgtcttacctgttccatgattctgatacagatcatgtagaagatgagtaacttacaagccggttctttgtagaaaagccaggtcccaaagtcatatcacgatcagttctaatctagtagtaaccaagtgtacattttgggctaaaaatattattactcattagttctaaagtttggcagtttttttttttgtgtgtgtaatttagcgcacgaatcttagcatgtgcatggatcttaactaacggtggctaacgcgttggtggtgggcagttacaacgacaactcggcggcgcgcggcgtggtgggcaccgactcggcgacggtggcgctctccggcgggcgcggcggcggcggcggcggcgaccggaaggcgaagctgcagggggtggtgctggggtgcaccacggcgcacgccggccaggggttcgaggcgtccgacggcgtgctcagcctcggctacagcaacatctcgttcgcgtcgcgcgccgcgtcgcggttcggcggccgcttctcctactgcctcgtcgaccacctcgccccgcgcaacgccaccagctacctcaccttcggcgccggcccggacgcggcgtcgtcgtcggcgccggcgccgggctcgcggacgccgctgctgctcgacgcccgcgtccgccccttctacgccgtggcggtcgactctgtctccgtcgacggcgtggcgctcgacatcccagccgaggtgtgggacgtcggcagcaacggcggcaccatcatcgactccggcacgagcctgacggtgctcgccacgccggcgtacaaggcggtggtgcggcgctgagcgagcagctcgccgggctgccgcgcgtggccatggacccgttcgactactgctacaactggacggcccgcggcgacggcggcggcgacctcgccgtgccgaagctggcggtgcagttcgccgggtcggcgaggctggagccgccggcgaagagctacgtgatcgacgcggcgcccggcgtgaagtgcatcggggtgcaggagggggcgtggccgggggtgtccgtgatcggcaacatcctgcagcaggagcacctctgggagttcgacctcaacaatcggtggctcaggttcaggcagacgagctgcacccaatgaacagtctattgatgcagatattattcaattattgtaattggtgattttgcgatcgtattaattaaaaagtgttaatgcaacgggttctcaaagaaacaaaaaaaaagaggaggggggggggggggggcaggaatgtgcgtacagcgaatggaaatgttttgcaagcagaaatgacgaatggcattttaggggatgcatgtaaatgatttagagaacttcacaacgtttcatataaacatcagaaaagcaagttagggtattagagaacttcacaacgtttatgaacatcaaggcaaagtattcagaagcaaaatgatgagcggctatcaggcatttgttcacagaactaagaatcaggatggcaaatcttggaaatgctcgcatttgttcagagaattaagaatctggatcgcaaatcaagtgctcgcatttgataaaattagcttgggaaatcaagtacacaatgcggacagatattccatctacaaatagatagataacattctagatttctctttttagctaaatatgcaaaatggcaacttcaccagtcttgatagaactccaagaacactttctcaaacagatcctgatcaggcttctgtctgctccctcaggcgacggattgtgcttctgaccgtgaccgcactggcagtgctggaagagcgtaataacaaagttaggaaacataatagtggacggtgcaccttacaaaacaccacacttacttcatggtgtaggcaccaccagccttgaccttgccacagtccttgcatccccagattccaactgctttcctcttcacagcaaactgtgaatcaggaatagcagtagacatggttagcaagaagcgattatacagaaacaatgcagataaaatagaaaacaaaggtaatacagaacaacacactgattaagagggaaaacattgtagatagtgagcatattgcataatcagaggctgttatttactgtttgattatctagatagttgaaatgaattgcaaagaggaatacttaacctaacctaaaaaactaataactaaatattaagcaagtgatgtagagtagcatggtcagcactacgcaaatttgaaggtatggtgctattcaagttccctctaaccagaggtcatgcaagaaacaaaccacagcagaacaaaaccagatatgattattttgaatattgtgctgcttttaggatagtcatatgacaacaagcatgacacatcataatacagtcaagcaaacccaaagacacttaaagcatcttgctgacaagtaatcattaatatccttggaagaattaccttgccacagaactcgcagaagtacttggagtgctgggaaacctccatcttcttgatctgcttacgcaaactggcaccatacctggtacctgtataacattgatattacaagggcatatgttaacatgagtgatcagacattcatgatgctatgaactaacagtgtgcacagttacaatgtcattaccatatttgccaacgattcctgccttcttggtgcgcttcgtctgcacaaacatcacaaacaagacttaaacagagcacaagcatagttaatggtacagtccacttttacgtatggtgatgattgcagacaaccccactctgtactaaaaatacttggaaagtataacttgtatatacttaaaacacatgacatttccacagtagagcagaaagaacttgtgctaataagaaaccccactctactataagtattatccaaaacagtatattaactgatcatgcagtaccaatggaaacatcggcacatggcagttggcctcaaaggaagcttaacaagctaaagtgtttaatggtgcataatttgaggtaatgatcatgcactttattaatcaacccactccaactaataatttggaaggcagaaattgtcactttaacaacaggaagacggcaacaccagttcatcaggtaataatacagcgggggatctcacagtgatagaattcgtatcaagaactacaagggcgaaatacaacggaagcatcacgcaagtgtttgtaccacgaaatcgttaggtgatcttgtgttggccacgaaaaagcgtcaacagcaagatctcacacgactcccaacgaggacattctaccggcacaaaccaaaacctcctaaaatcaaacaggaacagcaaattcctcctaaaatctaaccggaacgacatattcccattgcgctgaacaaagctacaactaaaccgaaaagggtcaggatgattcaatcagcacagcgagacaacgagttgatacgaaggggaaatccgagtgcacgcgaaggattggagaggacgtatgtacggtgagaggagatcgtaccatctagtcgccgaaaagttggagtactaggcangcggcggcggcggcagtgaaagaggcggcggcggcggctgctagcgaactcnagagggtggcggcgtggtggagctttatatangtgagttttagggtttcggggtcacgttgctgctggcgaagtgacacgttgggctttcgctatgaattccataagcggaggtgggccttccggcctggtagggccttccacagttgggcccttttagtttctcatcggcctagtattacaaggacttgtttggattgtccaaaataccggcccatccaggtctgtaggcctagtcccacataggtggactgggtctagattgaggcccacacaaacaaggcctagattaagccgaatgctattggacgaaaatcttcccactattggagttctgtatatgttagttttcttttgtttgattgtgaaatgccctcaggtgatttttcctgaaattttagtacgaatttggtttgtttaataactagaaaaaagccggtgcgttgcaacgggtaaaaactattttaatattattattgttatatggtttagttaagatgaaattcatagtgagaattcgggtctgttcactttgatgccattttcaatcttaccaagttttggtaaagttatcaaaaaaatggctacatttagtttgttgccaaattttggtaattatataagaaatcctgccaaaattttggcaagttaccaaaattttggcaactatgctaaaattttggattgccaaaatttggtaaagtttttttttttttttgcatcaaagtgaacaggcccttcgcttggatgactcctatattttcaaaagtgaacgaaattgaaaactgactcaaatccggatatgtatttccaaaagcgaattaacataaaaaccgacttatacatggatgaggtaccaaagtaccggcaaaaacatctttaatttttatttttaaaaaatactaggaatgacttaaattgtaaaacggaggaagtaatatgggactatgagtaaaatttttaatcggaacggattcgtctaatccccacctatccagactcacacttgtaattgcgccttgcatacgtgtgcgtgcggtgtgttctgctgttgttatctcgaaaaaaaatatatagcgattgaaaaggaaatacttttatcaccaaatcggagaagaacagtaacacttgcttgcaggtccacagcaatagtcaacctagtgcttacttgatgttaactgcaattattaggctccaatcacactcactttattctctccctaatcacacagaaaaacacacacagcacgcgctatctcttgctgtcagacgccgaatggatgaagaacacacatctatcatcccaattagatgtaggcagatcggtcgagcagctagccggttaattcttccagaaagtactgccggctagctatctactctatctatcctgaatttcctgatggattatctatctgcagttctgcatgcgtacataggtagctagctagtgaatggttaatggccaaccttaagatggatggcatttctgctgcatgaatgatggcgccaatcatactacatttcgtcgataattatccttgagctatgtgcacttatgattttctatcatatatattaattaatctagcttagcacttcaatttgaccatatcagctaagatcggttttagatttctctacatactttgagttacatcaaccttagtcctatctataaccctaaaacctaacctaaaattgatcaagaataacaatattatcgaagtttcaaccaattttacctgatatatttattttagcgtaccttttaacttgctacgtattgtgtctgccacttatatgagataattgatcttttcaaatatataagtatgattcaatctcaggccagatcatcatgttggggattgggccttatttggcatatttgacttggtcaacacttttatataaaacacttttatataagtttgtattaaaataatagccaatacattatctttatgctctaaatattgaatcatcgactagttttcataatattgatttattaacttacatgattaattttacagtcgatggaacatactcagggctttgttttgttcaattcatcataaagatcctaacgcactttgttttgttcaattcatcgtaaatattctaacgcgtttatctaatttcatttattgttaggacctacactagagtaaagcaaatcttcaaagaccaccgtgttttgcatcaacaatcagtcagattcaacaaaatatcatcgccgctcatttagatttaagtgtaaacactagggaatccctgattatagggcgtacatttctcttcggaaatactccagcattatagggagtactacagcaatggcaccagcatttgtgctgtgtcatgactaagcaatcagcagaaaaatcaggtaccggcactctgtccgtctaaatgaccaccttctcgattggacaccagatatctgaaccactgaatccatctgcctatcattttcaaatatactcaacgagcagtgccaaccaaatttagatatacagatacgatatcaaacggctgagatcacgatacaaatgctaaacctctgtagcttcaaatccgctaaaaagccttcaaataattgtcatcatgatacagcaaatagtccgaaataaaaagaaaagctaaaactcctcaaaaccgcttaaatttctgactggttaaccaagtgactagctgatataaaaccctccacggtgacaactatcagtttcgcagcataggcaagaaacctgtttcagttaaaaagtgaaattattgttagttttcaaacttttgacttgttatgcaatagggagataggcaaaaaaacaatgatatcaaaatatattttaaccatgcaaagtgcattatgctctgaagacagtatcaacatcaacataaagtcacaaaaacatgaagaaatcccatactgtaggtttctttaataccacaatacccccccaaaaaaaaatggtccctgttccactaggaatgagctgaaacttgactgtctagtcaaccaggacacaacttgactgtcagctaatagatagtaattggcgttttcatcttccaatgctaagctcgcaattcctacatgtatgtatacatcatcgggcaaaaaacccagacctttccacaaacaactggaagcctgaaaccatcccagggatcccagtaaattcctcctgccaccccaattctgttaagttaggatggggccatgatcccgacctggattgggactcctaaacaatgacaaagtatgaaaggaacctagatcaactaaacggcaaagcatatagtgtaacacattagtttataaccctcgagttcgctatatgtcactctacccacatgaacgcttgtgaacagtaaaacactgacaatattagattgatacatgtagaggtcattggaggcaaggttgtgacaaacaggttgatgagaggcccatcaaccaaagcacagcctcgcactatgagaccgctgaattttatcagcaccccgcagagaacctgcaggtatttcgaagctagcagaagagcttcccccattggcatggagcccttacacacaaacataacgatcactcacaccagaacctaacaatgcaccattccatctaattaggcaacaactgttacgaatactgaattcatggacgattgcataagattctgactgaccccacgagctagatgattcaatgaacagtatacaacatgacgggaagcaataggcaataatgcatcactgtaaaagattaaaaccagtgaaactaagtaccttggatgcttttagatgctgctggggtacatgaagacgcggaccttcttgccctgcaccaccatatcgacccaacaaaaacatcagaaatggccaaaactacaatcaggagcggaatggactggatcaaatgatggcgcagacgacggtgagagcgagattcaccatggaggtgggcgggaggttggaccggaacttggcgcggacgacaccggagttgccgtgcgggcgggtgaccttgccccagatgcagcggatggtggagtcgttgctcttcgtcttggccttgtagacgtaggcgatgcgcttcccggcgtaccacccaacctcctccttggtgttcaccccctcgatctgcagcagcgacgtgttctcgtactggttcgacttcgacctgcgcgagcaaatcaacgccaaaccaagatcaacaccactccaccgcggcgatgacggagaaggcggagacgccacgcagggggagagcgagctgtcacctcttgtagccgaggatggtgccgcggacgtacagcctcacgcgctggccttgccgtcccttcatcgccgctgaagaggaggagtacggagcaagcggcggcgacggcggcggcagagagtagggaggcggcggcggcggcggcgagtgaaatcgagcgcgtggcggcgtggtggagcattatataggtgaggcttagggtttcggggtctcgttgctgctaacggagtgacacgttgggcttcgctatgaattccacacgcggagtgggctttccggcctggtaggggtgctagtgttattagtccacatttgggccttttttagtttctcttcggcccaactttagaaggacttatttggatagtccaaaatcccggcccatccaggtctatagacctagccccacgtacgtggactgggtctagattgatgcccacccaaacaaggcctatattgggccgaatgctaagttagtttccatttttgttgcgaaatgcctcaggtgaattttttttatttttttagagaagggtattttatccccttctgaaattttagaatttagtttgctcaatttttcgcgaacgcgtaaaaggattgcacgtcaatatattagaagaaaatagtttttattacacaacgcaaccagccagaccggtttatgccaggggaagagagaaaaagcaaaatagaaaaacaagaaaactgaagcttagaaaactaccgcggctaaacacaactctaaatagtgaaatttggtttgattaatgttggactatgaactcaaatttttaaccggaacggattggtctaatcccctcctaaccaggtgtgcatgtggtgtgttctgctgttgttatctcgaaaaaattatatagcgattgaaaaggaaatactcttatcacccattggagaagaacagtactcctaacacttgcaggtccacagcaatagtcaacctagtgcttactttgatgtcaaatgcaattattaggctccaatcacactcactttattctctctctaatcacacagaaaaaatacagcacgcgctatctcttgttgtcagacgccaattgcatggattaagaacacgcatctatcatcccaattagaagtagacagatcgatcgagcagctagccggctaaatcttcctgaaagtactgccactggctagctatctactctatctatcctgaatttcctgatggatttatctttctatctatctgcagttctgcatgtgtgcataggtagctagctagtgaatggctaatggccaaccttaagatggatgcatttctgctgcatgaatgatggcgccaatcatactacagttcgtccatattatccttgagctatgtgcatttctggctttctgccatacttgcagacatgcagcagtactagggaatgttgattatgaacttctgagttctgatcagcgtactgtactatgtttcttggttgctgcagtgttgcaaccccttgtaagggcctagaagaatacagataagcaatcaatcctacgtggctttgtatgctctcttatgacttatgcatgatctcagtctgttgtagaatttgtcaagttcagaacattcagatatatatttgaaattgacgcaaataattctcggacctgatcccaatttcttcatataaatttctctgtgcatatccgaatggcacagcagagagaatcgctgcgcaatctacttactgtgctaggataattacatgagcaccaacttggaaacttggaagaaacatgaaggtttctgaattatgactgaactactactgtaatgcattcattatcctgcagtttccatcttaagtactatagtagcagatgtagacgtccatctgatcaggttagttccatgtaattttcctttttgagagaaaaaagatcggcgtctcaatttgtaagccgtgacgtgttgaaccagtgaaagagcagctagcttggttctcaatttctcagcgcgtccgtactgcatatccaagaaaggctcgacaagctgttccctgaacgtgatcttcagaaaaccatgctattcatatggccaaaaccatgaaagggtatatggatcacatcatcacacgatacgttgggcgataaatcttacagatttatatattttagaacaaacaaacccagggaaactattttgatccctcgagagaatgtcaccttgttgtttgaatgtcactcaaatggttatgaaaaaaattaaaaaaaagaagaagatgtattaacatgtgatatatcactccacaaatatgcaagtttcaacattgcctcgagagatcaaaatccactccctatatatagattgatatgcctgttctttttcctctgagtgggaatggaatggaatggcgacatgttttccgatctcataaatgatacattttttctgcaaaaactttctatatatgatttttttattggaaaatcttcttaaatccattttcaatcttctaatacctaatttatttgtttgtacctttgaatatttatcacaaatcatttagctattgaaaaaaaaacccttaagtaatcttgaacgtttcggacagcttagcacatgccttgcatgcccaaatgtagcatacttgagacgcaatatatccatggaggttgttagctagctagctggaggcaggtcgtcgtcatcagataagacacagacatatatatcgtgtagtgatctggagcagctagctaggaggagtcatagtgatctcctcgttttcttgggccgtttcgtcctcgatcactcctggtcgcatccgctggttgccatgacaagtgtcaagctcgattcggtagctagctatagctcgatctcgatctagcctgattttcggagaaaactgttacaaaaatcggcaccgatacatatattacaagctgaacccgaaagaatatcataagtgatccaaacacgtgacacactataacacgtgctattttaatcgaagagaaacacctatatataatccgagtcttgtgagtatatgtttcggctaaatatcattaataaattctagtatatatatgtcgtggtttgttatgtctggggttgatcaatggctaacaagagtcttccgcaatttggactaacttttataacaaaaacccacacacaagaacggttcagttattcagttctcgttttggggtgcgtgctcggctggatatatagctagctttaacgtccgtgcttgcttgcttgcattccggcgagtcgccgcgcgccgggccggccggccagccggcatgtcgtcgttgtcatccacttgccagcaaatgcgggcagagcaaacagacgcagatcgggtcagcgtaaaatgcagctggatttttactgcggattaattactactgggctggcattctgatcactttgctgcatttggttagtttggatggtgcagataaatcagacatgaactggtggattgtaaaattcggttcacatacatatgaatcgaggagaatttcttgtctttcaaatgggacttctgcttataggacttgttttgtaccctcgagggatgaaaacattctctgtaatcatcatcttattatcatcaacggatgcattggaatctatatcaattaattcaccagaatgataaagagatatgctatactgaccatttattatcaatttgtagccataattaagtatggtttaatttactccatttttagaacgacctactcatgaacagcacattcatgtatctcatatcccgatcatggtctctagcaattaaattccgtcttcttttgtagacaaaccagtcaccttgattatttttttcagtttcaatttgctacttttaattttgtttgaaaacgaaaggcgtagaacctgaaaatgcaaaaggagtcaaactttggaagaaaaaaaatcatctattatataatacgccattttatcccctctcatctcatcatctgcataaataagtggagactcacatcgccatcgccgcctacacactcctcctcctcctcctcgccgataacgatggcaatcgccgccgccgtcgccgccgccatggcggggcctcgccggcgcaggatgctgctcctaatggcgaactacgcggcgctgctggtggggtcggtggcgtcgagcctgctgtcgaggttctacttcacgcacggcgggcggaaccggtgggtggtgacgctggtgcagtcggcggggttcccgctgctggtcgacggcgcgctcgccggcggccggccggcgtcggcgccgcgacagttcacgtggctgtcgcggcggttcctcgcagtatgcctcgtcatcggcgccctgataggggccaacaac

SEQ ID NO: 42502 - DNA, 6702 bp, Oryza sativa
tggcgtcgctcatcgcggcggtggggctggcggcgtcgggcggcgtggcggacgacgtgtccggctgggtggacggcgggtcctcgccggcggtgtactggcggtggtggcgacgctggtgctgacgtggcaggcgtgcttcatgggcaccgccggcgtgatctacctcacctcgtcgctccacagcggcgtctgcatggccgccgtgctcaccctcaacgtactcggcggcgtcgccgtgttcggcgacccgttcggcgcggagaaggccctcgccaccgcgctctgcgcctggggcttctcctcctacctctacggcgagtacgccaaggccaagaaggtcgccgcggcggcggcggttgcggcggcggaggaggaggagagcgcttccgacggcgagggcagcgtccacaagagcctgacaggtggcggcgcggccggaggacacgtcgagacggcagtttgaagagaacgagccatgtgatgtgatgggctgggccgcgcgcgcggaaacgaagggagggagcgagcggtgcaacaaaaggaaaagaaactgaagcaacaaaaagaaattggcaggatgcgatgccattaggtgtagttgagtcatgcatgttgcatggattaggcttacttgcaagggacaaaaattgttgcatggatcagtagaccgactgtctgtgcttgtaactgatgggttagcttgatttgttcagagggtgatagctgttggtaggaagaggctcccctgacttaaagtctgaggagacatggtcactgacatgtgggcctataaagatgggccccacccgttagggttccatgtctctataactttacgtcagaggagctccgtctctattggtatggctggtgactagttgtgatggagggttcatttataccgaatcgatagtccctccgtcattcttattctagcgtttattttcatgtttaaatccgtgtcagttttgtaaaaacttgtcgttttagcattcacttttcatgtctaaatccacgtcggttttataaatagttgtcgttctagcatttatcttcttatccaaatttgtgtcggttttagttaattttggcatttatttatcacttttgctactgttcagtcaagtgagattctactaaatccgcacgacatcaacttcctcgaagagcccctcaacgtcctcgacaaccaaactctagcaagctttgccagattaattaggctttgggggctagcaacgaagggtgagcaatagaagaacaataacactgtgttcgggaggtgagattggaacctcacatcctgcgcacgcaaaacggagcgacatattttcttatgataattaatattatttttttaaaaaaaatggattaaaatgtttttaaagaaactttcgtacaaaaaccttttataaaaaacacaccgtttaacagtttgaaaagcgtgcacggagaacacgagggaggtgagttcgggaaggtggggaagaacacagccttagggtggtttgggagagaatgccggggaagtgggaggagatgggcgaaaccatattcataaccgaattcatgttgattttttattctagcatttactttcataaccaaattcgtgttgttgttgttaacacttctcattcaagcatttgttttcatccctaaatccttataggtttcatgtccatattcatgtcggcgttacactgagtcaaatttgattcttgtttgatttttattcccaagagctggatgaacacagcatcgaagccattgatatgcagaatgcaagttgagcaacctcgcaaacctgatgtattatttttaaccagcctagcttctcaccgtcagcaattcagcacgaggattgcacactgtttgacggtgatatgtcagtgctggagatggatcatgatttccatgtaaatgcttgtgcattgcatgattagttcttctagcttgcatgctccgaaacagttttgttgtatcatccattgttgtcgattgatggttcgttatccaggcacagttcttttaattccgttcgtacttttatcctgtgtgttgcatattatgtctctatgatgtgtatggaccattccttatatccttacctttgcaaatcaacagtaggcacctgctcatcaatgatcagataaacaagaaactatggaacattgattgagtcatctaggcctgcagagctcaaagagtcccaagaatgcaattgatagtgaccttggtccatgcttagctcagtatggcttgatgtgtaagtgtaactcatgtcagcaaaacatgtgacatgcccaagtgcaaccaaagggagtaatgttcattacagaaagaatgatgatccaaacagataacatggtacaatagaatgtatactcaagaccgaaacccaacatattttgagccaagcgcacatgagtaaagctgcaaataagaatcccattcaaagtgttccgctgttaggacaaagctttcatgataatacagacccggccgtcccatatgtgtctacaagacgacctgatacaaaacacttcaaaaaaacaaacaccctcagattagaacacaaatatcagacacatcacatcctgtcctcccttctccgtggagcacaagtgacgatctcatcgaccctgagaatcatctccgctgcctcggtagcagacataagaacagcttgcttcgccttaaacgactctgatatccccagcttttccatgtctccaacctgcggaagaagtcttagtatcagctccaacccctagaacaaatgtaaatgcaacttctgatatgcactagcaaacttacgccgccagaaatgacatcaattccagcagtgctctgctctttgtgatgctctgctctgagctgagagatcagatcagcgctatccagaccagcattgtcagcgatgatggttggaatggactgaagagcgcgcgagaaggcttcgatagcatgggacttcttcccaggtgtctttctcgccagtccatctacttctttggccataaccatctcaggccatccaccaccatataacacacgggtgtcgttcactgtttgtgaaagcacacataaggcatcgtgcagggacctctctgcttcatcaagcacatgctcactgcaggtaaaagcacacagtcaacacaagctcaagatggaatatagataaatgtaaagaaaaaagagtccaactataggcatgagcataccttgctcctctgaggacaatagtacaggcttgccccatttcaaccccagagaaatgaatcagcctgtcctccccaatcataatctcttcaatgaccttgcaatgaccaagtttgacagactccgggttatcaaaagtggaggcgatgtcaccaccagtgacaagagcaagccgctcaatgccctcaaaatcagcatgctcgattgccagtatgccagcatctgcaaagagttcctcagggaagttgtagatcaactgcctgttaacgaaacagttgattccatgacctatgatcttttgcactttttctctcattttttgcttttcagcagcttcaatttcagcaaccttagccattgaatcaacccgtacacgtgctccatatatcttaactttgtcggtgtccatagcagtatttgcaaccaaaatcttggcgttttcaatcctcttcggttggccaagaccgattttcttgtctagaatgaacctacaaaagaaaaaaaatcatgaaattgccacctcaagagcaggacttcagtttgatctgctcatggctgcttccaacatatgatgatttacataatttcaaaatttaattagtctgcaatgaataaatatcatgtactactttattcttgaacctaacagatgtttggggtcaataaaggttggatactgaaggaaattttctccctaaatattgtcaaacacaattctgacatacccttcatccaaaaaggagtcctttagagaccctccagttttcttaagaatttgaattgcttccaagttggtactgccctgcaattcagtagtagcacacacaaatcagaatctgcagtgacttaaatgatggtataatgaaaagtatttaaggcaatatagcggcagaatatgtagtaacagtcacaaatcaaaagttcaaaacaactaactgcaatatatagtataaagcattaacaatttcagtaccttaagtcttagaacagcatcaactgcaagaccagcaaagtattccttgtcctgggaaagtatttttgaactcaacgttgtcatagcaatgttcatcagatctgatctaaacttatctgcagtaacatggaattaaaagctgaatattagtggtgtgattcaatttatggaagagatgctagagtgctagacaaattatgtactgtgaacacaaacaagcaatcaataaatggtagatcttttgagcaaacttccatgcataaatcccaggaggcaaaacattaaatatataggacatcttcagtttaaatcaataaaccacatgcgtaaggaaatgtaactagcctgaatcttccttgttatccatggccctctgtaataaagcatcacgagcacattcagcagccatcctgaaccctgaaattggtgaaacaaatccattggacaggaaataaaaagtttaatctgacccatgtgtacagaaagtgatgctcaatcacacgtctacataacatggatgaacttcttgcaaaaaacttttttgtttattgaagacaacccatgagcaatagaatgtaacagtactacgaacttgctagtgaggaacatatgcattacattgcacatgattctcttgggcacagtcaactctaattatgatctagatgaggacttatgccgtgagaagacaaattaaactccgattaagcatgagtggtctaattgtcaacagtaaatacgtggcatcagtatactggtgatcatgtagaactgaaatatacctgcaatgattgtcattggatgtatcttcatatttaccaacttttcagcttccctcaaaagctcaccagccaaaacaacaacagaagtagttccatcacctacttcgtcatcttgcacttttgagatgtctgaggcccacattaaggaataacttttttttatttttgcattataaagattggccaacaagaagatccaataaattatcaaaaatatgaagtaaaaaacacttcatacatatgaaacagagatttaaaacagtgatattacctaaccggtgtagcaataaaaaagggtcaaattaaaggataccaacaaggaccttagcagctgggttgtcgatatgaagagacttcagaattgtagcaccatcatttgtaacagtcacactgcgtcccctgccagttgattgtaggatcttgtcctgagtatagaacatagaaaggcggttatgtgattacaaatttggcacttgatgagtagattaaaatttgagccaatatcaggggtgatagtttgcaaataaatgaagaaaaccaggatgctttagatttttgagcataccattccttttggccccaacgttgtcttgaccaaatcactgattgccataccaccaacaaaggatgcctaaataagaaacaggttagcatgcaagacttgcctgaaaaagcatttgagtctaaaccattttcgttactgtcagtcagaacattcgccaattccgaatgagaaatttataggatataccagtaaatgtaatactgtggcttcaaaagcaatcagtattagtattaaagcataaccagtaaggcagaaaagcttggtcaccattgggacacagaacaggtatagagtttttggttgtgaaataatcaggaatgagccagagccaagaactagagagcgtttggctgttctataggcagtattttggtgatgcaggacccaaggaaacacatgacataaatggatgtagcgtcatagcatagcactgcagagacaaggatggaggaattgaaagggcaatgatttgaactaaccatcctggcacgctctcccttctcctcggtcgcatcatccttaagcagtctatcaacctggaatatacgtggaaatagagtcaaaacaagtacgcaaacaaaagtgaggtgcagagggaagagagaaaacatgataaattagcttcaatcataaacaaggaggagcagttgaacagggatgtcgatggatcagacgattggatgtgtactgattgccactcgtaaatgctactacgagtgttcttaaattgttgcatctatatgacaatgcacacttaagctcaagttttcagtatcacttaataccagcgagtgatcaggtacctcggacggcagtaactagcattctaataacagttcaaacaagtaatagctccgtcaggtttcacagtgccacattccatatcaagcacaaaaaataaatccaaaaaaacacatagatctaaggaataccacacgactacgggcatcatttcactcaacacaagctaaaaccttcgcaaatctaactgagaaaccatatctccatcgcgcggaaaaggaacttgtgataaagccacaaatcaagaatgctccagccacgaacggacagaaacctaaggctccgcagatggagagcaaggatcagaggagccatagagtagggaagggcggccgtaccatctcgtcggcgag

SEQ ID NO: 42503 - DNA, 4064 bp, Oryza sativa
agttttatcactaaagttgtatatttctgaaatttactcctattatatagattgttaaattgattatagatgatttgaagctaataattggctatactatttactttaaccttgctctcgggctcagcgcgctgtcgctgtggaccacggatcataaccacgtactagcatcatctgcctgcagcccggaggcagcggcgaacaagcgtttggagcttgacgttttccgtgtccccgccgggagatgcgacgtgacgggcgatctagcagagagagagagagagaggaccagccgctcgtcgttttcgccgcctcggattgtccgtcagagcgccgcccggcgaatcgcgcgcgttgggagtttttgctcgccaatttcatccctccctccccccatgagctccggtgagatccccgaattaatccggctctacatctcaatttctcattcttggtcttctcaactgaagaaccaaactaaagagagatacgcaagagatcacacgcctcgcggccaatccaccgacacgcaagagagatactgaactactgaagtgaatgaaatctcaccgaagcaggagatgatagatcacccgatcggtaagcaagttgcagggattttttgccattttggccgtggacgaggcacggcagtggatggcggctcacagatgacgacggctgccatggagaggagagaagaagaatccaaaagccgtttggtgagcaggggtgccctccaccaaactgtgcctgtgtcacccaacattaatctgcactctacagccgtcccagttatggtactcctagactaatactcctgtatgcactggtcgaactgccatacggagctgcatgatggagtaaccacggagcctcaaagcaccaaacattgcccgtgccctgtccctcaaaaccgagagatttgataatttaacactccacaaaattgaggttcaattatttgataccctatccatttcccttcactcggatagtcccacgtgtcattctcataagtatcaattaaaataaattgataatgaataatatgtcaatttgtcaaatttctactgaatttccgcgtgtcattcgcatgatttcctagtggaacagcagaggttagcttcagtctaaagaagcttgttgtattccctccatttattaaatatacaaaagtagtttatttgagagatggggtacagtagcactataatcatatgagcattgtttgggctctgggcctctgatgacacactgcctgcgagtcttcaaccctgcaaccacagccggaggtcagatctgcatctgctgaagccgtacgaggttgccagcaaatgttcctgcaaaagagctcgccgtcgcaatgcacggccaatagtaaaaaaaacacaggcagtctatgcagaaaaaatgacggaagaatgatacgcagaattgagcgagctaacatcagttttctcctttcttcttcctgagactctgaatgtctctgacagtctaaaactattcacagcccaccaccatcaccacatggcaatggccatggatgtaaaccaccaaatttcaccaaaacaaaaaagagaaaacaattagaaaaaaaaagccgcccctaatcacccagatttacaaaatggaatcgaaggaacagccgaatgaaagtttttcatcatcctttttttgtttgtttttttctcctaaaccaaaagaaggctcatgcttgcatcgccatccatctttgacctatcttcctcctcttcttcttcctcctctactgatcttacgtttctcttttccgcgatttttctccaggctccaacgcgaaattcaccccacttgtgctgctatctctgtgcgtcgcgctccgggttttcgcgatcactcggagtcgctgtccatgctctccatccctttcagtcccctgtatttttgttgctgcagaggagaggaacaaagaaaaacacatagagatattagatttctcgtcagaggcaattgcagattacgcacaacacaaaccgaacggcgagtacagctgttagcaaaaacacaacaagagacaaaaggtctactacttggcacaagtaattcgacgaatcaactaacgatgacccacagttgatgctgattattacatgtcctaatctaacttcagaagtgcaagagaagaaagaaccccacgtaagcagaaacagcaacaagactgcacgagggacccacgtgtcagtgagccacaacgagcgttgcggtgggtcccacctgcagggtgaccgggacagcacgcgttaagaggctaccaacgtgggcccacgtccgctcgtcggcaaaagataataaagtgcagagatgccggttaagcacagtcatcaatgagcacccctcgcgcattcacgggcgtgggccccactcgacataggggacggacggacggacggatcgttttccctttcgctttttttcctgccccttcgctttgatgctttctcaggctttcccggtaattttttattttcaccaaattttacgcaatttcagacgatactgccaaatactagtactatcgatttttaagtagttaggagtattactgaacctatcgatttttaaatacttactaacttgatgcaaatcagagaaagtggatgtggataaaatcgatagaggagtatatgtaccttcttggtggacttcttctcgcggacgatatacttggatctggtcacatccgagagccacattcctgggcagacgaactgcacaaatacagaacaaaaaaatcatgtcagttttctcatcaagaccatcaagcaaaaagatggtagtaaaacacagtttgattaggtagcataatttatccatacgttgacttgcttctcgacaagcttgggcctcttcttgggtcgctggggcagcttggtgcctttcatggccatgaagtcctcctccttctccttgcgcgacagcgtcgtgtagatccgcggcagctcgatcttctgcgccgccgctgtcgccgccttcgacgacgagctgggcccatggtggtcggcggcctggccgtggccgccatggccggtgtggtgctgatacttggagtccgtcttggccagcgccatgaccaccccaccggcctccgccaccctgtgcgccgccggccgctgctgctgcttctccgccttcgtcgccgccgccgactgctcgccggatctgatcatcatcatgccgtcaaattcaagcatagcaacaaaagcaaactcgccactacagcggtggatgctggacacaacaacaaaaacagaaacttttttttgtgtttttatcaatctatctatcttagctctagtggatgcaagagcagccaggtgaaatggtggatgcagatgaaatgagcacagcagagcaccggcaaagcgactgccagatgccaacccacataaagagggaggagatgagaatgagatgagggtgcatgtgtatgtgtgtgtcctatttttatacctatattacatcaacaccttctatatcagctgcctgaagttgatgtcacggttgatcgttcacacacacacacatggcacatcaccacaccacatgaaccaaaagaagccattaatggacatatggattgcaatattgcatacagaaatgaaatgctagatcgacatgaatgggaatgagcccacagattagcaaagaaaagaagaggggaaagtgctctcctcctcgcttgatgatgatcctgacatggacatggtgacagaggctagtagtacaaaaaattgttgcctaaaggatctcgaaaatcaggaaagagaaattctaaaagtcgtttctaaaagcagaagcaaccgagtgattgaccactagtccgatcaaaccagtattgctactacatatttttattttcattgctcttgttgtacaaaaaaaaaagggaaaaaaatggtgtggaaagaaaagaggagaaggtatcttatcatctaaacgcacctcccctcggttgctaaagatgaagggggcgtgacagctcagctcaccatccagagtgtgaaagagcgggagacccg

SEQ ID NO: 42504 - DNA, 13636 bp, Oryza sativa
cggcctggcgacgctgcggcgagggcgcggccgccgacgacgacgaggcggaggcgtcgcggcgtccgcgcgagcgcttgttgtgtccccattggaggagcacggcggagtcgggcaccgcgctgccgctccccccagcaccgccgccgccgacgccggtggagctcggggaggtggggtcggagatgtcggaggggtggtggccgtggtcgcgctcgcgctcgcgcgccgggctcctgcctggcgcagcggctgccgacgacgacgacggcggggccggagccggtgccggtggcggcggaggaggagcgcgagtgcgcggcttggactcgagcgatgcggatgccgcggcgaggtaggggctggtacgcgcgctgtcggcggcggcggcggcggccggggcgtcgtcgtccttgctcgatctgggccccgccgccggcttccggctacctccgccaccgccgccgccattggggagcgggagacaatcagggctgactctctgaaatctgcagcagaatcaaacagaaacacaagagcgattggatcagacaagaacaaggtctccccttcagaatggaggatgaaacgaacagcaaaaactctcctttttcgcgagaattcgcgacaggaaaaacagtagaacatccccaaatttgcagagtgcaaaatcgaagaccaaacgaaaccattcagagatctgttcgacacaaaccagcacaccacacaaactcgagaaaacgctgaaaatcgtggatatctgaaacaattaggccactcagggaacgaaaaatcttcagccgtgagctctcatccccatcagcacggagccgacgaagaacaagcacaagaacgaaatcgacaagttactcagaaaccagtcaaagtgaccatgaaatggggaaaaaagcaacgaaattgcaacaagcaaagataagatacagccggaccgaacagggacgaattggcaaaatccagcagtaaaccgaacatagatcaaaggatgccttttgtcaaacaaggaaatcaagacggcacacgaacagaaatccgacggcgagcaagaaaaggaatgaacaaaacttgcctaaatcgggcggcgagagccgaagcgacacaaaccagaagcccaaacgagcagataaaatcacacctttgatctcgcgaaagaacgcagcggcagcagcagatagaacacccagaagcacggcagcaacgaacgcatcaggggattggagattccaggcctcacctcatcatgtccaatgccgatgggggtttcgccgggctcgacgacgcgacgtctcgagcaacggcgacggcctcgccggagccacgcatcaaatcgatggcctccttccctctctacctctcctcgcccctcttcagtttccccccaatcacacgcactctctcccacctctgcgcctcactctacagatcaaacatctcgagccgagaagccgaggagaaattgcgcgaagaaatgagtttcttggtgaatctaacagcgagaccagaagagaagagaagagaagcggagcgagcagcagcaatggcgatggagaggcgagccagacggcccaaggctttatcgtttccactcttccaacaatgccctccattcctcgcacctattctcaattctgccacctctacgactgcacctcgaggctagggtgtagatgtgattagcacaagaaccagtggtgttcgagtaaaatcctccaatggcagggagtgtgattagcaccaaattctctggcctaatgcgaaacctggcccatgccacagtgcgggattagctcagaattccggggggcggtttgcataatcacgcgtcttcttcagttcatccccgtgctccgttctgcaagccacccgagaaaattcctagcgccacccaagctccgagtcatccacacgatcagtcactgacagtgggtcccagctcagctccgagtcacccacacgatccagtcactgaaagtgggtcccagctctgatccgagtcacccttgatccagtcactgacagtgggtcccagctcagatccgagtcacccttgatccattcactgacagtgggtcccagctcagctccgagtcacccacacgatccagtcactgacggtgggtttgtcctcgcagcacctgcgcggacaaaatggacactgccgtgtgggtccagcaactacgtggccccagaaaagcagagtgatatacatctcgtgtgcgatttaggtaggagaagacgtgacgtgggggttggggacggacggccaggattggatagcgtgaggacgtggatgtgcttatccacttccacgtcacggattgatgggtcatgtgagcgcgaagagggaggagagcgtgaggactccccgggtcttgcgtggccggtactacgactacgagacgccggtttccagagtttcttacttttcagttaccaagaaaaattagttttatccaatccaaagatgttttagaacaaagtaatgggattggtaaaattctatacatggatcactgttctatacgaggaatacgggcctgtttagatccatttataatggcaaatggcaaaagttttggtggcaaagttttggcattgcaaaagtactagttggtgtttagatgcatgttaaagttttgtcatttctagcactaaagtgagagagagaaagagagagggagtggtcccaaagcactttttggcacaatttgctactatggactagcaaatgccaaatgccaaactgccaactttcgctactagtgtttagatccaaaatggcaaaaagtgctacaaaatagcaaaacttttgccattttagaggaaaacagagcctacattgatttcctgccttaacttacttagagatccagttcattttgaaatgcataattgaagaaaacaaagaaatataatttttgataattaaatgccatgaatagtgaggccatattggaagtgaatttgaggtgtttggttcaatcatagaaaaatcacatgaatttcaattttgaatgatttagatatgagagggaagataaagagacatgttagcttggacctatgagaagaggaggaatataaggataccggtaggaatttgataacctcggcagagaccaaggcccacttagtgacggtgacggagacgggccctaggggacggtagcgactcactgatcaggcagccatgcgaagaagctcgagagagtttagcaaatcagagtcgaggcagatccaagcgaattgtggtgcagatgacgatgagaaagaaaactagtgtggttggggggaacagctccatgcttcggcgacaacttcagccctccgatcagagatgggacagaggaggcataggcccagccaccagctgtggtgaccaagcaattcactatcaagcgaagaatgaaaaaactaggaggagtataggtcaaggagatcgggagcgatggatatataatggcttgttgttgcctaaagatggcatggatgcatagacgatgacgaaaagctaagcgagaagaggtggggcgcccccaagagacccatcttcctaagggcggcagtagtggggaagtttgtaacggcactaaaccacccgctataatgacatgaaagcttgtgtgagagagatggtaacgtgtaatgtcggttgttgcgttgagcatcgaggggcggtttatatagagagatagaggaaatatggaaggatcaaaatagaagggcggactcaatacaattcaatcatgttttaaataaactctaacactaagaaccagcaacaatataagaatgtatttgggaggttgaggatccatgtagctagaggaaagacaaaattgtatttcttgcattgcaacacaaccattgaattcaatatactcacaagatttcttctaacaatattttctttatatgtcaatcatgtaattgccatctttgtaatgcctaaaaaccgtggcatgggtaagaaagccacgccacggtttgtataccggtctgtttgtattgaaggaacagaaagcacaacaatatccccgcaaaaaaaaagaagaaagcacaacaatacacattattacaagtgatccacactaaacatagtttttttctagataatggatggttatcattgtgtcaaagacacacaaagaccaacaaacacactattataaatggtccatgctaaatgtagtttttattggtaatgaatgaaccacaaatacatcactaaaaaagatccacacaaagtggagtataaataaataagacaagctgctagtattaatatgataaacaaatgccaaaatttcaatccgtgttttataacccaaagttacactccttcagtttttatgatattttccatgcacattggtgcatccatatggggcgaaagacggagttcatatacccatgtgtagccttagggccaaatccagtggtatgaaagtatggaatccccaccgttgcaaaggaagggcatctctctgtattcatcaagtgtggtcgttaatgtgattgccactctttggacctcttcatgtcaccttcggagtttggattacgggcaatttcatgcctaatataatccattcagatttcagaccgacaccggaactaaatctcccgtcacgctgcatcgcaaaaatatcccaaacctaccctcattagcaacgtacgttaggctgtgctacagtaggatcggtttccttgccttacttgtacgaaccccaatttggtgttttcctgggtgcgaaatcaagtcgtaaacaagccagttgacacaccaaatacgcacgtacgctgaccgcagcaatgcaggtgcaggtgcagccacagagccagcgcttgccgtcgctgatgcgcgagttgcgccattgcggacgccgagcggactgcgcggttgtggcatgcagcgggccgcttggagcgcgtggcgtgcgtgggctgctgcggctgctttgctttgctgggttgggcggcaccggcgcggcctgtatcagcgtgagcctgccgcccgccgcgcagcctgctgctccaaacgaattcagatcatgtgtgcagttatagtaagtagtaacgaatgcaactttaacagttgaagcacattataaccgttggattgatggagctaaaggctcagatttgctgtgccttgctattacacattcacaccttgatgatatagtaatcgctacaggagaaattcactacagtaattcatcttttctaatggtctgagggcccgtttagttccccaaatttttttcccaaaaacatcacatcgaatctttggacatatgcatgaagcattaaatatagataaaaagaaaaactaattgcacaattatgggggaaattgtgagacgaatcttttaagcctaaatagtccgtgattagccataagtgctacagtaacccacatgtgctaatgacggcttaattagtctcaaaagattcgtctcgcggtttccaggcgatttctaaaattagttttttcattcgtgtccgaaaaccccttccgacatccgatcaaacgtccgatgtgacacccaaaaattttcttttccccaactaaacacaccctgagctgttggtttttattcatcagctacattgcaattgctaaagttgaaggcatagtaatgactgcacctgaactcaatccactccaagcggtggtgtgattggttctgaacttctgatccggatgtctcagagagctcacagttttggggtaagaaaatattttaggggctagaattccaatatttttaatgaacattttaaggttccgtttggtagagttacaaactccaactccagtggaaacaagctccaatagaaactgaggtgggtatagaaagtgtttggctagatttgtcagctccacgccaccacatctcttgtcgccatttcatcgaccaccttgttgacgtcactgcctccggcggtcagaccacgcgtcaccgacgccactccactcgcgtgccgccagcagtcagcccgcgcctgccaacgccgctccgctcgcgtgccgccgccagtcagcccgcgcgtcgccacctactgccacgcgcaccgcttcacaaccgcgacatgcgcccgccgtcgactccaccgcaacccttcgtcggtcgtcgcctaggtcgggaggaagatggggaggagagagaacgagaggagaggggtttgaagggggtagttcattggcatttttgtgtaaatacattaaaaaaattaaagggtagtgggtcttttggaggtagagtggagctgtggaggagaaaaaaaaacagctccacccccgtaatacaaatttgtggagcaactctactaactccgctccgaaaaatgaagaatctgtaccgtttggcacaactccagctttaggtaagttggagttgagaactagagctgtgccaaacgggacctaaattctctagaagtcgttggcaccactttgttgtcgctacttcgtttggctagtcactctaaacatgtgctaggtggccgaccgcctccgtagtcatgggctagcacacccctggtcgttgtgtccttttcgatcagcaagaggacaatatcaatcatatcttggtcgtatgcccggaagactggcgctcaaggcaattgggtagtcatacagtctgtcaatgcgtgagaacttgttttactagtggctctcaccaaggttcttcgacgaaggttcaacactattgcaactcttgtagcatggacaatttaaaaggaacggaaaataggatgttcaactttcaacagagatcctgggcggaggtagggaaggctatggctgcggaaggcggggcttttggtgtttggctaatgtgttaatgccgacgttaggagtttagggcgtgtttgcttgctgccctcagattcgcgcctggctcaggcgtcgatctcaggcgtccaatttcggtcgcctgcggtcggatcgacctgcctgagcaatggtctccaggcgagggcagcaaccaaacagccccttagctactaggggtcctggtgatcaccaaccaacttctgtagcgagaataggttttcgcagttttgctcttttcagtttcccctttcccgttccccttctctttttttttgtcttttagttggctcataaataacttttatttctcttaatgcaaagatgtgcttattgaatattccaaaaaaaacatcttgaattttgaatatatttttgctgaatctgtttttttttagctgaatttttttgatcggtgccaagtcctaccgagatactcttgtgtattcaacattttgaaaatttcgatcagaaatgtcctgaactgtgaactactatctggtacgctgtaaactcctagcagcagttgtcctatgcaccatgaccgtcattgactttttctgctaagcaagtggtcttacacctcaggacagtgcatctcagaaacaaaaacgaaaacctatcaattgtggcatagtgcaattgcacctgctcacgcttacactttttcacagtttcacttgacagcaacatgcagaaaatcgaacagcacagaaggccaaaaaacaatcacaacaccaccagagctaagacacagtccagcgcccaagggcacaaaaaaaaaaccaaaaaatagtgggttcgcggcatcaacggcggccgccggcgccgcgcctagtacgtcggcgtgggctcgctttccttggaccacctcgtccgcagcatgaactccagcccgatgacggcgaggaggatgatggcgaggttgaagccgtacccgatcttccacgagttgtccccgccgccgacgtggataccgagcacgatgttgacggcggcgaagaacagcaccagcctgcccgaccagtggtggtaccagttccaatacttccggtacttggagtccgtgttcggccgcaggaagaacgccaaaatctgaaacatttcagaaaatcatcatcatcatcagttcatctgttctgttcatgcagtgaccgtgcttgctttctgcaagaacggagcagagagatgtgatgcgtgcaatgggtgacgacctgaaggatgccgaggacgaggatgaagatgccgaggcccctgtgcgccgggatgtcggcctggatcttgttgtagagggcaactccggcgacgacgccggcgaggccgatgatgaaggcgacgaactggacgccgacgtggaggtagaaccagagagggtccatccgccggaagtagcgcgccaggatggcgccgatcggcatcaggacgccccacgcgaacaggttcagagcaccgtgtgccctcctcagaccgtaggggaacgacccgtccacgaaagctttacctgcagattcatcaactctgctgtaaaaaaaaatgttttcgaaaatgctccctcaagtttcacaactatcggcctcatcttttcgcttatacttatacttaccagccaaaatttaaattttcaacatcaaatttaaaattgattttggggtttttttcattaaagtttatttttcagtctttgtttttaaatcgctaagaaaatatgtataaaagttttattcacaaattatttttcgtttgagcgatacgatggggccgtatatttaggatgcaacacttgattaaatatttatatagttttttaaaagataagtagttaaagtttaaagatgaatatgagtagtatccaataagaggtctagtatttgaagacggagtgtgtaaaagcatcttgttgtgcacataatgccaccaaggaagaatgttgatacggcaacagaaaagtggcgactgacgactgaaacttcaagaatcaaacacctttttcgctaactgacacattgattacagttcaagtgatattgtcagctcattttttatggtatataggatcgactaagatgtcaactgtaatttgttactcctattattcaattttccagttaggtgcaatgtcattcatcaacagatttgctaaccaccgtcagggacttcactctgaacctcacacatagtgcagcgaaaatgtcaagttgtccaaattaaacagagggagagaggagaagatcaagatcaggttgatgagaagcatataatatactccctctgaaaattataagacgttttgacattggtcaaagtcaaactgcttcaagtttgactaagtttatagaaaaaataatattttcaactcaacgtaaatttattatgaaaatatattcaattattgatttaatgaaactaatttagtattataaatattactatatttatgtataaacttagttaaatttaaagtagtttgactttgacacgtcttataacctgaggaatatatacgtaccagtggtgaaatcgaaggtgaaggatgtcttgtcctggtgcttggtgagcttgttgttgacggggatggaggagccgaaggcgaggatgatgtgctggtgggtgagtcggtaggagaactggagctggaacgcgaggtagatcctggcctgctgcaccacgacggtgtggtcgtggttgttggagttggagacgaggaagccgcggttgacgaccaccttgccgctcgtcttgccgcgcagcgcgaactgcttgacgtgcgggaggcccttccgcccgatccacccgaccatggcgctcgagcccaccatgaggccgtcccgggagaaccccatccccacccaccccgtgctgtacatcgtcgacagcaccaccctcagcacgttgttcttgtcttggtgatactgcgcatatatgcattggagtatgtgagagtccgaatttttagaaaatggaagtgatttacattgtcataattgtatgagagtctgaattgagattgttttggaatggtagagtcgaaactaactgtaacacttcaggatttttcttggcaattgtgtggtttggtttgctcgaattcactgttttactgtcactgaaaagttactggcttactgctgcactagcgaatcatacatcaatttcagttgggcagttggcaatgtcctagcaggttaggtacaaactagatccacctgaaatccttgcagatctcagctcattgcaagcacacgcagagtactgaacttagagctagctatgctcgaacagcgctacacaacctcaattatgtgctgagaagaacaggtaagaacaatggcggtgggagaaaccacttacccggagcacgaaattgttccagaccggctggcaattcaggccggagtagttgccgacgagcacgcccggcagctcggtgttgcagctctcctgcgccgccgccgccgccgcgaacgccaccaccagcacggcaaccgccgccgccgacacgcgagccatgctaaccaacctccttccaagacaatggcaatggcgacactagcttagctgtgtgccccgcgcgcggcagcaacgcgagagagagaagctgcccggtttaggaggaggagagagccggttgatgagaggttgcagtcatcagttggtggcgctttggatgagctagtagaggagattttgctggtggcgtgtcgctgcggctggggccccgtggcctctgcgcgcctatgattggtgcagctagcggaggaggtgtgtggttgttggtggtgccggtttgggtgtccctctccttgcgcgcgcgccccgcgccgtctcggtggatggatggatggatcgcctccagatctggaggcgagcgagcgagcgagcgaacggaccgacgctcgcacggtgtggggagcttggagtgcaaaacgggcaaaagcggcccacgaccccacgtattcgtcgcgtacggtttgctacggagcgagatcctctactgttgaaaaaaccgtgccgttctcaataacttgtgagtccaggacctatcatgaagatagtggattttaaaatcaaatagttatagaataatttgagaaaatgtattattaacatgccacttcacaaacatgcaaaataaaatttaacttctacatatcacaaccggaaaaacaaatttaattatgaatacacattagatggttgtagtttaatttgttttttcgttgcgaaatatagaagtcgaatatatatatatatatacacacacataccaaattaagctctggtgaaaattaccatatagtcctagctggaatactagctactttgaataaccatgatgagtagtcatttcaaaccaagaatacacctgcagttcctgccacggtggaatcatggatgagctgctgttcctggaaacccgattagtaaattttgaatcgtacgctgttgcacggccccacgtttatgctccttgctaaaacatcaagcattgtgggacaatggataggaagttaaacatcaaatatactgggacggaggtagtatttgtgtagtgatatatcacatattaatatatctactcatttttttaaaaaaaaattataaccatttgaatgatatgtaaataataagtgaacatccttttaagagtttaaaatagttttccctatcaagaataaagtcatgtgattttgaagcaagaggttctgatccgtttgctactgctgcgccgtgaacacgtgacatggattgtagcatattcgtaagagagtttctatgtgggagggaggtgtggtgaatctgtgtacgtgctgtgagattcgggttgcttctgttaggagatgcagaattccaggatttgcagagccgtaaccgttaacaggacaagccggacggtcctttcagggaaaaggaaatctgaaggaccgacatgtcagtagatggtgtcaaaattaggcagtccagatggggccattttattgtgacaagaatattgaatgctgaaaattgtggtacaactaagtttttactgattggagggtgcactgtgattctttgtgcttactaccaatctcaaaaagtgagagaaaaaacagtctagctgcttctatgattttgttgaagctgcctgccggataagcctgagggactcagcgaaatcatccagcagctggtgagcatccgggaactgtgcatcatcgacggcgaggacaagcttgataatgttcatgtagctctggtaatgtactgtcagtgcctgcacatattcaaatgaaatgattgggtgctttcaggtgtgcctatgtaaaagtcgaagcactcatgagtcatgtctctttgacaaaaaaggcttgcaatcacaactggagaattatcattggaaatgtttcactttatgcctgaaacttaatcgctacatgtcatcaccaaattaattaaaaacggtgacttctgaacaattatctatgtttcaagcaaagcaggtgataatatatcaatgacgtgtgaaagctgacgtgcaacctttacaaatgaacttattttctcattaaaaaaaaaacaagtggttacttacatgtggatgcccatatacacttggggcaatgtactcgataggatgcccgtagaactccaccttctctgcaggtccgaccatgctcgagaatgacagagtggtattagcgagcatgccatggcagagagcagctgcagtctacagaagttgccatgtacattacaccaatgaataaacagattaattaactaaagacaagtggcctcagttagcatctccggttaatgatcgacaaaattcagataatagaactgctctactaattatcccagcaaaacataacgtagagaatcaataccttaatgccaaaaagtttgactattaggttgccgctccaataagtgaagattgcttccaacgagctcttcttcctgtcaactgttcttttcccctgacgaatatattcaagaggatcgtggaacatggctatacggaaaggaagtacgatgtaaccaattagatttccccatctcgcaacattgttcttgttggaattcatcatttctgccaatacctgctcaaagcagaaacaaaatatccaaaagttcagtaactatcatgacttgactgctaaaaggaactgaaatacccattcatgaaaattataataagagtggacagatcataatgaatccttttcttacatgtaagccaggtgttttcctgatgttaacaagaagagcagaccgcacacggatgtgctttcgtcgcgtacgcttctcgctgttcgtatcatctgaataagttcagaaaacatgacttcagatgcagctagcagtatatatactacgtacgattagcccatgataactttggaggaagatcactcactttctttgcggaagtaatagcgcgacaatgctgcagaagtcactccaactaacacatcattcacagtctgaaaaaacaccaggaggaatgacatttcgtatgatgtttcagagttaagctgacatatgcagttcagcaagaactaagaacccaagaatagggagaagatggtcttacacacttcatggcattcttgacgagcttgacgtcgtcgaggctgagcgtgcagtggacgaaccgcttgcgccggaactcgacgccctccgtccccatgagcggcgtgcgcgcgtcgcggaggaacagcgacgtcgcgacaaacaagcgacgtcgacgagcgtgtgcaaggcgagcacgaggtaggaccaggccca

SEQ ID NO: 42505 - DNA, 8058 bp, Oryza sativa
tggtgcatcctgacggcgacggtggcggccgctcggaggtcgggaagtcgaggacgtggagctcccagagcgggcgggagtggtccatcggctgcgtggacagcgtggacatgtagtcctcgatgacctggtcggggctggctgacgtggcggtggggtccagctcggggaagatgaggtggtcgtccaggttcactgtcgtccggacccaccgtggcttcgcccgcttgctcgcctcatccgacacctgcagaaatgcacttcttaaagtgttttttttttaactgtacgctgaatgcgacaggttcagaaaaaagacgatggatacaatggatcaagcattaccgacagtgttacactatgaaagctaatttaaaaatggcaaagcgtttgccttttttttaaaaaagagagaaaacactacgaacacgtactatgcaactaggcatagcaacgctgttccaaaggatttattcgaaagcaattgatcacgtagtagtggggtttacaaaatcgtatcattatcatgattattacatatggtaatccttatagtttttttcaaaacatggtatatttcgtggtaattgtacggttttcgcggtagctatatgattacaatgataaccattaaattacggggtgacggtaatcccacctaacatggttcggtgaaacctaactacttaccactggcagttaacgatttgcaatacgatctggaggcctctagccaacacactacagatgtttgtttcacctggctcgcaatccatacacggggttaacgaagaaaagcgagccgtccccgtgcgtacagtgacggactgacggtacttaattctgacgttgatttgcttcaaatcccgcacgtcgcggaattatgatccacatgtccggtatctgctttcagctggaaaacgtggacgatccatcgcgatgaaagccagcttctcggatgattctctccacattttcatgccaaacggctgctcccggtcataaacacagtagctgatgagtagcgatagtctaggacggctgctctgtatctgccaccgcattaataggagggcatgggtgcagtatcaaaccagctacttcgcgatccaaaccataaatcaggcaataacagcccggttaactaacacaaaagagatttgacggggagtaaaggtgatggtgattcacactgattcgtggcttcgcgcactatctctcgccgggattaatgctcgctgagccaatggattggtcggttcaagcatcagatgacttcgagaaagctagcaagagcattgtacacacagcacagccacttcctacttttgtcccagcttgtttttggccggagtcacggccgccgtgcgtatcctcggaagcagccattctagcccagacaaccgcaagaaagtgagccggcgaggcgccaggagcgtccatccaccggaaaaatgaagcagaaatcaatgcttccacgcggccccagaatttttttttcaagtaggaacaacgtgcgcgtgtcagcgtcgacaccggcggtctcaactccatgtgcgcccgagatgcgggatgcttcagcaaatttaattttgccaccaaacgagcgcatttttttgggtgcaagttggcgatcgaggacgagatgagaaatcgatgcaaagggatcatggagcggtgggtttagttacctggacgctgcagaagcgggggtggcggacgagggtggcctccagcccggcgcgcgccgccgcgacgtccacccgggcgccgagcccgatcaccgccacgatgtagcagttgaagttggtctcccggaacagccgccccgccgggctcatcggcaccggcaccgcggcctccacgtccctctccctctccgcctccgacgccgccgccgatgccatcacgctctcctcctcctcctcctcctgccgcgccttgctctccctctccctgccgggcgagccacgcgagtcacgcgacgacgtgtctatcgagagcacccgcttccgcagcgaggagggggagggggtaggggtaggggaggtggtggtggtggagtgggtggaagtactcgagctggcaggatcggccgtcgagcgaggatccatcggcgcttgtacgggcggtggcaagtgtggaatgtggacgcggtcgggggcggcttgacggtggggacagcgacggcggcgtttgggggcttgccttgcggactccggcgtccggccgggggaggaccgggaccgggggttgcgtgcgggttcgcgatttgctgcgtcgtcgctttgctattctatataggcgacgcgaagcgacgtggcgcgaactacccgaccgtgcctgcctgcctttggggttcggactctggacagtggaggttagttggctgggctcggcgtttcgggtagtcgtcgttcttgattggttggttgggctcggcgtttcggctagtcgccgtcctaattggtcacggaacccggaggagttacgactcacggagtcacatgtagggactacggagtactacctccgtccaaaaataattacaaccataaatatccgtgtttagcgttttgaccatccgtcttatttaaaaaatttataaaaaatattaaaaaaattagtcacacataaaatagtattcatgttttatcatctaataacaataaaaatactaatcataatctttttttcaaataagacgaacggtcaaacgttgaacataaataatactaaaattacatttattttaggacggagggattagtagtactgctccacgactccactgtactacagcctacagggctgtgttcgggagggggcctcccggcaaaacaaagcacctagaagtattattgtatgatttattaagtatttactaatttttttaaaaaaatggattaatatgatattttaagcaactttcgtatattttttttgtgcaaaaaacgtaccgtttagcagtttaaaaaaacatgtgcgtgaaaaataagggagtgaggttgggaaagggaggtaacgaacggagcctaatggtaggtataatagcagactattagttagctataaatatattttaataagataaaatatgagagagaagagcagcgggctacaatctgtagccagctgcagcacggacttcaagacgcaatgtgtgtatgacaggtaggaccatatattaatagtatagtaagcaactattatatgaattggctttagattaattgaagctagtagtgggctgtactattaaacttgttctaaattaagagcagatacaataacaatctataagctagctataaacatatctaaagtagataaaagaggagagagaatagcagcgggttacagatttgtagccagctatagcacggactcccagacaagtgtgtatgacaggtgggaccggatattaatagtgtagtatgtaactattgtatgaattgactatagatgacttagagctagtagttggctataatattaaacttgctctaagagctaggctaataatacggccgacttattggctttaaggttttgtagcattctcacagtctacctatataatagttagctctttacaattaatactgggtccacttatctctcacaaagttttttggttcttgtgttcaagccggctgtaagtttatagcccgcttctcccctctctcctctcttttctcctttacctcactatttagtcggcttgcatcctcctattatacttgctctaaatggggtgaatgtgtgaccgattaactgtcaaagaaggcattatttgacttggcaaaaagaaaattctatttgatatctctatataaaaaaagcaggttttgatttgatttgattcgattcgattcgacatggttgtgtttgtttcttttttctccccgtccagtcatcgtcttcgttgattgagagagcgattcttgacgagaaaatgggctttcaaacttccagacccttgggcctaaatacgtactagtagttgttaaacgaggcccagtcgtgtacatcgggcctaatgctgacccaaaactgttctcttttcccggaaagaataagttcaccagaggtccctcaacttaacagcgagatttgttgagatccctaaactacaaaaccataaacgtatacccctaaactcacacaaaacattcaaaggatgtcccatggcagtatatgtgggtagtttcgctgacatgacatcctagtcagcaaattttttataaaaaagtacgtggggcccacatgtcaattacacatcgtcctcttctcctctttattttcttctcctcctcttctctttcccttcttcttcactgagtgagcgcgatgggcgggcggtgggcgagaaagacaacgggtctgcgcggcagctgagcggcggacgacggcgacaagtgagcgcggtcggcggacaaagcggcgatgggcgggcggcgggcagagcggatggcgccccatgccccatggcgtggtggcggagatatcggccgatccggagtccaggagcacagaaagcgtgtaggactcatcgacgacggggccgagcgggacgttggggtcggagacggagagcgcgaggatgaggacagggacgcgagagagggtgtacttggcgaggggaactagcggcgagaacgacgtgctcgttcgctctgtccgctccgcgcgccgctctcgccgcctccgccgacacggctggcagagtagggcggcggagctcgcccaccgccgccacgctccttcttcagccacctccgctgttacggcccccctccgcctgccgtgctcgtccacttgcccgccaccatgctcccccgccgtccgttgcgcttgccttccgctctctcaccaccgcccatcgccgctctgcccgcatcccagcgccgctccgcccgtcgctgttccgcccgcctccattctgcccacaggccgcgcccgccgccgcttcgctggtgcgtggacccgccgcccgcccatcgcccatcgtactcacttagtgaagaagaagagaaagagaagatgaggagaagaaaagaaagagaagagaagaggacgatgtgtaactgacatgtgggccctacatactttttatttttttttttgctgactaggatgccacgtcagcgaaaccatccacatatactgccatgagacctcttttgaacggtttgtgtgagtttagggtacacatttatggttttgttgtttagggaccttgaaaaatctcgctgttaagttgatggatctccgctgaacttattcctttcccggaacggaagacggcctgtcccttagttgggctaagtctggggcagtgctcatgggccgctgaactgatccaaccaggccgaatttgcctgtactctgctgtacagcactctacaagtgaaaccgcgacgacgtagagcgactgccgcctactggcacagaggatcagaggagcgtagcaacgtgcaatcccgctccaaggtggataaatgcttcggccaaatctcaccattttgcaccgtgcatctcacgtggcacgtgaccggagtaacgaagcggagcactggtacaactacgctgtagctgtagcaccaaacggctagaacgaacgaggccgggtttcaaatttgaaacgcgaggtgcgccgcgcgggccccacagagcgtcgacggcgaggtgaccgcccacccgcggccccggtagtcagtccggcagacggacggtccagatcgcccggtgggtcctcctctcgcccttggggaactacaggcgctccagtggctccactagccacaatggatgctagggcaagttttataatagatgtggtggtcacctccaattttatccacatcatctatccaaaaattaaaattaacttatgtagatgcattgtatttaatacactagtcccaatacacttgccaccaatcagccatcttattttctcttctttattgaaatttgtgtgaaggttgtcccttagagcaggttcaataggcttatgtcagccgacgataggaataaacaatttagtttttggctaaggtggagcagagagaacggaaggagagagaaaagctggcgcttaattagtcgcgagctccagcacatagttccatgcatgcatggctgccctgccaatcgcaagagctgatcagattagaagattataaaataatcttttagaggaatgtgctaatgtagctacttgttttacaagctaatctctttccattattttttgttgacatggaacttttggagccggtagccagctatactattaaacttgctcttagagcaaggtcaatagtatagcaactactggctctaaaacatctatagctaatctaatagctcattcatacaatagttaactataaaaatatactacatcattaatacacggtcccacctctcatacacatataacattttggagtccgtgttgcagccggctacaaatctgtagcccgctttcttctctctcttctcttttcttctcgatatatggttacagccggtttataacctgctattgtacctgctcttacatgaggggtggctcctcccctttctcttcttttctctcctccacatcattatttaagcatacatgtcactttggagtttgtgcttagaaccttatagtacttgcccttatcgcaagtgtaggatgggcccttctgcaccggagcggtcttttaacacatactccctacgtcccgaaaaaaggcaaaccgtgagttcccgtgccaacgtttgactgtccgtcttatatgaaatttttttataattaatattttcattattgttagatgataaaacatgattaatattttatgcgtgacttatctttttaattttttccatatttttttcaaataagacggatggtcaaatattgggcacggaaaccagggtttgtctttttttgggacggagggagtaattaattaagtattagctattttttttaaaaaaaggattaatttgattttttaagtaactttcgtatagaaaatttttgtaaaaaacacaccgtttagtagtttaaaaaacgtgcgcgaggaaaacgaggaagatgagttggtaatatggggttgcaaaacagccaaatgtccttttgccccccaaaacacgagcgaaatatttgtgccgccgtgagaggagagcccaccgactacggtagctagctcgtcgttcgccggatggtctggacgtctggtccctgcccgttagttctggtgctatgctgcgctttgccatcctgtgcagctaccaattcgaaatcaaacccatggtgaaacctgtgattacgcagttaccccctttggtttttggttattacgagaagcatgatcgtttcgtttgcagcgatcaacagataaaatctttatatatctgtttttaacatgattttttaaaattactggacaataaattataataaaaacctaaaattaatttcaaaattaagtttttgaatttatttttttacaacggcttataagttattataaaaagcaagcaatggagtgtaagatataaagacatgattatcattaaaaattgttgaccggttctatagcggtatcatggataatcacttatcgcttgataaccgatggtatttggataaattttactaaaaactgatgcaggtagcgcgcatgtatttcaagttcaaattttaggacattacactacaccaagcaagggcccgggtgtaagaagtgtaagatacaaaaaggatcattcgaaattaccaaactggccctccatcttccacacgctcaaactggcccgtttcttctggatttttcacattttggtccttttaaaaaacttatttcgcaagtagatccctagaaaaacttatcccaaaaatggtcctttttggggcgccagagtggctggcgccgtcatccaacggaacggcgccagcctctctggcgccgtcctcctgccaccgtggcgcacgcgaaccgacgtggcaggatgagggcgccaggctggtgccgccccagggaggagggc

SEQ ID NO: 42506 - DNA, 29461 bp, Oryza sativa
  unsure (1)..(29461): unsure at all n locations
atgtaaaaaatccagcccgtttctcccccaggacgcctttttccaaagtccaaatcaccaaaccgtcgcggcgcaccaccatacacagcccgaggccgcgcagctctcgaccccgacgcggttcggcagtcggcatcgccaaccctcatctccccccctcctttccaccgacctcgatctcgcccctccccccacgcgcgcgatctcgcccagatctcgntgagccgccgccgccgccgcagcagcagcggccatggagaacctgatctcgctcgtcaacaagctgcagcgggcctgcaccgccctcggcgaccacggcgaggagagcgccctccccaccctctgggactcgctgccggccatcgccgtcgtcggaggccaggttcccgtcgtttcccccctacccgtttttatctcgctcggatctggcccctcgcgcctcagctgcgtcgatctggatctcgcgagttgctggtagggcagaaaggattagtagccgatgcggtctagctacgattggatctacgattgctgtgctcgccgaagactagatttggacgcttacatgaaatcgataggttttgtagcaactgaagctactaaactagttgatggaaccatccagctcgatggaattttgtgcggagttgcgcctgttagaaatggtttaagcttatttctgtaccagaatgggtgtacttcggtaacctgacgtttgaactttcctgatacgtttgatagagttcgggtaaatcctcggtgctggagagcgttgttgggaaggatttcctaccaagaggctcaggtatggcggttccaatagcaagtgcttgtataattcagtgttattgctcctgttttatctgatttggaatttttggatttggtttccaggcattgtcacccgtcgtcccttggtgctgcagcttcataggatcgacggagacagagaatatgcagagttcatgcaccttcccaggaagagattcactgatttcggtactccatctaccttttccttcatttttggtcatatcattctgtgattaaaattgcgagattgcatgtttatggagatcatatattcaaactgaactagattgccaatgttggatgatagtcaaacatatatgattacacctgtaattgttggtggaaacagtctttcaagtgctaaacatatattcaactgcatgatggttaatgatgatagtcgtattcttgcagctcttgtgaggaaggagatagctgatgaaactgacagagaaactggtcgttcaaagcaaatatcatcggtccctattcatttaagcatatattctccaaatggtaagataacaataatataaaatgtcagttcgatgtagttgctttatcacagtcaaattggttcattttgattattgtttgctgagatggatatgtggcttaaaagctgttccttttgtctgttgcttacttagtgagatctctgtcattgataagatgaccataccttatttgtctttatatgtgcatgcctgtttatgatttatctggtttctagtatctatttttgttagcgtcttaactcccactcttttgcagttgtgaacctgactcttatcgatcttcctgggcttactaaagttgctgttggtcagtattacccattgtcatttgtgagctattttcttttgtttgttctttttaaagaggtccatttcctgatttaccacttgctatatgctttccagagggtcagcctgacagtattgttcaggacattgaaaacatggttcgctcgttcatagaaaaggtatattttttgctgtaaccttttaatatttgtccactgccattgctgactatgcttgccttatttcggtaccatagctttgtatgcacatatacagtaatttattctatgcatatttgtttcgacattcttatgatttcagccatgtgttagcatatttggaatatgttttttgtatcatgcattatgcttgtagtgtgtgagctatgcttatcttgtcatgtatcatgtctgtaatgttgcaaaagcttatatgtatatcgaccctttttggtttgtttcagcccaattgtatcattctggctgtttctccagccaatcaggatcttgcaacttctgatgcaattaagatttcacgggaagttgaccccaaaggtatgcctttgttgtaagccatttggataaaggatggcaatcatgttttttgagatgtggtttgtcttgtaatgttcaggtgaaaggacgtttggtgtgcttacaaaaattgatctaatggacaagggcaccgatgctgttgatgtaagttttttcccagctaaaattaattgctaaaaactttattatcgatacattttgtccccggagatgtcaacatggattattgttcccttgcttttgggaccttttaaatctcctatgttgaatattcttctgttctatctgttggaagatatacagttgtagaaaatgaaggttatgtttgttctttgagctgtattttcttacggttcttttctgcagatattggaaggcagatcataccggctccaacaacaatggattggtgtcgtcaatcgatctcagcaggatatcaacaagaatgtggacatgattgctgctaggcgcagagagcgtgaatatttttcaactacgccagaatacaagcaccttgctcataggatgggatcagaacatttagcaaagagtctctcgaaggtatgcctttcatttcgtttctaatgtagaatacctgtaactctgtttggtatattgactcttaaatgttttggtgtatatgtagcatttggagactgttattaagtcaagaatcccagggctccaatctctcattacaaagacaattgccgaactggagacagaacttaatcgacttgggaagcccattgctacagatgctggagtaagattagggcttttttattctttaattagatactggtttattgagcctaattctgcatcccctttttatgctaattgctaatgtagtgcccattttttttgtgtatgttcttgatcattgtgctaatggacataattggtttgtacatatttggccatgcagggaaagctgtacacgatcatggaaatatgccgcatgtttgatggtatctacaaagaacatctggatggagtgtatgtttcaaacttaatgtttctgttgctaaatgttctcttagaagttttattgtagctacgtgtgtgcttcctgaattccgagataaaataacattttatcctaaaataacattttcccctctctgatctgtataagccttctaaaatttgtgtggccctaatttgataagctctcctttggtgttagtcttgtgtgtttactccaacgtaagcatacagcctattttaggttcttggcaaagtaacctgttaatttgtcttgtatttttaaacaataaatttctatcaaatgtaataaagatttcaataagcttgcttgggcgtacatgcacctagaatctccagttgtttttctttcagaagaaagggatcgtcgaatttaaccctaaaacctaattacatgatagcacttacaaagttattgctaataaagatttgcatattttcttgctgctgaagtatgcaatttaacacaatttaacttgtagattgttatatgcaattagcatcattctcccttgtgtgcttgttcttttgtgaattgaatgttgctttccctgatgcttacccacaaaaattctaatgtccaggcgtcctggtggtgagaaaatctatcatgtctttgacaatcagtttcctgtagccattaaacggttgcagtttgacaaacaactggcaatggaaaatgtgaaaaagctcataacggaggctgatggataccaacctcatttaatagctccagagcaaggatatcgacggctcatagagtcttgtcttgttagtatcagaggtcctgctgaggcagctgtggatgcggtatgctatctattaatttgatctattttttagtcttaacaaaatagcttgagcgtttctaacttttcgtgtcatatattgttgaagaatgtgcactacaacattatcgtatgtttgttgtactgacaggtccatgcgatactcaaggaattagtgcacaaggccatcaatgaaacacatgtaagtcttcgcactgttgcacaatgttttctgtaacttatactggggaatatgtgcattctgatggtacatgaggtatactgattgtactaggagtttaggaggtaatcaattaatactgttgaaatttttgccttctgttgtttcaatattttgtctttctaataaaatctgaacctggaacttttttgctcgacttaagatgagaagcagcatgataattaatttgcatgcttgtcaaattgtcattactccacttgtaattgtgtaagcgtcctaaaagatgtgagtgagttctctgcaggagctgaagcagttccccactcttcgtgtggaagtaggcaatgcggcttttgagtcattggacagaatgagggatgaaagcaagaaaaacacattaaagcttgttgatatggaatgcagctacttaaccgtagatttcttcaggaaacttccccaggatgttgagaagggtggaaatccaagccactctatttttgatagatataatgattcttatcttagacgaattggtaagtcatcaaccattcttccttgtatatattcaatgtatactgttactgctttgcaatgatggccatttgttgaagttgagaagtggtttatcatattgttgcaaccttgtgtaatattgcccactaatttagtttaatgatgaatatacatgccatcaaggctttgcttggctgccttttaacttattttacctgtattttctgctgaaccttgctacaattcatactcaacaggaacaacggttctggcatatattaacatggtatgttcaaccttgaggaactctattccgaaatctattgtctactgtcaagtgcgggaggcaaagcgctcactgctcgatcacttctttactgaattgggagcaagagaggtgagttcttctttcttaaagcttaataaagcataacataagtttttgggccctgttttacattttttttggtgtgccttttaaagtccaacagaattgatctaactagtaatactgccttttaaatgttatgcagattaaacaactttctaagcttcttgatgaagaccccgccgtcatggaacggaggactaatcttgcgaagaggctggagctatatcggagtgctcaagcagaaattgatgcggttgcatggtccaaatagtcctgatcatctacttatcatactcatgtttctcctttactcccagttggtgatcctcccctatcttggggcatatatagctgattttaccccgttctaggtcattcatagatcaacgcagctgtgaggtgtcatttggtttgtgcttttgttccttgtgcttgaggatctaggagacaccaggctgctgtactttttgtattacgaccaagttcatatatcgtgtttaattttgtcacagcccattctttcgttccgtttacatatatcgtcttcaatttgttactagtccattctttcgctccctttattttcagcttgtttaatttgtattatttgtatgtgtctttagtccatgtagatgtttatccgagttttcagagttctaacatagcatggaggattaaatataaatgaaaaaaataactaattgtatacattgtgtaaattgcgagacgaatcttttaagcctaattgctccatgatttgataacgtggtgctaatgacattgtgtgtaaatttgtctcgcagtgtgcaaatgaaatatgtaatttgttttgttattagtctatgtttaatacattaaatgtgtgtccgtatatccgatgtgacacacccaaacttatccgatgtgacaccaaaactttacactcatagatctaagcacccccatactacagaggaaactcaatcaagtatggtgaagatgagtgtagtggaaactgaaccaagaaaaggtgacgctgccaccggtgttgttgcttttatcgtaaggaaaaaacaattacagtagacacattttttctatgattggttgctcgaatctccagttcaaaacacacgcagagaacctaacagttaagtttgtccaggttgcactgacgatttcactgctagtacgaaacggacaaacaacaattgaaaattgcatgcgtattgtagtgtttcatgtctttccctggtaatacttgttcaccaatctttctgaatactccccgaatgtaagagttccattcggtgggatcaactgccagaagttaaaacatagattactatatcagaaaaaggcacgcaggagcactgaatgcaagtttctgattaggaacaaacctcttgatgatacggaatttcacttggaaacttgagcttttcatccctacaaaatatttcacaataaaaagaaaatgtcagcaaacccacattaatcagacctaggctttgaaaatctacgtgccgaattcgtaacggcaagcatattactattgattattgagtattgaccgtataaatgaacaaacccacataacacataatgatgagggaaaaccagtactcttcatgtgggctaacattatgtgttgaaattggttgggagctttggcaagtggcaagtcactagtaggatgaggggcaggaaactcaaaagttctccatgtgagagaatatgtgaacactacaatttggtcaagaaaactgcacataccaatctggttgcatgaacatcgcgaaggtcgaacgatcaacattcgaggcgttttcactgctgggggcctagagacaacagtaaaagtataaattactttacaactgcaggaactaggaacactgattacccatgactacaaatttatagtacaataccttcacacagtgtggagttgcacatagacgacctcttgatagtatttcagtggtttctccaacttggtaagccaattcattctcctcaaatgtaaccttatgcagtaaaatttcaattagtgcagaccacataaccctctcctgtataatatgctaatgcaattcacaggcaattattcaactaacaatgattaaacattgtttcaaatgcctggctacatttccaaatctgcaagcaccgatcaatttcaatgtagagatgactgcgtacaacctaaattacaaagcatcatcttgatgataagtctatagtgataacaggaaattaccttaacaactttatcatcacgagtccttatatacaatccagcagcactatcaggacaggggatctccattgaatttttcgtaaacaaggcacatgtaagtcctgcatgtaggatgcataatcagaattgaaaaaaatatataaattaaaacaaacgttttttaaacgctaaagcctcatagatgatagtagtaggaaacaaaacggagatcagatttatggttatcaatatatgtataatacagtaaggttatgggttcagaatttcaccacatgctcatttgaccacaacaaactttcatgttcaggagttatcgtgcaactgataatattcaaccatagggataacatgtattacctgttaaagatccatggtcagtatgccatccacaccacgatgaaacagaaccaccttcctcttgtttactgaaataagagacatgcaagcatcaatccttacaactaaaaggctagaacattgaaaaatcttgaatccaaaaaaaatatattgattgttacaaaggtaagaaaagttagaaagctttgatctacatggacaacacatgtaaaatgccttataatatgcgcgatgatatcgcgtgtcaatggtgtgtaatacttgataggcaccatcttgctgtttagtggaatcgcgtgacattgatcttgtttatccattcctaagtcttattaactccaaaatacaagaaggtcataaaggaatcactgcctagagatgcaattcatgcatgttttttcttgtcagaaatactgtgtatacatcatatttacctaaattgccgggggtagtaatacagaaggcggcccttgtgacaccttgagctggcaattgtctgctcaaggctttcaccatcatatggtcccactccttgctgcattactgacaaacaaacagaagttggtccaattcaccaatggaataccaaacttaaagaccaaagtacagagttgacaattataatcaatccaaaggttaaattgtggagattttttacttagccaaacagatgtggtttgtccctggacatttttaaaggaaatatcaggtaagcctatagaattatatagtacataccatagcgatcacaatgatgagccaacatcaagccaacttccaacatcagctttccaagagctttaaatgctacaaatgaaagaaatgttgtaaaaatggttggattctagcatggaaatacataataagttctacaaaaatcaaaaccacttaaaaatatatttcagcatgtaatgatcatgaggcactgaaaatgaacattaaccattcagtatcttacatttagcaccttgagatacaagacagccagtaaggtaaatggagtacaacctttggtacatttattcaatacagatatcctgacttataacatataaacatgtgctatgggcctatggcaagtcctccattttaatggctaaaataagtaggaatgggttattaaaatagtgataaaaggtaacaaatatgtactgttatactgagaaatagccctcaagtcagtcaatatacatacatatggtcagtcagtcatacctatttcgagctcaggaagatgactggctggccatatatttgttcggcaataagatgggtacctgctggttcaatattacattaaaaacacctataataagggtcatatttggtctttatgagtatatgatacaactcttttgcactagcaatacaataggtcattttgagtgatacaaatgatcgaccatagtaagataattaaactttaattaactcaaatcatactaaattcgttggagttagaataataaaggttgccaaattgttcagttttctccagtgctaaattgtaacagtaaactgagttaaattatttatgtatgaaaaaacgaaccttctcacaagtacatcatcagtggttggagcatccaaaattgggttggcataaaaggagcctttgaatgtgtctgtgatacagatcttttcaataaagtgcaatatctcacatatggtaagatgtataattagataaaagtgcaaaagtgcttaccgagtttccctgactcaagtttctctttcccatgactccatccaaagttaaacctaagaggcaaaggagcaaactcatcattgctgtgtactcactctagactgtcaaaatggatagaagttgaagtacaattcaggtgttgatcctaactaggagctcccaattggaggacataataggctacatcaaattcgtgattaagaacataagtacagaaccaaatggcaccaccatgcagttctgttttcacctgctgtctgggtcttcaagttctttcttcacatcttcagaaggtttgcaaatctaaaaaaaaatggaagcaagcaacaagagatttcactacaaatatcaagcaaatgttgaaactgaaatgtgcctcctatgaacaacacaaagatgagactaagagaagaacatactttggtgccaggcgcagcaacgttttccttagcacgggaaaaccaggcacctgcaaaaagacggctacaaaattcagttcaggaactcgaaattttctctgcaggccaggaacgcagcgcgcatcagttttcaacgcgtcacactcacgtcagcaatggagatgatcccgagcccgttgggcccgagcccttcctcgatcttcccgctcaggtccctatccctctcctgcatcagcagcagagaaaacggcgtcgcaactctgatggaatcaagaaccatacgacgctatgcagcgggttcctctcttaccttgaggtcggagaaggggatggagaccgtgcgcacggacggcggcggcggcgaagtctgcatggcggcgaggcagcggcaccgcaccggacgacgggacgagagccgcccgagcgcgagagcgagtggtcgtcgtcttcctcctcctcgggtggttggtgcccagcctggctgcgtctgcttccgcacgagacgaccaatctccatctcccccgtcacttatctcggcgtcggattcgtctgggactcgaatgccgggaggagtgtaacaactacttttttttgagaccgagacgtcagtgtgtgtagcgtcgcagtcgcagcctcgcaggtgagaggattcacgcatccgcgccggcgattccgcggtggcgcggcgctaggcacggctgctccggcatttcggaagagttgaaaagccggttgatctcgcgcggtttcctgtagatttgatctcgtcgcgatgcagcggtgccgaaaaatttgatgtgggatagtgttttcaattagcaaatttaaattctaatatactagtactgtgaacacgactcttcttgtttgaagtatactacatttaaattcaaatatacttgcttcttattttaagtatactaactagtaggattgactgggaggtcgcaaagaatattggcacactacaccacacgcagttcacttgacgcacgacacagaagtccagtacaaagtcatccaatcgaatgagatccctgtagttcccattttacacgcaaggtatcacgaatcagataatggaagccaactactacctccaccacaaaatgttgctacgtagtaaaaaacaacactttagcagtcgcaagatcactatcctaaaatactgcaagccaacagttttgaacttttgatacgatgatttggttcacaatagcgatgttatgtttgtatagatcaaagggcatctggttcatggaaagctatagaaggttgcatttgacagtcaccatgacaatcagacagaaattacagataaagagttaacaccgcatggaaatatcatttcaacgcaaatgagtgattggcatgcgttgtacaagatgcaaccagatagtctgtgcagtaaaacaaaagctaaactcctcaaaatcgcttaaatttctctggccggtaaaccaagtgactagctgatataaaacctccacgatgccaactaccagttttgcagaataggcaagaaacctgtttcagttaaaagtgaaattactgttagttttcaaacttttgacttgttatgcaaaagggagataagcacaaaaaaaaaaacacaatgatagcaaaatatattataccaaacggactgcattatgctctgaagacattatcaactatcaacacaaagtcacaaaattatgaagaaatcccacacggtaggtttctatcataccacaataccgagagatggttgtgttccaagttgtgttccactagtcaaccaggacaccactggatcagataatgcagatagccgccaataaatagtcattaacgttttcaacttccaatgctaagactcaccaatttctacatttatgcataataagggatttgatccatcatcaggtaaaaaatccagagcaaaccgatctcagggatctcaggcaattcctcctgccaccccaattcctttttagtcaggatggggctatcatcctaaactggattgggacccctaaacaaggacaaagtatgaaggacacctagatcaattaaacggcaaagcatatagtgtaacacattagtttacaaccctcgagatcactatgtcactcgggctcgcatgaatactagttaacagtaggaaactgacatattagattaacagatattgaggtcattggaggcaaggctgtgaggaacaggttgatgagagacccatcaaccaaagcatagcctcgtactatgagaccgctgaattttatctagggccccaacttccgagcaccccgcagagaacctgcaggtatttcgaagctagcaaaagagcttcccccattggcatggagcccttagacacaaacataatgatcactcacaccaaaacctaacaatgcaccattccatctaatcaggcaacaactgtcacaaatacagaatccagggaacaattgcacaagattctgaccaaccccacgagctcgatgattcaatgaacaataaacataaccagaagcaatagtcaataatacatcaccacattgtaaaagcttgaaacaattggaactaagtacagcactctaccttagatgctgctagggtacatgaagacgcggaccttcttgccctgcaccaccaaaacaatccagcataaaacatcagaaatggacaacgaaactacatacgactggaccaaaacaggaagggatcaatggatagcgcggacgacggagagagcgagatttaccatggaggtgggcgggaggttggaccggaacttggcgcggacgacgccggagttgccgtgcgggcgggtgaccttgccccagatgcagcggatggtggagtcgttgctcttcgtcttggccttgtagacgtaggcgatgcgctttccggcgtaccacccaacctcctcttggtgttcaccccctcgatctgcagcagcgacgtgttctcgtactggttcgacttcgacctacgcgtgaaaatcaacgccaaaccaagatcaacaccactccaccgcggcgatgacggagaaggcagataccccgccacgcaggggggggggggtgagagcgagcggtcacctcttgtagccgaggatggtgccgcggacgtacagcctcacgcgctggccttgccgtcccttcatcgtcgccggcggccgccgaggagggtggagatggcgatggcggcggcggcgggaaccgaggaggaggggaagtgacggcgcaggggaatgagatgagatgagccctagggcatgtggggttttaaaagtttcttgtggtagattggacggccgagattgcgtctagatggacggcggatgtgcatcgagatccccgtcggagaaggcccaagatgaaaggcccatctaatatatgggcctacaaacaaagtggacctatagtcctttttttgcgagggaaaatgggcctgttaacatagagcctcatctttttcttatgtttatcagccaaattttaaatttagagttaattttagggttttgtcattaaggtttattttccatcctttgcttttaaatcactaagaacacatatataaaagtttcacagattattttttgtttgcaaatatgtcgttcatgattgggctgaataatctctttataaccatctcagtttttttcgacggcttcaattatgtgatataaaatttcatctgcagaatattaaaaaaacatgacataatttttctgaaaacaaaaaaaatcaatatatgctttacactattgaataatattgaattattatgcatgaaaaaataattttaaagtagtatttgaagactgagagagtatatacgtgatattgtagtatggaattacgcactgcgtacgtgttgacgcttctgttcattgtctggatggtggtgtgttgatgtcgagctcgcatgtgtgttgacgagactttgcaagtgtaggtctcggcagattgagatgtttggttttcttatgctttgatggcgtagctgtgacataaataatcagactctgggtgtaaaaaataacagataaaaaaataaaatgatgtggactaatacctataatacctattgctgacttggacaaagattagcttcgattcagactttcagaggcaaatcatttgctcgcaaatttctctacttctgtacgtatttttattgcagtcatgacaacgaccacagggggataaaagaaaacagattaacgttcttgttcagacaaagttactgtgtgaacagaataaaaatatacactagtaaattatcactcgattaagtttctcatacagctagcgtcagtgttacgaccagactaactactgtgaattttttttttcaacgcttacgtgtgtgcagataacaatacctaatggtaatcacaggcttctcagatagaacaaagatagctgatgcttgaactggtcatgctgactagctacctcgatcctctgaactctgaagtctgaaatgtcatggattcagaagatactgcccagcttgcccatgatagagctagcttttgcttgctttgaattatgaagaggtcaatgttgcctaaccacaatatgccaacatgagttttagagtattatccgttggcatcaatagcttcacccatcatgattcatggcagtgtgacgaaggtaatcaacactgttttgctgatgagtgacagctaagctgtgtaacgtctcacctcgatcgacaacactccgtctgaatattccgatcacaacaaatatgtcaatgtcgaggacaagtttggtagaaggaagctggtaggcagcaacatccagatcagccgatcgaatttcgatttcaattcaaaaggttgtttttagagaattcacaaagagttgatgtgctacaactgcaagtctgcaacatatgaatcaatctcctcttgcttgctaaaatagcgtgacaagaaataaaaacctgttctttatcaagcaaggatgcatcttataaaacaaggggattatttacacatggatatgaacatatcatgctcatcataagttgcacaattgataactctctgcatacactgctgcgccatggcggagccgacagagttcgtcttctcaagaagccaagaggaatcaagagaaggaaaaaaaaacaaagagagtagaaatcaccaattcaattcaccatgtcactaattaaaaacttgctagctaatgtactcgagctatatgtaattttatcagggctccaaaaatgttacagctactgtactgtgcatgcagaattttttcgcagttgcagttcttgcttaatttgctagttctccggtatggccacgagccgcggcgcccacgcgtccctggcgccaccgccgccgtgaccgtggccgtggccgccgcggagcccggcgttgagctccaccatcttggccttcctctcgacagcgcaccgctcctccagcctcgccatcagctccgccgcgtccttcctcttcatcaccaccttcacccgcatgccgtcgccgccgtcgacggccggctccacgtggcaccccggccacgccatcctcatctcctcctcctcccccggcgtgtctatcaccggaaccacgtgcctcgacgacgccgccgccgccgccttgctgctcctgacagcggcggtggccggcgacttcttcctcctcttcttgactcccgaggtggccaccgccgtggcctcctggcacggacatggcagctgcaagctgttgcccatgcgactactactagatgcttctctctgtgtagctaagcttcgagtggagaatcaatggcgatgtgtgagctttgagtggcacctggatggagaattggagaaagtgtgcgttatatagcggtgaagaggagagcttgacttgttcagtaggagaagcgagcgtaagtgatggggtatcaaattatagactaaaattaggcaaatttttgcactaaaaaagaattctgatagtagcctattatgtacgtcatgcgtgtaacctcgatcgatggactagtcagccggtcaggtacgctaatgactgttgactagcttgtcaacggtctttggctcgtataagttgcaatagtaaaaatatttttccaagcatactgcagcgagtatgtacttccttcgtcccaaaatgtaatcatttttagttataaatctggacaactgtgtatccagattcataactaaaaattgctatattttaggacggaggtagtacgtataatgaatgtatccgcaaatacattttgtgcaatgacatttaactttgaaactaaatgcgagtatgcctgtgtttagttcacgttgaaaatagaagtttggttgaaattggaacaatgtaacagaaaagttggaagtttacgtgtgtaggaaagttttgatgtaattaaaaagttgaaagtttgaagaaaaactttggatctaaacacggcctatgtacaaagtgtatccacaaatatggtatgcaacagtatagctttgatttttaaaaggactgagcaaccgggggaatctttttgtcaaataattaaaaataaaatattatcatgttgagaaccaaaataaagggatcatatggttaaactaatacatcctactacaataccattacactagcaagtgcatatcattactttgaaattaaactctcctgttgctagtggcctcgcgggaccttccaacaaaaggagctcctggcaaccagcctcctagccaagattaaagaggaagccaaaacatgtgttttggtgggtgagaagaaccttggcaactggctcattatgtggttagctcggtccaaaggctctgagcttgtaacttttttcatttttttttgggttttgtacaatttactccatctctatttaatgaaattggcggcttgccagtttgttcaaaaaaaaaaagtcctcgttaaaaaaagttcttacagagaaattctcaataaaattgtttacatctaacaggtatatacatctcataattgaagcagcaccattttacaaggtcaatcttgttacccgttctatatattcttttgtgtttcgttgctcaatccagaataattattggtcgtcatgcacgcagtcactaatggactgtacttttttttttcataacggcattgccaatttagaacaaggcatatcaaatatgaatttcttttgcctcaggtgtcgtcagtaatatcttctagtcagactaataatgcgtgacttcgctccaattataaaacagttaataacaaccaaacatgtcacacgaggattgagtttcttttcaataaaggaagcgaatcaatgaaatgaaacagagcttctgcttttgtttaagaaaaaaagtttaactgattaattatggctgcagatcgattcttgaactactcaatgacaacacttcaaaaactttaaaaacatttacaattcatgcagcagcattgtggtaggttcatggatggaagagaaacacgaagatccattatgtacttacacataataaatagatgtttttaacagaatcccctcacatttatttaacaaaaaccagacattgctcttataatcacaggatttgcatctcttcacaagaagaaacagggaaaaaatatacgcgtccgcaaaatttcccttttatcatacttatataaacaaaagggcccccttttcttgtaaattatttacaggccctttattttacctttttatagctaaaaaatgcatggccctactatcttcgcatcatcaatgctgtatcaaaattgcagaaatgttctctcggcctatgcaactacgggttggaccagaccttcacttgagacagcaatgtcctctgtgccattggtttcaccttcatcatccttcgacaggtaattgtctacggctgctgcagcttggcgcccctctgtgatggcccaaacaaccagtgattgcccacgtctgcagtctccagcagcaaatacaccttccacattggtcgcaaagtttccaaattgagctttgaagtttgacctcatgtcttgttctagacccagcttgttagcaacagtctgtagaaggatatgcagttaggcactatgtgttggttggtctctaaacagatagctatgtgcacaattgtgtaatgctattcttgtcataactcataagagaaagggaggaaaactaaccgcttcgggacccaggaatcccatagctaagaggacaagatcggcctcaataatttcttctgatccttcaacttccttgaattggaaccttccgttcacctttccccattcaacacgtattacctcaagggccttcacatttccattctcatctccgataaatcgcttcgtcaggactttgtaacttcttggatcttttccaaacttgctagttgcttcctggtgcccataatcaacacggaagatcctgggccactgaaggcaatagtagaaacacaacagagtaatgttagtggaatttcaggcaaccgtagtggcgcaatgcttacattctaaacatacaaagattttcactaaaaaaagaatataaagatgctgttgttttatatgatgagggaactaacctggggccaggggttgtcaggtgccctctttcttggtggctctggcaaaagttcaagatttacaaggttggtgcaaccatgcctaatggatgtcccaatgcaatctgtgcctgtgtctccaccaccaatgacaaccacctttctcccttgggctgatatgtagttaccatcctccaagttgctgtcaagtaaacttttggtattggcatgaagaaattccatagcgaaatggatgcctgccaactcccgtccaggaatagggagatctctgctcaaggataatgctctaaacattagccaagtttcaaaggcatgaatgatatagactgtgttgcttagactttaaaaactggtgccaagaaagatgtaaactagagttacaaactcttctttttttcgtttttgtattaactcactttggctttgtagctccacaggccaaaataatggcatcattctcagagcggagcttttcaacggagtataaagggtcacttccaacatgggcattcacaatgaattgaaccccctccttagccatcaactcgacacgtcgctgaacaatgccctctttgtcagccttcatatttggaaccccatacatcatcagtcctccaatacggtcagcacgttcaaagacagtcacgaaatggcccattttgttcagttggtctgcagcagctagaccagctgggccactgccaacaatagcaactctctttctgcaaaaaaatgaagtagctttaggtgcagctattgttacatgcttcaactcatataagaaagcaagtacaaagttgtgccgaacacacaccctgttctccgaagtggaggccgtggtaccatccatccctcttcaaatcctttgtctatgatggcgcactctatgctttttatggatactggattgtctataatgccaagtacgcacgaaccctcacaaggagcaggacaaactcgtccagtaaactcagggaaattgtttgtctcaagtagccgatccaaggcttcatgccatctattctgatgaaccaattcattgaattcaggaatcttatttccaagaggacaaccagcaccagaaccctcctgcaaaagtttgatataagaaaaatacaggaaccataccaagaaaatttcacaaatcttaacaagtgaaaagacaatctgatgatgcaaagagaaaaagccacatcatgtagtaaataatggccatagaatcgataaaaggacaaaaactgaagaataaatctcagctgtccgatggaagagtggcaaggaagttactagatattccaagtccacctctgaacctgccaatatgtcacaaccatggcacctttttatttttaagcctaaaaaatatttttttcttaggcgtataattttggaggttttgagttttgaatattggtaaattatttttataccttgtgtacaattaaaacctcgtatacgtgaagaaccttgaaagttttgagttttactattgaaactagcatggtgtcccgcgcagattgcgcggctagcatcattatattttctctcatataatagcatatatgttttctcaatatattatccaaatatattaaaatgacaacataattttagattttgcaataactttacgaaactactaatgtgtaatattcatattgtattttatatacgtgttagttattaattatttttaatatcaaattttagttatttgtaaaatatatatattcctatatggactctagactcatcttttaatatatttttttaattccaaattttctgtaaattgtatttctatatagactctaggctcttcttccaatattatttatttttatttctgaatttttattatttctaattgtatttctatgtggactctaaacttatctttcaatattctttaatttttaatttcgaatttcagttacttctaaattgtattcctatattgactttaaactcttctttccatgtttttcttaatctcgaattttagttatttgtaaattgtatttttatacagactctaaactctacttttaattttattatgtttattctgaattttagttagttttaaattcctatatggactctatactctacttctaatattccttattttttaattccgaatttattttttttcttaattgtatttctatatggactatatactctacttctaatattcattatttttaattccgattttctattattttctaattgtatttctatatggactctatactctacttctaatattccttatttttaattccgaatatcagttatttcctaattgtatttctatatggactctagtctcctcttctaatattccttattttttaattccgaatttcaactaattttaaattatatttctatatggactctagtctccttttctaatattccttattttttaattccgaatttgagttatttcctaattgtatttctatatggactctatactctacttcgaatattccttctttttaattccgaatttcagttatttcctaattgtatttctatatggactctagtctcctcttctaatattccttattttttaattccgaatttcaactatttctaaattgtatttctatatggactctagtctcctcttctaatattccttattttttaattccaaatttcagctatttctaaattgtatttctatatggactctgtcttttctttttctccgattaatgtgagaatttctaggccatgagagcgaacgtggaggcttctttttctattcctttaataatataatagatagattatattctttacacacttttttaaacattgcataaagtacactcgattgtcggttttgtttagcacacaaattaaccatctcagtttttttttcaacgaacacactttctaaagtaaagtaaaatattatgaatttagtttacctaaaaattaaataaaatagaaaaaaataccaaattttatagggtaactaactaagcataccctaccattgccaacttaccaaaatatcataacgcagtaatgataaaacaagtcagaccaaaaaaattaacatttacataatattttttaataagatgaatgattaaatattatgttaaaagttaacagtgtcatctattaaaaagggaagtatattttgttactacaaataatatgtaaagatattcagtatagaggatggttaaattcgtgcgaatgcacgactatatgcactaatatatatggacaagaaatcaagagcatcaaggacattcatataaaacttttttgccgggtgacattcatataaaactactgtactgaaaagcatcattgtattttatgaaaaaaaactgcttaatacaaaagggaaaaaaactgagtatcacctgatgacagaaaggagtgccacaatccatgcaccgagcagattgcgtctttagcagtggcccaggaaccaattcaattgcaacttcattccaatcttttacacgctcatttggatctctgtaagaagtaccctctcgctcatattttatgaaacctcggtactttacagcatttgaaactcgtgatggtcggcttgatggctcttcgttcattactttctgcatatcaaagactttaagtcagactagaaagcttagcttacagaattacaataataactattttaagaaggacatcataaatttccaacagtcaagttaaatatcaccgatatagagaatgagaaataatcctgcttaaaccttatttacctctgtctttactgaaatgccatttggagcttgaattacttcaactggcttcttatccaccacttctcttgccttttgctctgcttctttagcagccttctcttcttttagtttatccaaaacccgcttgtaatcccttggatatacttttataaattttgggaggagagtatcaaaattcaagagtatatctctggccaaatcactttgtgtatgaagtctgtgctgttgtatcatcattctcaatgttgtgatgtcatcctcttcaactacagcatacaagtcaactagctcatagttgcaacggctactgaacttcccatccacatcataaacataagcaatacctccactcatgccagctgcaaagttcctaccagtttttccaagaataacagctgtacctcctgtcatgtactcacatccatgatcgccaatcccttcaactactgcttgagctcctgaattgcggacacaaaacctttctgccgccataccattgaaatatgcctctccctttgtagcaccatataaagccacattaccaatcacaatattgtcttgtggattaaatcgactatttcttggtggatacacaacaatctttccaccagatagtcccttaccaacataatcgttgctgtctccctcaagctcaagagtgatcccaggacagagaaaagcaccaaaactttggccagcacttccattcagcttaatatggatggtatctgatggcaatccatgaatgtgataccgttttgtgacttcatggctgagcatagtaccaacagctcggttaatgttccgtactggtgtctcaatgaaaacacgaacaccttttcgaagggcagctgttgaggaggctatgagtttgttatctaatgccatgtcgaggccatgatcttgcttctcaacacaatattgaacagccccagggctaatttcagcagctggtttcagcagccgtgagagatcaatgttttcaagtttctcgttgccctccagtactttgggatcgatctcaagcatgtccgatcgcccaaccatttcattaacagtgcggaagccaagctgtgccatgatttctcgtacctcttcagcaagcatgaagaagtagtttatgacatgttctggcttcccagcaaactttgcgcggagcactggatcttgtgtagcaataccagcagggcaagtgttggtatggcacttcctcatcataatgcagccaagtgtgattaatggcgctgtgctgaatccaaattcttctgctccaagtaaacaagcaacagcaacatctctaccagttttcatctgtccatctgtctgaagaacagctcggccacggagaccattggccacaagagtctggtgtgtttcagctaatccaagctcccaaggaagtccagcatttttaatccctgtccatctggaggctccagtgcctccatcatgtccagagatcagaacatggtctgcatgtcctttcaccacaccactagcgacaattcctacaccagcttcagagactagtttgacgctgattctggcacctgggtttgcattctacagtagaaagaagcgatatagcataagcaagcaaaactgtaaagtgcaacatgcatgatttcaattaaaaaggttctctaatatgaaacattacaacaaaaaaatgccaattaataaggaagtaaatgtgtaagtggcaaactggagtcttgcactaaatagttataagccaccatcatgagactttttacaaatgagactataccttaaggtcatggataagttgtgcgagatcctcaatagaatatatatcgtggtgaggaggtgggctaatgagccctacaccagctgtagaatttctagtgactgcaatatcaccaatgaccttgtggcctggtagctcaccaccttcaccaggtttagcaccctatacagttagaggaacaagacataaatttctactgcctgatgaaatagccagaccagtggtcatggacatattgcaggaagtaactcgtttagttttacaaaaaaccaatctggtcaaatacctgagccatttttatctgcacctcaactgcattagtcaaataatagatggaaactccaaatcttccgctggcaacttgcttgattgcacttattcttggattctttgatccatcaggaagaggcaccatacggcaaggttgttcccctccctcacctttttagatgtcccaattaacatataaaatggagtcagttagcaaattcactacagtagtaagttgatattctaaataaatagctgtgcacaaataagtcataaaaaggtttacataagatgctctgcagataggaagtgcaatattagagaagaatgaacaaaagttgataaataacttgcatcagcctagctgctgtgctcaaataagcaaacaacaggcatcttcccatttgtttctgtgtagcatatgaaaatagttcagaaggaatttaaaataaaggttcatatcaaattgcgactagccctgaaatcggagaacaaacaaagactatgatctaagctactggattgaatccaagtgatatatgcctactatcaattaacaaaaaagaaagccttatacgcctgtcaaaggatcccctgatttattcacttacgtttttcttagggaatgcgcataagctttgtgcatcatttgtattaagattgaaaggaacaaagttctcacaacaccatctacccaaagcaaatggttcgactggaaaggtaaaaaaaccaattgcctgtttacctttagctatagtagcgtataagccctgttggcccaaaatataacatttcctgatcttgttaacctttctgggaaagcaaggatgaaagcccaagtaaggtgctatgcaagagtggcccatcccccaccaccaaatggaggcccagccattgggcgaattttgggtcatatggtgttacaactctacgcttatgtggttaccctcccactatgtaatgatacgcagttcaatcgacaccgtcaaaaattggtctggcaactaatggggggatattatacttctatttccaatatcaagggtaatttggctactataaagcttaacctgtgccacggaaaagggtcagtgtttgagttgttaactggcctttgctcccattcttaatagttatataaccttcacgttccaggcacatataattaagaactttaagcataattcaagtgatttgggaataacaatgttaaaaggatctaaaagagccaactagtttttagatgttactttttagctcaaagtttttgcaagttatcatgggaaatcaagaagcttagaactatatcaagcaaacatgcaacacaaagcacacatgacatttaaagtaactgactcagcaaaagttcaggtccgtatatgatgcgagatacctgtgttagattttcctccaagggtgttcatagcctcagccagggaagtatgagcttccaaggaaatggatccataactcattgctccagtacagaaccgcttcactatctcctttgcaggttctacctcgtccaaggaaatttggtttggaatttctctaaatttcagcatgccacgcagagtacatgccttattcagctcgtaaatgcgcctagaatattctttgtatgcttccctgctgttaatccgtgctgcttcttgtaattttgcaatggaaaaaggatcattaaggtgtacttctccatttttcctccaatggtaatccccagggttgggaagagcatttgcatctgcacttccaggaggtaaagttcttgatgggaatgcaatctcatggagacgaagagcatcttgtgcaagcatttcaaaggttgcaccttcaactctactaggagtaccttcaaaacacttgctgaccacttccgaagcaagaccaagggcctcaaaaatctgagcacctttgtaagatgccagagtggatattcccatcttcgcaagaactttcatcattccatagtttgaagcataaaaatatttctcgataagttgttcttgtgtataaggtttcccatcattaggaggaatcctcccatcaatttgcaaccgccatattgcttctatagctaaataagggcatatagcatcagcaccaaatccaataagggtggaaaaatggtgcacttcgcgaggttcagcagattcaactaacaatcctatgcgtgtcctctcaagatgtgagacaaggtgctgatggacagctccaactgccaatagggaactgacagctacacgctctgaagaaaaacctgtatggaaacttctagttaaagcaaatgttttaatccaaatgctacagatgacggatcaagttaattttgagaattaaacattgaaatgcagagcacatatcatggtgacaagcttgggaaagctgagcttggatgcaaaaaaaaaaaaaagaagaaaagctgagctatgttgacacatgatccaagaggagcaagaaaaactaagtacgacctaacctaagatgaaactaagatgttgactgttaacatgttgttacgaaaatatacttattcatgatctgtatagaaaaaaatcttgatatctttcataccacaataacacaatattgaattcagctcaaaagtaaagattttggggagaatattgatttcatactaacactattgctcatgaatctatatctagatgatgataaattcatggatcataaaattcatgcttagtgagtctggtgtaactgaatcttactgacctctatcagagagaactagaatagtgtagccctcatgaatagcttcacgtgcttgagcacaaattttatctaaagtctgttttaagcccatcctgccattctttttaggataagttatgtcaagcaccttgctgcgccaaccccggtagttcatctttttaatagcctccatttcatttgtattcagtaaaggactcttaagcgtgaggcgatggcactgccgctctgttgtttcagacaagtcaccttcaggaccaatcatgcactccatagatgtgacaattttctcccggatcgggtcaatcggtgggtttgtaacttgtgcaaacatctgcttgaagtattcaaaagtcagcttctctctgtttgacatcacagctagaggagtatcatttcccattgatccaagagcttcttgtccatctttggccatcggtagcatcagcatttcaagggcttctcttgtatacctgaatccaaccaaataggtaatttttcaacaaggaggatgagaagaaacatactaagattgggctgttgcttacccaaaagccttcagcggagtcagaattccgcagatacccatatctgctttgttctcctttgtaatctgcagcaaagtgtgaaaaatccataaaatacctcaccattacatggtaaattactaaccaacaggacactccaaaagttagcaagataattaacttactggaagtgcacccgaaatgctcggtgcaattctctctgcttcatttacagattctatgatatctgtgagttgtatcctttgtcttttcagccactctccatatggacgaactttggagtactctttcttcaattcatcatcattcacaacacaatggttctcaaaatcaactaaaagcatcattccagggtttagcctaccctttcttgaaacatcttgaggaggaacatcgaccacaccaacttcactagccataattacacggccactgtaggtcacataaaaccggcctggcctcaaaccattacgatcaagggttgcaccaaggtagcggccatcagtaactgtgcgtgaagaccaggtcagaattgatacttatctatcataatgcatgcatcaatattaagaagagagtttagttttatcttgttacatgagattagagctggtccatcccaaggctccataagtgctgaaaagaactcatacaaagcttttctctcagggtccatgttaacatcgttttgccacgcctcagggatcatcatcatgacagcctctggcgcacttcttccagattgtatgagaagctcaagaacattgtcgattgcacctgaattcacaagataattcaataaataactttgcaaagatggccatacttccatttgacaggtgaaaagggatatggaatcccaaatatacacatttatttctcttaatacaaaaatgtgcgtctcacgtattcccaatatatatatgtatacatacacacacacacacacattgtttcagagacagagctagcagcaaactactgcttttatttttatcatgtgtaaattatgataaaggaatggaacctgaatccgaagatgtagcatccactatcggcagaagtttcaacatttcatcccttgttagacctagtccctcgcacttcaagagaccctcacgtgccttcatcctaccaaacatggaaataggacaaaagtgcaagtaagcatataaatataagctccatggtccataggcatgtgaagattcttgctcacaagaaaatgatgagagatgtgtttagtgaaattaccagttcttgttccctctaagggtattgatctcgccattatgccccaaaacacgcattggttgcgctcgatcccaactagggaaggtgttcgtggaaaatcttgagtggatctgtttgcatgcataacttttaaactataccttgttcatcttttgcacaactacatataaatgatatgcaatatggtttcatatgaatacccagtaggccagtactatctatccttgaatcctgctccatatgctatcatccatgtaaaacagtttcagaacctaagctacctcaagccaaataaagtttgttcaaaccacctaattaggatacacattctgaaaaagcagtacctaatagcagaactacacaaggattctgaagtgtcttttttgttgggcatcagctgacacagtttcagtttctacagcttcagccaaaggcatcacgaaacaggagggaaatagcatattaatattaataaaagaaaagaggatatttgatgcctgcttagaagcattatatatcctcacaaaaatcttgctgctagtaatcctatcttctgactatgatcatggattttgttgttcagacaatattgaaatggttattcacttaccagtgccatgtaacttgtgnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42507 - DNA, 1069 bp, Oryza sativa
ggggcggcacctgcctggcgccgtcctcctgccaccgtggcgcacgcgaaccgacgtggcaggatgagggcgccaggctggtgccgccccagggaggagggcgccagcatggctggcgccgccgcctccattcctgtttctctgtatagagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcctttagtaaaaccctttgatcagcatgttaaacataatgcactctaccactatatgaaattacttaatctaattcaaaatataaccacatgaaatgacatatataaattaaacagtacatagagatgtaatttttttatttttatttcatttttttgatatttttttcacacttaggagaacataggaaccaaccgtataaaaaataaactcaaacggacaaaatatgtgacatgtagaattttccaaaactctaccgaaacggacaaaatatgccatctattaaaataggcataactttctcatacggactcggaatcaggcaaataatatatgcacggacatctacagaaaaagttacatccgattctctcccgctttgccgggttcggcgatattaaaacctccaaattccgcttgcaagattgtgttttcgaggagagaagtttttcggtggagctttggaaaattccacatgccacatatttcgtccgtttgagtttattttttacgtggttggttcctgtgagttcctaagtgtgaaaaaaatatcaaaaaaataaaataaaaataaaaaagttgcacatctctcctctgcactagttcggagagaggaaaggagaggaaaaattctacatgtcacatattacgtccatttgagttcaatttttgtatggttggttcatgtgtgtccctaagcgtgaaaaaaatatcaaacaaataaaacaaaaataaaaaatttcggg

SEQ ID NO: 42508 - DNA, 1671 bp, Oryza sativa
aacatcagggaacagatctattatgttcatggaagctggttgatggaagatatgttgtttccattcaccccaccatctgtcaaagttccagctcctgagccttgccagctctatgttctcaatactgcccaaggggggtcctgggatgttgagtagccgatccatcatcagagttgatgaaatttctcctcggcactggatttgtcagcaaagaataagccgattgggagttgtcccaatccaagttgtctagctgagctcattgggtggtaaaattcataagaaacttggatgtttctgccctaatgaatgccaacaagaaggatgcatgggctgattgcagccgtaagaacttccctggatttctggtatttttcatgattgatatcttcaaatctgaaatctgatggaagttcaagatctgctgagtcctcataaggaaaccaaacccgggcatctttctgaaagccttcataaaagctgcagaaccaatccttaagcagctcacccgacaactttgctccagcatcagttggcgtatatgcatattctccatatgacatgcatctacgatgagtgcgttcttctccatcatcttccacaatcggctccaaccttgggaattcagcttctgtcacagatggttgattgacaactttcataactgccaagtttagccaggtttgcagcaaccaccatggtccacctgccccaactactgagccgacggctatcttggccgatgcattgttcaacatttgatatagatagccgaggaggattttgcccaagggaaattgtcaatcgtgattctagggcttcggctacaaagtgccaattggttgtggggccacagcttgatccacaaaagaggaatttctccagccacatcagcaaaaaggctacatgctctcggggagtgacaagccctttacccatatatgctgctacgtaactagaccaaccacctatgcttttggtcctgaaatcaaattggttcttagtgttcaagctcataggattggccgatgaagttacatctaatccggtgatcatagtgatgtcaatcaaagttggggtcatcggcccttggttgaataggaaggcgttgatggtgttccaccagaaataggtggcggcagccatcagggattcgtccttagcggaattggctatggtgagggaaagtgattggttgatcccgatctcatcccagtgaactgccttactagccgatacacgcttgtaccatgtggtccaactcttctcaggggtagttttctcaagagatggccaagatttgaaggtattcttccagtgacccagattaaggttggctaatctaaaggggattctgttggtttcaccagtgatgaaatcagtagggtcaaggttgccgattggaccaagaaagtagtggttctcgtgcgacagactcggaatcgcaaccagattggacatatgctacagttacagatggggatagagaggaagaaaacaagatgaggtgagagaaaatcaatctgctacaaaagaaagggatctagccgatgggtacttacctctacgtactcggccgatggcgcggtggatggatcggcggaagtcgacattgccgggggcggagatctaaccggggacggaatcgccttgaaatcgctggtgcaccga

SEQ ID NO: 42509 - DNA, 3034 bp, Oryza sativa
ctggaaaaattctaggtcaggattccatgcaattcccaaatgctgccagcaatgttgactgaaagggcagaagaaaaagagatgctctcttgtctctctgatattattcaggcataattcacaagtgaggtctttgttttcctttgcacaatgtcatctatcaagcatatctcttatgttaagtctgtctctgaataaaagccaagcaaaaacttttatcttcattacacattttgttttctagatccagacaaaaggccttggcacatgcacatttgagtatgtgagcttataaaacctcttagctgtgtatttatcacagttccggataaagaccattcatcacctttaccgttctgcaaagagagaggaccattcctcctctagaacagtgaattctccataagcttgggtgttcaggggcagtaagaaacaatcctcaagaggagtagaacccatttgcttaacagagagggttttatctaaagcaaccatatataaagatggaaaaacattgcttcttatcttatcattccaaatgtcatcccagaaaagagctgaagatccagtcctgatatggcagtttctgatatggcagtttgagattcccctgaagacatcagatagagccactatatccctccaccaaaaaggtcctttattccaaactaaatgtggcactttgaagttataataagagttccatatcagttgaacccacggcagatcatgtcctttgtaaaatttgactagatgcttaagcagaagtgctatattctgaactcttagattgatgactcctagtccacctttatcctttggtctgcacactagatcccaagaagcaagagatcttcgagttgaagttgggttgtttcccctccaaaggcaatttttcttggcagagaacaatagctttaaccactgagacaagcagctgcaaagaacacatgtagtatgttgggattgaggaaagcacagagtttatcaaggattgaggaaagcacagagtttatcaatgtgaatctcccaccatgtggcagaaattgtgagcttgctgttaatcttctctctaccctgtctaccaagggtgcaaagttgttaacaaccagatttggtaatatcagcatcggaaaagaagattaggtcgaagtggaatcgaagacgaagatcgttgtggaaacagagcaagaatcgactgcaatccgaatcggctacggtcaggatcggcagagttcgagttagacagggctagccgatacagccgattccaaaaatacgatttggtgtacatcatcggtttgagttgatatgcttcaagatgattgccacgcatggatagagtcctgagaaggcaattgtatctattaattaggatattttatgtaatttccttagagatatgtttgggcaaaagtctgccgcaaagacttatggtatcttggagtttgttagagataatagtcatgtccggtatagacatatcttgtaattctcaggtataaatagaccccgagccctatgtaataaataacacacgttcaatacaatttcggcgcatcgccacccttttacttttgttttgtttcgacgggttcttgcttccgggttgagctgcatcggtttcgatcttcaacaagaggtaaaacttgttatggcggcttgtattctcgggattagtgcttccatctttatgacactctaatcttgtttatgtaactcgccaagttatcatatatcttgtataatctttggtaatatcgtcatctaacctacaatcggctaacatctgttggtagaaggcggtcgattaggttaaatagcgatattagcttggattgtataaagtatctaccactctatgaaacatccagtggcttgattgtctagatattgttcttcttttcatacttaatgctgcatcagttgagtttgatctattaagtcgtgcttagaatatcaatctctagcgtgcttcctggttgccgattagcgtagcatcggggtttcagccgatcttaccttatttaacttcttttaccttacatgcctaattgatatgttaaatccgccctttgtgttaagatcttgatgcatttaagtatattatgcttctatttgatatattctacttgcttcaatatcttaatatgaagtggtatcggagtattagccgatacatgctagatctatctgatcggctatgctatgaacgtatatagttctgtcgttaatttatatttcgatctaagtgatttatactgtctcggcatggcgaccgatttatcccaatcacttgatttaagtatatatcgacataacagttatatattgttaatgtctacagccgatcgagtagaattagttctttcttaattattcatgactgccgatcgatctacacatgacatcggcctaaaataaatgatatgtcatcggcacctagccgatcggctatcatttataagattaatcgcggtttctttgtctttatttattgttgattgcaggatcaaatcaactggcacgctcacacatccgaaggcgagttttggacctgcactggagttaagcagatctcccaggcctcgtgttttctgtcaacaaaagtccactacccttggcctagttgtccccatgggcaaacccaaataagtaaaaggcattgtgcctatggtgcacccaagcagaccagcaaaaagcactgcattctcatgagataaattgattgggtagagacaggacttatggtaattcactttgaggccagtagaatgtgcaaaagaattcaacaatgccttaaaacagaacacctctctctgcaatgctttgagaagaattgaagtgtcatcagcatactgtattattgggaaacccctctcatcaagttcattaattgacttggtcaacagacctaaggagcaagctttgttaactattctctgcagcaactcagcaccaagaacaaaaagcaatggtgagagtggatctccttgcctaacccccctttagcatttaaaaaagtttctaggta

SEQ ID NO: 42510 - DNA, 3331 bp, Oryza sativa
  unsure (1)..(3331): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggtgttgcagtcgtcggcgcagtcgcagagggcggtggtccacgcccctccagccgccggcgccatgcggcacgacaccacacgctccatcggcggagcagggtagaacatgccgacggggatcccggtcaccggctccggcgccgccgccgacgactcgccggacttggacggatcagggggatacatggccgtgtagaagttaatttgactagctagctaatggatggctacctgctgtccctgagatgtgatttaagtactggacgttctattcgttgatggatatatagatggggaatattagtcatgttagttaattaagtaattaattaattgactagttagcgattaagcagagggacatagtagttgctaggaaaatactgggtttgaaactttgacgcacgcatgcagcgggattggcctggcaaactatgtcctgcagtctgcaactggagtagtagttttcttacatgcaaatgtcaccattgacttgcagcaggagtattactggccaggtgcatctatctgcttacctatctctacagaaccgtaccatattataatgttttgttctctctatctcttgactattgtctagcttaattcactaacatctatataaatttaaatacatatatagatagcatatatacttgagataaagtctattttccttcatcgaactagttcactagatcatacaacccctaaactattttttccctcattatataacctatacaaacggtacacgttactctataatggtatttcttttttttctctccacattgtcatggttatggattgcacatacctaatagtagttgactaaatctcggaaggacccaccacatatcatgtcctatacggaaacaacctgcggatatggagggagttccggataaggaaagacaaccagagttctacatggaaacgacaaggactactcagattgtatccatattggtttcccacgttctacttgtacaaggggacacctatgggtataaatacaagaccccctaggaggagaggggagaaccaccatggaagacacccatgacaatcaacacacgcccaccagaagccacaacatacaagcctacatacgccaagacacgccgccggatatcgacttcagggataggcatggctattcccctacggtgtctccggataccgtcaggagatacgaaagcgctatctctgatctcgccgggcacggattcgagaaggaagactaccctgttgtcgactacgagtcagaccttcagatcaacatgtggacaacagttagatatgctgcccacatattgtactggtgtgattatggtgaataaaagcaactccggctccggccaacatgatgtaaggttattacctgacagctcaggggcccgaacctgtataaaaatccccgtctccgtttcttttacctcagtctcgcgtatatcctagcaccgacgatccccatactgtccaaataccgtagtcgaaacatcaaacgtcgacacacataaatcatatttttgcattgaaattcaaaacgatcgatagatgcatattacaacttacctcttagtaatatttttttaaatttggccactttttgcataagtcgaaaacacctaagactgattcaaacaaattttaaatttcaatgaaataatcatgaaagaaaagtgaagtactttggaactttgatacgtatgtcatttatgtgtcataaatggcttaataattttcagttcaaaatacaacccatataaaatataaaccataaagagaaatgctaagaataaagtgaaacatttttaatagtttaggagtaaaatgagctgaataatagtttgaaggagtaaaatggacgaatttccttaatccgtttgttctttggttaattaacgatgagtgtatttgtagttgagtgtaggcatcataggtgatggaaatattatttagtgcacgctcgctacttctgattctaaagcaccacttcttttaattcaggtgactcttaacatatcacacgactcgcacagaggactcccaatgtgcgaatgagcattcaatgagtacttctttaagtaatttgatttttgaagtgattttgaaaagatttaacatttggatagaaattttttagttgcacaaggtccagttgaaaaactatactcaaaatttgaaatctttgacttcaattaacacttcaaaactcaaaatttaacactttcaactataaattttaaaacttcctcccaaattcggaactctcaactcaaaattaaaacttttaccaaaatattttaaacctacccaatccaactcaaaatttcaaatattcacagaaaatttttaaaacactatccaaattttgaactttcaacacaaacttttaacctttcaactcaaattttgaattttttaacttagtaatttatttataattattatacaatttcatcaaggggaagaaaaaaaagtgtgttagcgcattgtcccctcactactcgcgactcgtgtgtgactctgattcaattcgccagacataggacaagctcaatttgcgtcaactagccgcccccaaccaaaagcttttgttggcagtgattatttccaaattactcattgttgcaaatacaacgtgtgtgccttagttagttagttagttattcagttatttctgcatttgtttgattcagctttgcatgagcttgccgaaacttgtggcagtcgtgctccagttgagggtcgcgagattagctcatagagcccgcatcgtgcaccgagagcgtgacgcacgttgagcagctgtggggatggacgcagcgaattgccagcgtgagaagcggtcctagtggttttgatttcattgtaatcccattttgttatataaggaagtaaaccagaaaagcagctagctgttgcgctacgccaaaattcttctgcttcctttctttcttgtgttgccggatcggctacagtacgc

SEQ ID NO: 42511 - DNA, 15684 bp, Oryza sativa
tcatattaatccatttaagtattttatagttaatacttaattaatcatgtgttaatctattactctgttttgcgtgtagatgggaagggttcccaagaggtaagtgtcatggttacgggtaagatacaaccttctaacctacgacttatggaatatacggatactgcataccttcgtatgtacgatatgtttcccgataaggaaatcgacaaaagattatggaaataatcctcataggcaagtgtataacatagtcctactcggaaaaggatcgggattcaggattgtactgtatcgtggtgagttcggtatctccgagttctacttggagatcaaggtaactcacggtataaatacacatccctaggggtcctaaggtatcgaatcatacgccaacaccaccaccatagcctacaaatcggaggatgtgaagcctactcgctgggagatctcgtcgaaaccatctcgacaaggatctcgccggtaatcttggaatcgtcggtcttctattggaatctatggttttccatgtcaatctcatacaaactggactagggctattaccttacgagggatctaaaccagtataatccttgtcttcttgtttgcttgatgttgtatcgtatagatcatcgtaccaacgtaccctaaaaccctattcatcctgtcttggggtatccacgtcggcagtaagtaaaaagagtaattttactatcttgagaatatattcaaaggtaccatatttttttatgataaaatttaatactttaggtagtggagatatttttttaaatgtaaaattcggtgtactacaaatttcctaaagtgcagtaaaaatttctcccataaaaaacatgcatttttaaattagatgtaccatgaatgccgaaatgcaccaattagccgagtcatagatagtggttgattaatagcatgtccaataattaagttgatccagggaatggtttgagctaattcgtgaaaaagaataggcgacagtcgtttattcaaagaccacgttaatttggggtgacttatccatctgtatgtgtagttatattaattgtgtactttctccttttaaattcatcgtcgttttagttatacttattaaactttttagctttgaccaacattttttataaatttatatgttagctacaatcattagaacttctgtccggtcttactcccaacaatatttttattcaccacatattatttaatgagagatatcatagttttttttttcttcatctagaattaatgtgtgctactacctactttttctgtctaagacatattgcacagtttgcatggaaattgcgagacgaatcttttgagtctaattagtccatgactagccataagtgctataataacccatatgtgctaatgacggcttacttaggctcgaaagattcgtctcgcggtttccaggcgagttatgaaattatttttttcattcgtgtccgaaaaccccttcaaatatccggtcaaacatgccacgtgacagttaaaaaaaaattcgtgaactaaacaggcccttaaatcctacagatgaacgtggaaagaggaacagaggaatgactagtctgcccagtataaccgctggcactgtgagtgtgatggagacatggaaattaagggcctgttcactttgacgccaaaaaaaaccttaccaaattttggcaatgccaaattttggcaactatgccaaaattttggcatagttgccaaaattttggtaggatctcttatatagttatcaaaatttggcagcaaactaaatatagccacttttttgataactttatcaaaatttggtaaggttggaaatggcatcaaagtgaacaggccctaattaaccttgtcgtgcggttggtggtttgcgtggctcagatttcaggccctgattagataagactaaaacttttaagtccctatcacatcgaatgtttggatactaattataaatattaaacatagactattaataaaacccatccataatcttgaactaattcgcgagacgaatctattgagcctaactaatccatgattagcctatgtaatgctacagtaaatattctttaattatggattaattaggcttaaaaaatttgtcaagtgaattagctttcatttatgtaattagttttataagtagtctatatttaatactctaaattagtgtctaaagacagggactaaagttaagtccctggatccaaaccccaccttccacatgaaccaatcaaattctacgaatgcagcttgcgcattttttctaaagataattgaaatgcgttgcctctatcattgctgaaattaataaggtttgtagagtagctttctttgctgaaaggaaaaatacattagctaaaataatggctagttcaatctccgttaaggaaaccagattctaacaaataactcaatagatattagtactacatacacatttcaaaaaaaaaagaaagaaaagaaaacgtcaactatcaattctatgagtgcaactctatagtatagaaccccatttctcctctcatgtaatcatagaccaataataaaattagatgaaagaaaaaaataatctatataaggttagaattttttttttattcttaaaatactccatcatttcagcaacgctagattaaccaacacaacaggctaatcgtaacaaaaatccttttttttaataagttggcatgtacactaccttgagtcaaatcccaaaaatcaattttggcaattgcagcttgtgcatacacctaactcctctctccaatctaaatttcccccactaaattctcatcaaaatttcttaaatattcactcggaaatacgatatgacataagtccatgagctagtagctcctagcaagacacacagacacagtggaagcaaaatctccatggcggcggcggcggcggcagcagcagcagaagacgaggagaagaggcctctgctgcttcgtccgaacggcggcggcggcaaggaggaggaggacaagggcggcggcggtgggtggagggcgtgcgtgctgatactggggacggagctgagcgactgcctggcgttcgccggcatcgcgaggaacctggtgagctacctcaccggcgtggtaggggagagcaatgtcgccgccgccagggacgtgtcggcgtggacgggcacctgcttcctcacgccgctcgtcggcgcattcatcgccgactccttcttgggtcgccgcaccaccatcctcctcttcctctccatctactccatggtatacttttttatttattaagaaaagtatgctcaaacaagttttttgttaatgcgaaaaactgaatgtttgaagagatttttcttagtttttaatgtgaaaatatatcatactcctttattcaattttcattattcagacatttttgtgaatgaaatgtttttacaacaagatttagataacaaacaaaagcatatcaaatatgacaatagagaatttcggaattaaaggtcaagcaaagcttaagaagattttttttgggcaaatttttttatggtcttcatgctttacagggactgaaaaagagagagaacaataaatttcttatggcaatcaagaatttctgcgaaatgtcaagcaaaaattaagaagatattatgtttttttttcacaagttctttagaaaagaacatcttcttatggcaatcaagaatttcttaaaggtcaatcaaaatttaagatttaatttttgtttcacaaattattttgatggtcttcaccagtggactgaaaaaacaataaagaacgaaaaatttctgaaatttcgttataaaatttcaatctgtgacaggggatgatcacgctcacagtctcggcgtcgttcgcaaccccacaccttgatgcatcctccgatggcgtcctccgcgccaccgtgttcctggggctctacctcgtcgccctcggcgtcggtggcatcaagccgtgcgcctcgccgctgggcgccgaccagttcgacgacgacgacgcggcgccggcggcgagggcgtccttcttcaactggtactacttctgcatcaacgtcggctcgctgctggcggccaccgtgcttgtgtgggtgcaggagcgcgccggctggtggctcggcttcgccatcccggcggcggtcatgaccgccgcgctcgccgccttcctcttctgctccaccctgtgcggcctccgggcgttccacacgccgccggggagccccctcacgcggctctgccaggtggtcgtcgccgccgtcaggaatcgcggcgtggagcttcccggcgacagctcgctcctgcatcagctccccgacggcgactaccggatcatcgagcacaccaatcagttcgcgttcctggacaaggcggccgtagtggcgtcgccgccggcggtggcgatggcgagcccgtggatgctgtgcacggtgacgcaggtggaggaggtcaagatgctgctgcggctgtccaccgtgtggccgacggtggtgttcttcttcgccgccacggcgcagatgtcgtcgacgttcgtggagcaggggaaggcgatggacacccgcgtcggcccgctcgacgtgccgccggcgacgctgtccaccttcgaggtggtcagcatcctcctctgcgtcccggcctacgacgccgcgctgatgccgctcgcccgccgcgtcaccggcgaccgccgcggcctgtcgcagctgcagcggctcggcgtcgggctggcgctgtcggcgctggccatggcgtactcggcgctgctcgaggcgagccgccggcggcgcgcggcgacgagcatcgtgtggcaggcgccgtcgtacatggcgctgggcgcggcggaggtgttcaccagcgtcggcctgctcgagttcttctacgaccaggcgcccgacaccataaagagcctgtgcaccgcggtgagcctcgtcgccgtggcggccggaagctacctcaactcggccatcgtcgcggtggtcgcgtgggcgacggcgccggagaagggcggcggcggcgggtggattcccgacgatctcaatcgaggacggctggattgcttcttctggctcatgttcggcctcagctgtgtaaacctgctggcgttcgtttactcttctacgagatacagctacagggttgctaactaatacttcctctgtttcacaacgtaagtcattcaatcatttcctatattcatattgatgttgatgaatctagataaatatatatgtctagattcgttaacatcaatataaatgtggaaaatgctagaatgacttatattgtgaaacggagggagtacacacactcctaaattttactgtgtataaaattttctttcaattataactttgtcctttttaaaatcatatggtattaggccgtgacagaaatttaattgaatttgcacatgtttttaagctcgtgtgctaattcatatggcattgaggtataaattcatatgaaagtttttcatccaaaaaactgtcaaatgttgtatagctattccgattcgtttgaggtagaaaccaggttgtcttttactccgaaaattcttctgtggataatttggggatagttccatctgtgttcctgcacacttcttctaggctgccatctgcagctttgaagcccgtcgcttcttgattttctctatttgctgctgcttttgttttagctgacctgaaagtgaaaagagtaaagtatgttcctaatgatgtaaggtcgggagattatgatcagtttttatattagctgttagttcctctgcattctaaatgttactactatactgttcgtcatcttgcaactttcctgtcgattcagtcattgaatcgcaaattgctgtagcttctctgacaactccagctgtggagttgtttctgggcattgctaatatatgttttagtctgaaggaaaattctatgagcatcctgctgatgtttctggacgatgtaacattcctgaaaggagctgttcctgttattcgtgtgcttgtcattgctttaatcaagtaccataaattgccattgctttaattcgtgtgttctttcagttcataggtcatgatatacataacagaattggaactttaaaattattttgaatgattagtttatcaaataccattgtttgcaacaagtgttttcagataactaattttaactttaaaaactattttgaacgactggtctatcaaaccgaaagttaaaatatggagtaccacatgttgctagtgtttacagagactatagtggtcactcaagggtaacaaaacaattacagatgtcatagtttctattggtttgtttcggatcaagctttcaggctataatattcaagaggttgctcctctgaattcttacaaaattcatcagcactgtctctcaacatcaagggaatggaatggtgtaaaattgctaagcacgattccttcaacaatgatgcaaattacaaggacataacacataaaaaaagagccgcaaaattcaccacatcagtcgtacaaaatggaacagatttactgctcactaccttttgctatgaataatggctaatcaattgcatcagctacctctggtttctttcatctctggccttcaccaactatgcatagtctactcacatttgatggatttgtatatatggcgaacgaacagcaaggcggcacggaaaccaaccatgcccagcatgaggaagaaggcgtagcagatgcaggccatgtaaccaaagaagaatgatgtctgcatgaacccagacatgtcagaccgttcacggtagtagtataagcagtaagcgaagacgaaaatccagttgatccaccacaaaggaatgacctgcatcagaggaaaaaaaaaagaaaggataagatgcattagaacttgcaaggcatagcagggaatggcttcttgaactcctgagagacaaccaattggcagaaaacacacaattactgtgatatctaatgaggaagacaactctgttttttttttaaatgaagacaactctgttttgatgctagaatggaaatcatatgcaatccgcaagtacaacagtagaaggtgaaagaatgcatacctccaccaccactcgtggtcttcagcagtaagctgaaagtaggtcagagcaacagtaatgaaggctgtgacaataaggaggatgataaagactataaacagaatgctgtaaattgtgtagatcctgtgtccccagatgcttgcaagatgtagtacagctcaatgtaaatggcactgaaaggaagaaaaccggccatcgccatctgcggaatggttctccggtaccaggcaagtggtggaacctctctcaggaatttggtggtgcggcaaggagcctggaactcatttttgctgtttttcccagcaatgcctcccaaaacaagcaaaggaaatgtgaccagcgtccatatgagcacaatgacacagatagtaccaaagggcaatgctgccgttgaattgtaagcaatagcaacagtgttcaagaaacagaatgtcagaaagagaggtccacaaaacaggcatccagtcaatagcaagttcctcacctacaaacagaagaaactaagatgttaattggcagaaaataggaataacaagataatacgacccctgattccaaggcatttatgcaatgctaatctgtaatatagataatagaacatacccagttttttccttcgaactgacagtagaaagaggttgcactgtacccagcaattcctgaagtgagtgcataaatgacaacgagtgcagtaaaaagcgcaccccggttgtaaggatagaatactccgaccagtgcaagtaggaatataaatgttgtgctgcataggccagcatatgaattgttagataagtccgttaaaaaactaacactataggaaattcagtgtgtaaaactaatagggacttacagagcaaatagctgagtgcctgtaccaagagcagcagaaaataacgatttgttagtggggaaccgaaagacatccccatggatatatttccatcctgtttcttcctggtcatcaggttcctcctcatcatgtgaataccttcaaagggaataatattaatagaaaccttgagaaatcaaagctacgaatgaagctatataaacaagtgtccaggatattttgttcttagttatgaatgaagctagagaatcccaatatataaaaacctatctatattgtcactagaaaaaatttcaatcttcgaatcaatcaccacaaaggataggaaatgataacttacttgacaaaatcattcttcagtacacgcatgaggatcgttgccaggaatcctgtcaagaggagaactgtgacacaagagtttacaattgagaaccagtgaacttccaagtgatgtggcatgacagatgagctcgagtacttctccatcctcttctcaaacggtatctgtgtctccttccacttggctgtataaaggaattcgacatcaagttccttgtcttctgtcaagtccactaccgcgttctggtcagtgtgcacattgatctcaattacacggtccttattgtagaggatgtcaaagatgatgtgcctgtaaagataatacttatcccctgcatctgccttttctggcttagtcccaataaatccccaaaagggaaggtcatcatagtacatctggaagtagtagtccttggaaacagcgtgtcggaacttgaccacatcatccttggagagccgtctactgcaaacagacttggcatcaaaatctacacggaaatcaagcttgtagggcgcatcaaccagacgatccccattaaggacttcaccaagggcttcaatcttgtcctttactttctctgtagttgatgacaacacagataacttgattaaaagagaatggaggttaagtcagaacttcatctttctgtaaaattgaataagcatcagaaaaacaagtctagttctgtactagaaggtgttaggaatcaaaattcagcttaattgcaaagaatctttcttgtttatagtaaagaagtcaatggcctccacttgggagatgacacagttcactaagtaaacataaggcagattacagctagcaacaccttaattaattagggagaatctaacctggggcacaaaagggcaagtcaaagtaccggtacgtctcactgcaaggggcaaaatcaatgtgtgagaataaaataaagctgaaccttgtacatctgtgattcactctacaatatacatcaacaactagtagaaaagaaattatgtataaatccacttgaagcatttgacaaatctagcgcaactgacggcatcgctactagagaaatatttgcagtctctagtagcagctgtcagataatgagatccattatatcatctgcacatgaacagtgttgagaattttttggttattcagcaaggtatgcacttaaaggtattacttattatatccaggaaagaaaaaagaagacaaaatagggagccattgtgggcgtcttaaatttcggtagtatctgtcctgggagcaatggatatcatagtttattaccctactgaaagaaagcaaatgatcccttgcataattaaattcttttatcctgaattattccaaattatttcttgttttcaacaattctgcaggtttgttaataggatgcagtatttcagaatatcgcttgtacagtactatttcagaaggaatctaatcttgctcctacaaattaaattggtactcgtatagattcgttgtggggattggaacaggaaagattgagaaactccgaattaaggaagattgagaggcggagggacggacggacctggggttgtggaaagggccgaccttgttggcgtagagcggcacggcgtcgcccggcctgtagcggtggctgtccgccgcggcgcacccgaccaacatcaccaggccgaggaggagcttcggcgccgccattgctgccatctcaatcgcggtgggggatggaggcagtcaggcagagcagcggagagagagagagagaggcggacgagacgcgtttattaatagcaaccgcactcaagtggagtataggctgagctgcacctgcaaacgactgatttttcttttcaagcaaaatttgttccgttttccgtcggtggtgatttgctgcccaacatgccaaacatctgccatacttttggtggtgtatgtatctagggactaaatttcatatagaatgtttatactaattagaagtattaaacgtaaactaataataaaactaattgcataaatgagagttaatttgctagataatttttttaagtctaattaatctataattagcacatgtttactgtagtatcacataaactaatcatagattaattaggctcaatagattcgtatcgtgcattagtacagagttatagaatgagttttatcattagtctacgtttaatacttctaattagtttcaataatccgacaggggttaaaaattagtccctacatccaaaacaggatcttaccttcatgtaccttcgtgtataagatcaatgtgccttacataatataaacgattggttggatgagatttaacatttactcgctccatctcattgtaaatgtaagtttagaagtgagatgagaaaataaaatagaaggaaaattatccaaaataccccctattaaatgacaaatggtacggagtgagatggtagctgactgtaagacgaacagaaatttgaattaaatgtgattaatgtcacaataataagtagtatagttggattgtccttattttgagacaaaatttaaatatagaattgtatttatttaaatatatgacccgcacctacatggataatacctatcgatttatagtgactatgagtaatgcaaatatgtcttgttttctatcagttgaccgagattttctcttaagtatatactagctgtaggttatcaatacaatgtctgttaattcgaaatcatttactcctcaaacatatattatacaaattaataaagggtgtttacaaaataatttagggtataattgtaccctctatgtcacatgctggatctgcccctacattggtcccacgcataaaggattttacaaccgcatatatcaagtatgcgaaaagggtatcggaataaattcgataaaggtatatgtttttcttttcaaaaacaggaaatcaaattgatatttaacctaaaaaagccaaatttttctagcaaattctactagaagatgcgagattaagtgatgagtgggtgttggctctcctcagcactgtactttagtgtggtcataccaaaccgtacgttaacgcgtgttagcttctggttcggcaaattggcaccattttctttctagcttttgtttggtttgatttagctgctgagtggtgtccgattaattagtggaattggggtttaatttctgcttgatatatgacaagtttggccacttgtccagctactttcatgtttgataatctcattatgttaggacctgaatccttttcttttttgctaatcaatttgctacatacgtgtgtgctacaaggtttagttagtggggagtggcactgccattacgggtgcatcgccagtgcatgacagcctaacaagtatatgagattttgattttctagtgtcaactaagatcgattcattaagggttgtagtgcttgtttttttttggtaatatatatttttttgcctcatagaaaatagttgtaaaatactttaagatgactgttatttattatctctttgggaaaaggcctggatcattcaagcccattacaccaaattgaggagggactaagttaactttaggtccctcaatttatcgcccagcctgaatttcatcctcaatccggagaaccggatacaacgcatcctccaacttacaaaaccagtacaaacgaggtccacggcagtatttgaccccggttttgactgacgtggcacttacgtggatcgtttgactcggcatttgtcctacgtggcattaacgtggcacttacgtggcagtttgatcccaagaaaataaaaaataaaaaattgaaaaccaaaaaattaaaaacaatatttgaggctcatgtcagtcaaaaaaaaatagtgggatccacatgtcagtgggtcccacttcctccacctctttctcctaacctctatcttctctctctctaccgacgctctctcatctctccacaccggcaagcgcagacgagacggggaggccggaggggctaccggcgctagggaggacaggaaacccgtcctcgccggcggtgtccctgcatctccacggagccacgccttttctccagatccggtccgcctcgccggtgatggtcgaaaatccggtggggtcccgctagcggtgtgacgccggcgaagatcacggatggctctcctcctccgccgccggtggtcgcaatgaccacttcgaccgcttccgtcctcgtggcattcgtaccctccgcctgcagatcgagctcctcgccggtgagatcagcgtggaagaaggcgtgatgctcaaatggaaggcggatttcggatccacgcttggcagctgcgtcatcctcatcgcgtcctctgccagcaaggacggcacacggcagctgcatccacaccgccgtcctcccccgacatcgcggggcatgctgctgtgtactccacgatgggaggaggggataaggagaactggagaaggggaggagagagaagagaggggatgtgggggaggtagtggccccactatttttaaattttattatttgactgacatgtgggcctatatattttgttttattttttaaattattaaattttgtttcatgtgccatgttaatgccacgtcagatgaagatcgagtcaaattggccacgtaatctaaaaccgctatgggacctatattgtaccggttttaatagttgagagaattatttatctggtttttcggttgaatgatgaaaatcggattcgttgacaagttaaggtatcttagatgaacttattccatttgaggaacaacggttgaacttcacggcccatataaaatagttataaaatcacagtagttcaggccaattggatcggaattggattttgttttgttaatttgcagtaagtatcagtagaatttgatcatgttctgctaaaagtaaaaggaatttgatgaaaaaacaaattctgaccatgttgacaaaacaatacttatagtcgatgccggatgcagagctacagtatgatccttgtgatgcatgtaccaccatagaatggaccaaggcccattacctgcatacactactaaaaaaacatcgatgcttcgttgtttcgccgcatgacagcgtctacttgaattctgccttcccacgcacgtcttttgtgaaacgacggcggcaaccggcggtggcgatttgaagcagaatcaaacaccggcagcaaggacgaatctacaatgctaacattggtgtcaggcgatgccgatgactttcagcaaaacttataattaaactgcttatccatataacactatattctaagtatatataattagtatgctatgacatcaatagacatattatgaccgctgcctgtaggcaacatgttctcatctcctcccaccctcgaggttcaatttcattttgatactggatttcctattagaatggtaaatttaaagatatttggttcattttattatactatagatgtaatatgccaacgtacaagtgtagaatttacgaaacgcaatctgatcaaataaaaaaacgttggcacattaaatctatagtgttcttaaaaattgttgagctgggccacctagcctgaaatcctggatatgccactggccaatgggagtaactagctagctattcgaactgaaccataaataattcaatccatacaaaaacaattatgaactgtgtcattgttttggcaaaaatattgtcaccctctgatatccttgcatccaccagaacttgagcccttgaggtgctactgttggggggaagatagggggacctccccctaaccgactggctaaactctatcggtgtggagcctcctaaaagcactgtggccttccttccactcaacctggggaagatgaaggatgcgggctataagatatagcccctccgtagaataagaggaggacctccgataccttacatggtccacaggtgcagcacaatctgttcattcactaagctgcacgaactgaataacaatggagtacatggtttacatatatagcttcatgatcgcaaattatttataaacatgtattaagggaaacaccactaccaacattgaacatgaattttctatatccactagtagaaccaagttcagataaacatcatgggatcgaccgcataagaagcagattgcatgcaagttcagataacatcatccgaatggcagcatatactgcaagatgttctggtaacaaataatatattacaattcacacacaatgcttgtacacgatcacttagagtgaaccaagtgtactgtcaagttcagttccttgatcagctctagtgatatatatgagatttaattagttaccagtgaagctccatcggctgtgcaattattcttccaacatctccgaatgatccgaaggtgttgtgccacttgtttcattgttggtctttgatctatttccaaacaaatacacttgagcaatagcttccctatctcttcgaggagagcaacatcttcgctacgagttgtgatatcatcgtcgaaaaatgcccttccactgttatctgccttgtaagctgcaaggaattgcgagacaaggtgttcgtgatcgcataaaacgcaaagttcttcctactaatgagcgtcaagacaagaacaccaaactgatacacatcggttttcagttttagtgacacacagtacttatcatgatcatgaattgcgctgtcatcattgttgagcctctgcgcccatgagaatcccgtcagctttggcgtgaaactgtcatcaacaagtgtcttggatggtgcaacatagccatgtctgatcataccagctgctgaggaatggaggtactctaatgcttctgctgtctcaactgcgatcttcacgcgtaaatgcagtgggaaatcttcacggccatctagaatgtcagagagggttcctctagcagcatactcgtacacaaatgcgggacaatcagcattcaagcagtaacccaagagtctgatgatgttcttgtggacaatttgagataggatcatccctccgttgataaacgcctcttcgaaaccctcaagtgcctcggaaaatatcctcaccgctaccaccgtattgtcctcaagcgttcctttgtaaaccttacccgaagtacctccactgagtagacacgagtaattctgtgtgatttcatttagctcctcctgtgtgaaaattctcatattgccgagtcccaataggatcttagaagaattgctaagatttctcttgaaaatgctcaaactcttcttcagttgcatcctagaattatagctcggcccctggttgtcattttttcgccatgagcggtgtgatgccaaaatgtgttctgagtatcttccatgcatgtcttttaattcttttttaagtgtacgaaggcgttttgccacaacattcatttgaggacgt

SEQ ID NO: 42512 - DNA, 975 bp, Oryza sativa
atagcttgggcatcttgagcatcggttccagagatgactttcagagacttggtcaaatctgcaacattcttgatagccgatttgagtctggctttttgatcttcgatagacttcgggagatcggctaactttttgtgctccatatccagctcggcgttgcattcttgaagttgtgccatgaggtcaatcttacgagcttcaagccaatcgatatttgacttgatcgggcccttagacagctgatcaagctggatttctctacatgcacaagctgtcgattgtgctggattgtagcttcaatatccttgcactcccggcgatcggctaatctctgtctggccttttccagcttgaattggtgttgctcaaggtagatggctagagtaagggcatcggctagttcatccgggagtagagcttggatatctgtgaaccttgcccggatcgagccacagttggtcaccaaattgtctagtgatgcttctagccgatgagagatatcctcaagcgttctctttacatcatcagacagaggagctatagctttactggtggtgtcttcctctgtttcatcgagataattcttgatatcaaatgagaacagatcggctaagacctgcaagagataatattgtggatggttaaggatcaaaacatgattggccgatctcagatttgtatcaacaaaaacttactggaatagcaggggcagctggttgttcttcctcttcgacgttgtggctgtctgcagccgatggagtacggttgcctgattctagctgcacaggaggtgaaggaggacgaggaggctgtaaaaaggacaaatgttagacataatcggccgggatcagttaatgagaggattgagaatatcttactggtggagccggtttgagagttggtgctaccgatttcttcttcatagcagttttcttcttctgtaactataagatcagtgagcagttggctataagt

SEQ ID NO: 42513 - DNA, 778 bp, Oryza sativa
tgttacttatgctgagatatatcgaatcctggtcatcattcatccattctgatgcattttgcactagttagcctgcctccctgagcagtttacatcgaatgcgtattgttttgttgtacaaaagattattatttattagtattgtatagaagaaataaacaaaagcagctctaatcaggtgaactatagctgcggctaaaactgggcaagtttttgcattttaacttatggaaaatcttgtttgtgcaactctccaaggaccaaagggatctgtattggccatgtttcagcacacggcaatgaggttcagacttcagaagtccaaactgatttgtgtcttcccttcccaccatgtactatactgattgctatcttgcaacttgaaactcatcattgaccaacagtttcatcgatcagagcctattaacatgcagagatataatatctaatagcatttgtgttcaagttggctcacatcttaagctatacttatatttctagagcataaacagtaataaattcataagatgaagaatggattgtatttaatacgtatcaaatatcgcattgaagtaactcgttaggctctggtcctacacatctaaagccatactactccattaaaaaaaaggaaaaaaaagataaaacattacttttagggatgaatttgaacgaatttggacttctggggacttgtcaaatttaatttatccctcgaagttgattttttttttcttttggacagagggtgtactgtagaatctagcagcattatgca

SEQ ID NO: 42514 - DNA, 1487 bp, Oryza sativa
atgatgtgtagcatgagagaaaatggatagacgaacaatgcgactgtctttacccaaaaggcgacggatgaaaatttgtatgatgaacggaacggagtgtgtacagtgaccaaaagatgtattagataattaggatcaatgtgacgatcggaaaaatacaaatatttatattaattatagattgatagatagagaagagatagatattataaaactttcaatcaactatttatttatttatttaaaaaagttattaagaatttaatttgcgttaaataaaaaaaagttattaagaagttgattagcgttaattacgtgacccagttagtgggccgagccttctcgtgtgtgggtagactccatatccgccgctggaaacgaagcgacgcttcctcgcccttatcacaaacgaaacgaagcggttagagagaagagggggggggggggggggctcggacaatgagaagatttttttcgctcttttttaagacggactcatttttttttcatttttttttatcattcacaaaattgaaatcggattggaatttgaggaacagacgaaaatacgaacgaatagagggggcgacgaccggaaaaatctaaatatttatattatagttattatagatttgcggcgcttcacagtccatgtcgcgtgtccggattttgtaccgcgcgaatcagcaatgaattaggaatcgaaggcagataccgatggacgaaaaaaaaattacacaaacattatgtattttttattaggtataggtaggtataggtttaaatatgggtcttttaaaaggatggatataaaaatagattttcgcaaatggttgatggaccgcgtacaaaaactgaatatataaaatttagaaatattgacctattgttgtaggaaaataataaagcgatatgtcttcactaactaagtgtaacaccctgaaaattcgaccaacgaaatcaaaacaccaaaaatacggattttcaaaaactttttaagtaataaattgcatcatgccgattttattcgtctatttcattggattttgatctcggaatttattaatcgcgaataatgaataactaactaggaataaaccctaaaaatcaagttggctaaaaaaataattaaaatataaattaaaataaagattaggtgggattggaaataaaaaaaatattatcacgaccatattagcaataattaaattttagtacgatggaatgagaattaaccctaattaaaaattcaaataaattatataaacaaaataggagtgatattaaattagggtgaatttttagttaggataacacaaatatggagtaaactttgtttatgcaaaaattagaatttatagggctatatttaaatagaaaatgggctaaaatcgggataaataggaaaagttactgttcattgcggcataggtgttcgatcgtggtccccctagccccgccccctcccttgcctgcgtgcgccgcgt

SEQ ID NO: 42515 - DNA, 23731 bp, Oryza sativa
cgcgccgcggtgcgccaccgtcgccgccgccgtcgtcgctgccgccgtcgtcgccgctgctgccgccggtgagccgccctccttcccccctcgcgtccaccactgccgccgctcgggtgggagagagccgagagagagagggagaggaaaagagaggccggcagagagaaaaagagagaaagagagaaaagaaagaaaaagagaaagagagaaaagaaagaaaaagaaagaaaaagagaagagagaatggaggaaaagaaaaggaacaataaatagaaaattaggaagaaattaaggaggttaatagttcaagaaaatctaaaataattagaatttaattatagattaattatggtcatagaattgcaaaatttaatataaattataggttattcttggtaatttctaaaaaaatcaattcgcggtagtagtttagatgtaattaacgactaaacaattagatgaatttttttagactattacagattagttttggataatctctataagtaatcgattcactgtagaagttcggatttaatcactaggaattttagacgtatatttggatctttatttgaattttaaccgaattcaaatcgtttcttcgcacgtaattttagagcccgagggagttgcggatccaagcgaggaccaagaaccgcaagactttgagcaaggcaagtcatcactatcccttgaacacgttgatcccaattgcgaaattatttcgtttataaataaaattgcatgcaatgatgaacattctacttgtgtttataccatgccttgattattgtttaccccttattccttcgtaaccatatttacgtatgagtccctagtcaattatgacaattgcttagaaatgctattctagaatcatgcatactcatatttatcaaatgctaaatgcttgggcaatcacctttgggaaggtaattgagatgcggcatgtggagacatgagcaccacattgccatgaaattgatgacatgatttgggaaaggaaaataaaatgaaaacaaccgttttcgactggggcagacggaggatttgggtggtatctggaaaaggctagtaccgtccccggtcaattaaggaccgagccatgaagttaaacatgaaacgacccccgtacaaccgtacttctcgaatgggtatagacctagcggattagatagccgagcggaggcagtatccctgcatagatggttcacccctgagtgaggcaggcgcgctacggtggggcagccgttgaggtagggccgagaggcatgctctacatcggtgtcgccattggtaggactgccatgagtgtgtgagagagaacttaacttgaaccataatttaatatgtgtgtgagacttctcttttccgggagcgctagaactcctctcactgctagaaacatggacgcctagagtgcatgaggatttaagttcatggagcgggtactgccaatgcgaggttatcaaaaggctttgccatggcgcgtctcatgtgttgggacgaggctcatgtgttgggcagtcgcagagtgcgggtaaagtgtacatccactacagtgtgagtaaaccaaatctattcgaatagccgtgctcacggttattgagtaccgggacatgtattacacttggctagactataaattctttaacttgtgtgggatgggatattacatgatgatttttatgctgatggagccacttcctgagaggtgggaatgtggacgtcctcagaaaaccatgacgactcaatggcggaaagctatccttgggatcacaatggatggtggacagaaccgtcgttgtttaatgtgaacactggtattaaaacttgatcagtctatgctaggttttaggcttatgaaaagaattacaaaacttgctttgcgcaaaagaaccatagccatcctttgaattcttctgtcatgtgcattattgctgtggtggcttgctgagtacggttggtactcacccttgcaatattcaaacttaatcagaggccggagatgaagcttcggaggatccctatgcctattaccaggagggtgatgaggacgatggcgctcaataggtcttagttacggtcgttgcctgtggcaatagcgtgccgctgccttaactccgctgccttacctacttctgtttttgaaatgtattccggaccgctcggtccgatgatttaagactgtgcctgcgggcttatgatgtaataattcgtactagactctcatgtatgtgcacttgatatttcagctataagttcgtgtgtaccagactacttgatccagggaaatggtactgtttacacgattaattcctgttataaaaacgggggtctaaggaagctcaatttgagaagttttatatcccgggagatattcattaccgtattcatttcactctatattcgatccatatctttattgataatattttattacgtttttatacaagttttcaattctgattatgtttctgaaaaaaatgaaaataaacatggtagatcaaattttcatccgtttctgttccattttcataactagctaatactgaacagaataattgaatgcggcaggtaaaatcgttgcagcaatactcatacatcaacctgaaacgaccatcctaggctgtgaccaagatgatatctattgatgactttttaagaaatgctagataaaaaagtattcatgttcggtatcaatatctcgaaatttcaatattattttggaaaataccatatttatcgattacgaatagaagaaagataacaattgagcacatctggcgctccatttcacacaattattttgcgagaagacagaagattaaaattgaattacaaattattttgctagatccccagcaagcatgatccatccagattattggtgcatagggccagcctgcgacatgttaagcaccatcccacaaatcttcgacgcacttgtaaggcccattgtcacagacgaactgcattccagtcagacccctctgctgggggagtttgctgattttgtctctctcttcctcagtgagctcccagtcgaaaatatcaagattctccttcatcctattttcattgtatgtcttcactaacaaaacatcaccctgctcgtacatccacctcaaacaaatctgcaccgcaaattaaatattgaagtctcaattaacatggtatgcccatttaatctcttaccttaaattctgtgaacaactgttttctaaattatttatctgattgaagatctgattgcaccgttaatattaaatcctcttaacaaaatttcataatataatattctaataaaacatatatgtgtttgacgttttgaaatagtgtttcatacgtgagaagaaaaaagtgaatgtttcaagtggaaccaacctgagcaagcgtcttgcccttggtttgggcgatgtcgtgcaggacgccggagtccatcaccgcggcgctgccccacggcgtgcccttcgcccccagcggcgagtacccgcacagctgcaccccctctcgccggcacacctcccgcagcgtcctctgctgccacatcgggttcatctccacctggttcgccgccggccgaaccacggcgaacgacagcagctgctccagcttcttggcggagaagttactgacgccgatggcgcgcgcgaggcccagccggtggcactcctccatgccgcgccacacgccctccatgtcgaacgccggcgccatctcctccttggggaacgggaagtcgtagctgcccggcgccacggtcgccggccagtggacgaggagcaggtcgacgtagtccattccgaggttgcggagcgtctccctcgccgccggcacgacgcggccggcgtgcaggtcgctgcaccagagcttggaggtgacgaacacgtcggcgcgggaggcgacgaggccgcgccggacggcctccgcgacggcctcgctgacgcagccctccgtcgcgtacagcctcgccgtgtcgaagtggcggtagccgagctcgatggcgcggagcagcgccgccgtggtttcctcggaggaggtgaaggggaacgccgccgtgcccatgccgatgcgcggcatggtcgggagcagcgcgctcgcaggcacctccgggatggtcgccattgccattgccgtattgcagtgtagtgtagtggactagacaaggacgtgtgtggctatatataaagaaaaaatggattctgttcaacgcatgccgcaatgcagacaacacatgggacgataatgaaggagaaataatgaaagagaaattcgatcggcttgatttttcgtagctgagtagttgatcacgttgaattatcaacaataattcagtttttctgatttacattgtactattattattagtttactagtcatgcaaatcttgcaaaatgattaattacaaactgtacatgtaatgcccaaagctatgtcacgtgcaaagtgatttgtacacaaggctgtgaccaagacgagatctgttattgtcttatcaagaaatatatataaatcttttagtatcttatcaagaaatatataaataatgattcgatttccctctgacaacctagaaatttcgacaatcgcaccaaccgggatggcaacgatcaggatgctgttcgtccacgatatgcgatcctcgccatcggctagtgagatggggtctggggactccactcatacctaagatgtggatggttctaacagtcatggctatttgttttttcgaacgcgcaagctccctgtatacgaatcaattgttattctgctccaacagttgtaccgaaataatgaataccttgagtaggtagaaatagaaaaaaacaagaattttcctaaatgagaaatgttttctttctaaaggaaattaaataatattaattttgattaatatcagaatatcgaatgagtttatgcttcactaattgaatgataaataactgcaagtaaaggagataggtggtttaaaaataaacccaaaattttaaacatgtatctaaaatcacaacaaaaatagtgaaatgaaattagctcgtcgggaatgcatccaaaatcattatagacccagggaattaattaatagttcccaaccacgggtggagtgaaatccaacaaaaatagatcaagagtcgtatacatttaaactaaatctaccatcttaaatttagcatcctaaataaatttctaggtagctaattaaatttgcaatgcatcatctatggacctatatatgtataccaggggagtaaccatttttcgtgaacgtgtcgacgtgttttaaataagtggataggtatacagcaattaatatacatgtatggtccatacattaattgatcgcagaacgtgtacgggaatggtgccgtgcccatgcctgccgcacataattaagatagatccacatcatgatccatcatgattatttagatatatactccactgtatctaagtagcttgctagacgtcaccatcccacaaatcttcaactgatttgtaaggcccatggtcagagatgaattccaatccaggcaggcccctcagttggggcagctgactgatcctctccctctcttcatctgtgagctcccagttgaaaatgtccagattttccttcattctcttctcattatatgtcttcaccaataaaacatcaccttgctcgtacaaccacctcaaacaaatctgcacgacagagtaattatatagtgaaactttatttgacctgattttttgtttggtttaattaaatattttatattcatttaatttctaaactttcgtgttttgatcacttttgatatacatcctttgattccataatttttgacgttttaaacatggttgggtcaaacttttataattttaactatcgataatttttaaatatttattttaaaagcactacaacaacatatttagatttgtcttacaaaatcctataataaaaataaaaaattatttatttattttatcatagtgattttttatgtaatttgtatataagttggttgagtttgatcacgagatataaacattagacatatatattgaaatattcacttaaagttttctttttaccggttactagctttcacttacaaacaagtaaaaacataataatagtatggtatcacagtataaggataaattgatggcttacaactgatgatatgtaaatatgttatattagttatttagagttgttcttttaaacatccaaaatatgcaaaaccactctccaaaactatcttagggagtaatatagatggtattgcaaagtttagggggttagatgttcggttttaaagtttagggtgctaggtggatttgcatccaaagtttagaggggtatttggacttttttccttgttaaaaattttaagaataatggaattggagggagtagtatatatggtatgaatttttctcctacaaaatttagaaaataagtatatcaaccaacctgagcaagcgtcttgcccttggctccggcgatctcctgcaggacgccggagtccatcacggcggcgctgccccacggcgtgcccttcgcccccagcggcgagtacccgcacagctgcaccccctcccgccggcacacctcccgcagcgtcctctgctgccacatcgggttcacctccacctggttcaccgccggccgcacggcggcgagcgacagcagctgctccagcttcttggcggagaagttgctgacgccgatggcgcgcgcgaggcccaggcggtggcactcctccatgccgcgccacacgccctccatgtcgaacgacggcaggatcacctccttggggaacgggaagtcgtagttgcccggcgtgaggctcaccggccagtggacaaggagcaggtcgacgtagtccatcccgaggttgcggagcgtctccctcgccgccggcacgacgcggccggcgtgcaggtcgctgcaccagatcttggaggtgacgaacacgtcggcgcgggaggcgatgaggccacgccggacggcctccgcgactgcctcgccgacgcagccctcggtggcgtaaatcctggccgtgtcgaagtggcggtagccgagctcgatggcgcggagcatggcggcggtggtgtcctccgaggaggtgaaggggaacgccgccgtgcccatgccgacgcgcggcatggtctggataagctcgctcgccggcacctccgggatggtggccattgcaacctgcagaagtgcacagtgtagtgtagtggagaggaggacaatgaggtttttctctgtgggtagctatatataggaaaagaatggatctcctccttgaggtttcgtgctgcaagacttaaacaacacaagtgacgatgaaggtaacatttttctaggtgaagcatgggcagggatagagctagagcgaaacagaatgtggtgttactctcttaatttactttactttagattaaagtttaacctaatacaaatgtctaagtttgtattaagggggtacatatacggtgaaaatagataaggtatagtttaaaaaattttctttatcgggttcctgagcaccccctaatatatactagctccgcccctgcatgggtaagttagtaagagatcaatatgcggtacaaagttcatttgcaatataaacctgaaatatcatgggataaacaaatgagcatctgagatttgttcttgttatcatgagtaattttttttgccacaagattaaccataagtaacttttttttttggaataaactatttagtggcatggataaatcttaaacaattatttatatatgctacggtagcttacaggtttgcaaatgctgtgttagttagtaccaacacaagactaattcatttttaccttttctattttactagtccatgaaaacttgcaaaatgtatgattagttgcacctacctgtacatgtccatgacccaaagccgcctaggctgatgtgccccgttgaaagcgatcgagatagaagtctgacgaagactatgacgatctattagttaccttattcagaaatgataaaaacgcatcgaggtttaggccctgtttaggctgtgtttgcttggggaggttgggaacaaatcttcttcgcacggaaaacggagcggtccattaacgcgtgattaattagaaattagctttttttttcaaaaatgaatcaatatgattttttaaagcaatttttgtatagaaactttttacaaaaaacacaccgtttagcagtttgaaaagcgtgcacgcggaaaacgatggagaggtgttgggaacccttgggtccgaacacacccttagtcacaaaacaaaattgttcacgctgtcacatcgaatgtttggacatatatatgaagtattaaatgtaggaaaaaaacaagagttaattgcactctggtccaccttttattgccaaagtttcactttaggctatcctctagctcatatttttactttagactaggtaagattatctttggtgcactttggaccgcccaagtcattttctttagctgcatctactctataatattgtaaacaattgcctgtgtaagttggaaaatattaccgggttacgggctgctgatgtgtttaaagttggaaaagtcatttatgtattcctaaaaagtttatggggtggtccaaagtaaaataaaggtaaagtaacctagcccaaagtgaaaaaatgtgttaaatggtggtataaagtgaagctttggtaataaacggtggccctaaacgcaatttactaaaaaaaacaattacacagattgtgtgtaaattgcaagacaaatcttttaagcctaattagccatgatttaacaatgtgatgctacagtaaatatttgctaatgatggattaattagacttaataaattcacctcgcagtttcctgacggaatctgtaatttgttttgttattagactatgtttaatacttcaaatgtgtgttcatatatccaatataaaaaccaaacccaaaaaatttttccaactaaataaggccataatctgaaaacgtgtaaaatgttgtgatattaactagagaacgaaatagagtgaaatctataaccgtagttctagagtgagtactacatgttattaacaatgtaaatatattaaacgacagagtattgtaaaagtaaaatttataaatagctgaaatttgaattgtggaacgaagaatagatgtaaacacagtatgagattaattgaaattagaaatggaagataaagtaaaattagcaattgaaattcaatacgagttaccaaacttgagtccctacaatactaaattaaactttggattaaaatgaaataataaaataattccgagtcaatataaaacaatacacaatattattttaaaattcaaaacaaaaattaaaacaaaactactcctccaaaacatggaaaatggttaattcaaccagtacaatgtacggaattggacttggtgattcttcactctctagtatgtcttgttatcattgtccatgtaatctctataatgattgattatagccttttaaagaaaagatgggaataaattctatgattaaaaaatatgtctctccctaattgttttctttatccgaccctgcatccatgtatgctcttgcttttgtcaggatgtatgtcagctatatactccataactcttggtcaagtatgctatagctagagctagcttatggcggccactttggttgaccagaaacagaaaggcaagtggctgatggctgatgacattgttccgcttgaagatatatgcttttttaaaataattataaagtacaacacagacactcacaacatacgtacactcacccctataaacgcacgcacgtaaaccctactcctacgagcatctttgaagactgagctgataaatcctaaagactgacgaagttactacagacgtctcgttgtggacgggtgcatcacatgccactaaaagcacaaaaccgttaaaatctaaaaaattctctcccataaaaatcaaacccaggatttaaggtgctactaaagtttaatgaggcgcgaagatatgtgctgatgcagtaatattgttgcttctttccatgcaaattctttgcccgtcgtgtgtcaaaaagatggggccactagccaccaatttttggaattatcggagaaaacagccttcccctcacacacagcctaactgttggctgcttacctggttcgttgcatcccatggcgactagcgtaaaacacaactacgaaaagcatttttccgtgggttcaaaaagtgttttttctacagagatcttacccgtctgcatcaggtgtctgggaaaataaatatttttccatgcgggcgatcaaccacatgaaaaaatacatctttccgtgtggtcaggttaagtggaccgcacggaaaaatctgatttccacgtgcgggtgcttatatcacctgcacgtaaaataaaaatcccaaaaaaaataaaatcaaaaaatccgaacccaaaccctagaagccgttgtcgccgtcaccatcgccatcgccgaatctgccgccacccacatcccctaccaccaaatccgcggccgccgcacgtggggagggcggcgccactccctaccgcctccttgttgtcatcggtggcggcggaggcggcggatccagccatcgtggcggcggcggttgcggaggaccgtcgtggtaccgcaccgctaaaatgcgggtcccgcgtgcaccgtgctgcctagcgatttttgagactgtgcaggcactgttttcacactgtttgacacggcttcatactgtttggcactgtttgagcgacgatcccgcgttgtggttacgcagaaccgtcgtatgaacagtacaaaacagtgtacaaacagtgattgaacagtgccgacgcggtaaaaaattcgatgtcatcgtggttccgcagtttcaagctgtgggactatcgcggtcccacgctttcgtcccgcgggaccatcggttttgtgttttggatctgcgggactgtcgcgattccgcgttttcgttccgtgggacggatatatttttatatgtatgtatataaatgtaaattattaagaataagtatatttgcaatttttttcccaatccctctcacctttcaagtgccagccacgccgtgctgaacgcgatgagcagcagctggggcaatcgcggtccgacgtgtcattgagggtgggaggcgaagcgaactaccccatgccgatgaggacaaattgtgggcttaaagaagacttttaaggctctgaaatgatagtcactttttatttttaataaacctggtttcaagagaatttttaggggaaactagttttacattccttattcagttagcatgcgttttgagaatttgtagtgtattggcaaatatttgggcggcatgttttgcacagctcgctgagctgcttccaaacgatatttttacagaggagtgattgttgggctctaggctgattcggtgaagtgattttcggagctagtaaaaagaagtggcttctgctgattaacctagtgaatcactttcagtcgcagaaacgctcctttcagaaaatcagaagcaggaggaggagctttacgtaccaaactcaaactgacccaaagtgtgtactggcagcagtggcggaggcagctgcccgggctccatgccatcgcaacacacattgctccacagcataaacatcatttactcattaattgcttacataattaccttgcttcctggttccaaggaaggttaattagatgactagcgagttgtaccacatcctaatcttgctttcctgatgtatagtagccccgtactctaactccttgacaataaacaaccaacatttcattgataaattgtaacttggcaacaatcaactttaagtctagataaacggtacaattttccatatatatatatagggcatgttcactttgatgcaaaaaaaaaccttaccaaattttggcattggcacagtgtcggatcccaaaactaaatattcggaaaccgacatgtttaactgtatcaagccctggatcagtagattgatacagcttcaacaatctggattttcattgcgtacatttgaacaaggctccaaaggagatgttattacataaattaataggggaatttacaagattgtggctaactattacagcagaagctatagagtgtctcaactctaatattttgctatagacttaaaccatctaactaatctagatttgaaaactaggttgaaataatgctaacttatatgattgaactcctggcttcggcaagaacttcaatttaactctggaaaaaggggtttgaagcaagggtgagtacaacgtactcaccaagctattatattcaataatgaatgtataaaaaggtaatatttgagtaggattacgattacttgcagaaggcagagaatatagaaatagaaagcctgatgttttaaatgtagcagcatttagtaaaatcttgaattaggtttctaaccaaagtaccatatgagtcccgatactcaattccgtgagcacggctattcgaatagattcaggtttactttactgcagtaaatgtacgctttacccgcaatccatgacatgccaatattcattagcttagtcatggcaaagcttttcggttactaacatcagtggcacctgttccatgaactctcatcctcatgcgctctgaacgtaacgttatcagcagcgagaggagttctggcgttcccgaggtttttagagagagaactggttgagagacccccgtcatctcaaccaggttttcacaatacacacacacttgagctcaacaaatcatttacctgcgcctcggtaaatgttatatttgcccttcgcggcataggtttgcctcctgcgcgaggacttaaataagaaccactgtacagaggtaccacctttgctagataacctactttgcaaggtctgtccccattctagaattgcggtcgtactcgttcgtttgacataagtagttggtaataactatatcgactgagacagtactagccacccggaaatcaaccaattcgtacgtactgtcccaatctaagttcattatatttttatgcaaactaactaggcagggctaagcaaagctagcccatatactggatcttgcatatgtatcaggcttactgtatctcaaacatcatgctattgactcaatgccatagcaatagtaagcagtatatagcaatactaggagcattttatgcctacaaaggggcaggcaattaattaacttgcccttgactccaacgtcgaataatatccaaggtaggcaacctgattatctgatccttgaaataccacaagttgccatccaaaataaaataaactctactgaagaagaggaagagccaaattcaataaaatccataaaataacaagaaaacgataaacgactaaaagggctagggtttagggtataacctatctcctttataaggtataaggattactgggctaatatgtgtaggttctaaaagattggagactaaagtggataggagattaagcaacatttgtcgcttatatttcatctgtgggttttagttgcttggagagtaagggatataactggttaagtgagtatgtggctagtaatggtcgaagttgggctttggtagaagaatggctaggatttacttgttctcgagtcgatgctgaaataggatagcatatcggctcgtatttcatgtataggttatgagtagttggagggtaaatggttgggatgatattgtagctggcgtggagtctagatagcaagctgattgaggtaggataaatatcagttagggtttaggtgtttgctagtcgttgctagagttgggcagcatggcgactagacttagcatcttctctagccgatgtcaacagacagtataacggctagagggataggaggtttgtgtgggtttagtggggcggaagtgttactccgacaaccgtgagtggcggcggagcggctaggatcacacagagcccaagagctaactgtgcggcgtgctgtggaggtcgagggaatagtgaagctccgaccgctgtacgcatcaaggcgtggggtgccaggagcagcatttcgatcttgggtttgggttttgccaggctttacaaccaacggtccaacgtcggggtcgatagaccgcacgaacgtccccatgaaaggcgtaaagttccaaccggcggctttttagtggctaaaaggtattttgaaaataaacggaaatattcgaaaagcaaatataagtttaaattgtaaattcaattataagatcaaatatttatccaaatggtatttgaataaattaaggaaatttaaataaaatattaaaatagcaaatttggtaccaaaatgtagattttgaatttagatgaatttaggtccaagtttcactggaatcggatctacggtttaggagatatgggcttctaaagattgggttttgaattaaatctagaaaagacaaaaatacactgttcatgggcccacctgtcagcctttctttttctttttcttttccttcttcttcctcccgtcatctccttctctcttctcttctggccgagtaacagggaggaggggtgctggggctccggtggccggggatcgacgaagtcggcggccacgcgtgttcccgcgcaacgcgcatccgaggatggtggtggccagtagagggagttagggaggaggccggaacggcgacaacaagagctctcttcggccggcaaaggaagtggttgtggtggttgctatggggtgggggagaaggggaaaatgggaaaaatgggttcgccggaggtagggggagtcagtggtgcaaggatttggctaggggaactatagaggaggagatcgaccgatggcggcgtcggccggacttgacaggagagagagaggaagagcttcaattcaagctctgataatgtgaggaggggaggacgatctcgccggctatttaaaggcggtggatgtcggttgcttatggcggtttcagaggagaaggcgagaggagacacggctgcggcggcacagaaacaggagcacggcgtcgactctatccgctgattggccatcgaaggcggttcggctcggcggttgatgtcagcggcgtgaggtggcggctgacgtcggcggcagttgcttagcggcgaaggaaagacggcggagttggagggtaaggcacggcgacggtggcggcgcgacttggcggcgacggcaaggaagcggcgacggcgtgtgcgtgtgcgcgtctgcagaaggaggaagggcggctcggctgtggtggctgggccggcttgggctggaggagggaaagggtttcggcccagtctagaaagaaagaaagtctaattttcctagagattcaaataattgatttagaggaatttggatggctagattttaaaaaggatttgaattcggagagggattttaaaataaggatgttctaatttatttgagtgcaatcttttgagagatagaatataacggaatttatttgatgcactcgattgagagggaagggaaataaataggatgttagcctcaaattatttggcaagaatttggagaagtatttgaggctaatgggaaacttggatatttggcgataaataagaataggtctgaaatcaaaggatgggtcgacaattaattccaatgaaattggaattgctttggtttaggttcaaaggtattgttggaggatttcttggaccacaattcataaaagtaaaaaggatttttagactaaatttgaataaaggaaattttggtcaaaagaaggtttaagatgcaaaatcaaatcaaagagaatacctcgatttaacaagatcaatttttagaataaaaaccacgaaaaattttaaatactagacagggattttatgcatgttagttttaggaggtccctctaattataatttcttaagtttaggaagttattaagaatagaagaatcggcatgatacatatttagaaaatagcaaatttttagtatgttacacatagttgccaaaaatttggcaacttactaaaattttgacaggatttcttaaatagttaccaaaatttggcagcaaactaaatgtagccacttttttgaaactttaccaaaatttggtaaggttgaaaatgacaacaaagtgaacaggcccatagtttttatctcttgctaggcttgcccagcctcaagaaaatcgattttgctaaacatcacacgggtgattttttcgttgatatttgacagatttttgcccctacaattatgcgtcgagatcagtacacgattctgcgtcgatgttgtcgtgaggtggagaggagacctcgtgggttacacgtttgccgctgatcacgattcacaagaaatttacatcctagctacgtgtaaatatcctatataactaaaataaaatataaaattacagtcctatttaactaaaattacatatgtaaattcagttgatattaattacaatcctatttaactaaatctacatttgtaaattcagttgatttgacatgtaagtgcactgtaattttgataaaaataatgtgtaagtaaatatgtacttattattttctttaaaatataaaattacaatcctatataactaaaattacatttgtaaatttagttgatttgacatgtaagtgcactttaattttgataaaaataatgtgtaagtaaatatgtacttattattttctttaaaatataaaattacagtcttatataactaaaattacatatgtaaatttagttgatatgacatgtaagtgcactgtaattttgataaaaatattattaaaaatattgtgtaagtaaatttgcattagttattttatttcaaatataaaattacagtcctatataactaaaattacatatgaaaatttagttgatatgacatataagtgcactgtaattttgataaaaatgttgtgtaagtaaatttttattagttattttattttgtaatccgttggatgcaaatccaagggaagaaaaaatctgggtgattttttctcaaaaatcacccgagcgatgcataggcggtcccaaaaaaatttatggctccgccaataactggcagcaaagcggcatgaatttctcacaacgggccacaatattgttgcgggccggaccacaacccatcgtaacaaatgccttcctaactaacaagcttggcccaacctttctcgcttttcctttgtcgtcggtactaggaataagttcaccggagatccctcaacttaagagcgagattattttagtgccttaaccacaaaaccagaaatatatacccctaaacttacacaaaccgtacactcaaggtcctataacagcatacgtgggtggttttgctgacgtggcatcctagtcagaaaaaaaataaaaaaagtacgtggagcccacatgtaagattcacatatattttcttctcttttctcctcctcctcttcccttttcttcttatcctcttcacttttctcttcaccagcggagcggcggtgggcagagcatcgatgggcaagcacgacagcggagcggcgggtgtgcacggagccacggcccataggtcacgagaggttcggctgtcggcggtgccggccccgacacaagagaaggggagggcgtcggcgtcggtaggagagctaggcgcggggggagggggagagggggtgggttggggagtcagcaagccgcgggcggcggaggcggaggcgccattgccacggaggtagcatcgtcagcgactggcgtctgatgatgagttgatggcgtacatgaagtattaaatataggctaaaaaataactaattgcacagattgtgactaatttgtgagacgaatcttttaaacctaattgctcaatgatttgacaatatggcgctatattaaatatttggtaatgacggattaattagacttaataaatttgtttcgttgtttactaacggaatctgtaattagttgttttattagtgttcgaagaccccatacaataccttatataatatgctatgtaaaacgctgaaactttacccggctgtatgtaatcaccccctgaacgagaactcatgttctaatatcgagacgcggtcttgaccgtgtctccgtctacagtgtggtgcaggtgaacagttgaacagtgcctgtagtgtgtatgcacaatgatttgtcgttagcagcgcattcaattcattaaatttattactcctaccaatccgtcctacactccacagcggcggctcttttctctcgccatctaagaaacttcctcatccagagttgactgagtccacggtaagacaaggcttcattcggtacagcttattattgcccagtgtttctcgaagcacgcaaaagaacgtatatatattactacctccgtcccaaaataagtgcagctatagatattcgagtccagcgttttgatcgtctatcatatttaaaaattttatgaaaaaaattaaaaatattagtcacacataaaatactattcatctattatcatctaataacaataaaattactaatcataattatttttcaaataagacgaacggacaaacgttgagcatgaacagtgttaaaactacacttattttgagattgagggagtagcatattactccatccttccaaaaatctgagacctatttattttttatcaaaatcaagaagcaataaactcactcactatgtgacaaaaccaataagcatgcaaccaataagtattagaatgatttcttgtttttcgatcaacaatttaatttagcacatggtgactatcaataagactcagatttttggagaaacaaggaatgaaataggtctcaaatttttggaaggagagagtattaattaagtattactctctccattccaaattgatctacatatttcatagatacacaaagaccaagaaaagctaataactctctcatattatatttactctagcaacaaactcaatgcatgcaccatccccactatttcctagccaatagcaaatcaagatattgcatgtgggttataaatacatgtgtacatggatacatgcatcaatgtccatttactccaatatacaaataacgaatagatataataaatgaacacaaatatggagatcatttaggaacaacctcaaaaaaactatatgtagatcaatttggaatggatggagtaactaatactccctccacctacttttgataggcatatttccaaatctgaaaaaattatttttgataggcatatttcaatctaataacctatcatcttaatgaccttctcgcatttaatgtgtgactctccattcttccatacaagattggctacataggtatcgagaaatgcaaatattaatgaatcgcttgtttacgaggaatgactagtagcatgtttaaataactgataagtagaattacttatccttagtctatgtgtcaagatgaaatatgactattaaaagtagatggagagagtattataaattttaaaatagatttattttagctttataaagaaactcctataaaaaaagtgcttttaataaaaaaaggagatagtaggagtaccatttaacaggtagataaggttgtgttcgctggagcatgttcccaactgaaacagtgcacacggtaaacggaacggcctattagcacgtgattaattaagtattagctattattttttgaaaaatgaatcaatatgatttttaagcaacttttgtgtagaaactttttgcaaaaaaacatcgtttagcagtttgaaaagcatgtgcgcggaaaacgagaaagataagttgggaaacttgggataagaacgcagcctaaggtggtgtttagatccagggactaaattttagtccctgtcacatcgaatgtttggacattaattagaactattaaacatagactaataataaaactaattggataaatgagagctaattcgcaaaacaaatcttttaagcatgattaatctataattagcacatgtttattgtagcatcacataggctaatcatggattaattaggctcaatatattcgtctcacgaattagtccagggctatagaatgggttttgtcattagtcaacgtttaatacttctaattagtgtcaaacatccgatgtgatagggactaaaatttagtcgctggatccaaacaggcctaaggctgtgttcgcgggaggatgttcccaaccagccattagcacacggaaaacggaacggtccattagcgcgtgattaattaagtattagctatttttttcaaaaatagattaatatgatttttttaagcaactttcgtatagaaactttttaaaaaaacacaccgtttagcagtttgaaaagcgtgcgcacggaaaacgagggagatgagttgggaaacttcgggcaagagcacaccctaagagcaggtacaacagcaggctataggccagctataaacatattttaaagagataaaggaagagagagaagagcagcgggttacagatttgtagccagctgcagcacagactccaagacgtaatgtatgtatgataggtgggaccatgtattaataatatagtaagcaactattatatgaattgactattacattggctatagatgatttggagctagtagtgggttatactattaaacttgctctaaggttgtgttctttccttcaagttcccaacccttctcctcgtttttcgcgcgcacgtttctcaaactgcttaacggtgatttttttgcaaaaagtttctatacgaaagttgcttaaaaaaatcaaattaatccattttttttaaaaaaaatagctaatatttaattaatcatgcaataatgcgtgctccgttttacatgccggaggaggggttcagcttaagtatagttacggaaaacgagtatcgaccactagctgctttcgtttacattctgaaagagagtgaagactggttacgccccacgtggatgattccattccagtcgcgctcgcgccagacggtcgatgcgcgcaaagtcagggtcagctcttcaatttgagtaccaactatagataattaaatactccttatatctgaagtattattgtatcctcaaatctgaaggttcctttgctacactacagatatcgatcgaagaaaactagtccataggtagataaatattgtatcgttgaatctctcaaggtcgtttcctttgctttgctagctagctgcagaagaaaggaaaagctatagctattagagagagaggagggatcagaagaagctgctagctgctagctcgctgccggccggccggccggagaagtacctctaatatatataagtccgtcgatcgtgtcagccatcgccggcgccggcgttgatcaggaccatcaccatgcatccaccatactgaaatctctgtggaataatcctatatatcgcccaaggtatgttactactcccttaattcccttcgtgttcttttgtttcgaactaagtagcatcatatatttagaggaggagtggtatgctttagctatatggacttcaaaattaaccatagctgatgtacttgttcttctgcacaaaattaattaacctaacctcgtgaaattgcctagtaagcacaaaccaagatgatttagcaatctccattccatatgagcacacgcatgacatgagagagcaaattaagtcagcgcaaacgccgtagtgcgctgctatgctgaatagcaattaaggttccagcttgcactggttctggatcaaggccaattcttcattaggctactaactaaggggatttaatttctgggtccgaatttagcaagatttgttatattggattatccgagcagcaattgatcgagcttctttctgcgagtttgttaatactagattaatctgatgttttctttgattaccttcggggaattaatttgtgagtctatatcatggtaattaatttatttaactttttttttgaaacttaaacaactttattaacaaagacagagttaaggggatacaccctagtacatccacagatggatacaaaggtagcagaaacaccatctttaacgagatagagactaaccatctaaggaaacaaacttccagatgcgactaaacagcagaagaggaccagatcgacggagctttgcggcactgccgcgacgactgaatccttgggcctccattggtgtgcacaccgtttgacagaccgaaaggctcctacgcctgccaccgcggtaacggcacaaatcggaggtttgatactgagccgtagattttggtgtatgcatcaccggactcagcaaagtggttccacggagtccactgttaaatctgaggagcaaaaattgctcaacccgaacggtagacccagcatggatactgctattttcgaacaaaaggaaatttgattctaaagaacagctagccaatatcacaaagttaaacagatggttgtgatggagcttctgtctttctaggtggccaaagattgctgagatagagagccactgagtcagatccgacaaaagcaaaagtaatgaacctttaatgttcaccgccggcgtcggcaacaaggcatccgccatctggaggtgttcaaggccatcggctgagagtagcaaggagggcaacagcttcgttcttgacttaattaggtcatttttttgcaaacacgcaaaagacttatgcattgatataatattagaaggaagcaaatagttacacgcgcaaaaggctttgcttcaactggtacaggtgttttcatcaaccttatctcttttttcttcatgacgtgtatgcttaacgactttaatatgtatagctctgatgctgcatttacatagaatcggttacatcaattagctcacacttctgcaacacaatattagccctccattgctaccaagtactgtgcttgcatgcttgaaatggagagtgctaaaaatatgaggttttctcatatgttttgtgcacaggaatacaaacatgtgtgcttttatatcacaaatttgctctatatacctgtgaaatttgctatattgtttctattaaaacaagtttagaagaattgatcctacaactgacaatctactccttttggtcctgcagcttctgtgttcaacatattttaattaagattggtattcttatgcttaccatgttatctttttttttaattattttggcagagacagggtggtcaacattgagggatctgtaatgttggtatacgacacagcttgcagaaaataagattatgattggaaatatcacacgatgctatgataagttgaagttcaaagtagacatcaatcagaatattaaggttttcacagaagatgagattaaacggattactagcaacttcagcattccgatcggacaaggcggctttggagaagtgtataaagggactcttgatgatgactatgatcttgttgcggtgaagagatatattagcaaagatttaaggaaagagtttatggaagaagtaagcatccatagtcaaatgagtcacagaaatgtggtggagctcataggctattgcattggagaaagtactctaatgattgttactaagtatatctccaaaggaaaccttgatgacatactccacaacagtgacatttccatccctttggatgtaaggctgggtattgct

SEQ ID NO: 42516 - DNA, 5107 bp, Oryza sativa
acacaagcagtaaacactcattctcataatatatcatctaagctaagtggaaagaaaagagaaagaaaatctatttctatacttctaatatacatagtatacatacattctagttaactgatatactagctaataccctctatcggatgccctcctggtactttgagaagccacccctgactgccgagttccttacaacaacccgtcatgaccatacaactggggctaaatacggaggaatactctccctagggaattaacttaggattatataccggcgcggaggaatacccgtactgagatgtcaccatcagcggcccacctctcatcctcaatatataaccccaaataatgatatcccgtaatctagacaccacgtctaaactaccagatactactctaatatcatcgtcatgacatagagtaattgcatatgcaaacattatacccgcaccaaagcatctcctagataagctagccgtatattcagtataacatgaacataatataaagtaggtactcatatacttgaaagtatttcaataccataaatgtatttagaagagtattctaataaaagtacaaagcttacaaaagagaagagaaaagctactagagccatacccgaactcttccgaaggcttccggactcctgatttctactctatccctattccaccagctagatactactaaactaaacttaagagaaatgagagagctattgcttgaggtgtgtgttgaagtgaagagagtgaactccttaaataggcaggtaatgacggttatggtggttagaaaggtcggtaataccctccaaccgccatagggagtgaatctccaccgttcccccaaaaccctgcatccagcggcttcacggtaggttcggccgaaccaggggccggcccaaccagcccacatttttgctggtggcctcctctggtattcctctcagtagacttgtgaattttggcccagtgtgtcgtgttaattctgagttcttggcccattcatacataagtctggttctcgacatcgtccgattgatttatcgtctgagttgatgtcgattctcctccattttattgtcattctctgcaaaaggttagtatacctactactagtggaatattattattctaacatatttatgctttgcaagcatcactagttctcctctattttggtaatattgacggtcgaaactgatcgataacgaccatcaacaattggcgtgccccgtcatctagttattagaatgtctagttaacagatcaatcttctctctcaattttccctccccttcatgtcgtacaaaatcgtaaagtggcatcttctcgcagaccatgatactttggattgcttctttccaatttcatttgatgtgctcaaatctctgtcagattctattccaaagtcccttggaatcaagaatttttggaacgagtgctgcgaatgtcttttgccacttgtctaatgtaacatgcctttggtgccgccttgtacttagatggaacactgggatcattgaagtcaaatccttgctgttcaagtgttcatttggagactctttaagtacatgtgttattatttgcacttctttggtaggcattccctcgcaagtaatcaaagtcctgaagtttcaaactcagtactttgtttaatctgctttgtgcgaacataaacagcagtaaaatattgcaattacatactagtgatttttgatttgctgatcttgtttgggataaagaaaattacctgtgtacagtttgttcatattttgcttcattatgcctaccactcccctggctggtgctgcactgctctgcctccccacactgcctgtacctcgctgctccaggacatataaatcttcctgctaattagcaatgatcagtagtccagtacatactcaagatcaaatcaatttttgggacctgtacaaatttcctgatggttccttctacaaaaattgaatgtgcaatatctgaatgttgcctatttttgcatgtattgttttgctgaaactgagtgtgaattgattcttgtgatttttttttacagtatgtcagttccatttcagaaagcttagaaacaatgtgatccaaactgaaatttagttttcctaagttgcactatgtgattagttttatctgtatacatccaaatgaaaaatagtatgcatctaatcttgttcacattgagggatatctctgaggtaattactgccctgctatttcggtatggtatgcatatattgatatatactggtccctgcttaatttatattgggctttacatcttcagaatagtccagaatgctttacattacttttatgagctaaattaacatttgttcttaaataagttcaccggccttgaaatatacaagcatttgccagaatacattctaaacatctctcttttgtcgaaatgagcgtttttgtgtgtcgaaatgaaccggtaagaaccagtttggtatgctccgatctttttgtttgtttatgtataataacttaaatgatagtattattatttgtagaaactatgatgatgaaacctataacactttaaaacatgatgaattcaaaccacttttatgaaattgataatgatcaattgttggtggaagaggaaaacaaggaagattcttatgcataacgtatgcctggatcttattcaattcttatgtgtccaacaataggtgtgtcagcatggaattgaatttggattggtatggtgtgaacctttgatcccatatttgtatttttctttggacatttgagctgaatgtcagttgaattagacttattgtaaagcaaactttatatgtaaagagggcatatctgttaaaagatatttggttaattccactgacttgaaaagttattttttaaaaaggaaaatgtgtgctcctgcttctgatgatattctgcaatgagtatattcttgcagttgcagtgtattagagttcatttatattgcctaatggcatgcatagcacgtacacgcttactaatgtgtagcagggtttaccaaaccgtttgagggtaaccctacgtttgacggttactggctttgtttggcagccagttctgctgcagcagttgaaaatcgctgcagctggcagccgttttgaactgctgcagccgcagctgctgtcgaaaaatctcttccgaacacacccactgcggtaactgtgaggtataccgtggtttcaaaaactgaaaaggttatcgcatgtaataacctggataaacgcatgataaccatatggatagtattatgttgtatattattagaatgtcttgttaacaaacatcaatcttctctcaattttctttccccttcatgtcatacaaaatcctaaaaggtcattttccattttctctcagaccattgtactttggactgtttcttttggaacttcgaacacggctttggtacgtttgagtaaaagtgtacaaccacctaaccctccgtctcaaaaataaggatacagattcatagtatcatagtattatcttaggatgggggtgtcctatagtatggactaatatattaggatggtgaaaaatgacgtaaaccttgaattactattttttatttatttactgcgttcaatttaatttaaattaatctgtccctaacaatgtgatgctattaggcccatagcccgatacattaggccgtcccgtttcgaattttttacatttttaatttttttaatatttacagaaataatctatcggcgaaaaaaattaaaaaaaaatagaccctgccgccctccactcgggcggcaagctgacgtggcaaacgggggagggacgggcggtgacggcagacgggtggcggagggttttttgcacgaaaacccttgcgcccgatgcaaaaaagccagcccggacaggccattttgcaggcggccccttgccgccctctggccgggcagcaggcctcgctgcttataaaaggcctgccgccctgcccctagccctcattcctcccctcacacctctagtaaaaaaacaagaaggggggagaagagaagaagaggcgaagccctgccggattcagacgccgattttaggtaatattcatagatcctatatgtgactattgagttaactaatgtgtattttttaaaactttgtttgaataaatacattatatttttagggttttacttgtactaatctagaactgcatactgttagatatcggtaactatgtagatctgctagtttgaaatcaatactttaccattacattagcatacacaacaatatattacattgtaggcgtttattacatgaaagaataatatgatctagttatttcgttgacaaatatgtccaacaaacatacatttcaagtttaccatggcctaggaaacgtccgttacgggccaactggggtagatctgtcaaaatttattgtaacaccaaggggaattgatagaccggctgagaggagtgtaccttctataaaaggatggttgatgaggggcttgagagttgatccacagacaagtgacataacaatcaatgttatagtaagtcgggcaactgagggtttttattgggaactaatgccagttcaaaactctcgtatgtggagatggtatgtggagaatgcattgcaacgcgggtggcctctagctatggttccgtttgttcacccgaaggatctaggtgtgcagatgaacatggatgatggcgagggaccaagtgctgaagtaaatgagacttttgtggaagaggtcaacgcaccagaggaaggtggcgtagtagctccagtaggcattcaacctggttgagtagccaacgagggggagactgtcggtaccattgtggatgaaatggagagagaggattttgacaacgagcgtgtagaggaaggtggttcgtcagatgatgagacggatattaatccagccgaatgggctagtgaggatttttctggtctggtcgtctctgaagaggatagtgtgagatgggaatacaaagaaaatgaggttattcagggagcgatttatactagagcagaagaaatgaaggaggcggtaaagcattttgtagtgtcacttcatagagagttttgggtt

SEQ ID NO: 42517 - DNA, 13829 bp, Oryza sativa
ttctcaacattttggtttcagtttcagattcaactctgaagatttttgttctgtgagaaacaacagattccatatatgaaggtataagatatatactggtattgcaaacaaataattaaccatattctctgcaggtaaaagattttaatttgtgtcaagaaatataaggtagtatttacccgcataatttggagatatatgcaacttcaatagcaacgcacaagttgtacatctaggattttggtacatatctccataacaattccactccagttaggaaattgtttttgcctcaacaaaaagaagaggaaattgttgcacactcctaaattatttttagttagtttctctcttttttatttctcattaaagtttttgagacttgccatcagttatgaacaacacctatcttctttttagttttttaattgaatatcacacatgcctgcatggatctcatcagaaacatagccacgtttgtagtgtactgtttagatgctccatactgatatgatgattagatatgtttcttccacaacatcaatcccgacatccaaatcgtcagaagttagcaatgttgcatttgttaattggatttgccaacactaatgcttgtgggggtaattatgattacacgtgcggcgccaaagcataaaagtgactttgagcactcaaaggggacatgaccacccttgttaatttacttgtattttaccaccattagtgggatgtatgacatgcataatatgacgtacacatgcaagttaatgttaattatttgagcaaattaagtatactatgtacataaacatcacattcaccatgtctaggtctagtatctattgatgcatcgtcggtacccaatgtgctcaatgatacatgtcacatagaccatgagatgtttaatgatgttgacctgccaagtttttgtacaattttttcccctaaatgctttccatatttctgtactgagaattctaaaattgatatatataggacgccagacctttttctctgaatagtgtgtgataatctggaaatttattttttttacggggaatctggaaatttatttaatatgcacgcgtaatggtgtgcgtgcattttctacaaaaataatagcaccttaattattagaattctagttattgagttcacaaccatgaaatcaaataattactttattgaagattaatagataaattatgcttaacaatcttaaataatagaattttgttaattggaatgccattggactacatgaatctaacctaattgacccaaagaaaaaaaaaagaagggaacacattgaagttaagaacatcattagtaaacgagattgggatgaggccgtgtgaaatgatctccataattaaaaccacttaaggatatatctttagcacggattattcatgatatccaacgtgcgaattatgtacttcatccaaccttgatctacaccctaccaattaagaattaataagaacaagaacaccaacttgatgcgggtagaatattggtgccatatgctgttatgcgcagcatcagtacactcctagagaagttaatttccagagtaaaaagaagaattaatttgataaaataccactcatttatagatgaatatatatataaggccttgcctaccatacatttcctttatatatagtttgctaattagttcatagaggattacataactctttacatatgaaactgaatatatactcgcataaatattatcatattcaattttgtttctccatcactaaaaaaacataacagacaaaaaaacatgatcttatcacatataaagtgcaataataatgaagatagaaattattaaatcacaagggccctaataggaagcagagtaaagaggggagcattatcatctctaatgccaataggaatttttttaaagaagttgatgtgatgtccctcccctggtagccctcctgtctgtgatggaccactgaattttctccccttaactttctgagtgcatgcagcacaattctgcctttcccatgcacacacatgatttcccattgatccctaagcaaagcaaccttgatatgcacacaaaaatatatatttgcaggaactttaaaaatccctttttctaacatcacatctggtgacaagtaatataatgcagatctccccactcaaccagagacacaatcactgatgttactcgttaaacattattctgcacaaatagatatgtgtctgaactctgttaaaggttttccatatcgtatcaacataaaaatgcttatgtgtcggttaaattttttttagagtatattaaatcaaatataatttttggctctgaaattgggactgtacattgatcgatgtaccgctcgcggtctgcttttggttctccaaggacgctttcaccctggttagggtgtggccgtgtgtttagttgtttgggcataaagttttcgaagtatacagacgcatatttgaagtattgaacgtagactaataataaaacaaattacatattccgtctgtaaactgcgagacgaatttattaagcctaattaatccgtcattagcaaatatttaatgtcgcatcacattgtcaaattatggtgtaattagcctcaaaagattcgtctcgcaatttatatgtaaattgtgcaattggttttttcccacatttaatgtcccatgtatatgtccaaacatttgatgtgacgtttttgaccaaatttttttatctaaacaatgccttaataaattgacattaagttcctccttactgtcccacacatgtttttttattttgtacatgagattttctcagctatttactcgatgatatgaatccagaggtttctcaaagaaaaagaaaatccgagtcagattttatgcatcctctgtgcacttgtctctgcttataggaaaaagtacgaattacccccctcccgaactatcacgatcgtccgaattatatttaataaaacaatgaatgatctctaccaaccaaacaatatctcctaggctagtatgtgtttttcgcgttaccagtggcgcacacgtggtaatctagtcagcattttatttaataaaacaaatgtggggcccacctatcatactcttcttcctctctctttctattctctctcgctcttttctctctcacgcagcgcgcacggcaaggacgggcggtgggagtgggcggttggcgaggatggcacggggataggcggtcggcaaggatggcgtagacggtagcgcggacggtgcggacgtcggcgtggaggcggagacgacggaggagcgtggcggcaaagctagctaggtggaggactccgactccagtgactcgttgatgctattggtgaggtaaggacggcggcgagtagggggcggagccagttgtgggtggcggagggggcccgaggacgatggcggctggcgacggaggcggaggctgaccgggcacgcggggacgcgcggtgggcgatgggctcgtcctcctcgtcgtgggcgcgtggggacgcgcggtgggcggcggcctcctcctcagctgtggcgcacggggacacgcggtgggacaccgccgctactgcgggctcctcctcctcgtcgtgggcatgtggttgccgatggcgcgcagggactgcggtgggcggcgggctcctcctcctcgtcgtggacatgcggtgggacaccactgccaccgcggctcctctttcgagccatcgagccgcgtctcgtcctacctccccgcgcctcgctccccgtccgtctcacgcctctcctcgtccgccggcgatgcgccggcgccggcgcagagaaccgggcccaagggcgggaggaagagcgtgccgccacgctcgcctcacctcgctctgccgccatgctcctcccccgccgccgctgccccgtgatagagagagagaggaagaatgagacacagatagagaggaaaagtgagagagaggaagagtggaagagtatgacacgtgggtcccacatttttttaataaatagaatgttgactggactagcacgtgtacgccacgtagaccaaaatcaccgcggattgagtaggggggtaattcgtccggtttgcatagttggggtgaagaatgtccggttttatggtttagggggtaattcggatgaccgcgatagttcgggccgggggagggggtaattcgtacttttcccctgcttatatgatcattgtatgaaggcaaggaaacccctgatggctactttggcgcttaggaatttcactgaaaacaattcattttccacataaactgaataaaaaaactttttttcgaggaggcgagcaggagttctgccgtttcatattaggagaaaagacttaaaaaaaaacttttgtacaggagtagcaaatacagtaaagaagaaaaaaaggcaacttcaggctaaaattttggcaaactacatttgggccagctcttcttcctttgatttgaaaagtaatccaaaggaatgtttcctggaccaaaatcccctataaaacccacctacactgatagttgtccaaggcagtatcaatccaactcacaaacacaaaagtgtaccaaagcacccttaactggtgatgttttataaacaccacttcaaaaaaaaaaagaagagaaaaagccatctttatctctcaaaagcagaggattacacaccataagccataatctttctttgtaaaccactgatcatcatcaagagtgaccaacacaacacttgctctcactcaccctctgtcactcttttcttctccatccatccatcctcattgtcccaacattgcatccacatgccaaatggacattctcatcccacttctcctctcctcgatctacgtgtcgtcgtcggcggcggcggcggaaaccgatgcggcggcgctcctccgcttcaaggcgttcgtccacaaggatcctagaggagtcctctcgtcgtgggtggatcctggtccatgtcgctggcgtggcgtgacgtgcaacggcgacggcagggtgacggagctcgacctcgccgccggcggcctcgccgggcgcgccgagcttgccgccctctctggtctcgacacgttgtgcaggttgaacctctccggcaatggcgagctgcacgttgatgccggtgacctggttaagctcccgcgcgcgctgctgcagctcgacctctccgatggcggcctcgccggccggcttcccgacggctttctggcgtgttaccccaacctcaccgatgtcagcctcgcgaggaacaacctcaccggcgagcttcccgggatgctcctggcgagcaatatccggtcgttcgacgtgtccggcaacaacatgtccggcgacatctccggcgtgtcgctccccgcgacgctggccgtcctcgacctgtccggcaaccgcttcaccggcgccatcccgccgtcgctgtccggctgcgcgggcctcacgacgctcaacctgtcgtacaacggcctcgccggcgcgataccggagggaatcggcgccatcgccgggctcgaagtgctcgacgtgtcgtggaaccacctcaccggcgccatcccgcccggcctcgggaggaacgcgtgcgcgtcgctgcgtgtcctccgcgtctcgagtaacaacatctccggctccatcccggagtcgctgtcgtcgtgccacgcgctccggctgctcgacgtcgccaacaacaacgtctccggcgggatccctgccgccgtgctcggcaacctcacggcggtcgagagcctcctcctcagcaacaacttcatctccggctctctcccggataccatcgcccactgcaagaacctccgcgtcgccgacctgagcagcaacaagatctccggcgcgctcccggccgagctctgctcgcccggcgcggcgctggaggagctccggctgccggacaacctcgtcgccggcacgatcccgccgggcttgtccaactgctcgcggctgcgggtgatcgacttcagcatcaactacctgcgcggcccgatcccgccggagctcggccggctccgcgccctggagaagctggtgatgtggttcaatggcctcgacggccggattccggcggatctcgggcaatgccggaatctccggacgctgatcctgaacaacaacttcatcggcggcgacatccccgtcgagctcttcaactgcaccggcctcgagtgggtgtcgctgacgagcaaccagatcaccggcaccatccggccggagttcgggcggctgtcccgcctcgccgtgctgcagctggcgaacaacagcctcgccggcgagatccccagggagctcggcaactgcagcagcctcatgtggttggacctcaacagcaaccgcctcaccggcgagatccctcgccgcctcggccgccagctcggctccacgccgctcagcggcatcctgtccgggaacacgctggcgttcgtccgcaacgtcggcaactcgtgcaagggagttgggggattgctggagttcgccggaatccggccggagcggctgctgcaggtgcccaccctcaagagctgcgacttcacgcggctctactccggcgccgccgtgagcgggtggacgcggtaccagacgctggagtacctcgacctctcgtacaacagcctcgacggcgagatccccgaggagttgggcgacatggtcgtgctccaggtgctcgacctggcgcggaacaacctcaccggcgagatcccggcgtcgctcggccgcctccgcaacctcggcgtgttcgacgtgtcgcgcaaccggctgcagggcggcatcccggactccttctccaacctctccttcctcgtccagatcgacatctccgacaacaacctctccggcgagatcccgcagcggggccagctcagcacgctgccggcgagccagtacgccggcaacccggggctgtgcggcatgccgctggagccctgcggcgaccgcctcccgacggcgaccatgtccgggctcgccgccgcggcgtcgacggatccgcccccacggcgcgccgtggcgacgtgggccaacggcgtgatcctcgccgtgctggtgtcggccgggctggcgtgcgcggcggcgatatgggcggtggcggcgcgggcgcggcggcgtgaggtgcgctcggcgatgatgctgagcagcctccaggacgggacgcggacggcgacgacatggaagctcgggaaggcggagaaggaggcgctgagcatcaacgtggcgacgttccagcggcagctccggaagctgaccttcacgcagctgatcgaggccaccaatggcttctccaccgccagcctgatcggctccggcgggttcggcgaggtgttcaaggcgacgctcaaggacgggtcgtgcgtggcgatcaagaagctgatccacctgagctaccagggcgaccgcgagttcatggcggagatggagacgctgggcaagatcaagcacaagaacctcgtccccctcctcggctactgcaagatcggcgaggagcggctgctggtgtacgagttcatgagccacggcagcctggaggacacgctgcacggcgacggcggcagatcggcatcaccggcgatgtcgtgggagcagcggaagaaggtggcgcgcggcgcggcgaggggcctgtgcttcctccactacaactgcatcccccacatcatccaccgcgacatgaagtccagcaacgtgctcctcgacggcgacatggaggcgcgcgtcgccgacttcggcatggcccgcctcatcagcgcgctggacacgcacctgagcgtcagcacgctcgccgggacgccgggctacgtgccgccggagtactaccagagcttccggtgcacggtgaagggggacgtctactccttcggcgtcgtcctcctcgagctgctcaccggccgccgccccaccgacaaggacgacttcggggacaccaacctcgtgggctgggtcaagatgaaggtcggggacggcgccgggaaggaggtgctcgacccggagctcgtcgtcgagggcgccgacgccgacgagatggccaggttcatggacatggcgctgcagtgcgtcgacgacttcccctcaaagcgcccaaacatgctgcaggtggtcgccatgctcagggagctcgacgcgccgccgccggcaactgccatataaattcatttctgcagagagcttgtgattaatcgaccatctctgatgatcacaaacgaacacataaaaagacgcaaatgttgcatccagacatgcatgttccttgttgttggctgtttaatcttgatgcgatttattcatttgtgagctctagaatttccaagttatgactaaattttgaataaatttaggctggaaaaattcaaactggatttgaatacgtttaggaacaaaaaactggtagatttgcatttgaaaaaaatgagagtacattctagtctttcagctgttacacaatatatataagcaagacaactcagtggtatattggaccaataacacaattcattgctcttgagcagcccattaacaggtttttagttgtggcccagtaatctcgccatcccaaaactcatcagtggttttgtatgggccagattcgtggacatagaaatcacggtttcccctgaattccgggagggcgcttatctcctggcgatcagcatcggtgagctcccaatcaaaaatttcgaggttctctctcattcttctctcattgaagctcttgacgattatgcaatcgccttgctcatgcagccacctcaggcatacctgcaatttcggtgaaacttatatacatattggaattattcctaaaaactttgccatagatagcatggtgttcaataccacagatattgatgaattttttgtcgactataaattatctttacatcactgaaaatttagtttatcataactgatccaaaattaagacgtattgtagcattatatatgtacctgggcaaccgttttgcccttctgtacggcgatatgtttgagaacagggcagtccaagacggcattgctgccccatatagtgccacttgctcctaaaggagagtaggcacagagctggatttctttctccttacaaaactcccttagtttgttctgccggcaataggggtttatctcaacctgcatatatattgtagtcatgcatgcaatcccaacgacaattaataatacaatatatgttccaaaatatgtatgatgggacaaaatataggatgataatgtattgtacagtaatacctgatttgctgcaggagggatggttgcaaatgagagcagggtgttaagcttcttgcaggtgaaattgctgacaccaatggctttggtgagacctagcctctggcactcctccatgtccttccaaactccctccatgtccatcatcacaaagtcattgtcgtacaccggcgaaggcgtttcttgttccactctcagtcttattggccagtgaatcaggtataggtcgatgtaaaccatctgcaggttcctgcagtagtacatgaagactcacgcaaaacaaacaaaataatggtaattttatcatcttcaagaaagtaccaaaaatgctatattttctattttaaaaacatgacacaattatgtactagttaccttagatgtatcaatcattttagtgtaaaattgattaattttttgagaggaacctggacgagtctacgggtcgggctcccgatcggtttggagaaaaatcggggctgaagcgtccgatttacgtgcaaaactattttaaactaatttttctcttaaattacttatccaaattatgatccgattgcactattaaattcgttgcaattaaattttcaaaacaagaccacacatggatatattccgatgaaaaaagttagcttattattgaattatttttaaatgttgcacgatgttccatcaagtatatcggaattgtttcactaagtagatcgaaaatgtttcattcatttaaatcgggtgttgtttcaccttatataaaaacaatgtttcagcaaatagcgaaagaatgttttagttcggtgcaacatttgatccatacatagtgaaacattataagtacactaggtgaaacatttttcggtggaacaaaaaaataaaacgaattacgttaatagggggtttccaaaatatgtgggttttttcattgcaatggaatatttcacttcactgcaatattaaatctatagatagtgaaacatttttagtggaacaaaaaaataaaccaaattcttttaatagagggtttccaaaatatgtgggtgatttgttgcaggtggaggcagggattgtggtgggggcccaggtggcatgcatgcgcccgcggcagggggcgggggagcgcctgatttttttctccccccaccggtcgactgatctctatcattatcggagcaacgtagctaaaatttctcactaaattaataaacatacaagtgattgtttagaggttggtttgtgaatgatgctgacgtaccggagcgtcctcctgagcgccggcaagacacggccggggtgggtgtcggagatccagagcttagaggtgatgtagaggtcgtcccgggacgcgaccatgccggcgcgcacggcctccaacacggcctcccccaggggtgcctcggtgccgtacgccgccgccgtgtcgaagtggcggtagccggcgtcgatcgctcgcaggacggcgtccctgacggtggccggcagctggggcgcgtccaacgggaacgacgcggtgcccatgccgacgagcggcatcggcttgccggacctcagcgccgcctctggtatcgtcgccgccgccgccgccgatgctcccacaccaccaccagccatgaacgatagatggctagcttagctgtcgtacctgatcgagtgaggtaaaaagatcttagagaaagagagggagtggtgcatgtgtcagtttcatcttcgtcagttcagcgaatttagtagtagcatacatgcatcgcgacaggtatatgattgggagctggccggagacaagataacacaatgtgattgcggttgcgactgcgacacaaaactgtcactacttgtattttcacacacagaaacagacgtaatgtatgcatcacggaaatttatagcatcttggacaaattttccttcttcagcagtgaaatattaggttgtaagttgcgcgctgccggccggtaatctcgatcgccatcccaaaacttgtcagcggtaaaatgttctatagttaaacatgatatacatatgcatattgatatgttgttcactactacgctctctccggttttcaatgtttggcgccatggaattttaggcagacttttgattatttgtattattcaagttttgtttttaaatatgtaaaagtataaaccctacttttcatcaaagatatattcgagaagcttgaacgaagatagctgaactattgtttcaggggcgcgcgggacacgaccagaaggctgggttgagtggcgaacgtgtcccactgccagctgtgggcaagcgttcactaccataaatgaaacatgtttatgggggaaaaccccaaccagcctgaggtcaaaaagacgctaacgctgagtcattaggagcaacaggcgtctggatatgtgtcgcgcctgcccagtgacacccgacttatccaactgagaagaaaaatagccgtggcactatcttggataggttgaggatcgccaggcccaccatatgccgcgtggtgggcaggatggaaacccacctgggccagatcaatgcccagggagcccggggcaacttaatcatatacttttggttggtttctcgggaagattagaagggaaccaactgacagcgacaagacagctgagtgacaacacgaaggaagagcagaaaaatggcactgtgagcccctcggggacgtgctatataaaaagggatgcttgttccttagtttgaaaaaggtctagtttataatttccagatccagatagtgacaaaaaaaacaggagtaggggtattacacctttaggtggcctgaacctgtataactgcttgtgttcatttgtcttgtggggagctggaccctatcttggagatcttttccacgtcgtgcacaactaaccccctggacgagttttcactcaaggaaagatctgcacttcctcgctgctggagaatcgctcctccaacacttcccctttctagcgattagaaatttgttacctacttgagttcttgctaagtattactccctccatattttaatgtatgacgccgttgacttttcgaacaacgtttgaccattcgttttattcaaattttttgtgcaaatataaaaatatttatatcatacttaaaaaacatttgatgacaaatcaagtcacaataaaataaatgataattacataattttttgaataagacgaatggtcaaacgttagacaaaaagtcaacggcgtcatacattaaaatacggaggtagtattacttataaggtggtttaattgagtgttctaacatgtagcccttatagatataccatattatcaaattatacatgtttcaagtcgacgcgacttaaataatgttagataggtacttgagttgagagaaggtttagtcataaaaaaaagggtttgttggaaccatgccaccctaattttgcgaaatttgagatatgccacccgtatctcaatgacatgtaggaaccacatgagtcaatgacatatgggtcagggtggcatatcacaaattttgcaaaatttgtgtggcatggttcaaattttccctaaaaattatatgtgctgggattcccttattgccttctattgatggtatctctaatcaacaaaatacaaatatcggctatgggctcttttagtgaagcattggatgttgggcaacctcatgcaactcagcgctagtcatacttactacaaccctatgaaccatgcaacaggtcacacaaccacacctgacatctcaaatgattttctattagacaacgcttggatggatgtttttttattaaactaggtgaaaccccgcgcgttgctgcgggagtttatcatgagaacaataagtaaaaaaacgtgtaaaatagcttaaacaacataagcttatataaacataagttttcataaattgatgagatttaaattgaaatagtatgtagaataatgatttagatgtaaaagtaagatgatgtggctttatgaggcggttggacagaggcggcctgcacccctcggcggcgggagacgacgggaggtaggcggcaggagacgacgggaggtaggcagcccgcatccctcagttgcggcaggcagcgtgcggtggtgggaggtggtgcgacggaggcggcccgcgccggatcaggaggtgtggcgcggcgaagacagcaggcatggaggtggggccgccagcaggaggtgcgacggcgtcgaacaacggccggcgatccatctttgcaaacgaacaaataacccccccccccagctcaatccgctgtggttttgatcctacatggtagtccagtcaacaattcattgttaaaaaaataggtgggccccacctatcagtttctctatctgtcttgtgtctctttcccaatctcttactctcttctccattggagctgcatcaagaagggcgacggcagaggcagtgacgaggcgtggggagcacggcggcggaggaggcgaggcgaggcgtcggcgtcagcgagacgagcgtggcggcggcgaggcagggcggtgtgggggcgggcgcgagcggcgacggcaggcgcggctgggtggcgattggcagcgcgaggccaggcggctacgc

SEQ ID NO: 42518 - DNA, 18401 bp, Oryza sativa
ccggcgccctcgatgcaccagacgcggccgcggaccacgatgtgggcggcggagggggggcgttcggatgcggtcgaggcgacgccacgcgtacatcgctaggtcgaaccactcggcatcgcgctcgatccatcgctgggcagaacggacaacgacgacaccgagacaccgtcgccacggtcccggttccttctcgccatcgagcttgccgcctacgccaacggccgtggccacgtccccgtcgcctccttgactcgttccactcctcgtgggtgcgcttccgtgtcgcctacatcaccccactgctccagctcctcgtcgacgcctgcgtcgtgctcctcctcgtccagagcgccgaccgcctcgtccagtgcctcggctgcctctacatccatctcaaccggacgggcgaggcgagcgcggcggggacggccagctcgggcacgtgctcgggtggccaccttcctcccgcctccaacgcggagctcgccccgcctccaacgccggccgcccaacttctctccgcctcctcctccaccggcgcggatctcgcctccccagctgctgttgcggctgccgccttcctcctgccgcagcctcccgcgacaccgctggtcacccgagctcgcctccaccaccgctgcccgccgcccaagctatgcctccgctggcggccatctgagcgagcggcctccgcctaagacgacgacgacaacgcctaagagcgggcggccgagtaagagagaaagcagagggattggggaggggagatggatgacatgtgggtctaggtgtttttttaatgttatttgcttacaggattgccacgttggagctacgtgtgcaagttcaagtcgaaaacagctcaaaatagtgcttggggggggggttatttgttcggtttgcaaagttgggggtgaaggatgtccagatttttggttcaacggggtaattcggtcgaccgcgatagttcgggggagggtaattcgtactttttccttttaagattaacattggtgtcagctgagtaatcagtgccgcattcattgtgctggttgggaaaaccggtacctaagccggttttccaactggcacctatctgtggttctgtagtagtgtaagtaagaagaaaaaggaacagtgtttggaacacttccagctctatctagcttgcgtgctaccaagtatcattggttatcgcgtcatgctacttatgatacctatcatgctactatcgagtatcagctgatactgttaagtataatgctgtgatacgtattaggtatcatgggactactaagtatcacatgatactgataaagtgatactaataagtatcattagtaatcacctgatactagtaaaacaatactagctagtactccctccgtcctaaaaaaaaacacaaaccctgggtttctgtgtctaacatttgactgtccgtattataagaattttttttataatttctatttttattgttgttagatgataaacatgattaatactttatacgtgacttgtctttttaattttttttcataatgtttttaaataagacgaacggtcaaacgttggacacggaaacccagggttttttttggacggagagagtaagtatcattagtaatcacctgatactagccacgtaagccacgcgttgcgtggctcttaaagacccgtttgaaaatgtgtatatatggctcaggccaacggtgccctactattgatatctcgttgatgggcaaataaatagtgacactatagctggtaggtttacagatatcaatcagcagttttttctaaaatccaatggcactgtaaattgaaaaatcaacatacaaacagcttcggtaacacattctgaaagtaacagaagcataaaggaagtagtattatattaattagttcgcttcataatataagatgcaacttaagtatgaggaatcagtcaaaggataacgttgattacaactttaactaataatctgcaatcatatattttctcagcgatctaaagtggtaagtaaaaccatccttattttcattcgtcatttgatcagcctcaagtgatgtgcacttgaatatttagtatttagcagcataaattcagatatcattttagcccttggaaaagcatatatgtaaactgctgaaaccctgtctatgaacaaaactatttttactgtaatcataaatgaatacagtaattcactctccatggacaaattcagcatgatcataaatgaacatagtagcttagcttatttttatggaagaacatcaatcaattgttgcagaaaatagttgagcttcaactccttaaaatagtatagcatgtaggacacagcaacaaaatctagcatttaccgagagaagtgtaatcctaagttttcatgctgttggtggcatgttacggttagggaaatacacccaggatcatttgtgcaaacatcaattgatgctagcgacccaatccctccaaagatattgctgggatattttggtgtgcttgcttgtaatttatgaaattgatattcagaattaattgaaaattttatatacacttcaatgcatcatctattgtgagctgagaagttaatttgagcaacatatattggtcaattttaatttatctctagttaaagtctattagttacatccagcaaacagaaatttctaattaaattgaaagccattggctttaatcttatttggcttaaagggtaaccttccctggtttctgttcaagcaatttatcaagcacgaaacgtgcaaaaactatatatcaagatgggacaactaaccaaatgtttgcatactggctttggccatcttcacacaccgtactttaacactgactcgcaacgaattacctcagattctagcatgctattccagctggtacacaagctttactgggttctagcctccaatgctgcccatgtagcatcttgaagggcgatggccaaccacgcctcaagcccgtcgtcacacgcatgtcgccaagaaggagagcaagggcaacgcatgatgtggagggggaagccgatgcctttggcttggaggtgggggtcgacttcgatggctatctccgatctgccatcgtggatctgattttacagcaccaaactcgcctagaggcagcggcaatagctgggaggaggcatggctaaggcgctcgagctcactggtgaggtggtgcaggatccagtgcgcctattctgggacgcggtcgaaactggtgatccacttcatggtggcggtggggaggttggcgggctggcggcggcagtgtggccgtgtgcgatgaagagacaaggaggggaacattctctcctttttttttggttacctagggacgtggaaggatgtatttgaaaaagagctttctcgaaggatccagaagagattttgcaaatagagagatctgacggatgataatgtccggaggatatatcgaacggtccttgatttctcgatgatgtggcccaatcagattgcaagaaactttagttctttcaatactttagattggtgaagtgatactaccaagtatcaccggatattagtaaagtaatactactaataagtatcactatattagtaatcaactggtaccgatactactaagtatcatctgatactattgttccattttgatctaacctaaccgtttctctggagaggccaaagcagcaaagcagccatcaacggaagaacgaggtgttgctccacttcttgcttcgtcatcggcttcttcactcgttgcatgtttgcgccatcgattatcccgtgcggtccacagcccggcgctgggattgcctggtttcagatagagccacttatggcccgcctggaacctaaaggggcttgcgtctaggaaaatcacatgtgtagtagtgtcgttgccatcaactagtaggtcaacctcttacaggtcacggcggtggcagcaacggtggccgttggcaatggtaccatgcacttggactgtgaggagagcgagcagtgccaaaggttgatagtggtacaacacgtggtcagatcaggcttgcgttggttattagtcttatctgatggaaaataagaaaataacgttcctagatttaaaacgatctctatgatgtggacaagattggagattttgacgactagtatactttcattcacaaaaggacataacatgtgtgcatcatgaggaaaagtatgttggactctggtacacgaaatttgaattcttcttgagcagtccattcattggctgggctagcattgatcagggaccattagaaaaagtcttgtcaccagtaatctcgccgtcccaaaactcatcaactgttttatatggaccggttttgtggacgaagatgtcaagagttcccctccactctgggagggtgcttatcttgtgacgatcatcattggtgagctcccaatcaaagatgcctagattctctcttaacctgctcttgttgaagctcttgacgattacacaatctccttgctcatacacccacctcaagcatacctacacttccagtttgtactttcagttctaaatagtttcatatctagttaataaacatgatatgcacgataagattcactaaacaatgcaacataggtatatatagtattcaccagaacaattattaccataagtttcatgtatcatcttatcggccattaaacaaaccacttttgccttttgtttttcctgctacggtctctaaatataattgcatagctggaagcttaatttatcatagcacatataaaaaattgacatatattgcagtgttctgtttacctgggcaatagttttacccctctccatggcaatctgtttgagaagaggacaatccatgacagcattgttgctccatggtgtaccctttccacctaaaggagagtaggcacagagctgaattcctttctccttgcagaactccctcaatttattttgccgacagtaggggtgcacctcaacctgcaagtgttcatgtaatcccgtgaacaatattaataaattaatcaatgtacatgttgaaatgttttggacaaagagaatagagaaaaaaatgtatatgtacaactataatataaacagtaccaagtagtactaagaaaatgttgtctccatactcataactaaaataccatttttcctttttcctcgcaaaaaaaaaactaaaataccatttccctttttcttcttacaacccctcttaatcttttatgtccttgtctctctcatctgtgcatggccatgacgagtaactacttaaaaaaatactacctccatattttaatgtatgaagccgttgactttttatccaacgtttaactattcgttttattaaaaaaattatgtaattattatttattttattgtgacttgattcatcatcaaatgttctttaagcatgacataaatattttcatatttgcacaaaatttttgaataaaacgaatgatcaaacgttagtcaaaaagtcaacggcgtcatacattaaaatatggagggagtatttgttaagatgatccataagtgatttacgtgggcatttttccaacttgcctgcaaccaagctagggcctatagaaatcatggatttgtgtaggcaaattccaacccgtgcagaaatcaattttcacggtgtggctctctcaaggacccacccatgaaaataaaattccagtttaatttttatagacataaaaaacccacaaaaatgactaaacttcaaaatgttatagaaaaatcactttatgtccgattgaggtgaaccacggttctccatgatccttgtaatatttttcttcatatggttgggtccatatttacttaaaatatttattttaatatggttgctcactgccgtggtctttatatgagttgatatatatgttatgcatcttgacattaatgaatgatcagacacaaaaaagtattccatgaaagtattaatattgtcatattacagaaaacactaatagaatatcgtataactttggtttacctcaatcaggtttaaaataaatatctagaattgtttttaagtttggactttctaaccctcgtaaaaaggaaaaagttcatataaccccctaaacgttgaataaaaatccatataacaccctaaactttacagtcggacatcatccaccccgaactttgcaatacaattcatgttacccctaaattagtttcagacagtggttttgcatattttaaagtttaaacgagcgatttaaaaaaactcgtataacatacttacatacctcaatcatcggtcttaaattatagtatatagtaacatcatattagtattatattggtattcatttattcaagtggagatttaacatatatgtccaaggcatatgtcacatattcaaaatcatccatcgaatatgcaaattatgtagtaatcattttgtaaaaccaccatatgggttacatgaatagtattgtaaagtttaagggttggatatccggttttaaagttcaaggtgctagatggaatttcatctaaagtttagggggtatatggactttttccttgtaaaaatagatatcaaagcttgtaatgaatattaggcacctaaacgatctcatatataaaaactttcaactataaagttgtagatctcattgggatctacaatttcctggtagaacatttctccatccgaagtcatttgaaaactaaaacaaacaatttctaaaatatatctgagaatgaaaaatgaatatttgaacacacctcaacaatctgaaataaacgaactttcaactgcaaagttgttgatttcgtcaaggtctacaattctcatatagagtttgccatcatctaacttcatttgaaagagttacttttttttcatatttgaaattataaatgatctcaaataaaaagactatcaacacaaaagttgtacatctcattgagagatacaattttcatattaagtttgtcgtcatccgactttatatgtagttgcaatttttttttcatattttagtggtattcccatattttatgatggttttcttacttacaaccatccgctaaatatcgatttttaaagactgatttcacaggtatctgaatgtaaaaaagacttaccttcatagctagatggatttcttagatacccgtctgtaaaaagtaggttttcgtaggtgatttatgacctgagacagtgtcaattatttttgcaggtgtattttttcttggctgccggagaaaaaaaatgatatcttcctagaaacgtttcttagtactgagacatatatgcaacggaggtgagagggcgaggcttgattggacattatggctgagtttgacagttacgtgggctctagctgatcgtgaagcttgaccggaatcgccgatgtggacacttttttttttcattttttaatattgttatcccactaaataatgctaatgggtttttctctagttgatggtatatatatagatgcaattccaaaagagtcaagattattataatgtataggaatgtttggaacttttacttgatttgctgcaggagagatggttgcgaaggagagcaatgtctcgagcttcttgcaactgaagttgctaacaccaatagccttggtgagtcctagcctttggcactcctccatctccttccacactccctccatgtccatcatcacaaggtcatccttggaatatgtcattgactccggatcttcagccaacctcatgctcaccggaaagtgaatcaggtacagatcgagatactccatctgcatcttcctacaatattcgtacaaatcaaatcaaccacacaagccaaatgcttgatcatatatgcaccctctattttttttaatgttggttagttaaaaaagaaagacaacaatgatggtgatggttccgccatcctaccaccaccgccggttttgctaattggcgcagatgccgagatggtcaccggggcatgcacgcaagtgctgatttatcggtagctaattggcctaatccaattaggatggtgcgattagcgccagcctccaataatgataacggttagtatttcctttttccttttttgcgggactttccttttttaccggagatgtttactttggttagttgtagataataaccataattaattttttttatatttaatgatcttcttttactaatagattaaaaagaaaactatacgtaaagttaacttttgaaaactttttcaatccagatttaaaaacttaaaactttcaactctaatttaaattttttaagtcaaattttaaaaactttcaacttgtagtctcaaatttgaaaaattttcaactcaaatttgagacttttaacgcagatttgaaaactttcaacttaaaaattgaaactttcaacccagatttaaaaactttcaactcaagatttaaatttttttatattgaaaaatttttaagttaagatttgaaaacttttgaccaaaaaattttttggtaacacgtgtgctaccgattaaaaattcgaaaaaaaaacatgaaaaaaaagaaggaaaacacgtgaggggagaggaagcgaaaaaaagaaaaacgaaaaagatggaaaaaagcgaacgaaaaaagatactagtgcccatgcaccagttagcatcctggccaccaccgccgctgtcatgtgaaaccactcacccatttccatgcctccctcccacaacctgctgctagtaggctagtttctagcctatttcatttttattttttactatttgtcttttcgtatttctaggcggctagctattagaatttcttgacgggtctcagattatactacatggatcaaatataatattctagctaggtatatagaaaatttatatcgactggttagagtagctacgcagctggacatgaagaatgacacgaataattaatgatcccggtgcaacgcatgagcatatatagctagtccaacaaaataagttgcagttatactcaccggagcgcacgcctaagagatggcaggacatggccggggtgcgcgtgggcaacccatagcttggacgtgatgtagagctcgtcccgcgacgcgacgaggccggcgcgcaccgcctccgccacggcgtcgccgaggatggcctccgtctggtacacggccgccgtgtcgaagtgccggtagccggcctcgatggcgcgcaggacgacatccttcaccgtcgacgggtcggtcgcgccgagcgggaacgaagccgtgcccatgccgacccgcggcatcggcttgccggagctcagagccgcctccggcatcatccccctcacatggtcatgggatcgaaccgatcgagagaaattgaagataaggctcgacagccaattaatctggccatatattggtacgcgaggcctcatatcagcgactcaccgtgtgacagctacagcccgaacgacccaagttcttcatattttttttgggaaaaggaaaagagaatatttgggtgctttttgtcgacggcactcgctagttgcaacactatctccgttatttaatagataatacagttagtttatttttaaatttctaatatttattcatttaaagtaaaacgagtatcaaaagttctacacgaagcaaacataatatatttttctatttgcacaggacttttgagaaatgatgaatagtcaaacatattaataaaataactacatcatatctattatatactaaaagtccattaaacatcctataaacactattaagccgccacatagaactcccacaatcgctcgtacatcgccacgtggcatttaatcatctagccatcgattttcactaatatacggtgggcccattattttataccattagatttatttatctaaatagaaagggataaaaaaagtggccctcatatcctacccctcccgtccagtacatatgcttgtgtacgtgcgtatgtgcctcccccatatattttatttctcttctatcttcctcttttagttagatggaaaaaacattttatgatttatccaaatacaatgataaaaaaaaggggcccgtataccttccccgcctatccagtatgcacttgtcttttctctcctattttcctcttttagttatatggaaaaaaatatcacctcccccacatatttcttctctcctatttccttcttttagttacatggaaaaaatattttataataacaaattttaaacaattatattatctaaatcatataaataatttttatttgtgctcactattagattattttctgtaaaatttaaaattgaatatccaaattaactatattaattattaaagaaattcaatacttttagtcatatatattctacgaattatagctattgttcattgatccatacattttttaaaaaaatataatatattttaaacgttctgattaataatatgggtgggcaagtttgaccgcaagaaaactaaccagttgaactacgctcacttcataatgttggatataaagacaaccataatttttaagctacatttttaaaatactcctatgccttttaaaccggtagaagcattatttctaaccgttagatctatcttatatagaaaaagtgtttattcatggtacatgacatttcaaaaatattactgtgcaatgataatacttcgtcgttatcgtgttatttctaggttgcgtggagtctctcatctactctacataaaatgttcatagatagatcgcttcttaaaataacccatgtatttagtggagcttcatttcccacccaacatcctttaacatattatgataatatattatacatcaaaagaaagaaaacaccttacgttttattttacacttactttactttcgttgacatgttttctaagaaaataaatctacattcttttgaaatgattaagaagattataaataattgcttataaatattacttatatatgatataatataaaactgataggttaaaatattattaaacaattaattaacgctaacaaaaataatttatggagaaatcgtggcggatgttctccggttaatatattgcttttataaatacgtcaaaccactactggtgaaagggttttcactcacggttcgtaaccccatatagtcccgattatacaactaggaccacgaatctatctctagtcttgggtaaaataaccagaactaaaaattatctttagtcccggttcctattcaaaccgggactaatgtggtttttgcaccacctagcaaagatcacttctccagtagttaacatagcgtatgacgtacgcccgcgcgaatgcacgggctacctttctagttttataacatttaaaaggaggtatagtccaacacatatttttcatttgctgatatatacatcacatgtactgctagtgtgagagtactccatccggttagaataacatcacacgctgctacttctaatattacgcaatttataactgtgagcaggcagatcaagcaacgcatatattagattacttaaacccgtgggatctttggaaggttagggacgccacgtcatcggttttttcaaaaacaccactcacctctgattaatcacgttttgggttaatcacgttttggaaagtaagtgtgccacgtcattgtatttttttgcaaaaaaacgcctgcacttcctgttaattgtgcgttggttcctgccgctatggtccgttcgatcacgcgcgagggactagcgtgtcccagcgtggctgctcttccaccatcgtgagatcgttggatcagaaacggacggcctagatttggcaagaaccctagccacctcgcgctcgcctctcttctcgctcgtgctgccccaccctcctccctcgtgcgggtcgccgcctcgttatattataaaccaataggtatatagttaatttaggctgtgttcttcccccaattttcccaactcatctctcttgtttaccgcgcgcatgcttttcaaactgttaaacggtgtgttttttgaaaaaaaattctatacgaaggttgctttaaaaaatcatattaatctattttttcttttaaaaaatagctgatacttaattaatcatgcaataacacagctagttttatttttaaacttgtaatatttattcatttaaaataaaacgagtatcaaaagttctacgggaagcaaacataataggtttgtctatttgcacagaactttcgagcaaggacgaatagtcaaacgtactaaaaaataactgcatcatattctaataacatttaaaaggcggtatagtacaacacatacttttcatttgctgatatatacatcagatgtacagctagtgtgagagttactccatccggttagaatgacatgacacgctgctacttctaatattatgcaattttataactgtgagcaggcaaccaacgagatcaagcaacacagattttatttgaaactagcaggtatagagttaatttacgctgtgttattccctagtttttccaactcatctctcccttttttcggcgcacgcttttcaaaccgctaatcggtgtgttttttgtaaaaaaaattctatatgaaagttgttttaaaaaatcatattaatccttaatgaaacatgcaataatacatgcttcattttgcgtgccagggatgaagggttcccaacccctcctcctgaacgcatcctaaccttgcatcagaaataggtgtggaaaaaaaaaacctcgggctcgtgagctcagcttgggcttggctcgagctcggctcggctcgaatgaaaaacaagccaagcccaagcctcctttttagctatttgttgaaatgagtcaagcccgagttggctcgcgagccgcttgtttgggaatgatatatgtcaatgatttacccctgcttttcctaatgattactaattatatataaagagatgtttcaatgggaaggctcgcaagctagctcaatctggcttgagccaggaaacgagcagagtcgagctcatgttttagctcgtttccttatccaagctgagccaagcaagcctagtttgttgtgagccattacaatctgagacgagtcaggcttgactaggctcgtttccacccctaatcaaaatctatttatcttctattatataataaaaatccattaaatttccttaaaacgctctcaggttgacacatggcactctaaaaatgttctcaagctaccacgtggcgctagaaaatcctaaaattctagaaaaaaacaaaaatatccatccctgattttcacttaaatatatgggtccaatattatacaccgttagatttatcagaaaatactacgttactgtcctctccccgcaccgcaggcgctaaaattccattaaacttccttaaaacgctctcaggcggacacatggtactctaaaaacgtttccaagctgccacgtgacgccagaaaatcataaaattataagaaaaaaatatccatccctgattttcacttaattatatgggtccagtactatacaccgttagatttatcacgaaatacaacgttaccggccgtcctctccccgctggcgcgtgcgtacatgcgccatcctccctcctcttttttctcaacggtagttaattaagatcaaaagtattagtatcgtgttaactaattttaaatagtattggatttatatctccatagggcatagaccaccagggcacatagccgtatctcccagccgcaagtgtactaatagatgtacatgtatgtatatacgtgtatgtgtgatcatttacaagaaaagagcacgtggctctctcccattggctctatcatgtccgggcgtccggttaattcaaatgcaggtacatataataaaaacttactatctacaccttccatcccaaaaaccaaattcatagtgaggatttgacataaccaagctaaaaaagaatagtacaaatctaccaaacaaatcaactaaggatgcttatccaaaccaacatcaatttgggtcgggctgtttatacaagccagtctatacacaacaaacagggatcaaatacaccctaattaaatctacttcctccgtttcatattataagacttttaaaccgtttcatattataagactttcaaacattgacaacattcatatagatatatatttatagattcactaacatctatataaatatgggtaatgctagaaagtcttataatataaaacggatggagtacatagtatcactgttagtgatgtatgaatattggttcatgttacaaaccttcaacgatgtaccattgcctgttcttaacatgtaccagaggtgatcttctcaacacataattggttggaccagcataatattgatcaagaacaattaaggtttttagttgtcaccagtgatctcaccatccccttgactccggattcatggacgaaaaaatcaaggcatccccttgactccgggagggtgcttatcttgtggtggtcaacatcagtgagctcccaatcaaagatacctagattctctcgcaacctcctctcattgaagctcttcacgattatgcagtcaccttgctcatacactcatacacccatcttaggcatacctgcactacaattgcaaaatgtttcatatatatacatgttagaattcatttcaaaattacctacacacacatagtttcactttttcatacatataggaagtgataaactcctagcctctacatcgaccaaggttgtacaaagccaaaaaaagcatgacaaaaaaaggcatggtgttcactataatagatatattggcattatcattttgtcaaatacaaatataacaacaatttctatttgccatgggtctttttcttcttatgatatctaaatttaatcagttcatccaaagcttatcttgttgtagctgatccaaaactgagatgacatagtatagtattgtgtttacctgggcaactgttttgcccctttctaaagcaatctgtttaagtgggcagtccatgacattgctacaccatgaagtgccatttgcacctaatggagagtaggcgcacatttggattcctttccctttgcagaactccctcaacttattttgccggcaataaggatgcacctcaacctgtaaccgttcgctgatcacaataagtgattgtattaagtattaattaattatttcttctgagaaaaaagtcttgacaaggataacatgtaggtcagtatttataattttaactagttaacgatatatatatatatatatatatatatatatgtatgtatgtatgtatgtatatatatgcagtgtcacataaatggtgccattgaattggagatgtttaaaatattaaattctgtacaaggtaatgttatggagtgaatgaagttgattaaaaaatgaaattcaatcttggagaccatatcaaagagctaatatgccttacttttctcaatcaaaagattaatatgtacatatgtgtggaacaaaaattgatactgctggtgagcccacttttgttttaggaaaaataaaaatgaagaggggcagtgatgccgttttctatatttttttctctcctagttaactcgatatattattttaataggagaagtgtccattagcaaataaccaaagttttagagtatcttttagcatagccacatttttacggtatctcttggcaaataccataaattttggatgtttagtagcaaattttgccaagattatattgttttgtacaaattacctgatttgctgtaggagggatgattgcaaatgatagtaagggtatcaagcttcttgcaggtgaagttgggtaatttggaaccatgccattataattttacaaagtttgagatatgccatcggtatctcaatgacatgtaggacccacatgagtcaatgacatgtgggtcaggatggtatatctcaaattttacaaaattataatggcatggttccaattttccctagaataataaatgggctaggcccgatttattctattaaatctcaaaggcccataataaatgttaaggataataataccaccttgggaattaaatgaggagtatctcaacttaaatagggagttattggaggctccctattgactggttgaggtgaggatcggaaagccacacgcgcgcgcgcgagccgggcgggcgtgggggcgaggcgtgcggtgcgcctacgcctgtctctatcctttttgcaatggaccatcccgagattgcctccgtaatgagattgccttcgtaacgggcaggcgagtcaattccaattgatcgcgtcgttactgcggcaaagggcggatatcgctcctacgctacaaggaaagatctaatccgatcagatgcggctactcactttccatctgttgttcttcctcctcctcctcgtgcacgcctgagctgctactgttctgcttccccgcttctgatcgcttgtgcgcacgagaaatcggaacaagcagggcctccggaaccataccttcgcctgagatctgcaccgggtaggcaggtgatcaggtttttggggagtgcttctgcacgattgctcctcttcatcgtcgtcatctgctaccatgtctggtgccgccgtcgccgctgttgctgctgccacacctggagatggaggcgcgcctgtcgacgggggatacccatagaccggatatagagggtattggggtacgctggtacgaggatctacgtagtacgatatcaagcaaacaggaaacagggattatactggttcaggccccttggtagttaatagccctaatccaattgatatgggattatatgatggaaaccacagattacaaaaggaatagtaaagctcgatgataccgacaggatcgtagtcgagttgatccgactagatctcccggcgacctggctttgataagctccggcttcgtaggctgtggtagatgtgttggctctaagatttaatgccttaggtcctcccggggggtcccttttataccgtaggtcaactggtctccatgtaggactcagagacatcggacccgacatgatataatgacggccgatttctatccaagtaggactctttccatctatagactccatgatagacttccttaacttatgctgagaacgtccgtatatgcgcaaacataccatatcgatacgtgacgtatatcgaagggtagagggtataccttacccgtaaccctgacaatagtgtcgtaggctctccagaccttccattatatttgagagatgaagtgaataattcaagtcatcaaacaagcataatgaaacatccgatgcctcgagagaggaatattggagacattgctgggcccttagcctgccagtcaacttcagcctgagatgtgcccgtcaaaccactcgaaggcggcgaccagatgtgttacacattcaagagacttgacaaaaatggctaaagatctacaacctctcaaatattcctaactcatactcatgtgaatctagttcccaggatgtgcactagatccacactttcatcttaagcatgattatacatagcaaacacaactaagatgaaagaaacttaagacttacaacaacttaataattacataggccgaccggccaaatagacttattagagaacagtggaagcttgactacccaatcacaagcacaccgactaggggtttaccccattaagttctcatcctagaagaaacaatcggaactcgcatcactcaaggactaagactaaacctgcaaacaaaaggttatatcaacagcaagagtcaatacattaaacaagttaatgtactagcaaactgtagcgcccgttccgtcgtggcgcctagcgggaaaactatctcttaaaaactctatttgcgaaatctgttctttgcttgttgtctagtgtccgtgccatctcagatctgaaatccccgatctatcgtcgagttcaatcccgaatccaaatccttcccaaatcaattcctccgcaaaagtctattttgcctcccccgggttcgatgggccgaatctctctcggcccatctccccctgcgtcggcggcgctgtctctctctctgtccctcccccctctggtctacccgcgcgccgcgcgtgcgtgcgcgagagccgcgccgagcgcccctccctcgctctgcccgcgcgtgcgcgagagccgcatggtcgccgcccgtgccgcgcctgcgccgtctgcgccgcccggccccgctgccctaccgcgcagccgctcggccccgcgaaccagcgcgcgtgcccgagctgcgccgctcaaaccgccgcgcctcccgttgtaacccgcgcgcgcgtgccgtggtggccgaccgcctggtcgccgccgccgtcagcctctgccgcgctagcccgtgcctgc

SEQ ID NO: 42519 - DNA, 7066 bp, Oryza sativa
cagagctcctcctacctctgccgcgtcgcccccgctccctcctcctttcccaaagaggcaagggacaagccctcttttctctccctcttttcccctttttcctcccgccggcgtcatcctcctcccccctccctgtcgccgctttggccacgactgccgagcgctagccctctcctttgaccgccctaagtcggttcccaaaccgacattgctgctcctataaacccaagcttccccctttcctttcctctcccattcgcctccacgccattgccgccgcctcccgtgctctgttcgccgtcgctgttcgtcgttgcacgtgtcggaggagccggcacgagcaaggacgcggaaggggactccgggcgcgccctctccttcctcttccctgccccgaggccggagagattactcccgcgccgtcggcctctcgtcactgcgcccgcccgcacggtagtgcctccctccattcttcctcctcgctccatctcctccccttagactcgggtagtagctcgagtagcctccccgtagctagccggcgccgccccgaccgttgccgccgctcgccgtgtgctcgccgctgtcgccgcccaagctcggaagcgccgctcgtcgccggcctcgctcggcgcagctccgcccaatccaacgctagcatcggattcccgtagccgcgtagatgccctcgccgtcgggaattggcccctcgtgacctcatcgccgtttcccccttccctcgccgccggttgccgccgccgcaatccgccgccgacgcactccctccggcgaatccgagccattggctggtctcccccggtcctgtgcgaccacccggtgtgctcgctttcgcctgtatcgccgtggttcgctccgccgctcgccgctgtcgtccgccgtccgttccggctggcgtcgtcgtctacctcccgccggcccgcgtggcagccacgtaggcgccacgtcggcgccaactcggccaagaccgggtcgagccgaccacggtcagcccctccctgtgcgcgcgttccaccgcgagccgtgaggctgcgcgtgggcccgctgcatccgtgtccacctcgaaccgcgcgcgtgcaccgcgtccctcccccgcccgcgcgcgtgcgccgcgtgctcgctccgcacggtgaaccgtgtcaccgacaagcgggtcccacccgggaccacgcgaggtgagcccggtccaccggctctctctctcctccctcccgcgcgcgcgttgggccgccttgggccggccggcccattaagctcggccgaaccgccctttctctcgggccgcgccctagccgcccgagggaagtctaatttccctccctcttttattttattttcttttctttttcaaaaaggatttaattaaatccttttcctttagaccaaaaatccaataatcgtagaaattcaatatctccccaaccgtaaatccgtttgactccgttcaacttccaaaattcctcaaatctcgagatctatctaatggcacacttagaggtcattaatagggctttatttttgccgtttgttgagttgtcccgttctgcgtgtactttcggagcccgaagacccgcagtgcgaggagttcgaggatcaagctccagatctcgagcaaggcaagccacctttgaacatcttgagcctatatttgaatttaattatgttgcttgaaaaatattatgcattgataggatcgcacttaatctgtttgtcccgtctgcaaggcagattggcgaacctacctagtttgttgcatttgatccttcctttgttaattgttatcccatgttcccttgtaaccacccagttgcgcctcggaaatcgtgcactctgcacgagtatcgacggccgccttcaaacttaaaatctgaaaaacatcttgggtaaaacttgggtcttacaaaaaacttggaaaacccgacacctgggtcggtgcttgcgaactaaatgaatttccaaaaccgcggaccggggaacataccgggtgtacggtttcccgctcttgcacttaaggaccgttttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggccttggaaatgtcttgtcatgaaagcttggaggtctcccgatgtggctgatccccacgggctgggtgatccgggttagtaatgtcgtgcgggtaaagtgtaccccctctacagaggttaacaaactgttcgaacagccgtgcccacggtcatgggcggatgtgaggtgattcctagcgtagttttgtttgactactgccttgtgaaattgctgttgtgaaaaggggatcgttgtttggaaaatctgcagctgatgggatcagctaggcccgggtggccgtttgaaagatgttggcccgggtggccgtttgaaaattgttggccgggtgccaatcttgatcaattttaaagactgatacattgcacatactccgaccggacgagacgcactgtctcatctgtgtcgtttgagaagcactcacttagttgtttccagaaaagagttcaaataaaaatcaattgcaaaaacaacagccctttctttgaagcctgcattaaacacttatttcccatggcttgctgagtactcccgtactcacccttgctctatataaataatcccccccccagttgctgaagaagatgaagcggatcctgcagatgaggagttcttccaggagcaagccggctacgatgagttttagggtttcggcctagttcccaagtcgcgcctgtgttgtttgatccaagtcctagcttccgcttcccttttgtaatgcagttgtgagctcgggatctgtccgcagcccaacatgactgtacctctactctataataaagagacctctattgctgtgataatttgtcttcctgtgataccagtactgtttcctgggactggtatcgattaacaggttaatttggagcgtcacgggctagatccggtcggtactagttcagggcgtgacacaagcacaagtcaattctaccatactatatgtaaggcatatattcaaaggaaggcaatatgtagttcattttcagcataagcaagttttgtttcgcaattcttttgtaaaggagttgatgcttcaattaacaaatcaaattttaagtttcaatattaaattcatcataattccatcataatcaatctcttgttgtcatcctttgacaacaagtcataatatatcacctcacacacacaactcaacacatctatcaatttcaaaccaatgtcacatgatcacatttttaaaacatagtctatactcatgacacatcaccaaagcgctcatgaccgtgagcacggctaatcgattagtttaaagaactctgcagagtttgtacagctttatccacatgatatgaactctctagtttgttttgagtttgcaagactccaccacactcttcattttgaattacactacttagagcctagccttgcaccagcacgatacgtgttcctccatcctaggcatacttgaaatatacctagaaccgttaagtggtgggcccacgccttaaacttaatgccgtggtggcggacacgacgggaacccaccgcacaataccgttgtattggaaacgcttagtcacctaaactaccacgtcagggtaaataggaagctcctctgaattatacgaactcatacacaccgacctaccagaatgcaaggctagtcctaaatagattactcagcttaggccatctcatactagcacatgtggatgtacgaataactttaaatgggtgacacaagttcggtccttatggacttgggcaaacactccccctatcggtatgcaactaacaccatatgcacaccacttgccgcccaagtataaaatcacattttacacattttagttcgcaaatacccatcatatttattttattccagcaaaggttcatgtatcaaaatcatattttaattatagatggaatgagcatttgcatagttgtaagcatggctaagcaagtagttgcaaatagagcatatataaacccatttgagcacaaagagtgtactctaaccatttctaggggttcaaacagcaagaggatcaattattcaaggtggggtatgcagcaaataggtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaaatgttagcacctaatccactccttcaccgattatgcaattatctagataaaggacacgttatgcaattaaacaccgaaatagctaaaaaatctaaaatgctctaaaatgcatgatttatgcacagtgattaggtactgatctaaaatgaattttaggtgaaataatttttattttatcttattccattagggagttatgaattttagaagttttatcgatttatagtagtatagtcttaggtagtgttatgaaatacttttgtaaagtgatttttactagattagacttcacaggggtgtagagatgtgttttataagactaactcatttggtttcacaatttttggagttacaatgattttcttatagattttacaagttacaacgtgttttaggcatatagtgttttatatgtgcatgactctcaagttgtaggttcagaacatgctacttcctgtttaagttgaataaaaggaataatttggttaactaaaacatttttagttcacatgtttatggtctttactactatggttcatattttataaactagagatgctataaactaaactagcaatatattatattaacctagaaattgttatatgagctaagttcttctaagttttagtggatggggatggaactatggcctctctggtctaacaagttttattttggtttattcatagctagaatgcatttttttaactaccttacacatatattttgcttaaccattactaggtgattaactcctaggttatctatttaaagattagagctataatatgttcaaaaggtgcaatattttattttactatgttgaagctcactatttgctggttctatggaaatttggttcatttcatttggactaaagatgaattttctacaaattttacaaagtaaaggttgctctatcttggttattacttacataaatatttaaaggcttttattacatagtaggtgtataattttatttcatggaagtatacgttttgttgattctacagaacttgggtttactcaaaaaggatctaagatgaattatgaattttatgtgaatttctaaagttcagcttacctaaaactagtcattttaaagataatagtttcagaggcatttgatctaaagtatgtatacaatttcattttactttataggaaaacataagttggtggatctatagaaactgagtttgctataaaatgagttgagatgaattttatatgcattttataaatttgtgtatggtttatgtatgatttatcttagaccaattttagagacaaagtttgtacagtgaatgtctagttttatgcaataactctaaagttcttgatttggtgagttcacagaaatttgatttactctaaaatgagttgttttcaattttttatggattttataagtttacatgttttcctgttgaaaatataaagcttttagtattatctttttacattttcagattttaaactcatggggtccacctgtcagtatcaggccaatatgcaaaaaggcccctaggattttcaggaaatcaacccgcagtcctaggtccatatgtcattgattgggaacattacgtaatgaaccttatagttatttaaattctcaaactgaagtccctgactcctttttcacacgcacagaggcagagcagccatggctgagctcgatcccgggttcaccggcggcgattggtggctcggttggagttggggttaaaagataaaatgaagagcatgttcttgcgattccattcctctagttttcttggtcagaggacatcggagtagcgccgatggcgagtgtgagcggcggtggttcttggggtgaaagctcatgtgtgcatggaaatcgattccgaacgatgcatgcatgtggtcttctagccttcaggatgctcaccgtgggtcgagctagggttttcgaggtcttggcggcagcggtgacttgtggaacggctcggcgacggtgctcctcctcgggtgaacgacgacggctcgaacgggacgatgagctgctacaagcaagcatgcacgaggtttgtgaggtcaaggagatggtgtatgcgcgaggaatcgaacaatggctcaccgaggcagcggtaatcgacgatgacggcggaggcgattctagatcggcgccggtgaagaaaagatgcgttctccgagtccttcaaatctccggctggggttcttgaggcgtattgaagaggagattgaggcgatgacgatggcacaacggcttgctccgaggtggtcaagaatggccggacgacgacgatggttgaagcggcggcgctccggtgcgtgctccagggcgtcgtcggcgtggtcgcgttccggtggctgtgatgcacaaaatgggacgtggtcaaaagagaaatggttcggcattgtgtggagagaagggaacgcgaaaaacctggagatgaactttacccaatcagcgatggcgatggtcgtcgtttccacggccggcggcaaggtttggggcgatggagaggcagagaacctcctccctcggtttcttcggctctgagtggtgaatggagaatggcaacgcgtctgggaggagtagagagtgagaaaagggaaa

SEQ ID NO: 42520 - DNA, 13384 bp, Oryza sativa
aagaggctgtcaggtgggtccaggtcgtggcaaactaggctagggtgagagggttgggtaagattctgggtaaacttgatttttagatcatttttcggaattattttctcctctaactttgtagcttcataacttaatgtgtggaccaaattatctagtgttgaatttactggaggtaaatgattacacctagattccattttctttggttgcactcaaaaataatgggtagattaatcacagaaattaaacaaagatgggctgttagaaagctagattgaatttttaggaggcctaaacagaggaggaaaattctagaaaaattatatttaggcatgataaataatctagtatttgaataaattattttccatcttcacttatgagcagttaaatgtacttttggatgaagtatgactttagccgattaaaatttaatttgattccttttagttttctgctttgactgattaatttgtggtattaaacttagttattaacttgtaccaatattatagtgaattgcttgtgctaaacattatctatctaatttttttccatgattttaacttgcacataatattttagagaattaggattactttactttgtatatgtgttcccacttcataattgcacctaatattgttacagggattacattaaacttcttttgggctgagaagatgatatttgagtttaatattaagtccacatgttatcacccaagattaacttttgtttagtaattttaacccttttagtttatgctcatgagacatattatgaaaagcaagaccaaaatccaaatgcacaagagactcgagcctaggcatgcattatgcacatgtatgctcatatacttggtgacatttctagtctaatgttgggaatgaaaaggttttattttgttctcaaattttaatcatgcaatgatttaagttggtcatcacctaaattaaaacggaaatttttgactctaaaaattggagaagttaacctctaactattttgacaagaaattttaagtcctgaaattttgggtatgttacaagtagcccccgacttctctctcctttccttggaattcgcaccggcggaggtgcgtctatttaagggagttttggggatcccatttgaggtctgcctgttgaaaaaactctccagcttccaagcgtccctcgtcttcttcgctcccgcaaaaaaccctagccaactcgtctcggtcctttctccggcgatcttcggtggccatggatctcgacaagtctacctccaccagtgcgtcactgaagaaactgcaagaggatggcgcccttcccggtcgcgggaccgcggagagggaagtaggaggtactgaaccccagcctgtcctgggtcgcatggttgcggttgaggactttattctctgtggttttcttcctccgccttctgaatttctccttttggtcttgaatttctatggtctttccttgctccatttgaaccccaattccatcgccttcctgagtatttttacgcatctttgtgaggcctacattggggtggagccgtttcttgacctcttccgcttttactatgagttacgctggatggaatccaaaaaggtgtccgggtgtgttggtttccgacttcaggatggcctgaagtcgcgatacatcccctttcagtgcctcacatctcgcagcaaatagcgggggaggtggttctatcttcagatagaggattcggatcctgtcttcgttgtacctaaggaacagccagacaagatttcatcttggaccaccaaacccgccttgaccccgtccctccaatctttcatcgatatcattgacgacctccgagaacgggggttgtcggggtatgaagttgctgccgacttcattggtaggcggatccagccgcttcaggctcgagcccatcctgcctttgattattctgggccagaggacgcgacccgggtttctcctcagggtatttcctttttagttaaattgactcccttatgttcatgtttttcccgtcttatcggattctgttctcaatctacaggcttgaatagcgcaaccgtggagcgccgcgtccgccaactgataatcagcggcccgacaacggcgagcaacgtccccgtcctcctttgcgagaaaggggtagccgagcgcgacgctgccatcaatataagtgtacttagctgtccttttgcatctttcttccgggatcacattatgacttcatgaaacgttggctctccctctgactgatatcatcgggtcgctcgtggaccatcaggtggcggcgtcgctgaaagagaaggtcgccaaggaggggtctgacgctgctgttgccactaccacgacgagtggcggcgacgttccgaaaaaggggaggaaattctcctctatagtcggacatcgtcggaagatacccactccctcagtaagttcacccgttatttgatcacgtagtcggaaaacttccacctcacatcatatcgattgtactccaggcctcggacgcgtctcccccgcctccgcgacgacagcggcttgtgacgctcagcgagaagtaagtgaataaatttgaggtttcgtgatttcgtcaaactctgtctcaatcgcagcctttcgcagggcggcgcgggcgaaggcggcgtaagatgggtctggagggacctccagcgcatctcctgccgtggcctcgacggatgtcgtggtcgtgcccaggagccatgaggcgacacctagcggcccagccagcgatctcgtggctggtcgtggttcgccggatgccgtcctcacctgggaggagctctaggttgagatggggcgcctcctcgaggctggtggtcacggtgttagccacgagatcgcggaggcgagggcggcggctgcgtcgtcggcgaatgagcgcgccaatcggctggcgcgtgatctagcggaggttcgcgaggacctccagaagatgagggaactggtggccggcaatgagcgacaacagcaggggctcgagcaccgcatttcggagcttgagaacaacttgtcggaaatccgtggctcgttgtgggtcacatatactggtctgcaccagctcgccggggagtgcggtatcaagtctaccatcccggcgaatcccgatgagttctcgctgatgtcttctcttgcggagctggtgacggcgatggaggagatcccctccaagtatccagccaggatcggagaggagacgtctaacgggatctacaccggggcgtgccacgtccttgcgtgtgtgaggctggcgcaccctgaactcgatctgcggaagatcttggatcagggggcagttagcgacgcgcgtaaggatgtgatggaggaggtcggcgatctggggagtccgtcctcccgctttttgaagagtagggtcttagctctcttgtactctttagtcatgccttgtaaaacttttattggttccaaccgccctagtgtgtgcggtcattgccttagctttgtttggcattttgatctcgagtactttgttgtcctttgtagagatgttgatgtcgaggatgtcctgcggcgcgggcaacctgagttgctagtggtcgttccgttacttgcgtccgaaccatatgtgccggaaggcgatgtagatcgaagttcgcctgtggaaacgagcatggcggcgactcccttaggttggttgtctttgttaccatttcctttgcccttccgtctggatcgacttgatttgttgtgttctcgggagagaagagcagcttgacttagtcgtttccatgctgagcagatctcgagagtgcgcttgttgaccaggaccgtcccatccagtattggaggacgaagtttgaggttgcggaactcgagaggactatgctggaggtgagaaaggatcaggccgtagagacacttcggggtcgtgagctgtggttcaactcgtatctaaagagttgctgcacatccatgtcgagagtctgtagagagcatcgagtaccccgtggggatcccgaggaatcggcggccggatacatctcgtggctaaatggggcctgcgcccagctcgaaggcatcggtcaacgtatcgacgaggccttgaagcaggagtgtcgtcgctcaagccgatatgccggggggcacgtgctggcctgtatacgagatcatcgtccgcagctgcacctcgagttcctccgcgaagggttttctcgttctcggagaactcctacggagatagatggcctggcgaagtcgatggcgccgctggcggagaaggttttccagtcgatggactggcgttggccttcctggtagtctccatgtcctgtgacaaatgtctttggaagaagtgtaatatagttttggattttgatggaattgtaagaaatacttgtggaatagaaaagaaatctatctaactaagctttcttactctggacgttgtgtgtatgagtgtcttctcacttcgcaactttgatcagtcgtttgagttatacactctccctagcccccagccttgtcatcggagaattcttctcggaagataaggttcttggacctttgacctgcctcggttgaacaagcactgatcgtagcctccagccatgaagttggaaagtttatttccgattacacggcttggttaatacgcacggcgagaactcttacacgactagatcttacatggtctttcgtctctacaggatataacaaggccttatcggctctggtcgtccccagccgaagttcccttaggttcctcggaggccttgtcaagacgacgtaaagggacatgaggataggtttcaacgctaggtgtcatctaggtaagggattatcgggaaggaacactttgattgtcgtctgtacctgaaaaataggctttattgaggctgtaagatgtcttacaagtatggatactattgacttatacatagaatttacgtaattgatcaatgttccaggaatttgccaactcgcggccatcgccgtctgcgattttgaatgcgcctggccacagaacttgtgtgatcgtgtacggtccttcccatttgcgtgagagcttgttgcgccctgcttggctttgaacccgtcggaggacgtagtcgctgatcgaaagcgtgcgtgctcggatgcgcttctcgtggtaacagcgaagggcttgttggtagctggctgctcgaacgacaactcgtttgcgatgtttctcgagtagattcacatcgtcgtatcactgctcctcctgatcctcattggagtacttctgtattcatgtactttgatgtcgtagctcggtggggagcatgccctctgagccgtacacgaggaagaagggtgtctccttgttggacgttgtcggtgtggtacgcacggcccatagtactgatggaagttcctcgacccacttcttgtcatgtgacatgagcctgtcgtagacgcgggtcttgattccttgtagtactatgccgtttgccctctcgacttgtccattgctctgagggtgagaaaccgaggcgaagcagatctttactcccaacctgatgcagcaatcctggaaatcgacactgatgaactgggagccgttgtctgttatgatacgatggggcaatccgaatctgcagaatatccctttgatgaatttgatggtgttgtcggccttgatttctcctgtgggtgtcgcttcaattcacttggtgaatttgtcgatcgctacgaataggaacctgtagccgccttgtcctcgtgggaatggcccgagtatatctatcccccagcacgagaacagccaagtgagagggatagtctggagtgcttgcgctggcagctttgtgtgtttactgtggaattgacaagcttcacaccactgaaccatgtcgcaggcatctttgagggcggttggctagaaaaacccttgtcggaaagcttttccgactaatgtccgaccggcggcatgtgacccacagatcccttcacgtatgtcgaggaggaggtgtctgccgtcgtcggacgagacgcattttaggagtaccccatttggtgccttcttgtatagatcgttgccgatcatacagtagacttttgctttacgggatattttctcggcttctgcgtcgtcctcgggcaactcttcgctgcttatgaatttaatgagtggggtgcgccagtcgtccgtggtctcgatatcggcaacggcgcgctctgcctctgtagcccccgaggtggtgtcgggggcgaccgggctatcttcgccgcttgcctctttcactgatggcctcgtcaggacgtccagaaaggtgccaggttcaagtggttctcgtctggacgcacatcatgctagatcatccggttcgatgttgtctttacggtacacatgtcggacctcgatcccatcgaaccttttttctagcttcatgacttctgtgagatacttggataactcggggttagagcacttgtaatctttatgcacctggttcgtgactagtttggaatcccctttcacgattagtcgcttgactctgagtgcagctgcagctcttatcccggcgagtagtccttcgtattcggctgtgttattggttgccctgaagttgaggtgaattgcatgcttgaattgatctcccgaaggtgatgtcaagatgaatcctgtccctgctccctggctgttgagtgcgccgtcgtacgccattgtccatgtttcattgtcgatttggttgtctgacctattatcaggcatggtccaatcgactacgaaatcggcgagtacctgtgacttgatgattgttcgtggcatgaagtagatatcaaattggcttagctcgactacccatttcgcaacgcggccgacaacgtctttgtttctcacaacttcaccgagagggaaggaggagacaactgtaaccctgtgggcttgaaagtagtggcgtagctttcttgatgtcatgattactgcgtagagcagttttggatctgtggatatcttgtctttgcgtcgtggagagcttcgctgacatagtagactagtcgttgcaccttctctctctcgacaacaatgacagtactaacagaatatggcgtggcggcaatatagagaaataattcttcattaggttggggggcaacaagtacaggtggattggataggtagcgcttgaatgcaatgaatgcctcttcggcctcctgtgtccatacaaatttgtcttgctttttcagcagagcgaagaaaggttgtcctcgctctcccatcctagcgacgaacctgcttagtgctgccatgcatccggttagcttctgtacttccttgagtcttgtaggcgacttcatgttctcgattgccttgatcttctcgggatttgcttctattcctctgccagagacgaggaagccaagtagcttgcccgatggtactccgaacgtgcacttctctggattgagcatgaggcgatatcgtcggaggttgtcgaacgtttcccgcagatcgtcaatcaaggagtcgcttgccttggtcttgacaacaatgtcatcgacgtaggcctcgacattgtttctgagctagtcactaagtgcaccttagaccgtgcgctggaaagtgtttcctgcggttattagtccgaacggcatcttaacatagcagaataccccgaacggcgtgatgaatgctgtcttctcctcatcctcttttgccatgcttatttggtggtaaccggagtaagcgtcgaggaaactcaacaactcgcaaccggctattgagtccaccagttggtctattcgaggaagaggaaagtgatccttgggacacgccttgttgaggtcggtgaaatcgacacacattctccacttcccgttggccttccgtaccatgactgggttggctagccactctggatggagtacctctctgatgaaaccggctttgagaagcttgtcgagctcttctcgtatggcttgttttcgatctggtgaaaatctccgcagtttttatattactggcttggcatcgggtcgcaccatgagtttgtgctcaatcacctccctgggtaccccaggcatgtcggacggctgccaagcgaacacgtcagcattgtcgcgggagaaggtgatgagcgcgagttcctatttctcgcctagtgaagccccgatcttgatggtcttgtcggggttggcactggatagtggaacgatcttgattgcgccgtctggtttcggcgtcttgtttgtcttgctcactttcttgggtggctctgctgtggcaggcgggctgggcgtgtgctcgaccatgtcgaggctccgcttgtcgcattgtactgccagcttagcgttcccttgaatagtgattgttcccttcggtcctggcatcttgagcacttgatacgcatagtgagatgcggccatgagcttcacgagtgcagttctcccaatgatggcattgtatgctgtatcgaatgcagcgacatcaaaggtgatctgttccgttcggaagttgtttgcttggctgaaagtcacaggcaacgtaattttgcccaatggtttggacgatgactgaggagtgattccatggaagggttgatcggtgggtgtcaactcgcttcgtgggatccccatcgcgtccaaggtgctggcgaagagaaggttgattgagctgccgccgtcgatcagtactcgggcgaccttgatattacgaatagtgggttcgaccatgatcggatattgccctgggatgatagcagtcttggggtggtcctcttctgagaattctatctactgctcggaccacttcatcttgggcgcggccccctgccacgtcgaacagacttcacgttccactttcttgtattctcgctttgaggagtatgccgtggaacctccgaagatgtgtgagacatggagatcgtaatctgggtatgctaagtctgattcctgagtaggcgccttagcgtccttctcaaccacgcgtactcgcttgcctttttccgatgccatgtgtttggcgagcgactttttgaagacgaggcaatcttctagagaatgtctgtccgtcttgtgtatagggcaccatgctttcttcgtgtcgctgccttgtgggtctgggcgcttggcagggtccgcgtattctgttgcgagaacttctgattgagctttccttttcccactcttgcgatttttctttttgcttgactcaggtgcgtccttggctggtttcttctctccttcggtctttggtttgtcgttcttgcatctcagtgcgtcatccgcatgagcgcatcggtcgacaatttcgaataatctccgagtagtcatgatgcgcctcgttaccaactcctgagtagtatagcgatctctgacaccggatttgaaagcgcgaattacagaagcatcggtgatctcggggattgtgtttctgcactcgttaaagcgccgaacataatccctcaaggattcgcccgggttctgtgtcaacgcatgtgggtcatcttcgatcgcgtggcgcttgtaagttccttggaagttggctacgaactgctgccacaagtctgcccacgaagagatcgagttggggggaagatgcatcagccatgaacgtgcaaagcctttaaatgcggttggcaagtaattcactaacgcgttgtcgtccgctccggcagcgcagagtaccgtggagtaaacctaaaggaactcttctgggtcggtgctcccatcgtatttctctattgctccaggtcagaatctttcgggccatcggacatcccgaagtgaacaaccgaaagctctacacccaacgctgggggcggtgggttgttggcgatcatgcgtccttcgtggatgtctatccgatgatgaagatgacgaggatgatgacgatgacgatgggtcgtctagttccggcgtacgattacggggacgtcggccgggttctcgagaatcctgtcgtcgtctcccgctgttatctcggtgccgatctccatcatcaccgtcattattgcgacgtcctcgaccagtatcgcccagtacccgccgttcgcgatcgttgtgatcgtggcggttgtggcggttatcatggtctcggtcttcgcttgaatgacctcctcgatcttcgttatcgtgacgccgtgaagagatatgacgccgggaacggttctcgttgtctcgtgtgcgtcgtgcctctcggcggccattcaggtgatcgcggagatcgccggtgccgcgaggtggaggggttgctcgatgaggtgattccgccgttcagggtcttcaccatttgcatcgcaagttggtggctgtttcgggtgcgctgcagcagcggcctcttcgaacgcgttgctgaggttggtcactaattgcgttgacggctctgatgtgttgggccggagtagtcacttgattctccgcttccgcattggtgcgtgctgacgtgccgacatcgtcgatagccaatacctcacgaggcgtactcgttgtcgatgatccatagtcttcgagtaggtgcaagactgatggttcatggggatcgatgtcgattaccccaacaaatcgatctgaaatcggcgtcgctccttgttccttgtcctcatccctgatggggatgcgtgactgctggaccttaggaggtggcgtcttcatggcgctgagaaagaccttgcagctcgagaggtcgtgattctttgtcttgtgaataggacaatagacatcacgagttggagaggtacactgaattccacgctcttcgcaggcacgaatttcagcatggacgttgagaaagacccagcaggcttgcaggtgtgtttcctggttttgtggataggacaccaggaccttgtcacctcggaagtaatcctcgtcggctcgtgattcctgtcggaaagacaaggcttggccgcactaggatccttctcgggtttggatgtcgttaacgttccgatctccgcttcggtgggaggatccttcgacatggagttgaaaacatgaaaagaaaaaaaaataaaaaaacatggatcttcgttaactttttatgattcttttttttcattaaaacatgttttaatccttcgacatggctgagatcggcattgtggtgtaaaccggaaagacgtttcgccgacttgagtccacaccagtgttgttgaagttggaactccttggttgaggttggtgttgacgctgttgtcgacgaatctggatgtcaaagtagtagaaccttgagcaccaagtccccctacctggcgcgccactatcgacgggggatacccgtagaccggatatagagggtattggggtacgctggtacgaggatgtacgtagtacgacatcaagcaaacaggaaacagggattatactggttcaggccccttggtaggtaatagccctaatccagttgatatgggattatatgatggaaaccacatattacaaagggaatagtaaagctcgacgataccgacaggatcgtagtcgagttgatccgactagatctcccggcgacttggcttcgataagctctggcttcgtaggctgtggtagatgtgttggctctaagatttaatgccttaggtcctcccagggggtcccttttataccgtaggtcaactggtctccatgtcggactcagagacatcggacccgacacgatataatgacggccgatttctatccgagtaggactctttccatctgtagactccatgatggacttccttaacctatgctgagaacgtccgtatacgcgcaaacatactatatcgatacgtgacgtatatcgaagggtagagggtataccttacccgtaaccctgatagcgccgggagccggagccgctgtgaacgacaatatcaacggaggcagtttgcctcacaatccagcggagagacattcacagggtataaccttcgcatactgttaattcaatttttgatacttctgttagtcgtaattctattgcgttcgttgtatggtcatgatgcttattatatcttaagcatgcttctggttatgttagattttatcactagatcaccccactttgttcatgccatgattattgtcttaatattttagattaaaatatgtcaatatatgactatatttccaacaactgacaccgatggctttggtaagacctagcatctggcactcctccatctccctccatactcgctccatgtccatcaccgcaaggtcctccttagcgaacacagccgatggtgggccttctggaactccaaggctcaccggaaagtgaaccaggtacaagtcgatgtactccacttgcaaattcctacatacatgaaccattgctcaaaccaactacgaaaatgcctgcctttatcaattgtcaaacatatatatgaacatactccctccttccctaaatgtttaacgctgttgacttttttaaacatgtttgaccgttcgtcttattcaaaaacttttgtgaaatgtgtaaaactatatgtatatataaaagtatatttaacaataaatcaaatgataggaaaataattgtgacatccccgcccagagcttaataggattaatagaatactacaacttctttttcggaagccgatctcagaagaactctaaggttaagcgtgcttggcctggagcaatttcgggatgagtgaccgaccgggaaattcttagcgggtgcacgagtgaggacaaagtgtgcagaaaagatttgtgttggtctgcgagggctttctatgacctataaaagctgccagatataagcgggacgttacaataattaataattacttgaattatttgaataagacgaacgatctaatattttttaaaaaaagttaagggcgctaaatatttggggatggagggagtatatagcgagctctaactattggtgcatgctaaccggagtgtcctacggagtgccggcaccacacgaccggggtgtgcatcgctgatccataatttggatgtgatgtagagttcatctcgcgatgaaaccaaagccaacgcgcaccgcttctgtcgtggcctcaccaagggcagcctctgtgccgtaattggccgccgtgtcgaagtgacggtagccgactttaatggtgcataggacggcctcggtcacggcgaccggatcggctatatgcctagcgggaacgttgccgtgcccatgcctacccacggcatcggcttgccggagcttagcgccacctccggcatccgttttccctctgcaccgtccgcagccatggggggatcgaaggggcaattgtgggagatacaggattgatgaagtatatattgtgtgtccatactactaactatatatatatatatatatatatatatatatatatatatatatatatatatatatatatatatatatatatatatatatatatatatatatatatatatatatatgtatatat

SEQ ID NO: 42521 - DNA, 2316 bp, Oryza sativa
tttcctgtccacccacctgacccgcactgacagtaaccctaaacccactctctaccacaccgtctgctcaactcctctccctctcatctacctttttcacttctttggtgagcagcaccacctctcctgcccttatgtggtgcatcagccaatggaaccagtcacctcgaaccagcccaatgcggtggagcaagcggtgtgagggttatttccacggtgacggcggcagatccacggtgagcggcagtggtaaaactacggtagatccacctgagcttgacagttacaagctaagtcattctatcctgctcctctctttagggttcaattttttaatttagttagttgcatcgggggtatcgatatggtcacaatttccaaaatttcggttattttaatccgaaataatttgaagttttaaacaaaatttgatcaaattcaaatatttttgtggaattcacgaatattgcaaaaatccaaaaattccaggtgaaataattttgtatgggatccaatagacccaaaattttgtaaatttcagtccaaacttttgttccctgcctctctctcagctttcaccacactctttctttttctctccctctctctcccatgcagagcggatctgaaacgcagctagcagctgttattcttttggggtgactacgaatcgggcacccgacgttatttctcaagatgtattcaaaaaatgtttcaatattgaaaatggtaaaacacaatcaatcaaatcatacaatgaaaaattttggtacaatatataaaacaacacatccaagtgcatcgaaaaaaatgaaacaccatggaaaaccccacaacaacatttcaatttaactaatgaaacatccaagtacatgaactgaaacatcaaatattcaaataaaaaaaaaaaactagatcaacccctccctctgctccggtggtttgccaccacatcgatgtcggggtgccgccatgggtgaggaggtggcaccggcgtgcacctatggagatgacgctgtggccgaagaaatgctcaagaatctctaccacctgctcctgtggccactctgcaacaccatcgcccgatgccacgccgagcagggccacatccgtgtggctgccgctgtgctaagcttggccacgtccttgccaccaccactaccatggctttgctcttttgccaacccatgagcgataagctcttcgtgaatgctagcccgttgcctcacaaatagagaagagaaaaggcgtggagagaagaagggagagagagagagaaagggatgatggaatggataagaaactatgcctcacatccgacagtgatgaaggggtatgtatatttctatgtgtcagttgtaagaaccggagctaatgcctgcttataaacggcactgaagacgtttcctgtggtagtgacgtagtgtttcactatttcggctggtaacattggcaatttatttttgaccggaaaatagtggggaaatcccccacggtaattttcattaaataaaggaactgtaaaaaaagattacaaattgtcaatccatgattgaaaagagggtctcaaaactactcgaagtctaggtaaatgtagggttggtttggtttgagtcctatattggccttaccaatatttggcaatttcaatagtgtttattgtctatttggtttggagccaaattttggcatgcctaagaaaataggccatttcaacagttaatttaggctattttggcttcaatccaaacacaatttttcctttgccaaaattagccatgccaaaagttgccaaaatttgacattgacaaaaattggtaaggccaatttagaccacaaaccaaaccagccctagctcctctttcaggcttgctttccatctactgagagagggagatactttgttgaatataagatcatttctctgcctccacaagagccaagcagccactaagaagatttccatgaagcaaaaaggagacaaaaccaaacctctgcacttgaatcatttgatgaaaatcaagagaagtatcccatgagaacccaatcatattccaacaggctgagcaaaggggcattcaaaaaacaaatgatctcttgtctctcttgatcctaaggtacacatgacacaaaaggagggtacatttgggggcttgcaatgctttctctctaagagatcccgagatcccttgtatttgttctgtccaaaaacataagccaagcaaaaacttttgtcttcatatatgctttacacctccaaatcaaggcaaagtaactagggttgtagagaccaaaagcaaagcttgtagaacttct

SEQ ID NO: 42522 - DNA, 4153 bp, Oryza sativa
catcgagctctagtgcaaggtacccaacagcataggtttaagatactatgtcaagataaggcacgcaggggtatctaccgcaagagagtgaagcagggatgtgttctcaaagccgacggcacatgtcattgctcatgtgcaaagcctaagctgctccacgggccatgcacccatgtcattgctgccgcatcggagtgtggcataccagatgcagtatatgtgtcacagtacttcagtaagcaaacaatatatcatacatggagtggcgagatttatgggttcggcatagctggggagttcacagagactaatgatgaagtaatcaatattcctgacccatcgaagctccaaggcaaggctggaaggaggaagactcgtcacatccacaacgatatagacgagtcggaggcgggcagggtgaagcgctgtagcaaatgcgatgaacgtgggcacacctacaagcattgtcctaaagacaaggaaaaaccaagtgcagcggaggcaggactatcaggatcagtagcagatggagctcgccctacgggtgaaggcactacctcaactcgatcccgtcctagacgtcgtcgtgccacgtctggctacgtggtgtagttcttgtgttctatgttggcatgtggctttgcttgtaatttggttcaaacttatcgatgtgtttatgtttcatcgtgtaatgtcagacttccgcatgtaatgtctttaggtctcgtgatgtaatgtcagactttggcacctactgtctttaggtatcttgatgtaatgtcagacttcggcatgtaatgtctgtaggtttcgtgatgtaatgtctgtatgttttcgactgctcacctgtcgtgcagacgacgttgcttaggcagacgtagcaccacagcggccaccctgactaactagtcctcatctagttgcgcacgttcctaagccgactccccctccgcacggaggtaagtatatttaaggattttttgtacatgcctcgcacatctatgtgagccgattgatccaattgcttcaggatttcatgcaccgttcagcaccccgccttccacgggtaggccatctgttgtgcccctcacagctatttaaaaaaacaatagtacttcgacaatcaatttacatgcattttatgtcttagtttacaagggtcccgttgtcgatgtctaggtttcgcccagtttgctccgacgcaggtcgcccacttctcctaggctgcagggtcagcgtctcaggcagctgcgtcgacctcgcactcagcgcagttctggcagtacaccgggacttcgtcacaggcagtcggcacgtcgagtcagggtccaccactggacaatgctaggacctcgtcggactacggggtggcttccaccttgctcttctccatgagcgacttcgacttcgcttcagtctcgacagaggacgtcatcggcccctcacagctgggaggcgcaccgccggtgcagacgcaggaccagtcgccatccactccagcgccagacactcatgctacccgtgctgtgccaccgaatcgtttcacgtactcccaggaccacgtgcgagcacaggctcggaggaccaagcgtggtcgcggcgcggggcagggccagtagagcagacttatctttgtttatttactttacatgctagtactgtatgcttgtgtaatgaatacgttgttgttattcgggtttctcatccctgaacttcgctgttaatttttacgaaagcacgatatctttcggcacatgcatgacatatttctgccgcaccgatgcagcctcctttattcgcgtgcgatacgactgcggaatggctgacccaccagtgcccacatacaactttcggcgccaatcaggcgtacccaccatggcccgcgacgttgacatgtcagggatatcactgcgatttttggtgcctatataagtcgccttaacgagcgaggcctctgaagcatctaggcccccgttgttaattttggtaattaatgacaagcgctaagtgtggactaaccattgctattaagatatattttaagttaggtccacgtcatgtgtgcgcatggatgattatcgatggattaaaatttgatggagcgaagcgaagaaaagaaaacggtaaaactagtgctttagttttaaaattgatcgaggtgaagggcgatcaaatttgctagtttatttttagtttcgccgtactatcaaggggggtaatgacctagaaatgagatgattttaattgccacattaggtcattatgcatttagacttgtgctcacatttcatctcacacacacaattattcatctttcactgggatcgtcctgaccaggggcggtcagaccggccatagagtgacggtttgaccggagtgccccggccggtctgactggccccaagcgggcggtctgaccggcgcataaggccggtctgatcggaggcacatgcgcggtcagactggccccctggaggccaggatggtgttgctcggggtggccgatacagagccgacggagccgtatttggtcagaccgagctgatggcagtctgaccgagccaaggccggtctgaccggccactcactatcggtctgaccggccaggccgatggggccctctaacagcgctacaacggctcgttttctagccgttgcagagtagcacggtctgactggccacatacctccggttagaccgccagagcattgagttggggaatttcgcccccaacggctagttttggttggtgggagtataaatactccccctccagcagcaaggggctctcttggcacccaattcaattgcatacaccccttgcacctctctcacacccacttgagctttgtgttcatccatctagtgtgttagagggttaattagccaagagtcaagtgcatttgcttccattgtagagcttgtgtggcacttgattgatcatctccacgccggatcattgcttgttactcttggaggttgccgcctcctagacggcttgtggaggagttgcctggtgacctctccgagaagattgtggaggaggcccggcgtcggttgtgagtggtttggagttcaccatcttcggagtgaaggaagaactaccctagtgatcgaggcttgggtagtcctctccgtgggccggctcccgccttgcccaccccttgacaaagggggcgtgcggtggcttcgtggttgagcggtgtagttgggctcgcctcaacggggagtaggaaaccgacgagtttccgaacctcggtgaaaaatcttttgtctccttgtctcatttacttgttgcatttacatttgtgcaatttacatttctagatatatactagagaccatttcaccttaggattgctaaacattaacataggaatgtgatttactttcctagagatataattgagccattatcacgctaggtttgcaaaacataacttagttacttagttagagttgaccctcaccaagcctagcaacttaggttagttttgattaggtgtcatttagtttaaatcgcctattcacccccctctagtcgacatctcgatcctacagcctcacaatctttaataactcagtcacattcggtactctcttccccacttgcttcattacaaatcctaccagctttcgtcaatgggtagacgcctgggcattgaggatccgaattggcatagtgatccttgtgtatacctactaccaccttggtgccagcgtcctctctgcctatgcggtgactgatgccaactaatggcttcgaggaatcctgatattcgaggaaggcccttttttaggtgccctaactatgaccgtgaggtattttattatttgcatatgcttattcattccgtatgggcaattattttattcttcgtaatactactctattcgtcaggcccgcactacggcttgcgtatatatcgagtgggtcgatacagaaaatcccgttctcgacctaaccacttgtttacaagaaggatgctggtatttcgcattcgaaagtactgagcaatacttgcagagaaaagcggcttacgaacgataatgtcgtgaacaacagtgcaactagcgggtgctaactacggcactccctccatgggaagcccgtccaagatgcacaagcggtgatcgttgtgcaggttcttc

SEQ ID NO: 42523 - DNA, 6217 bp, Oryza sativa
  unsure (1)..(6217): unsure at all n locations
attcctgcagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggacggtcaccgatgagctcggaactgcggcagcgaggtgggcatcggagagcggggaggggagcagcgccgtgagtggctatgcctaggtggggttcgtggagcgggtggtgtggacatcggcgagcgaggcggcgatggctgggagaccagaggattcgggctgtggctgcggcggaggcggcagcgtgggagaggggtgatgcagggaaggagcctaaatatgaaacgcagacgacgcgacagcgacggcgacggcggcggtaggagaaggaaaagcggaggcgagcgggaacatcgacgatggtggttgcgaagcttggggaaggtcgccgacgagctcgggtgtggcaacggcggcgacctagttccgagacggcttcgtgtagacggacgatgcgaacgggagggcggagtggtatgaaatgaagaaattcatggttctggtggcaaaatcttaaagacctacgaattgaatggtaaattcttgaaagtcagcatattggatggtaaataatgaaatttctcgatgttacacccacgttttctattttgatacaggagtatgtcaaaatggttaatggtgtagttctgtggaattttcgaaccataatatctatggttctctgatacgcactaaaatatatatggttccgtgtaatttggaccataatacctgtagttttgtacaattgatataatccaattagttaatgtttggaacaataaacaccttgtattattagttatcacagaacaaaatgtattatataattttttttatcacaaaatttcagataacatagagtgagtggaggaggagggcaggataaaacagactcggaacaaaaacgggtcaaaaacccaaacctaacggcaagtcttggtacgatccgacggtcacaaatttgtaaagaaatacaaaggaataaatcttttcatctccctcaactcttgctcctaattaaatctgtctccctcaagagtataacacctccccaaccttcgaaaccagagcaaatcgagtccctcgattgtttggatagcagtttcatctttcatgacgctcaagagacccacgtgtcagtgagaaaaattaaaataataataacctcacatgttagccattcatttcttacctttaccctattaggaaacgataggcaaataaataataaagaatagtagatcaatcacagaagacacgagatttgacgtgaaaaaccctcccaaagtaggagaggaaaaaccacggatgccagccagcgaatatcttcaccatatcgggtgaggttacaacaccgaacgacggtttacaggaatatatatgaaggtgaaaccctaaaaaaataacgatccataccgtttcgctccgtttgaagtgggcctgtttagttcactaggtaatgccacatctagtactaggtagctacattttgaaacggaggaagtactgagtataacacctccccaactttcgaaaccagagcaaatcgagtctctttggatagaggtttcatccttcatgacgctcatgagactgtcggtgagaaaaattaaaataataacagcccccacctctccctaggccctagagcaaatcgagtctctttggatagagatttcatccttcatgacgctcatgagacctacatgttaatgagaaaaattaaaataataacagcccccgcctctcccaggccaggcccacttacatttggcaactttcatatgttgtagactgtcctcacagaccaacacaagtcttttctgcacactaggccaagcacgcttaacctcagagttctttagatatcggtttctggaaaataagttgcaacttgttgatgtaagtattctattaattctattaagccttgggccaagatgtcacaatccatgagccctgcgctgcatccgctggccttcgacccggttgccgaggtcgctagggtggtagacggcggccgacatcggcgagctcgcagggagtgcgggtaggaatagcgaggagctactatcctgaaattgttgtcgccgtccgacaaggcatcgttgccttgctcctctcctgacattcgatgggagtttcccggactaggatgccacatcagtcaaatcagctatccatattgtcttactacttcagggcctgtttagttcactaacgaaaatttttagcgtgtcacatcggcgatacggacacacatttaaagtattaaatatagactaataacaaaacaaattacagattccgcctaaaaattgcgagacgaatttattaagcctaattaatccatcattagtaaatgtttactgtagcaccacgttgtcaaatcatggcgtaattaggcttaaaagattcgtctcgcaatttacacgtaacctgtgtaattattatttttatttatatttaatactccatgcatatgccgaaacattcaatgtgacagggtgaaaaatttttgtttgggaactacacagggccttatttaacccggttttgaaagatggatgtttaataatttctgaagataaaggacctacagtgaacttattccatcccaaaacagtgtggtggtgtggcttggatgggccgggctgggcctcctacagtccggctcggtccaactatatatctctcccacctttatctattctattaacaaaaaagtgaaaaataaagaaaaattcattcttcttctccttctccttcttctcttcttggaggatatttcttccccctccgtctccggcgccgatctgcatccacccgccgagcagagaccagcgccgccgccgccgccgtccgttcctcctgtatcgcgtcctggtgagcatccgcccctcgttacgcacatttttttattcgaatttttttttcaagaatgaatttctgtgcgttaaccctagatagtacgtagcttccgttgtagatctggatctggaaagcttttctcttgatttgttcgtaatgtgatactaatagcagtttctttgcttgtttgtttgtttccctaaagaaatttcttttttctgggatgtccgacgttggagacgcccctgtgcagcgccgctcttgttcgaatccggccggtggtctgtaggattgggcggctgcggcggcggcgagatggacgacgacgccagcatgagcataagatgggggggattcttcgagtcgccggcgaggaacctcggcctgcagctcatgtcgtcggtgcctgctgagcgtgacaccaagcagctgctctctggtagccccttcctgcatcatcagcatcagcagcatgtcccgcaccaccaccatcagccccatcacccgcgtgactgcggcgccaatggcaatgccaatggtggtgctatgcctcctcctcctgccacggaggctcccccttcaatgccgatgaacttcgcgcgcagtgacatgtggatgcacccgcaacagcagcagcaacatcatcatccccgcgagcacaaggctcttcacaatctcactgttggccatggttcttcgcacattgcgcatcatgacccagtgggctatgggatgatccccggtacgcataccctgcagatgatgcagcagcaaacagagcctcaactgcaacccccaccaccgcctcagcagccaaaagaggaatgcatttcctcgccattgatcgaggaaaatgtacctgttattgatgagccaccacctcccaagaagcggcagcagggccgccaacccaaggtaccaagggctaagaagcccaagaagtctgctgctcctcgtgaggatggcgcaccacccaatgcaccagcaccacggagaaggggtcccaggaagaatatagggatggtaattaatggtattgatttggacctctcaaggataccaacgcccatttgttcttgcacgggcgcaccacagcagtgctatcggtggggtgcaggtggttggcaatctgcgtgctgcacaaccaccatctcaacgtacccactgccaatgagtacgaagcgccgtggtgcacgaatcgcaggcaggaagatgagccatggtgcgttcaagaaagtacttgagaagcttgctggtgaaggttataatcttaataatccgattgacctgaagaccttctgggcgaagcatggaacaaacaagtttgttaccataaggtaaaagacaatgaaattctaaaatttgttggctttgtaggttgctctgcagctgtttggtctgagtaattgtctgtatgtactctagattacaaactgcagaatccttttaggtgtaggttttaggcatgtcctgtccctttgcagtagtttacatgcctcatctgtgacctgggtgctgacctgtatggtggctatctgcatgtatctttgtcattatctttacaagtagcagtgtaatgcgacaatctctaatttaggtggcatgaaagttaatctgttcaacgtttctcattatgcttaagtcttctgttatacaatgctccattgcaatgcctggatgttttacagaatacaatatagttgctatctcatgaagtagaaacgttatctttttcatgctgtgttctgtatgcatgcaaagtttatatagcctatatatacatgtcttttcttttattgaactgatgtttgcatgcatgatgaatgtgggcaaaggttctgtacctaatctggattacttaaccagttctaataatatctttactgtgagcaaggttcttgccaatttcatttgatgtgctcaaatctctgtcagactctattccgaagtcccttggtatcaagaatttttagagtaaatgctgaggaatgtcttttgccacttgtctaatgtaacatgcctttagttctgccttatacgtagatggaactctgggaccattgatgtcatctttgctatttagtgattaccctttaagtccatgtgttattatttgcacttctttaggaggcaattattggctagtaatctaagtcctatgtttcaaactcagcactttgtttaatcaactttgtgcaaacagtaaacagcagtcaaaatattgcaattacattctattattttttgatttgatgatcttttttgggataaagaaaattacctgtatagtttgaacatattctgctctattatgctgcaagatatcaagctatctgcataaatcttgtcatcctgaaccttcaaaaaatacagtaatatttcacatgttatgcattcaaaatgttgatcctgtctactagggcaatttaactctgtcaaggctaattgcattataaggtatgcatgttctctattttttctatttgtagattacagagaaagtggtgccatttgtaataaatgatgttatgattcagcaattttcttttttataataaagtactataataattagaatgctgatatgagaatgaacgatgatgattaatgagcatcagaattatatgaaatgttagataattaattatcacaaaagctattttctttccaacttcatatatgctgaaatgtgggttgctgctagtttcgtgttgcctaaactgcagtgttacatgagaatattgaatgtttgcacatatgttttagaggccttgagtgccacaaacgatggacagcacctttttgtaaaatgtaaatacccagtaaaattattgtgcaaaatatttggtagtctatgaagccattaggaaaataatgtaattctgagcaaatagaagctaatagtgccaataccagagctattgtgatagatattgttcactgatatgatatgtgtgaaacgttataacttgagctattgcgaattgcggtagcagagtgtgcgatttatcagcatcatcatcgtacatctgggaatgttgtcttgggtgatctgtacatgtactctagttccata

SEQ ID NO: 42524 - DNA, 1163 bp, Oryza sativa
tatgatgtgatatggttttccctactgttcatacttgatgtgttctaaatgagagtgtgacactacgtatcttgaagctacaaaatgataattacccttttattctgtctatacatgattgttcctccatttggtcatttcattgtctcgtgtggtcttcacatggcttcattgttacttgctgagatatatcgaaaccaatctcgccatcattcatccattctgatgcattttgcagtagtgcttattgttttgttgtacaaaagattattatttattagtattgtatagaagaaataaacaaaagcagctctaataaggtgaactacagctgcggctaaaactgggcaagtttttgcattttaacttatggaaaatattgtttgtgcaactctccaaggaccaaagggatctgtattggccatgtttcagcacacggcaatgaggttcagacttcagaagtccaaactgatttgtgtcttcccttcccaccatgtactactgataatcttgcaacttgaaactcatcattgaccaacagtttcatcgatcagagcctattaacatgcagagagagaatatctaatagcatatgtggtcaagtttgctcacatcttaagcttttcttagatttctaagggcgtttacagtgtgccgttgtggctttcagccttactcccaggaaccgaatattcgtgtccacgtactcaaaccgtttggcctcctcaggaccaaagcacccatctttttatcctatggcaggattggtgtgtaggcagctcaaattcctagccccacatttctgccatacagcacccctttcatgaccctggtactactaaagaggaaggcaatgtttgatcatgctcctcctgcagtaaaaagagcacattccagctgggccttattgccttccctctctgataatgggctttctgatcaggagattttagatgttgcacctttgcaagcccagccatcaagtccagaagtcaccctagtagtgcttcagattcctatggctcctgtgaaaaaaaaggattggaagactatcctatacaatcctactagaaggtagagctctaggcttcttaatgccaaccaagagctcaaatttgatcatcgaatgggaattggcaaacaaaggggaaaatcggctaaaa

SEQ ID NO: 42525 - DNA, 3229 bp, Oryza sativa
ctccaatgtctgtgcgcagttgagaatatgaattcgttcatttgcatcgaagtcgggggctactgtcatggttatggataccacatacctaatagtagttggctatattttggcaggacccaccacataccatgtcctatacgcagtcaacctccggatatggagggagttccggataagcatcgctaactagagttctacatggaaacgataatgactactcagatagtatccatattggtttccctcgttctacttgcacaaggggacacctatgggataaatacaagaccccctaggaggagaggggagaaccaccacggaagacacccatgacaatcaacacacgcccaccagaagccacaacatacaagcctacatacgccaagacacaccgccggatatcgacttcagggataggcatggctattcccctacggtgtctccggataccgtcaggagatacgaaagcgctatctctgatctcgccgggcacggattcgaggaggaagactaccctgttgtcgactacgagtcagaccttcagatcaacatgtggacaacagttagatatgctgcccacatattgtactggtgtgattatggtgaataaaagcaactccggctccggccaacaggatgtagagttattacctgacagctcaggggcctgaacctgtataaaaatccccgtctccgtctcttttacctcagtctcgcgtatatcctagcaccgacgatccccatactgtccaaataccgtagtcgaaacatcaaacgtcgacagtggcgcgccaggtagggggattttggtacttcaggatttcgacgagatgggtttaagagatggattctccaacaacaagctacttgacgacttccgaccaggaagattcaacccggccagagtacgtctcccaacgagattggaatcatcgtcaccatctattcgatccggtgagatcgaccaagcttcgacacgtcaccacggcagagggccatggtgtcagcggcatctaagactgatccaacaccaatccctcgacgcgtgggacatcgactggcgtaaggcattggctgcccgagtagccaaactcggctggcgtgaggcattgatctgttcattggcttgtagtctaatcggagttgaggagttcctgtgattgcactagaattcaattcctagttggcaatcgagctgctcattctggtgacgtaagccaaaagcaaatagatcaactaaacagccaaaaagccgcagtacaaattctaaggtaattagtaagattaatttcctaattaatctactaatttcgtagatatatccggcatatatctacaaaggtacgcaatattttatatataatttaccgtacctattttcagattatacggcattgtcagatctataatttattatgtttacctagagcatgttctttatacagtatatatcgcgcgagcgtccccgatgttaggccaactgcggtctaacgctggagcacgctctgttttcctctgtataaatcatgcttgtttacggttacataatgcctaatatttaatctgctcgttatatcctgataatactagaagatccatgcagtttttcgaatacatactcgatattatctgctatatatcttgtcttctagaaaatatttttcaggaacaactgagcactcgactaggttatggtcgagtacactccattatcgagaacattctcgacaaatgcgagttatcgcacccaacctaccaacaaagaccgacgacctatctcatagcaccggccatggctggactactcgagaaaaggttgttaatggataattcctcgcgaacatcgtcggcttgatcacccgacatgattgcgaacggacatccggatatgctgtaagttaggcacgtgagtcatgctggccacatgagatacacttgcaataaaccaactctagcaccttccatcggtgttcgagagataattccgctcgctcactggttctcgcaccagtacgcagcaatctctcgcaccgcaccttccatcggtgttcgagagataattccgcttgctcactggttcccgcaccagtacgcatcaatctctcgcaccgcaccttccatcggtgttcgagagataattctgctcgctcactggttctcgcaccagtacgcaccaatctctcgcaccgcaactcccatcgttgttcgagagataattctgctcactcactggttctcgcaccagtacgcagcaatctctcgcaccgcaacttcagatggtcgaggtacgactacagcaataacgtagtggtcctcgtaccacgactcaaaatgatcgagagacacctactcaccggttctcaaccagttaatcgtagtgatctctcgtacatttgcttctagtggtcgagttacgactactgcctggtcctcgaccagcgatgtagcgtttctcccactttccactttaagtggtcgagttacgactactgcctggtccacgaccatttctcccactttccactttaagtggtggagttacgactactgcctggtcctcgaccagcgatgtagcatttctcccactttccattttaagtggtcgagttacgactactgcttggttctcgaccagcgatgtagcgtctctcccactacttccactttaagtggtcgagttacgactactgcctggtcctcgaccagcgatgtaacgtctctcccactatttccactttacgtggtcgagttacgactactgcctagtcctcgactagcagtgtagcgactctcctactacctctatttcaacaaagttgatagcaggtacacaatatcgccaagtgttttacccagagatcccttaccacgacgacctagcgttgaaacctatcctactgtccctttacgccgtcttgacaaggcctccgaggaacttaagggatcttccgttggggatgcccagagccgataaggccttgtcggatccttcagagacgaaagaccatgtaagatctggtcgtgtaagagttctcgccgtgcgtattaaccaagccgtgtaatcggaagttgacttttccaacttcacggctgggggctaggatcagtgcttattcaaccaaggtaggtcaaggtccaagagccttctcctccgaaaatgattctccgacgacaaggctgggggctagggagagtgtacaactcaaacgactgaccaaagtcgtta

SEQ ID NO: 42526 - DNA, 1790 bp, Oryza sativa
gactattatatctataagtttattatgcaagatattatggatcacaaaatttacttgtagatatggcaaaactaatatttatttattatagttattaaaaattatttatgtagcatataaatagatttgtttatatagcaaacatgttgtactactatccacaaaataaactacatatacatttttaataattaaaaaataaataatatttttatgtcatatctaagaataaattgtcataaataatatcttgtattataaactcataactataaaagtctcaaataataaattcttatattttacaaatttagagtatttgtttttcataccatagggtaaattagacttcttcataagagtttaactgtcactgacgtaaaaggtatggaaggaatccaaactaaaattcagagatatataagaagatgagcaaaattcaggaacatataaatgggcaaattttcaaagacacgctagaaattttctaaaaaactaatcaacacacctcaacctttaaaaaacaatccaagcacccatcccagaacaagttactgttctttagtcttcatgaccaatcatgtgacatgcgcacacgtactctgtaccacgcatgcacgctgctggcacgatgatatcgtgtgccgcctgcacctgtttggtcagtactgtacgcggtccgagcatgaacaatgtatagtggcctcgaggtttagcttcgaagagagtgtgcaacatagattagagcaaggctaatacagccgacctgttggctataaggttctttgtagccttctcttagcctacccatataatagttagcactttattgttaatacagggcccacttgtctctctcacagagtttcttggtccttgtgtccaagccggctataagtttacagcccgcttcttctctcttctctcctccacccttagcatttagccagcttatagtttaccattatacttgctcttaaagataaaatcacaactgaggatacctcattcccaatgcccggtgatttgaatgggtctagaaaaggatttgcttctcagccttacttttttttaagcaagaactagctctatctattactatattatctataaacaacttaatagtcttcacatataatagttagatacatatttattgcattattgataattggtcacaccttattcttacaaaatttcttagtgtccctgctggaactgattacaaatctatcgcttgtttttttttctcttctcttttctctcctccaactcagtacgaatttgaggtggcaacttctatagctcatctatatcaatttattgtacatgctcttacagtctataaaataatttaactttgatacaaatatgcacattaatcccttatatcataaatcattttataacaatgcactggccctcgtgtcaggtgaacaaatactcctctgtccttcccctagctccattcctttcttttttgttcttcgatatatgcatgttgccgaccttctcaactctttgttgctgttgtcctttttggctctcgatggcaccgtagctctgtgctctagatttggtcactgcccttctgtgctttgggatctgtcctccaccgtcgtcaccagtggtggagctacatgttacctatggggtcagggtttttacaaaatagccaaaagctattgatatttgggttgcaacaacagaaaactggccatccatccctcgtgacttcaaccagccaccatagtgtctttgtgctccaaacgtggccgccccgccactat

SEQ ID NO: 42527 - DNA, 7100 bp, Oryza sativa
gccccctccagcaccacagaggcgccccctccttcgccaccgccaccggcggctacaacccgacggccgcgcccaccacgccgccgtgcagctacggcgacatgtcgtcgtgctcggccgtcagctcgccggagaccgccaactactacggcgccgaccacgacatggtggcgcgcgaggacgacgtggactacgccgcgctcgccgacatcgacgccttcttccagtcgcccaagtgcatggactactccatgatggacccatgcagcacgttcttctcgccggcgccggagtccctcgccgccgagtgggaggacgaaggtgagatcagcctctggagcttctcctccctcaactgatcgatcgaaccggagatcgatggagaccaaatccatggaggtgatcgatcgatcgaagcctccacactctccagtgatcaccattaagcgcaaattcaattactgactgatatatcagtacgtgaccaagaattggccacggtacaataataatcatataatcattcaattcataactattatctacatatatatatgtagtatatacttaatcaatgtactagtgctactgcttcttgattattttaggctaattctgaattgcgtgggagctctgatgaagctacatgttttaaggcagctttccatggagcaaaactcccctcaattccatgtcataccatgtgtaaaagtggtgttcctgcaattgcaagtaatgaagtataatcaattactatgatgttaattatactcctctcaacttatgtccaaagcataatggtcctttttactagtgcagttatggcatgattggtatctagtcgacgcagaatttccgggatccttacgactgaaattaaattaacttctgtgcgtgtgtctgtggggcccttgtcagtcgtatgcgtctgtcgtatttcagtacccagctttgatccatcgccgtcctctgctgaaaatgctacacttgtcccgcttctctaattgtcaaatccaaaacgttttatttactaatcgagctgatgcggtcaatatttatttttatactgtcacgtatcaactgcagtatgcatctgtatatgtttgcaagaaaagggtatgggcgttgtgagctgtggtcaaaagcaacagagaatttcctttccctatcatgtaaaacagctggatttcgtagcggatcatggcgcgccgcttagattaatcgcagtgtccgtcggagaagaaagcgaccggccaaatctcaaaaaaaaaaagagagggtaaaaacgagaggaggcacgtatcggtctcgtcacgctcgagcccgaatccgcatttcgcggggtaatgcgagttcggatctgaggaaacgagcccgacccgttaaaggcgcgtcgtccagccgcccgaatgcccgatccacctcgtccatagcagcctcgcatccgaacccgagaggccgagacagcctcgcctttgccctactcgtctccttccttccttccgccgccgccgccgccgccgcgagggccatggggtacaccaaggagcagctcctcgcgcgactccaggttggtgccgccgccgccgcccactgggcgccactgctctctacctcccaactcctcgactgttcgctttgcgtcgtttcctggtagtggggatcggctggattggtggtcgtggatgcgccggtgctacggattgtagcgtcggcgagatgcttcccgttccgttctagcttgatttggttttggttagcatagttataaatggaagcgcgatagggcgtttttgctgccgaatttagttgggttgtgctgcggatagtttttttttttttttttaaccccggatgtgcgcatgaatcgaaggccggaattgcccagttatattgtgcgattatcgagaattgtcacatcctatgtgtggcaaactagaattgcttgccttctggcatcacagtggaccgcgactcaatttagtggtattgtcttgtgcaggagctcaacattgaattctcgtgctacgatcacccggttgtgttgacggtggaggaacaggtttgcaaaccgtgaagttcacacttcgttctacaatacttttgatggatttactgtaagtgctaattgaacttccgcaatgttaggccaaacatgttgggcatttaggaggtgctttgagtaaaaatttgctactgaaggtatgtgtcttaccaagtgatggacagttaatttcttggaacctattttcatgtattgatatttttaaattctgagtttcaggacaaaaagcataggctgtacgttgtttctgcccttgctggcaccaaagttgacatgaaaagtaggtgcatttcttgaaaactatatcctctttgttacttatttgaatgtatgccaactaattttctgttttccttaaacccattagttttatcacagcgtcttggtttgggaaaaggtggtctgcggatggctcctgaggaaaatttgcttgaagtgcttcaggtcagccattattcatgtttatctaaaactgcatactgtttgaaagcaacgaagagcgaaatatagtgcatctttcagtttcatatattacgtgaaaatttcacaaaagttaaaaaaaaaattctgcctgtgatgaatattgttggttgtgaaaaaacaaatatcccttcatgtattgtcttgccctttttctgtttcatctttaatgagtacttgaattttggtgcttcctggctctaccagcattttagctggatagcttattgttatagtttcaccctatataattttcttcacatgttaatgtattttgtccttgattatgtccaggtacccttaggctgtgttactccatttgcactacttaatgagtctgcaaggtatgggtgcttgctttcacatgttaattaaatatgattggaatgggaattcggtccattgttgtggaatttgtatttctaatagcttgaagcctttaaacttgaaaaaaaaaaactttgtgagctctgttcactttaccttaaacggtgaagagctatttactagtgtgatgtgctcattttatatccgagcgtcgttgttttcattccacttgatggtttccacttttaggatagaaattagaaatgcaaatgctatggttgtgactgatggaaccacatgcctcttgttttataatgcttagcttttaatgtgtcctattatattatacttatatatcagtttttttcatggttatgctattgcctttttaactgattcatataactgtgtatttgcaagcagtgctgtctcactactactggaccaaggtttcaagtcaaaacagagctgctacttccatccactgacaaatgatgtgacaatcggtatggttgatactatcatcacttccgtaaccaacactgtttcatcacaccatgtgtaatgtcattagttagtcattactgtgatactagaatgcacaccattccgttagttagttatcatggcacagtttcatgtaggttgcacaaggccttggtctggctactgttatattatttttataaggagggagacctccgttcaactttctttacctttttcaaaagaagaatagattagtaaaatggctttcttttcctgatttactccatttcagctctcagctcaagcaatctggacaagtttctcatgtccattgggaggcaaccagcttatgtagacttagaggtaatctttggatcaccggaatatgtgcatatgatttcattcggtccttccgtcccaaattataaggccctcaatatcatactttgatcattaatttcttccataatgttattaacaactacaaaattagtatcatatgaaagtactttcatacacaattctaaatgttatgaatgcgtaacactaaacatagatattattagcttaattattagttaaaagttaccaatattgatttttcctataaataagggtgccttatatttttgggatggagggagtatgtgctgggaagggattgtgaaattattggttttgtgcaggcttcaccagttgtaggcaaggataatcctcctgatctagcagattttgtaccatcaggtgtcccaaattctgcagaaccaattgagaaggtcacacctacaaatgttcctcgtcaaaatgatgtgcccaaagagaaaacatgtcttcctggtaagctgttatctactgatatatatattgtcccttgttatttcttctgtatatgcaatctatagtccttacatttgggcagtacatgagcgtagtagtagtgctactataaggaggtactactgtattataacaactattgttaattaaacaagcaggaatagatgacagtgtgaggatgaaacatgtgaacttgttcatgttgtcttttactcattaacctccatttcttttacatttttcttgtgtttttttttattacactttcaagttacaataaccagacatggcatactttgttcttgtatcagaagtgaaggctaagcctaaagttcagaacaagggtgcagaaaagacgcagagcaagatacctacaaacggagctaatgttagagaaatccgcaaatgatgtatttgacatcatgtccccgttgttcctttctgaggtaataagattgtgcatgatgaccctcatgaataatgtccactctttttgtagataaatttcttttgcaggtatcaaagaaactgaatgttaagcaggaagaactttcttctatatttgatggctttaaagaacaagccactattgatttggagagtgtaacggttagttctcttctgctatatgttagcactgattgctcatttgtgttcatgataggcaaccgtggtaaataccctagcttccactaatatgtgtcgaacaagcatctgtggtaaaaattaaccaaacaaaaaaaaaaagccatgggcctaagtaaatgttgcaagtcacaatttctttgtgaaggccttcataagaaactttcgttgtggtaaaatcaggcatcaaactgcccacgtttggagtttggtgtggtgatgtacttcagtttgaacttcaataaatttctacctcgttaagttgtgaagcatgtaacggacgcggctgtgtttcactgcagacgagtctgaagaatgcagcatacaccgctggatttgaggctggcttcgagactatgctcaattcaggtttaaaaggacaggcttctcggaagtaaattgtttcttttaatacaatggacataagtcgattcagtgaattttgtatgacatttagtgtaaaatcgatcaaattataaattatgctttcctttgacctgttgtctacttcatgtttgctcaatttttcaagaaggttgagagatcaaccttgtcagttgaggtaaaattagatctcttataagctctctaaatgaaaaacaccgttgaacggacaagcgttggaaaacaccggttaaatttattctccgtgtttgataaactttaaaacgttgcattgagcattacataatttcattgtctgctcaaataggaacattctgcactgccatgtctatcatttacatggtcaacttttacagcagatgttcttcagccatccatcattgtcaccaactttcggaaatttccatggtcgttacacattctacctgccattgccaacaaaacattagttaatcagagcaactttactaatcaggtagtaacaaaaagagaagaatggtagctatcaggttacttaactgatcaaacaggtatttctctttgattgctatttggcgatgatcttcaaatttagaaaagaaacagagagcgccaccaagcgtagaatgctgaaatgagaattgaagaacagcaaaaacttcaaaacaatagcataaaatcaatcaaatcgcaagtgaagccaattcccggaagcccttttcccccttttgttcttccatagtagattcattgtacataatcatgtatgatctcatgggaagagtggcagatgagatcaagagtggctgttgccttttgagtgtttggtcggaggttcaagacttcaagtaaggaaggagaagaagaaaacgcaagtagcgacgagaacaaaagactggagggccgtcatgtcattaccgccggcgtcgcccgcctctggccttcctcgccgtccgtactcccacccgtcgtcggggtcttcgagcccccgcggcggccacatccacgagaagggcccccacctcacgatcgtctgctccctgtcccggccatcgccgccggcgccgccgccaccgttgttggcgctgccgcggcgagctcgctgttggcgttggacccggcggcggcggaggacagcagctggtaccggcagacggggcaggagttgtggaggcggagccacggcacgatgcagtcggagtggtacacgtgcttgcacggcatctgccgcgcggcctccccgagctcgaagtcctccttgcagacggggcactgcgagccgtcggacaggtgcgctccggtgatctgcaccgtcgggagcgagtcgatggccgacgacggcgcgggcgccggccccggccggtcgttctgggttagctcctcgatgaggttgttcaggttgggcccattgaaatagttcccagggtcgatggccggtggagtagacggccgccgcgccaccggcggtggggacggcatgcgtcggcgaggcggcgccggcgctggagagggcgcgggcgcgggcccgggctggcggaacgcgcgtcctggcaccgcgggcgcaggctggcggaacgcgcggcccggcgccgccacggggggcgcctcgccaccgtatatgagccagcggcgcgggtggccgtcgtagtgcgggtggtaaggctgcgggaagaagtgtggcgggggcggcgcggggcgcggcggcgggtcgatctcgtggaggaacctgccgaagcagcgcggcagaagacgtcggtggacgggtaggagatgatgcggatggcgcggccgcactggagcaccagtacatgcggcacgtccggtggtgccgcacgccgccctgcgccggcatcgtcgacgacatggcgtggat

SEQ ID NO: 42528 - DNA, 4760 bp, Oryza sativa
  unsure (1)..(4760): unsure at all n locations
aaatcttgcgtggggtatgcatcttgcatgggcacggcgccggttttaagggcacgcgcgctattgcgccatggagagggagagctcgacggttgattgggtcggcgcgcgcgcggggaaattaagcgagtgcacgggtgggaagggatggctttgcgaggtggacgaaagcgattccgcggtcgcggcggcgtgtggcgtggtgaggcgacggcgtacgtagtagagaagggcgcgtgcagtgttgggcgcgggtgacttgtgcgtggtgcaaaagcgcgcggcttgcttgccggccaggaggaagaggaggacattggcgctcgcgggaagtaactgtgtcggttgggccatgcgggcagcaaggcccataggatcggcatgtgaatgtgggcctattctggagagaatcaggcaggattcgaataaccgtggacctggaatgctgtcgggcccaaagaggtcaggctggtgactggtcccgtcccgtcgggtggagcggatgggcgggcggaataatgctgcccgtgccggtcacgaatattcacctgcatattcttgccactgtctccgccagtcgttgtgaacgttacgctatgaactggtcgccgccgccgacgacgacgcgaggcatctgctcggagaaatatactcctaccatgagtccatgactttacagtactcgtagagtctcataaacctttcagccaaatataaagtcgacgtattaattggtcggtattttcatatcgaaaatagtagctcttgacccccaaaaaaaggaactgctgggtagctcttggccaataattatttctcataacaaaaaggagatgactaagaaaaaaataagaggtagtgcttgatcgtattcaaaagagtgtacaatacacgagaaaattttggcaccgctaccattctctagccataaagtagtccctccacagcccagattccaggcaccaacaacaaccccaacagacgctgacacatcgggcccacatattaacgggccccacacgcagcgaccctccggttcatctccacctcccaaaagatcgatgccctaacaacttggaagcccatctcgcctcgccgccccccttcatattcaccctccgccgcctcgtcaattccacgcgaacgcgagagctctcggaaagcaccaccaccagcacagagccagcgcgagagagagagagagggagaccaaaccccatcccggatctctcgtcgtcggcggcgtctgcgatggcgctctccgaccgctcccgcgagtcgctcctcccgagcttcctctacacctcctccgccgcgaggtccttcgccaccggcgccacccgcttcccctccccggtgtccccagcttccccggctccgggtgccgtcgggggcggcgcgcccatctcgatccaggctcccagggagaagatcgagatgtactcgccggcgttctacgccgcctgcactgccggtgggatcgccagctgcgggctcacccacatggccgtcacgccgctcgacctcgtcaagtgcaacatgcaggtgagttgggggaacgcctggatctgtgaccctgctggctttggcgcttctgggagccctgctccttcgtagatctggtgatatttagttttgttcgatggttagaggaacgtgtggttgcgaacttgtgatatccatctaggaatctaggcatgtcgccatccgtttgcgtaaatccagccgcgcgcgctttgctgtgcatacagctttgactgtcgttaaaatctgtagtttttatttgtcccgtcaatgttcttcgtcggttccaatgtgcttgcttctcattatttagttggcgtagggattgatgaggagtagatactagagtagctatcgatgttaaacatgttcagtactagtgtttctgcagttgaactggcgtatgtagaaactggagagttgattcacctgccctcttattaagttacactactaatccttcttctttacttggttgcaaattattccgctaccagcaattatatttatctactgttaagttccaagctttttgttagtgttagtgtcgtggagcaaaatgcttgtgtatcttttggtgaagatactttatatttctcactttgataatactttatgtttctcactttgataagtcgattggtgcatctcccttttgccggtctctactttgtttattggaatgtagtttgattctttgagatggttgggtaggcaggtaaaatgatcggtgaatgtgcgatgtccagtcaatgtttgttttaagttgtaattgaaatgtttctattatggattttggactgacaagttttggttgatttttttcagattgatccagcaaaatacaagagcataacatctgggtttggcgtcctcttaaaggagcaaggacctagaggcttcttcaggggatgggtgcctaccttgcttggttacagtgctcagggcgcatgcaagtttgggttttatgagttctttaagaagtactactcagatattgctgggcctgagtatgctcagaagtacaagaccctaatttacctcgctggatcagcttctgctgaggtgattgcagatgtggctctctgcccatttgaagctgtgaaggttcgtgtgcaaacccaacctggattcgctcgtggactgagtgatgggctccccaagttcgtcagatctgaaggcgctcttgggtaagtataaataacatgtttttatcttagaatctgatatgtggcaactctttctctagttttatgcgccttgacaaatctcattccttgataatgacaggctttacaagggaattgttcctctgtggggtcgccaaatcccttgtaagtattagtcactttgctacattgatattatttttaatgttttcatttatgtaactgctacacgagactggcactaaaacctgatgttccaggacttgcttgtgtgataattctgcactatcttgtttttctttgatagttgcaatatccaacactgcttcataacttgctaacttgtcaactgaattttctgtacaagtgaacttctattgcctccatggctcatgctgatattattcacttttcttttttttattgtcaatattttttttcatagtttatatggtttattcacttaagttctgtttacttattcatggttgaaatttaattcatttagttgaactagggttggtcagattacccatgggttgtcctgtgtccacccctaaacactggctatttcctgaaacaacacaaaaataaacccttcacatctgttactattttctgttggtagagaactccgtttcaaatttccttaaattaactgttctgttttggataatgtagttatcagtttaggcggaagtttactactactaaagtgttttgtagtttctgctatatgtgtagttccgcagattggctatcctcagttagcttttgttaacatttatatatatatgaatatttattgaacactctaaagtatgaaccatcaactgtgtatggattaacagtagctgtcaatgtaacagctatgtaactattatgtgataaatttatgcgtacggggatttgaacacagtgtggcatggcaccaatgagtttttgtttgtttatttttatgagagctatgctgtcatgttatttcttctatgcatccattgaatatttccatcgtgtccagatactatgatgaagtttgcctcctttgagaccattgttgaaatgatctacaagcacgctgttcctgttccgaagtctgagtgcagcaagtctttccaattgggtatcagtttcgctggtggttacattgctggagtcttctgtgccattgtctctcatccagctgacaacttggtctctttcttgaacaacgccaagggagctacagtgggtgatgtaagcatgtcttctactaataaaacccattatgtgcaagttttatttcttatcttgatgttactttcatgttggttgactgcatatgaaagttgcatttctgtatgttcctttcatcagagtccatcaaagttgtagttaatgttacataactgctcccatcaaatcttcgtaaacactagaaaagttatagcacaagagaggtttatttctataggcggattattaaaaatagtctgccagtaatgatgatgaacttgtgtggttaaatgagctgtcagtatcctaataaatatgggatatccgatatatttatgtactaagctcgacaggaccaccatataccaagttctatatggaatcaagtttcatacatatggcgaaagtcctgcatatatatggaatcaagtctcatgtattctattcatgttcttatcatgttaattgaatgtacatgtttgttgtattatcacaggctgttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42529 - DNA, 1176 bp, Oryza sativa
catgtggcgagtctcctgcatctaacgactctcgaggatctcttcatgcaccatctctactatcccctttctcctttgcggcattctcaatggcgtcgagaggcaagcaaatatgttagaaaggtatatgtctcttgtccttatggagtaactatgattttagggttttttaaaacaaagtggatgaggtttaaatctattagacaatttaggtgtctttcgtctacggtttagatacgtttagagtatcttggtttttgttatctctctttgttgatgccttatttgtttgtgtgaaccttgatgaaaatctaggtgtctgctggtgatccaactagcgacacttgattcaaggttcgagttgtagactcctttggtgatactggtttattgacctgtcaaaagaatgaagatggcgaccaatgctcgttcatatgcttttgcacgtaccggggttggtcaacgttatggatgtgctcgtctacttacatgtcttttggcaatctaagatgctctatttgctaggttttatattttctgatgttgtaaaacacggttgtaatcttttctcttatttgatatatttggcatggtttctactactataaaacgtagtcgccctccttcctccccttacgttgcacacacgaccgccctacccttaaaactaggaaaaaaatggttggttaaaaagaaaatcagagaaaaatggttggttaaaacaaatggttggataccatgagcatgcgtaatccatccctgcatgagcccattgcaatgtacggatagtcgggcatagcatagaataaaaatccatgttgtatacccctcaagtcgttttgactttggttaaagtcaactacttcaagtttgatcaattttgtagaaaaaagtagtaacatttttaacccaagacaaatatattataaaaatatattcaattattgtagcgcccgttccgtcgtggcacatagcgggaaaactatctcttaaaaaccctatttgcgaaatctgtttctttgcttgctgtctagtgtccgtgccatctcagatctcaaatccccgatctatcgtcgagttcaatcccgaatccaaatccttcccaaatcaatccctccgcaaaagtctgtttcgcctccctcaggttcgatgggccgaatctctctcggcccatct

SEQ ID NO: 42530 - DNA, 3423 bp, Oryza sativa
tggatcccccgttttcccaaagaggcaagggggcaagccccctttctctccctccttttcccctttttcctcccgccggcgtcatcctccgcctctgtcgccgttttggccgcgagcgccgagcgccagctcgcgccttgaccgctcaaggtcggtttccaaaccgacatcgtcgtcctataaaccaaggcgccctcccatcgattcctcctcccgtttcgctcgccgccaccacgccattgccgcccctttgtctcgcctccgccgttcatcgccaagcaccgggagagccggtgcgttcgtggacgcggaaggggactccgggcgctcgtcttcttcctcttccccggcccgaggccggagagatcactcccgcgccgtcggcctctcgtcactgcgcccgcccgcacggtagtgcctccctccgttcttcctcctcgttccatctcctccccttagactcgggtagtagcacgagtagcctccccgtagttagccggcgccgccccgaccgttgccgtcgctcgccgtgtgctcgccgccgtcgccgcccgagctcggaagcgcctctcgtcgccggcctccctcgatgcgtttcctcctaatccggcgcaagggacggattcccgtagccgcgtggatgctctcgccgccgggaatcggcccctcgtgacctcatcgccgttttccccttttctctccgccggttgccgccgccgcaattcgccgccgacaagctccctccggcgaatccgagccgttggctcgtctcccctcgtcctgtgcagccacccggtgtgctcgctttcgccggtatcgccgtggttcgctccgccgctcaccgctgtcgtccgccgtccgttccggctggcatcgtcgtctacctcccgccggcccgcgtggcagccacgtaggcgccacgtcggcgctagctcggccaagaccgggtcgagccgaccccgatcaggcccttcccgtgcgcgcggtccaccgcgagccgtgaggctgcacgtgggcccgccacatccgcgtcctccgcgaaccgcgcgcgtgcaccgcgtccctcccccaaaccctagcacgcgccgcgtgcgtgttccgcacggtgaaccgtgtcaccgacaagcgggtcccactcgggaccacgcgaggtgagcccggtccaccggctccctctctcctcccctcccgcgcgcgcgctctgagccgccttcttgggccggccggcccattaagctcggccgagccgccctttctctcgggccgcgccctagccgcccgagagaagtctaatttccctccccctttcccttttcttttcttttctttttcaaaaaggatttaattaaatcctttttcctttagaccaaaaatccaaaaatcttagaaattcgatatcttcccaaccgtaaatccgtttgactccgttcaacttccaaaattcctcaaatctcgagatctatctaatggcacgcttagaggtcattaatagggctttattttcgccgtttgttgagtcgtcccgttttgcgtgtagtttcggagcccgaagacccgcagtgcgaggatttcgaggatcaagctcaagatctcgagcaaggcaagccacctttgaacatattgagcctatatttgaacttaattatattgctcgcaaaatattatgcattgataggattgcacttaatctgtttgcaccgtctgcaaggcagaccggtgggcctacccaacttgttgcatctgatccttccattgttaattgttatatcatgttcccttgtaaccatctagctgcgcctcgatattcgtgcactctgtgcgagtatcgacggtcgccttcaaacttaaaatctgagtaacttcttgggtaaaacttgggttttacagaagacttggaaaacccgacacctgggtcggtgcttgcgaactaaatgaatttctaaaaccgcggaccggggaacgtaccgggtgtacggtttcccgctcttgcacttaaggaccgtttccttggaatttcatccgaacataagacaagtacgaccacatgggtggaatgggacacccctgactgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcagctttcgaaatgccttgtcatgaaagcttggaggtctctcgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgccttgtgaaattgctgttgtggaaatgggatcgatgtttggaaaatctgcagctgatgggatcagctaggcccgggtggccgtttgaaagttgttggcccgggtggccgtttgaaagttgttggccgggtgccaaccttgaatcaattcaaaagactgatactttgcacatactccgaccggacgagacgcactgtctcatccgtgtcgtttgagaagcactcacttagttgatttcagaaaagagttcaaataaaatcaattgcaaaaacaacagcctttccttgaagcctgcattaaacacttatttcccatggcttgctgagtactcctgtactcacccttgctctatataaatatctcccccccagttgctgaagaagatgaagcggatcccgctgacgaggagttcttccaggagcaagccggctacgatgagttttagagtttcggcctagttcccaagtcacgcctgtgatgtttggtccaagtcttggcttccacttcccttttgcaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagttccggtcgggactagttcggggcgtgacaattattgatttaatgagactaatttggtgttgtaaatattactatatttatctataaacttaatcaatcttaaagtagtttgaccttgaccaaattcaaaatgagtaattataatatgaaacagaggaagtagtaagtaagacctgatacataaaggccaagctgagcataagtgtatggttaaaccaaaatttgtggcttaaattatcatgaatatattgtccattctccttgtaatgttaccggttacacccatagggggatccactagtctagaaaaaacac

SEQ ID NO: 42531 - DNA, 5515 bp, Oryza sativa
ctgcagccctgcatgcacatcgattgttgtcggtacacaagcactagcgctgctagacaggggttaacacaagtagtaaaagcctaggagctgcagatcagagaagttccagctgactcccacaaaccttgacttggacggctctgatcatgcatcctcttctcctcaggtagccaaaaagagacatgacaaagttgcaaaacccatcggcagtatgtgctcactgcattttcccggcaaagcagagagaaaattaaaaagacgacgcagacatatagccctttctttctctctctcctttagccggaagtggaatattaaacaagctggaaacatacaagccagcactgctcgcaacaacaacattcagaagagagagaagtatagagagagagaggggagcatgagtcagatccatgatccatcaatggcaccacacagtccacacttgggcatctgggcgagacgagacgactaatccaacttcgatagcaacggttgctgctagctgctgtgctgaacagtgcagcgtcgtgcagctatatgcctatatatatccctcaaaactcattgcctctcctcatcacagccacaacacctagctagctgcagcttgtgtgcgagctactcctgcagctagctactagctacagccaaagattaccagcaacagaaattaactgtgtgagacgtcgatcagatcgttcgagagaatgggtgtaggaagggttatgaacgatgcgaagccgtacctggcgatgatactgctgcaggtggggttcgccgggatgtacgtggtggccgtcgcctcgctcaagcgcggcatgagccacttcgtcctcgtcgtctaccgtaacctcttcgccaccgccgtcatggcgcccttcgccctctggttcgagaggtaattaattaactagtactagagcgctgttagctaattagttagctcatcaactaatataatctctttctctaagtcaagctagatttaattaattaaacttcctttcatcgttaattagaacgcatgcatgcaaaagcatagaccatgcattgtttgtggtttgtacaacacacgcatgagcttacatgtttgcctgaagtctgaactctgaacaagcatgaataatgaaaatagctagtcttgcgtgtttttctattttcacaagagatgggagtagtccatttctagctatagctagcactgctgttcgttcgttcgttcgttcataagccgggtgacgtagcgttttaattagtccctttcagagttgatggtgcatgatatgcatgctccacgataggcacttctccagatcctaatatgaaaaagcagcttgtcaattccattatgtatctgcaaatttaacatatgccgatcgaaattcgaaaagtatatatttatgcgcgcgtatgctttcttttcccagctagcttttaatcccttgaatgtcacgcgttaaatcagcttatgcacatatatattccaactagaatctatagatcccagacaagaacagcagcggtacagaaagcagaaaatgacaccttacatattaaccgtaccataatcaaccgaattttatcaccatcaatttagtgacggcctagctatatatgtgttcacttagctagttgaatcatgttcttagggccctcctagagttgcaactagcaactgctgcatgagcattttcttcagtaatctcagcttaataacctaattaactgagctaattaattaatcagtggttggctttaataactgattatttgctcctacttgatacaggcgagtaagaccaaggttgaccctcatcatcttcctgaagatcatggggctcgccatacttgagtaagttaattacaagtcaaataatactaatacgattataccgtacatgcaattcagctctagtcctgacacgtgtacgtacttgtcaggcctgtgcttgatcagaacctgtactacatgggggccaacctgacatccgccggcttcgcctccgctctcatcaacgtcctccccgccgtcaccttcgtcatggccctcgtcctcaggtaatcaataattagcatataattagcatgtggattaatcgtttaatcagcatggaatgcgagagattaatggtgaatcggttgattaattaattaattaggatggagaaggtgaagctgaagagcgtgcacagccaggcgaagatcgccgggacactgttcacggtggccggagcggtgctgatggtgctgtaccacggcccggtggtgcagttcccgtggaccaaggggcagcaccacgacggcggctccggcgccggcggcgcggcgggcggcgggttcctccagggcaccatcttcatcgtcgtcgcctgcgtgtgctggtcgggcttcttcgtcctccagtccaacaccctgcagagttacccggccgagctgtcgctcaccacgctcatctgcctcatgggctccgtcctcagcggcaccgtcgccctcgtcgccgagcgccacaacacccacgcctggctcatcggcttcgacacccgcctcttcacctgcgtctacgccgtaagctcgatctcttgctcgatcgatcagccatggcggtgttcgccgccggcgagctgtcgcgcgctgacacgatgaggtgaatggatatgcagggtatcgtgtgctccggcgtggcgtactacgtgcaggggatcgtgtcgaggcagaggggcccagtgttcgtgacagcattcaacccgctctgcatgatcatcaccgccatcatgggctccatcattctcaaggaagaaatcaaccttggaaggtactactctacctcgtacacgaccccattatactatatatagtaattaatcatgattagagtgaataattaattaacggtcgattggttaattaattaattgatttgtttgtttgtttgttaattaattattgcagcgtgatcggcgcggtgatcatcgtgatagggctgtacgcgctgatctggggcaagggcgccgacaaagtcgagcagacagacgccggcgcggcggcggcgggcagcaacaagggcggcggcgagctgccattgacggcggtgcccaacggccacggcagcaagcacggcaacggcggccatgtctacgacgtcgagacgccgccggcggcgaacgggcactactagcctaagcacatgcagcagcagtccgtcatcctcggcagtccattgtaagctagttgtggttcgatcgaccatcgatcgatcgagagcgtgacacgatttcttcttcttcgtcgtcttcttcttcttcttcttttccttcttgatttctcctaagaattcttgtgaggtattaaaattttcacataatgcaatgtaatggataaggccaggacgtgtccggaagtgcttgcttaagtaatgaatcacatattattctctctagctctgctgtcttacgtggccggagctgcaattaatttacttgtcaattaactatagtgcaaatgcctttgcttaatgcatgtgttgtcaacgagacagtactgctaatctgctatactgccatctccgttatttgctcttggcgtgtgtctccactaattacaggctttttgcgactaattaattgactcgaaatggaatccaaatgtacatgcaagctggtatagctttgatcgatgcaacggcatgcattgattgatctgtgcatgtcgtgatctctgcctgccgttttagctagctttaatatgtttggctttggtactgaatgacattttctaatcaaagtcattaggtgctgaatgacatcgattgatttaacaatagatcaacaggcctaaacattctcttctcatctctacttttgcacagtgagtgactgactattgctatctctggtatataggaacagaacatgtcctctgaaactggtgaaatcctagctagacatagttcaactggtttggattggcccctttaaacagtcaccttctgtactcaacttcttcatcaatcttatcttaattatctctatggaatcaaacacgtaaacctagctacctagctaggagcagatagtttagctatctcttgctaattgtctgaaaaaacagagaataactaatttggattttgattggacatcatatggatatgagctgcattggggccggatcgacatgacgacgtaagatgatcattttgtagatgagcgacaggccgtgttgggtgtacacgcatgctgacgtgcgtgcgtcgcatataccatatgatggaaatggcagatcgatcggtagtcactaacatcagcactaattaaaaaaatccccgggatcacgggagatatttgggatttctttacggtaaagagcaggggatatgaaccaaattctgccgtatcttttagtgctcgttcattgtcttattaatgacaatttgtttatctttattaactaaagttagtgtgtgtgtacaactgaatcaaagtgtgcgcgtagtacgtgttctattagtttgtgcgatgatataagttagttcacagtacagtgtgactgtggagtctagaacctataagtctgtgataattcgagagaaattatatagttttctgtaggaaaaaagtataattcctgtaaatttcaatatttttacaatgcctattgtaacgcaccaatatttactggtatgacgaggtgtgacgatagaattcccaggcttatttagagagccgatgcgaagctggtttataagaatttagaaaatataagtttgtcaattcctactctccagtttcgtaaaaaaaccatttaaaggtaggctatatctagatttgaacgcatgagtttctttttgtgggacaaagatagcttctactatctcattgtctagattctaagttaaatgcatgtttacttgcttgtcattttaccctaccaaattttaataggatagtaaactaaacacaaccttaccattatcactccaccaaaatttgataattctagatgtttcctctcataaaaacatcatcaatatttgacaaggcaccaaatatatctaacgctattctttttcgataatgctaaaatataccaaaatttaacattactctatccatttcatattataagactttctactattgcccacatttatatagatgttaacctataagtcttataacctgaaatggagggagtatcaaactttaataaggctaaaaatgacaaccaaagagaacaaccactgtgtgagaatctgcagccgctgaaactcaaccttactccatccatctaaaaaacaagctagtactggatatatctctattcgttgtattataatgtgtcatatttagtcctaaattcgtttttttacggagggagtatttcatttgtcttcaccatggaagaaccggtcccacttaccatagacccaccacagtagtacactacagtagtgagtagtactgtcagaccctgtttagatgggactaaaacttttaagtccctattacat

SEQ ID NO: 42532 - DNA, 2787 bp, Oryza sativa
taatagtaaaccacctcaatagtatgtctacataggtatctatagctctctcatgcattgcttcgtttttctctatagactatctctaagctagtagatagctttgctctctctcttcatttaatatcttccaagtagaaaaatatgctgacatggatctcttgtagatagcttatagataaccattgtgggtgccctaaagtttaagtccctaaatccaaataccacccgacaaagcccacctcacgggcacccctaaacagaagtaaataatttcaaaatagtccctcaagccgtcgccttcctcacgctctctcccactccgccactgctccagctccccctccccgcaaggcggcggagatcccaaggtcgtcgggggatggcggcggtggcggctacatctccggcgctaaccctcgctgtcgcggccgcggtgatagcggccgcgtgcctcctcctctgcgcggaggcggtgtggctggacttgccgcagtcggggaccaagtgcgtgtccgaggagatccagtccaacgtggtggtgctcgccgactacgccctcatgtacgagtcccacccctcctcccaccccaccatcgccgtcaaggtaattccccacatttctagccgtctctcgcttcggattctatgatgcagtgaggcgcttccgttgttttggaatttttggatgggctccgatctaggttgcggtagttttggacgaattaggtcaactccatggtagaacgatagatggatgattattccgtgaaacggagcggtggcgtgaagtttttggttttgctgcgggtttagagatgcttagcgcacattatattgtgctggaataatcgttgaactggttgagtccttgagtgcgagggattatgtgttattggtgcagctgtgctcgcgaaagacagaaaaagtttgtgcctagtgttcaccggattgcgatgggagctgaaacttggaatcatatattctttgtgtaacctgctaggaatttgttgttctctaggatctagtgctctgtctagattccatttgcatcgcagggaatgatgatgatagtattctagaataactggctgatgcgtcaagtggattggtatgattcgcattgatgacgcagggtatgcttacatatgatccacaaaccgcgtcgattccttctgtctaaattgcggtggtttctgtccaggatgtcactcgtaacagaatacaaggtgattcatcttacagaatcacacacttgcttttctagcgacttctgtaagaaactccatgggttgtgggaagtaaaaggtgatcaataagaatcgcatcgatgcgaaataatgagaagacaacgatgcaatcatgttattatgtgatgtgaaattaatactgtaatgacttggtaccatatgtgtatctttttattcggaatcatttgcatgaatatgacagtgtgttgccatgctttttgcgttcgaacaaacaaggggacatactgaataaatagactaacgtgtagacatatggttgataaattgcgagtgccgtataagattgaataagtagatagacttaggtgagataatggtaatgtcatataaattattaattgtagaacccacttaagtgagcaggtgatatctcaactctttcttaatattattttccttgaaaatgcacaagaggaacttcatgggactaaaatttccaattccaaggcaaatggatggagtagattgtaagggttactagggttaaatggccatgcaactcgctatatactagtttctttagtctttactccaatttatgtccactgattgtaattttatttatgtgaagtataatattaattcattaggagatctattttcatccatgaattagtactggctagattagacactaagcatactatttgtgtttgctccattttgaacagtccttatgttttttcttttcgcagctttcgaatcaagaatatggttttttttttttactgtgcgagtatcaatctgcagttactgcagtccactaatggagtaaacgatgctactccaatcctctcaagcttagcatttcttcgagaagcttagcaatttgcttttacatgatttgttgaatgaattactatctacttgtgctgttatagttctgcaaatgcttatgcttggtgcaggttacatcaccatatgggaacaccttacatcacaatgaaaatgctacggttggtcagttcgcattcacaacttcagaagcaggaaactagaagcaggaaactatcttgcatgcttctggatagatagcgcagagaaagggtcaggaatatctattaatcttgattggaagattggaattgcagcaaaggattgggatgttatcgctaagaaggaaaaaattgaggtaggagtaggcttagccaaactgctgacggtccatatgaccatatttcactgatgtccagtttaattcactgcttctctaattgctgcaatctaattccttttgtagggtgtagaactagagcttagaaaacttgaagtggcagtacaatccatccatcagaacatgatatatctcaaagcaaggtaagttttacttccacatgattgacttactgtggttgaggctttaaaacgaatattggtggtactaatagagggttcagtagaatgccaatggaacttggaagtggtaatgaaacaatcatattgtcttcaattctcagcactagataccattcaaccacaaagagcgagcattgtttacaaaacttacgatctgcag

SEQ ID NO: 42533 - DNA, 6534 bp, Oryza sativa
cccttatatggttaagaaatcatagtgttatatgagattatgtgaacttgaagacatttattaccgccctacaggattttaaattagcggcaaatctaatgatttatttgatttgttcatacagggaagcagagatgcgaacagtgagcgagaaaacaaacgctagggtagcctggttcagtattttgtcactaagcgtctgcattgtggtttcaattttgcaattgtggcaccttcaagggtacttccagaagaagaagctcatctaggttagctcgcttgagctgtaccgtgactccaaaattgcaaatgttgttacattggggaaaacagttttgtcatgttagttcgaacttcacgctagcgaggagctgcttgtactttatgtaatttaaccatggttcagtttagatgtgttgtgcattatgattgcaaataggtgataacttaaatctccctggaatatttgatgccttcaggacatagattacaagaaattcatcgtcttataatgggatgcaaaaattgtggcttatgtggtagtgggcggtggtttttcttccatttgctttagctattacagatgtcatgtaagtgtcatagtatggtccgatccttgtaccagtaaaccggcttagatggaaacaccgatatgagaaggccaattatctagcatgtctttgtcctgaacctacagtttctgtatgggacaaatacacgttaacggatgaatcacgcacaatgatgcaaagtcaaaacaaccggagcaacatcgtcagaaatctgatcacagaaagaggctaaggccctctttatttagactttagactgattggcctagacttttaagtcagcttattggcttatatgatttataagccagtggatttaatgtcctaagtttaatggtagagttatacatctatctcatataagccaaaaaaaaagcttctccaacctagtttttggcttaatagtgttagagtggcttatggtttaaaaaagccaaatgaaaaagctgcttgtttgttttggcttagacttttcgacttataagttggcttataagcctaaacaaagagggcataagctggctaacttgctattaaaattttcatacgttcttaaactaaaccagaaaaccaatgacagccggcctaagctgttaacgacttaagcattcacatcccaaaattcccaagtcctaacacgtatccatccctattctagtattctgataactctcaagctcttgatgatatcaccatgtccgcgtcgccgttgcgacgacggcgagcaccatctccagctttccagctgctcctcgacgccacgcagccgcagatgccctcagctctgatgatttctacgctggcgagcctgagaaaaaccagtggcagatgcgctccccatgggcaaggccggtgacgccgagcaagcggtgcacagcactgcgccggcggccggccacggctccgccgtccgccggtacgccgccacgattggcggggctgtcgatgccaagtgtgtccttgtgctgttcctctccatcggcgtcttcgtgctggtcctcttcatgcttcttcctctccatgaccatgcatcagaaaccatccctgatgatgaccctggggtacttcctggtaagaacactttccttctgcagcaactttcagcactgattaaccgtctgatcatataaattgacaagctacatgatttaattatgtttgtaaagtcagatgcattatccccaaaatccagacagtagaatcaaaagatttcgtaaccaaatgatctcaaatagtggtagattagaagataccagctactcatgctagctaagctttcagcaaatatgaagataaagtgtgtcaagcttacctttatcctcttatgcatctctcaaaagaaaacgcctatcattcctccaggtgaaattcaggctagcttcttcttgttaaagaaacgtcaacagctcattccacatgtcagaaggctacaaaaggacatatacagagaaatagggatccccaatactacggtatgccattattccactttgacaaaagaatttgtcttgcactcaagctatactgaaatgatcgctgaaaattttgcaggtttcggtttctatgcatacatccaaatataaggattccacttatgtaaaatttggtattctaccgaacccaagaaattcctccataagtgcacaatccattattgccctgagaaaaaacttgatacaacttacgcttgagcagtcgaatttatctttgacatcatctgtctttggagatccacattgcttggagatcttggggttcccaggagggatcacggtgcctccaccacctgatggcaatatatgcccaacagctcttttcaatgtcacactcaacatgactatacaacaactaagggtgcacctcaaggagctagagagtgagcttagaattatattgcagctgacaccatatgaggtccatacatcttatctcatctgatatagtcagttactccctccctttcacaatgtaagactttctaccattatccacatacatatagatgttaatgaatctaaacacatatgtatgtctagattcattaacatctaaatgaatgtgggcaatgctagaaagtcttacactgtgaaatggaggaagtatttgacagcaagtgacaacattttattttgtgcaggacttaattgtagagataacaaatgaaaatggttcgacgatcaacctgcccgttacagtccacattttaattgccccaaactatcctagcaattatctagaaacctacagactgaaacaactagcccaaatcatcattaaattaattccaaaaaaccttgacctaaacccaatatttggcatgattgagaatttgtggctgtcaccatgtctacaaagttatattccatcatgtgctcctaatccagctccagctccagcaccatcactatccccatccaatcctgaacatccacagccaactaccaccaagccttatggaagtttttcatgcccggctttggaaagaagaaaaactgtctctgtacatcgcaggttatcgacgatatctcccatgatggtaccaccagaaataccgacgaggtttgatagttggagtgtacacactgacaggaaaaatcgctctccacttgcaaaaccaatgtcccttgtgccagcatccccatcaaaataagtaagttgcttatagaattaccaagctagtccttaagtgttcttatattgtttagcaagattgatgcacgtttttgttacatcttagagttataactatgaaacatgcattaatgtaaattagagcaaacaaacaagagtaaattagtttacatgacagcaagacagggattcagatgttaggttttcattttatcatctgaatattattatttctatgataaatgtttatcttagttataaagagttgaacacaagtttcagtattcgaacctcaagttgatttattttatctgttatccatgcactctacaggccagtgccttcaggtcagataactgttgttactgtcttctgcagttgattctacacttgttccttcaatgtgattttgtcagttacatccaaggttgcatgaagtgcttctgagcgaaagtcctacactaatgcagagtaatgctcaagaaatcttaaccaagtgtatatatgaaatggttaagttctctttttgaccaaaaacactgtaggggaaatggttaagttctttagcagtaagatggaaaacctccagctacgggtggttaaccataagtttctttaatgcgttcagagatttttcatccaaacagcttgtgcatttgcatgagttatatagattgctcttgtcccaaagaaccattctgtgagtatatgggtaacatcttgtgctcagatgctcgcttatctgtatttttatagcgatacggatgattatcaattatataagcaagcacaacttattctgaaccgaatagagtatccagaaaaattagtgtataatttctcaaatccatagagattaataaagattacaacaagtaaagatcacatatgccatccattatccatcggcattctcatagctgctgactcaaaactggaagaaaaaaaacaccttctgaaagaaactgtgaaaatatcttactgatcaaaggcagaaaacactttcttctgcacgagctccacgcttagacgaggcgataatctgggaagcttttcctgcaaaacgatcattgatatgagctatgatgacacaaactctagactcaaaacacctaaactgaaggccaggagcgagcgcgattgggaggacgacaccacacctcgctgccgtcgggaagaaccttggcgagcaccgggatctcgtactggtacatctgctcccaatccggattcgtcgtgatgtccctctcctgatcgaaacacaaaccccaacttctcaggatgaaaccccccaagggagagagagcgcaagagccacgaacgtggtctagtctgcttgcctggagctcgagggaggcgagcgagtagggtgtgccggcgagcaggaaggcggcctggagcttctccttgaggccgtcgcagaggcagcacccgggcttcgtgtacagcaccagcctccccgcccgcggctgccggggacgcctcgccgtcgccggctgcggcgcagagtaggcgggaggcagacctcccatgctgcgagaggcgcagtacgcccgccgcgcgcggaagcacggttagcgccgccgccgccgccatcgatatcgtttgggttatcgctgagacgctccgcgccggcggcgagaggcgaccaggttagccgcgctgccacgggctgggccgcacacgtgccaggcccaacgcgcaaggctcgcgtgttcatgatgggccaggcccacctcacttttgttatgggcccaaaacgcgcaaggctcgcgtgttcccgatgggctaggcccacctcaccatggatatgggcccaaaacacgaacccacaacgccgcgacgtcgcgcatctcctcctcctcctcccccatccaaagcgagcgagccgagggctcgagggctcgaggccggccgccatggcggcatccgctatccgccaatcccaaatctcccccccaactctcccccttctacgccgcacgcgccatccacatgccggcggagctggcggcgcggaccggcggaacctcgtggcgttcggtttccggtaagttttcgctacttccgcgtagacatttgttactgcttgtctggtacactggtacagtccaccatggtggagcacatcagcggtagtgcttatctggaaatgcccttgccacatcgatggtgatgcagaaaaattgccaaacgggatactgcagagtgtcaattagttgatgcaagtagcgggtagaatacactgtggagtgaatatgaacgaattatcatctttgcaagttgaaagcttgataaggatgtgattttatcaccaattaaatgcatggtgttgtggcgtgcgatacaaaagatgcatattactgcgcctgtatttttctccagtgttgataaacagtacgagagagatggttgcaatgatttgtagattggattgcaattctgtagttaattgatggtttaggactttatgtttcaatagttcatttgtcagtctttagtttctcgaatgtatatatcataactatgcagctcaattctttcttgtaattttgcaaccgaagagtgggtattatacacctagttttctggtgaatatatagacaatgtatcaagatgttgttttcttgtcattttcagttcttttctgtgtagcaatgctcgatggtcatatttactgcttatcatcagtataatatgccttattgtcatgcctaccaattcagaaactctgttaatgaaaattgactgatgttggctgagaatgatttcacatggttttcaaatcaagggctctattttccgaatcgagaggattggagcttgtctacaacatttcgcattcgcaagaaaatggaacactgacaagagctacccattggccatattttagtattttgccaccctaatctgctctttacagttttaggatttattaagcatatgagttggggccttgggggatctatgggcctgcttataatgaaatggtgattcttcacaaactgaataggataagtgcatctactataacaatataatgatacaaataatattgcttatgattaagacatgcataaggtgaatttctagcaacattagtattatggtagaactataaactatagtatggatcgactacagtaagcacaacccctgggttctgtatgcatatcatcttaaaggacatacatgctagtgagctctttctctaaaaaaaaagataagggggacatgccattatagcagatggtctaatagtatagctatttgttcttttcacctcagtacattttgaatttggtgctcgtgccaaattggggggatccac

SEQ ID NO: 42534 - DNA, 1739 bp, Oryza sativa
ccgctaggctttaagcctttaacttcatctgttgatctcgtagagtccgaaagttatacttttcttactagtgttttgagctctaccgtgtttacagcagcatatcgactgcaaccaaagttgaaatattaaatattaaaatatagagctaattttatttttttatcgtagtttattttttacatcggcttttaagtcgttagaataatatattttctctgttttttaattagatgacgccattaatttttaacacatgtttaaccatttatcttattaaaaaattttatacaaatatataataaataaatcatgattaaaatactctgagtgataaaaacaactcataacaaaataaattataattacataatttttttaataaaacgaatggttaaacgtgtgacaaaaagatcgttatctattaaaaacagaggtagtatgtaaacaatttcactcataattttcttaatagatattataaaatattgtcgtctttgtctctctctctctcatcagctgcatgcaactgaatgtatcctttcctggaaagtaatttggttgcttaccctagtcatcacaaaagcacctggttaattacgtagcatccggtttggtaataaaaaccaatgactcaatgaggaatccgtaagtggtacagtacaagattacgaggtggttaaagggacgggagtgtttaattaggttgacacacgattagtgagtggcctccagcgtccactacgtacgtgtttctgcatatctgcacgaaaagctaggcacaaagaaccttctgatcggtcgatcgatgagctctgcgtcagaattctatctaatccctcttgcgctcgcggcttcggttctctctgtctttcagcctgtcatccaattcgatcgcaacctaggctagctgctactggttgctgctgcctggtaggcacaagccaagatgaacttgtacacccactactataaaaatttacaacatgaaagttgccatgtccagtggtatatacactggacaatgtcttttgttcctggttgggatgagcagggttccaataactgttgggtaaaagaccagtttggccccagaaatatattcatatattcattgtctgaaaatgagataattgctttaaaaaaattccataatccagtactctatataagatggactgcttgttaatatatatactttccacacttgaggatctgatagagggagacagcccaaatacattgtaaaaacttgaattggaaaaaaaggtacaaatagataatacaaacttgacccctgatctttttgttaccatcttccaattgaaaaagggtacaaatggatgatgcaatttaaaatttgtgtgagtcgatggtaaaagactccaatcttccaagtttatcctcaaaactgacttccaaacaggtattcaaaaccaagattatcttcacttgaacaacaagaactagggagctgcctagctctgactcactgccactttgtggagtcattagacatagtttgatccagtgatgagcatatgctctcctttttttggccgcggcggccagccggcgagacgcggcgcctgacaaaagcaaaaggagatgaatatggacatgggcgtatcttcccagcaatccgatcctcctgccgtgcgtggcacatcatcatacattccacaacgacctccgctgcacctctgatgagctgattcggccatgaatcagacgcactg

SEQ ID NO: 42535 - DNA, 5090 bp, Oryza sativa
attattgtaatttataaatgaatgataaagtacatcaggtttggttctttacctgaaatcagctctctaatattttcagttcagaaggctgcacactttgaaatttactaatacatcccaactgtttatttttttttaaaaaaaagcaatagttcaatttagtggcttatttagttatagttgatactctgttgtcgcaatttatattctcttactgattaggcattagagttaagaaaaatactactccaaattttcttcgctgattgctccgaaaaacaatttcctgacttcagagtcaaccagcaccgagactaatgcactttgccaaaattcttcaagagtcggttgatagtggaaaccatactgcaaaaagattaaaaaaggtaatatttatagtatttcatctttttgaacaaagtactagaacaatattatgggagtgaagctatccactagtatagaatctcaaaaaatcataaattgagacttagcccatgatgtcatctactattatctgtctgtttcatcattgtaattgtacagtacagtctagataagatgccatcatcataattaagcatcagttctgtattacttacaaaaaaatggtacgaagttgcatgtgaataagttcagaatatcattgttgtatttttagttgagactatgacaatcttcaaaaaagaaaaaaaaaagactatgggctgtaatattcattaatcaatattacagtttaggcataaagattttcagcgtcaagttttgtccccaggccactgaggccagcagatggggccctttttcgtcaaggaaatccagttctacagaatttcaggtggagagatcaaggagcctcattatttgaaatcataaagatattccaagcgattcagtagtataatgcagaagcttctttagggaaacaccaatcaaactgccaaaaaaaataaaaataaataaatcacaaatcatgtattcatgttccagctgaaacctctctaaggctgtgtttgaggagaatgagatagagaagattgggaagatacgcaaaacgaggtgagcccttagcgtgtgattaattgattattaactattttaaacttaaaaaatagattaatatgattttttaaagcaactttcctatagaaaatttttacaaaaaacaaaaggtttagtagttcgggaagtgtgcgcgcggaatatgaaacaaactcactccctttattctccaaacgaacgcagcctaagaaaagtacttaataagtcgttcacatgttctgatcaagcacatatcaaactaaagactgattttgccagtccacctactgcgcttaaaaagttggttttgttgctaactgttcagctgaaaataggatgataaatgattgctggtaaccatatcaagcatttcccaagaaaccaatcatgccatgtcaaacagacacagaaaaggtctcatcatgtgcttcccctctatcatctggaagtcgtttggcatagtaattgggacatggaatagactggcctagctgcttaccatcttcttcatagggaagacctacatgctgaccatgccctacacaagtttcagacaagcctccctctgcggcgcacatccaagctctctacatgcttgcgaaacagcgaaaggcaatcaccaactcacaagatccgatcttacggtggccggacattgatggacacatgaagaacacgatgcgtccttgccagctaggggtccattccaattggctctggtgacactgacagtgacaccaaaacgcccttctgctttagcaagtagccacaaatccacgatgttttgccatctgagtgaggtacattagttcctccatcttccaccatggttggaaatctacccattctatggaggcatcattctattctataataattcttctaaatcagttcaaatccaacctcgaaaacatcataagaactagaatagggctagtaataatttagatcccagagaaggcaagcacgattgcacgaatacaagtaggtaattaagcaacagaggagcaatttggataagcagtagaaaaaaaaacaggattatatttttgggtacctgaggcgccaaaagaagaatcggcggcggcggcggcgcttgcatctcctgcatcgccgtcgccggcaaggctttggctgcgagttgcggcttctccgatccccatattcccgagaaatttcagtattaaccatccaatacgataacctttaaagaattgccacccaatacgttggcctttcaagatctaccaccagacacgcgaaattcttcatttcgtgccattccgtctgcttgtccgcgtcgtccgtctttgtcttcgtctccgagctcgtcggccgtcgtctcaaggcttgaccatcatccctgagctcactcccgtcgcggttgccagcgagagacattgcaccttcgacagggacgaaagagcacatggttttgtcgacgtctagatggtagacggggacggagtttgcggacatggcggttcaacagcagaacacgaactcaggggcgacggcgacaatgatcggatgagagcttgggcatggcggcaacagcggaaagctcgggggcgacggcggcgacagcggaacgtgagctctggggcgacgacggcggcaacagaacgcgagcttgggggtgactacggcggcgaccggacgcgagctcaggcatggcggcaacggcggaacggaatgcgagctcgacgacagtggcagacgagctcagggacggcggcgatagggcgcgagcatagcaacagcgctgaacgagcttggggatgggaatggtggcgatggaggttgggaacggcggtggcgacggtgccgaacgagcttggggatggggacggcggcgggggcgggatgcgaggtgacgatgaccgtgcctgggcgacgacgccacctagctcggagacagtcgcgcggatggacggcggggcaggcggacggagtggctccaaataaagaatttcgcgtgcctggtggtaaattttgaaaggccaacgtattgagtggcagctccttaaaggtcatcgtattggatgataaatactgaaatttctcccatattcccagttggaacggtaaattctacaaagtacgaggactaatatgcaaagagttatctttttctccttccagccgatctgtaccgtccgccaacacaacggtaatacgagatcatacgagggcttttctgcaaaaactccacaatggcccgagggaaaccctccatctggtcgtttatttcgatcgaacggtgtacatcgccaccgggagccccatttggatcgccagaattggtagtgatcgtgtcaagaggtgggccggactaattcacacatggtccgggccttatccttcacgaagagaaccgggtgatctggcccggcccaaacaccactcgcgatctatccgcacttgtctgcgactgcgaccacatcacgggggtgggcccacctggtcaggctagctaccacgcgagccgcaagtacccatcgcctcgtcatccggagagactagctcccactttcagtctcccgccgccgccgccgctgttcactccgcaccaactccgacgatcccccggcgagctctcgacgatggcgacggcggcgacggcgtcggctacggcggccacccgcttcacgcggctggcgggggtcgggctccggcgcacggcccgcctccccacggccgtgcggttccagcgccgggtgctcgccaccaccgcgctcctcaggaccgccgagctccggcccaaggagcagggcctgcccgagacgctcgactaccgcgtgttcctcgtcgacggcgggggccgcaaggtgtcgccgtggcacgacgtgcccctgcgcgcaggcgacggggtgttccacttcgtcgtggagatccccaaggagagcagcgccaagatggaggtcgccaccgacgagtcattcacccccatcaagcaggacaccaagaagggcaacctccgatactacccgtaaggactagaaactgaggaaattcgtattctgaatgtctaagtttatgttcgtttctgctgaaaatattgcgtcttttgtgttaaaattggacgagcgacttgcaaatcgaggatataacggccgtttaatttaactgggaattccttctgagatcttcactccacaagtggatgccatgattagtttgcaaatgtaacattttcttttgtgtccatgcttgttcgtgtttgagaattctagaaatccttaatgttgttgcatgagttttgtttatttaatcctatcctgtttgtttaggatgtcgcatcttcttttattaataattttagtgtattagtgagttttttttttttgccgggtcggccgaaagattcggtcgaccaaatttcattaagaatgggggaagttgtattagagagtttaattggtctgtttcaattgttgtatcaattgttgataggttggtctttaaggatagaatagcaactcttttcataccagaaattcatgctttacaatatttgttgtgggctggggaaataatgtaggagattgtgttttttatgtggtgctctttcgtgggaccttacttcagtgtgaaaaagatgggctgcttgaattttgtcaatatcagactgtagctgccaccaccttgtgcacttttgggattccataaaagaacattttgttctcccatgtttggcggtggaatcacacaaggtataatgtggccatcttagatatagcagatctttacaaagatgtgatgttaattgaactagctggatttccacacagttttgcacagagctaggctaaagtttattcgaaagcagagttggattttatgtataactgttgtttctgtttctatacattcaattttattttgtatacaactatatcaatcaatctacactttataatttggacaaaccatgataaacaactgcgtagatcttactctttttattcagttaatatggtaattttctaggaccttggagcgaatgcggtgactcttgttagccttctctttatcatataatagat

SEQ ID NO: 42536 - DNA, 1872 bp, Oryza sativa
atggttaaagggattgaagcctggtccgaggctccgagctcgccggaaattaggcgcctccagtaggaaaggagaaccggagtcccggatgcctcgagccagacaacaaaccccttaacctaatccaagcaaatacacacacactacagatcgagacgccatggatgcatcggcttgcgaggaatgaagcctggtccgacgcttccacacgcccgagccggctcgatcgccggagaggaattaagatgtggatacctcgagccagccaacattccccacaagccaccatggccaatgaatttaatgaagaagagcacggacatggcgagccatgaaagagcagcagctagcagtgataccacatgctagcagcgcgttgcaatggatggatcgttgggcaagaaaggagaaggatgcgagggttttgaagaggagagggatcgatggggcagggaagcgaggacaggggcagtaatggcaatttatggtgacatgccccatttggcacagcgggtgccctaatgcccaataactgcgctactctacgtccagcccccggcctgtctttacgttgctcgagccagtgaagggctttgcagttctgctgctgcttgctagctgcgcgcatctctcactttcctcgctcagagagaggccacagctgactcactccctgctttgaattcccacaaaatgcctcgtgaagtgcaccccttctctccctagctctctctcgtctcttcagggcctggaatgtcttggacaagcttgtggtgaaaatttacttttcatctgaaattcagaattgaggaagtactcttctaaaaaaagttcagaagagatgaacggcaaaattcatattttcagaactgaggaaaagactactcttctaacaatgggctcacacgagatgaatgtcaaaattcggaaatgaaaagaaaaaaatggtatacttatatgcagtgatcaatacactttcaggacatgatcggtcggtgcttttaattctgatccgacctgagcatattcattctctttaagacagcattgaagtgcccttatatatatcaagagatgaggtatagctttacgatcttgtgtgtaatactacatatacagtactcctactgttcactgtttgtaagacagcattgaagtgcgatagcttaaaaaaagtgcattcatttacatttttttccccttaagacaagcagtgtatggagtccattttgcctcgtgaaatgaaccaatttagtgtaaattaaagtcagtggaatgtctgtgaaaggcttgtaggaagaaagccttcattaaaaccacaccaaatataacctcatctagtcacctgcgatctactagcccctcttccatgttttactgttctgcagttacctgccccaaaactaaaggtcttctacacacatacctctactagcagtagatagtagctcaaacttctaaacgttttccatcttggaaaggatggagaataggaatgagacttggatgacttgacgcaagcaagtgctacaagaatcaaaatgtcctttatgacaagctagctagctcgccagccaaaaagggcttgtaattgcatcaccgaaatgtcaacaccactccccgaaagagtattcaaaggctttctagctctgggttcttgggttcttcctgttcttgggttcttcctgtatatacacatgtatatgtctcagcttattcaaaaacatgtccatcaacacacggatacacagtgcacgcacgcatgcagtccacgcattttggaaaattcaaatttcaaaaatgaatgtgtactatatacatatacacataaactaatttgccaaatggtctgaagatcgacctggcctacat

SEQ ID NO: 42537 - DNA, 15033 bp, Oryza sativa
tttttattgtttatttaataaattatgtatcaaatatactatttgtaagtatcctataaaatgaagtattttgtattggcatcatatgtttattttattcattttctcttttattaatgtgatgaactaaaaataattaattttttaaacagattattcttgaaatatacatagttctacttacaaaccgaactcgatagtcaagctcgccccaagcctatctaaaagctggaaggtttcgtaggctcggctcgagcttaagcataggcaagcgagctcggcgccacgcctcggctcgttgacagccaatacacctaatactagcttgaaactgatcaagatgcctgtgtatatgaatgcatgtgcagttttgtaccacagtagcagttactctcagtcaaccttgcagtgttgaccaatgaccaccagcctattacacacaagtacacagtgcctttggcctcccacgtagcccgacagagcttgtgatgatcaccatcattacctgttgatttgctcagctcccactccctggcacgtgcctcgtgcgagagagccacagctacagctagggcctccacggcctgcagctagctagctagccactggctcgagcattctctgctttcctttaatatgagtgagaaacacgcgtgaatgacgctccggccccgtgccatcagcagtactcgcgcgctagcttgagactatatgcatgctacatgcaatgcttgcacgcttccgatctgcctaccttttgatctttttttgttctgaacgcttgcacatggtcaaagtgtacatgtacgctcagctggtacgacgtagctcccctattgatatcgttgctcatcacaagcaatgaaccaatcgtggctctccatgtatgtaaaaaaaaacaacgagaaaaaaacactatggcatttggcaggtgaacacgcgcgaggacaggcagagttacgttgcagatgcagacatatggaccggtgcggcggtgcgtcgttgccggctggtacgtacgtttgccttgcccgcgggaatgggcaaccgggcgcagcgcagcgctgcctccgcggattcgcaggggcgcgcggttccgtggcgcgcgcgcgcgcgtccgcgtccgcgtccgggaacgcgagagtgtgcctgcctcgcctgcgcggcgcgcggcgacacagcgggcagcgactggcattgtcggcgtggccggaggggtcggggcgcgcgcgcgcagcagcagcagcagcagcgccggggtgggccgggtcccgaggcacggcaccggccggacacgcccgttcggccgtggcatcacgcgttgcaggggcggtccagtggagagcagcagataccgtactgtgcgagataatagctgtatgtaaggtatgcctgcctgactgactgactgccttcaatccttgtaggtggtgtgacattatgtaatggactattccatttcttctcctggctagctagcttctcctcaaggaagaaaacatgcgtatgtccatcagtccatatgtctacacatgccatggaaccaacgctttctgatattagttgattagtattacaaaaacaatatccatttgaatatgttgttttcagaatttaccggtgttctttcctgcatgatgagcgcctcaaaatgtacgtagtgtagtaatattccccgtatttcgtggccaaaaagagagtgaacaaaaaatctggtgaatctggtgtgtttagttcgtgggtgtcacatcggatgtttgactgatgatggaaggggttttcgaacacaaataaaaaataactcgcctggaaactgcgagatgaatttattaagcctaattaatctatcattagtacatatgagttactgtaacactttatggctaatcatagactaattaagctccaaagatttgtctcgtgatttccatgcaaactgtgcaattagttctttttatctatatttaatgctccatgcaagtgtccaaaaatttgatgtgatgtttttggaagagattagctatataactgtcgataactttttagatgaaaaactttcaaatgtaactccactataattacaacgtagttacattgtaactagactatagttacaatgtaactggcacaaaaacgctcagaatcacgttgttgcttagttggttaacatatgcaccgtgagatcgtgggttcgatccatgccccaagtgtggatgtgatttttttaatctgcttgtgcgcatcttgatgtcgaataaggcctaactcgcaaaagaagtggacatcaatatgttagagaaaaaaaatgatgaatcaccgtccttggacggaaaatttagtccgttggacttggaggcgtccctcgcttacggagtcaacaaaaagttgatctcgagatccgcgtgcaacgtcgggtttgaacggccacgattaagtgacgatcacacgcgaccgaccggccctggcccacgcccacgcccacgcatggcgaattggcgatgcttgatgcttgcaagttggtgaaggattctcccggtcgtacgggctcttttcgcggtgaacgcgcgcgagaaaaagaaaagcaacggtttaactcttgtgcatggcttgtggaccatagaccacagtacacgtggccaacggctgttctactgctccagcatgtactagtgggtactactcctgccagtttcacatgcatgtgagcccctggtttcacccagaattttatcgagcagacggtgcacacttgttgggtgaactgatgatgaccagttgagtgtccattgtccatcaacttggacataaacatacacatgctgcataagagacaaaaaaaaggtgatcagtaaccagcttaccgagaagcgagtggttgcagcttgcaggttctgactctatcaacttgctaaaatgggggatcgattgaacgattccccttgtcatttcctgttccacgcacgcgcgcgctcgatcgttcgggccagctgctgcttgtatggttcaagccacatagccatgcaaagccaaagcaaacctctctgaactctgggtagatgtctccattatttttgctagctaggttaacagtggcgcataatgcagcaacgggacaaggaggtagccggaggagcccaagagagagacagagagggagagagttgagacagggtcatgtgcggcggtcagaagagccttggccgccgggtagactggcgctgtggcagcagcagcagctgcgcggcgcggccggtcaattatggacaaatgatggcgccggtgattaggtgaggggacgacgcgggccacaacgccagtacgtacgtcttcggcttcgatcagtcgcttcccgccgcgcgacgacgccacacggcgccagttaccagttggccgtttgggctttaggaaattaataattttatgattaagtttatttcgggcggtgtactgcttcctcttctcgcggccatcggctgctgaagtgctgatcatgtataagccccggcccgttgagaagttatgatgtacattgaatattctgggacggaaggaaaccgtggtactaaactcctcatcagtgacggaaattaaaccagcactactaaactttcggcactaccatccttaagcgtgtatataggaagacgcaaaacccctacttacttttcttcaagtccaatatacacattttgaaataattgatagaagttatcacggagcgaagatatgatatgaactcatggcgagtttacacggtgagtgcgcaaacttgtgacatgttcgcaatgttagcgcggagagaagtgaactatcgaagttagtggctcgtatatacgagaacttgaaattatcataaattttgacaatttgatcttttccgaaaactaattttacaaatgaaccgcggccaaaacttattttagaaataatcttttttatcagcaccaaatcgtatggcgctgaacgtaatgtcttaaataagttttggccgcgatttatttataaaattagtttttggaaagggtcaaattgtcaaaatttgtgtgaaattatccgaatcgaagttaacagcggttagtcacctacatcgatctagatagtcggtgttgatctacatgtgcatactgactacaactttgtctcgttggttaattagctatccatccgcaatggataagcaaaagagtacgcaaggaggaaagaagtgagaggggttattaatttcgtctgcatccggtccagctagggcaatctaagcatggagatcggccaggtgaaacaagcagccggagtacagcccgtccaccgctgctcaccggtgcccaaagggagacgggcgtttgcgatgaagcggcacatgtacgcaggattggggacccacgcccacgcttgcgacatcgtcgtgcgcaaccggttcggcgtgtggtcacggcgaaaccaaaagtacatcaggaagacgcggtatttcaagttcgtcgcgctcggttcggcgatgtccaaggtgagacggaagctccaggagtggatcaagcagcacggcttgttaacgtgggctcagtactcggcgcggcgggaggagttggaggccgctgaggcaggtctgcagaagcttttccaccgtcgcatgcccgctcggtttaggaagctgaagcggcgagtcgtgaaagagcgcgagtgggagcggcgtctcttgttgaagaagcaggcccacgcggcgcagggtgcacccataacacgcgccctattcgtgtatatgtcttcatgtctagttcaactgttttactatctgagaagacttatgcttggtagtgtcacgcccagaaatttccgaatagaatttcaagtaaaatgtgcattaaaatccccgtccaggaccggccggggtacacaaacgacaaagttgacatacagatccatgtcttacaaacattataaaagtcttacataaatgcagcggaaaataaaaagataactggagctaagccttgacttgcaccgcagcgggaacaccactccacaggcatcctcgacggcacggacgaagcctactcggagaagccaccatctgacgcatacttaaactttggggttttggggaaaatagagcaagattgagtactacccactgtactcagcaagtcataccggaataggggtatgatgcagggaattatcaagggatagctataatggttcatttgcataaagcggtcatttataaccagaagttgaaagtagtaaacagttgtaataattaatcaatattaatcatccactgtccaacgctataccacgttgcaacaggcccaaccatccacctatactattcaattccaaaagactagtctagggtgagtctaatcacggtgaatctggttgaccgcccataaccgcgggcacggctattcgaatagttttactccgatcagaggtgtacaactgtaccaacaagacacagccccacgacatgtttccatgcgccgacatgccaccacgacataccggaaagaggccgtgacaggacccttcgcataaccccctctaaccaagcacaccacacttcaggtttcacccccactcctcgcaaggcagcgggcagtcccctctcgtgcctaggcgaatccggaagccgcataggccgtcgcagggcccatccaaactccatcacgcccacccttgcctggatgcgtcggctagaggaaagctacactacaagcccagccgttgcccacgctggcttgtggtaagtacgaggaattcttccagggtttcccgcgaaccggtccttaattgccatgggcgcgaccatcaaaatcatgcacccacagcccaccatttaatatattttaattaagcaacaccagaacggtggcactaatccaatcattaacataaggacctacagtctatacattaatatgatttcccccattgtgtgctagttgaactaatcatggctaagcactccctagtccaatctctagtcatgttatatcccaagctaacaaaggaacatggtacaaaatagcatggctatgacagtaggtaaacattccacagtaatattataaaacaatgcagtatttgaagaaaaacaatagagcatttgcaatataggatcaacatgttcaagtgacaagcatgacttgccttgctctgctgctggaggaatctcgacgactatctcaaagtacaccggagcgtcgggagagccggaatctaagcgacatacaaagcaaataatacaaacaggctataagactactgaaacagagaacaaaaccatttttaatggattctacacatttttcttgatttactgagacttgaatggacttaaacggagctcggatgaattagttatgatttttagaagattctctgtgtttttactagtaaagaaaagtccttaatgaattattgcgcaataaagcatcccagggctgacgtcataggggggcaggcggcgccgacatgcgggccccacgggtcagcggctcgagagagagagggaggggcgccggcacgtgggccctactggcagtggcacaaggcgggagggggtgcggctggcaggcgggccctaccggtcgcggctccaaaaaggggggggtggcgagacgccggccgggcccgacatcaagccggccggcctgccatggcaagggcggcggagcgcgcgcgtcgccagcgacggcaaccggcgcccggggggaaaaaaagggaaacgggcggggcgccgaaaggcggcggcccgacccggctcggcgctaggagggagaggaaggggaaaagaggaggaggggcgcctcaccatgagttggccggcgcgggggaagacgacggcgaacggcgacggcgacgaccggggaaatgacggtgaacggcggacgggctccgagacaccctaagagagaaaaagagacaggttagagggagagagggagtccatggcgagcgggaaccgtggccgacggcggcagctatggaaaggctcaccggcgcacggcggacggcggcctccgatggcggaattcgacggaggaggggtggacgaggtggagctcggccacgcgaacccgacggcggcgacggcgtggtgcggcggcgaccctagcggcggctagaggcggctggagcaatgaaaaaaaggcggcggcgggtgggagcacggtgcgggagcgatggggagcttgggagaggccgggaaacaccgggggaaaaaataaaaagggaaaaattgaggaggaggatgtggggatgaattatataggggcggagaggtcgggaacggccgggagtggctcgatttcgccggagttagtgggggaagttggaggtggggagagagagagaggcgggattcgaatttgaatcccgaccatctcgtgacgtgggcgcgagcgggagtgagggcgtggacgcggggaaggcggggcgtgtgggggtggggcgcggggaaggcggagaaggtgggcggcgcgcgcgtggcgtggctgtcgccggctcggggaggcggccggaggttggggaagggactgacaggtgggccccacctgtcagcgcccgagggagatagggggaggcggcctggacttcgggaggagaaggggaagcggaccggcccgatatgggaaggggcgcgggaggaggaggaaatgggccgacagcccatttggggaaaagaaggggaaaaaaggaaaaaggaaaagaatttccagggattaaatattgcttgtgctcaattttaattggttaaaattatttctagagctctgaaaattccactaaaaatcttgttagcgtatttcgacatgtagaactcaagaaaaattccacatgccaaatccgattattatttgcattaattcattagggttttctcttgcttttacaccgatattttctctggtggattataaattcaatttaggcttgggaaagaacttcagggtgtgacaggtagcttgtgaagttgtatttggataaagtgaagacaattaatgtgtgtatttttctatttcttggtatctccaaaaaaaattatatatggaatagtactacatgtaaaatctcatttacaactagaattgttactataagagaaactcttctttaagagaagctaatgttttttttttttccataagggactttctagaagtacagtttgttaaatgtatacaactacaatggtcgacgttccagttcgcatgcacacccagcagcccagaatgaattgaacccgtggtcggcggcggcgcatcccgccggcaagccaaaggggaaagtttcaccggagcaaacgcaagaccgattcgtcacgggctcgcggctagggcatcctctagggttcatgataccatttcaagcatcctcatggcatggcgcggcgcatctaggtggccaacggcgaattagcggcggaaccaggtgaacacgagtgtggggaaatatggcgagcaacaagacacagcggtaagctagctagctagtagcctttggaaggtgtatgagctagggaaaaaggattgggagactaccgagacgaagggcgcgtagtgaagaaatgccagcagagcggaagtaatcttccgacctcggcgcgaaccaattaaggtcggggtaagggaagacgacctcgccccagtcgccaggaacgcaccggcacctcgggcgagccacgcggtggacgagagcggagtggtggaagcgatcggcgagctctagggatggtgaaggagtggaagctaggagggagaaagagagccctggggcggctttcatagttcatagagctatcggtctggaggagaccgagccagcggtgtgtgccgagcttgttgtaaaagttagtcgatatagtggaacgacgactaaccttcccgatcgcttcagtcgttgatcacccaagacatgccagatgacgacacaggaacacacgatatttgttaacgaggttcagccgaagcctacatccccggggctctgattatgggcgctcctccccaaccaacatagcacctagccgctacgagtccatggccacgccgccatcctctccctgcgtgtctacgctacattgtagtcgtcatggttacatcgtggtgcccccctctctatttaagagagttgccgggttacagagtccaactctaactccacccctaacacctattacaactccaagtccaactgtaaccaaataggactagtatattcgacacctattctaacaaactccaccttggaaaatatacgtcacctagaagtagtagaatcaccatgccgatccacctgtcctccagacttggattatttccttttgcagcttcaccacgagccgcccgacgagcgtacaccagactcaccgtcttcaagagactccactctccctgtaatttcttcctcttgactccacctgcaacagcgctccgccttctcatctatcatcacggtcgtcttgccaagcgaaattggattccttcctagttgtcccatcatagactccccaaagaccatgttcacctccacattccgtctttgatttgattcaatctaatccatggccagataaccaatgtcatcactaaatagacaaatcaaactcaccaggcatgaagaactgaaccctttcttccttgttgtcttatgaaccaagctaacaaatccaacatccacgcttcttgcatctgtagactgaatccatgatattttgagaaaattcaccgtcgcctcgaatcacttgaagaattaccatgatagccttcgctcttactccttcagtgacgcagatttccatatatcccatcatgccgacccgcatattctggatatatcctgtactgccaaacagtatcgttgaccccatcaacgatatttgacccgatgttgcccgggacttctcgcatagcaaaccacccgtttgccactgccgcaccggtccaaccaatctgctacacggccggtctacctccgtcctgcttctggttcggtccggccaacactctagcatactccttgttcctgagccatacctcgccaccttgctgagcaacctcgtcaccgtgagactatctctacagagttcccaaggagccttctcgccaagtcactattttgcgccgatttctgccaattttgtgccatatcgaatcttcccaagccagcttttaccattgcccaagaaagtcccagtcaaactgaattccaaacaaccgagtctgactctgatggacttatgcaatccgattgcacaacttgactctaatggccacagaaaaagatacaactcagccaccgtgtccgcctagacctctgttgcgttttcctcacgtccaacttcctctcagcaaatagcttgccacaccacgctcatacacaaattatgcacctgcttgcatctagcctcccatgcattagggcctttttctttccgcttaggatttattataatccagcttattagaagtaagctgaaagaaacaggaagattatttttacagcttattataatctagatgatgggttattgtaatctaataagctcaccaaagggagctttttctggattattagatggcaaaagacccactgcccctgattaattctaattatttacctgaattgccaccgcgtaccgcttcgtttctttttttcgttgaccgtgtgaccgcttcgtatcctgcgcgggagtcgcgagatcccctttcccctccactttctcttcttccaccgagaagatcggcaggcgagggggctgtgcgacggcatcggcctaggcgagcagagggcgtccggtgcgcggcagcagcgaactcgggggcatgctgcgtgcggcggcgaggtccatagcccattccgacggagatggatcctgcagatggtgaggactccctctcgaaagcatttcgataccgtgatgatgtggtgaataagcgatcccaatcaggaggcaaccatggcgtctctggcctacatggctccggcagcttctctgatggattttggggcgacggcgtcggcgaagatggacatataggcgatcttcatggctcacccggcgtccacggccaccatgtctcgcctgccccccatggcgccggcagttctggcggatcacccgtcttccatggagccggtgccgggcaccgcgacgccactgtgttccaagcggtggcagatgtgtctccccctggcagaggccgtggacggcgtggcgggcatggtggtggacctggacgtggtaagagatcggccacacaaccttccgcacgtggtggccgaggaaacaaggtgccatacaagccaccaaggccatccagcagtgcaactgttgtcggcgacgccgagggagcagctggtgtagacaatgacttcacagaagaaacaatggacagtgcgcctcatggaatggtacgtctacttcatttctctacttcaaaaattaaggtttaatgcatttatctactgcaaggattaggttgaatctaattgaatttaacgtgtatgtgtactacatatgaaaaattaatgtgtatgtgtctatgctaattggtcatgtatttaccatttctaatatagaaatacttgtgaatatataaacactagtggtgtaaaacaacatgtaaatctgaaccttgatgtgtttgatttatcaaatagaaggaggagcttgataaagcagattggtctagcacacacaataggatattttgtgaactatgcgtacaacaaattgaagacggcaataggcctatcgggataatgactactagatggtaccagatcatagccaaaaagtacttccaaaagacagggctaagacacaataagacacaactgaagaaccggtgggatgtgctgaaatccatgtacagcttttggcttggtctccttaacgacacagggcttggatgggatcatgcaaaaggaacagttgctgcacctgttgagtactggaaaaaagtcaccaaggtaataattcatgtctcatgtacatgattttcatgaaaatgttttaagtgcttgcaataattgaagatttgatgttttatttttagggacattctgaatggaagaagctacaacatggaccaccagaatgtttagaattgctggatgaaatgtttggtactattgctgttgatggttcttctgcttgtgcacctggagaaaatgctggaggggatgatgcaagtggtgatgtacaggaccttggcgacacaccagtagattgctcattgggtaaaaaaccagtgaagcgagggtcttccagcaccgccactagtccatacaagaaggttaagaaccccatggttaggataatgaggaatattcaaaccactatggataccaattgtgatattgccaacaaggtgatgcaaggtgaatttaggttcaattccattaaggaggtgatggatttggtggtggattgcggggcagcagaaggaagtgcggagcatttcatggctacaagattatttgtgaaagctgaacatcgtgatatgttcaagactcttaccaccaaggtgggaaggctctcttggttgcagagatggtgcgagaaggaagggcagcagtagaaaattgctaattatttatatgcatgaactagttatctctgtttttactttgtcagacaatatgtattagcaagattgctacttatttattcgcatgaacttatgtactgcctggccatgtaatatggcgccttaattttgattggatgaactactgtttagtgatccatcaacatggtctttctgtgactattgaggtgatatcatttgttgcattgtttgtagatgggcatgtatggaagtgatgatgacgatgaggaggaggatgaaactattattgttgctagcagacaactagatatgatgagaaaatttggaccggtgttgacatcatttggtatgttctacgctgaaaattatttgaacaagtccaagtatagaaaagctaatttagcgggtcatgcttgggttatgagaaaccttgaagttccacaagattgttatgacatgtttagaatgagtaggccactctttgagaggttacataatttgttggtctcatcttatggtctgaagtcaactagtaagatggattcagttgaagctttagaaatgtttttgtggaccattggggctccacaatcatttgttcaagttaagaaccgatttgagaggtcaaaaggaaaaattagtagaaaattcaatgaagtgttgcagagtatctatctcctttcaaaagatcttgtcaaacctagagacccaaacttcacaactattcacccaagactacttgatgatcggtttgagccccatttcaacaattgcataggtgcaatagatgggacacatataccagtagttgtgcccgcatcaaaggtggttcaacatgtgggtagaaataaatatccgacgcaaaatggcttggccatttgtgactttgacatgaggtttgcattaattgttgcggggtggcctggatcggcacatgatatgagggtgttcaatgatgctttgcgcaaatatgccgctatcttccctcatccaccacctggtaacttctcttatccgtttaatagtctcgtcgaactagcatcaattataaaataatgtctcatggtttatgtttatgctaacagggaaattttaccttgttgactcgggctatccaaatcgactaggatatctatctccatataaagggaccaaataccatttaccggaatttcgagagggtccacgtcctagtggcaagaaggaggtgttcaaccacttacattcatcgcttcgtaatgtgattgagcgctcttttggtgttttaaaaatgaaatggagaattctattggacttaccaagttatccaatgctcaagcaaacaaaaataatacatgcttgcatggcgctgcataattttattcgagatagcaaattgagtgatgaagagtttgatctgtgtgataatgatgaaaactacatgccgatgccttcatctcaagggaatgccagtcacatgggagacgaagatggggacgcaaatgccttccgtgatagtattgctgatgctttatttgctaggagataataatttggttttaagtctaatatatatgtggaagaaatattcatgaatgtataattataaatatttgtcaaatttttatttatctacatcaaatttatatctattgtataaagtcaccgaatgatgacaaaggcatccaaaaaaatagttgagggcattctagactttagccatgcaaactcaataatccaggtttccaataatctagagaaagaaacagctcacagcttattttcctctagcttataataatccagcttataataatctgactcaataagttggattataataatcctaagctgaaaaaaacagggccttaatctcagcactgtaacatgcagcttgtgcatatgcctgacgaccaccatgcactagccatcctatattttaatgcatgcagccatgatgattgtatacaaatcgtgccgcatgaaagtgtcttctccgatccatgcgatttgctcgactccgttcaagttgtacgcaaagaacagcatccgtactgttcgtctgtacctccgcacgcaccgcagtcgcagccctcgtgttcaccgtctacgaccccgtcatcatcggccatgcacgtccgccgcgccgcgccacgctcgccggcttcgcccttccatcactagcctccctgccgccgcggatccgcgatcgccgcgtgcgtcgggcgcgccgtccatggcgctacccctccgatctctccgaacgccttcggccacgcccggcctcgtcttccagtcacgctccgccatcgtcggtctgatcgcgagtgaggtcgtcgcctccgcaacgtcctcgttgtcgccatcgatctcatcgccatgactgacgatctcctgtcgatgcacgatcctcacctcgtgtttcctcctccacatgtcttctcgatccaatactgaaaccttctgctcgatgggt

SEQ ID NO: 42538 - DNA, 7057 bp, Oryza sativa
  unsure (1)..(7057): unsure at all n locations
ccccaccttttaagtcgtgctcccccaccatcaattaccgatgtgggactaaacccaacaatctcccccgtcacacatcgggcccaataatctcccccgtcacatcaacccatgtgaccccgaagacttcttacctggcctctccaccatgtgacccatggaaattattccgggtttcaaaccttgggctctgataccacatgttataaaatttagtcgatatagcggaacgacgactaaccttcccgatcgcttcagtcgttgatcacccaagacatgccagatgacgacacaggaacacacgatatttgttaacgaggttcagccgaagcctacatccccggggctctgattatggacgctcctccccaaccaacatagcacctagccgctacgagtccatggccacgccgccatcctctcactgcgtgtctacgctacattgtagtcgtcatggttacatcgtggtgcccccctctctatttaagatagttgccgggttacagagtccgactctaactccacccctaacacctattacaactccaagtccaactataaccaaataggactagtatattcgacacctattctaacagagctggcgtggtcaaggtggggcgagcgcgtcagagcggcgacgtcatcggcgtgcctgcctccgcgtctccccgagctagaggacaaggtagaggcaaggaggaaaaaggaaaagcgcgaggcgaaaaagcgaggcctccctctgcttgactgcttctggtggcgcgactggcaaggcggactgaccggcgtcgacgccttggacactagcggcggggccatggtgagacgccggctgtgacggtaaaggcaggcatggtagcttggcgcctggcggcgagcggaggcaaggcggcggccagagcggtgactcgcacgcgagggcgggaaacggcgaggttgcatggctggccgcgctggcgagcgagcgaggttgcctactctcctgcatgtgcgcggcagcacgtgatgagcagccgtggcgagtcgggctcgggcagaccggagcttcggcacgcgagcgtaagggagagggatctgctgggctgtcctgcttagataaagaagggagaaagcggcctgattggagaaataggcatgagagggatttatttggatgaagtttgagggtgatttgatttggatttgaaattggacgttacggagatttgattcaagtttgatatttgaatgtagggactactcaaggaagggaaacacggtgggactcaaatattttggagttgtaagattacttgaaacgaggattggatttgaatagttgaaaggatttactgatagacttaaggagggaggttcaaacaagcaaatttaaactccgagtctatttcgaaacggtaattttgaggagtcaattttggttttgaaggaaaggagataaatagagcactcagaatacgagattttcacggataggtatttcatcagttttgaacgccacgtaaaaaacggggcattacactagctataatctcaaaagaattgtaatttagtaacgtttggtttggctttaaatccactattcacaggatgagaatccagagctgaagctttgtcgtaaaggacagtaatcgtgccctctggtaggcagtgcacctatttgctcgaaaacttccgtaagtttttttttttccttcaaaactattagatttttaaccattggattacctcgagatttgcgcatgaaagaattttttttctagaaataattttttacacatatcacgcgtaagaacatgatgctaactaatcaaaccatacttgaatacaagttttatataagttactatatcgtagttaccatgtaattacagtacagttacaatgtaattgtgtctcaattatatactactattgttatatgtgaaagtttttcattaaaagaattgagacatttttttagatactcccgtaccaaagttactaccactatataaggaaacatgcaatttatcaaaattgtagtaaaaactttatattagactgaaatcgtcttatatccgtgtgcatgggccataactttactcagtttaaactagtttagcggccgtccatgaaatgggcctggatttagcctatataaaataggccgtacatgggccgataattggatctgaacgatactctgaatattaaattctcgcggagatgcgtcccgcccgcccgtgacgcgtacagccgtacacccattcctccacgctgtttgctccccgcgcgccacgaagtagagtactccatctcccaacgattaatgccaagtcaacaagcaacaattctttttgtcgaacaccagcaagcaacaaatcatccagtcagcccgaacacagataatgcagccgtcgcaacgatcccgccggccaccgaggttgagccgccgcaatgccatccggcagtcggcgtacgtggcccggccggcgtcacagctctcgccgccgtcggagtcggaccaacccgccttctggtattcgacggaggaatccgttctggaggaaagggttgtggaagatgaggtcggagatcatgcagaggcaggtggagccgaggcggccgcattggtggtggaggaggcgtcgacttcgagctcgtctgcggtctctgtccacgcggctatggtgatcaggaggagcatcttgaattggagtaagctggatcttatcggggccggatcgtccggcagggtgtacaaagcggtggctgagtaagtccgcttgcgatttaccgtttgccttgctcatgaactgttcgatgcaatgcttcattgtacttcgtgtctggttgtgtgttctattctttcagcagaccggcaatttcggatgagttatctctgtatttctcaatgcttcttcgtattattgccttgtcagggatgggtttgtatttgctgtcaaagaggcttcgttgattggtcccgaaagctatacgaagcaaaccgcatgtcagctaaagcaggtagttttatctcttatcaattaattaggtgaaaaattatcttgtaagtgtttaattaagcaaattgcaatttttgtcaggggtaaaatttcagagtattgatgttctccaattctaaatgattccaagtataagctaattcagtattagtaacaacatttcaggaaatcttgcttcttagtcggttggagcacaagaacatagtgcagtattttggtgccaaaatggtatgccagttctcatatgctagttgaacaagtgtcttcattatgttgctgatcgcctctgcaaactgttgcctcccaaacaccttcattttaggttatttttcttcggtttgagcttactatccctgtttggatttgcttgcagggagaaaccgtgctatgtattttccttgaatttgtgagtgaaggttctttggtatctgtatatgagaagcaacagctggaggaatcaactatatcatctttatacaagacagatcctcaatggattggcttatctgcatcatcataatgtaatgcataggtgataacacattatctccacaaaaaaattcttgctgctggcccggtcatttgaaaatgtacttgttatagtagtgatcaagttaagtacagatgtacaactctcgatcaaatgactaaatgagtgaagtacttctttgtcatattatggtaaatctgcactgtccttcccttttcaatgcagagatattaagtgtgcaaatattttggttgataaaaatggagcagtgaaggttggagattttggactggcaaaggaggttacttcatttttggtttcagtgtccttttttcccctggtttgactgacagattatgaaatgattttgtttgatattgacgatgtgaattctcaacccttttaattgatgtaatgccagataaaagtctggaagcagaaaagatcttgtaccggaagtgtatattggatggctccagaggtaattgtttgacttagtatttatacatagagttttgctcccatccagcaggtaccatcgggactgtccggtaccaaatctcagccatttaatcagcgaaatcggacggtggaaaataagtggtacctccaggtacaaatttgcccatgaggaggtgctaaaaaatttcgagtggtggaagggtaaatttgttttttcgcgtaggagtgtccagggaggcagtggcgagttgcttcgtgcttcgtcggcggcggcgagttgcttcgtcggtgacgacttgcttcgtgggaggaggcggcgtggcggcggctgatccgtttgaggctgcggcgtctgatccgtttgaggcggaggtggcggcgacggcggtggcggcaggtggttcgttgcggcgaggttgtgttgggcgcagtggtggcgggcgcggcagtggcctggtgctgctggtggcgggcgcggcggtggcctggtggtggccacggtcacgaggtagcggcggcggctggtgtgtgggcagccttggctgcgaggtggcgacgggcgcgatggtgccggccgtggtgatgaggtggtcgtcggagccggtgttgtggcggctgcagcgacgagatggtcatggagtcgtcttagcaggcgatgtggcagtgtatacatcgatttcttttcatccgatctaaatcattaggttcggttggttgcagcagtagatactttcattttctgggctgcatatactcttcttcttcattgcttataggatttgtattgtacgatttattggatgttttgatgagctcaaccattacttgttctttgtgaatgttcaaatggccaataccctcccatatcatttactgattactgcaattcgagtaagggcgtgaatgaagccgctggtgaaggagctcgctggttccgccgccgcggatggcagatgcggggcgagcaagcgagcgcacaggcgggggcatggatgcggggtgagcatgcgcgcggctcaggtgggcttcgcacgggtggggctgcgctcggagggaggaaaaaaaaggagattagatgagaaagcagcgccacacggagggaggaaacagagaaagagcgaaaaagagaaagcgagggtgcgactcctttctctgtttcccgatcgtacccttctaacatggacggatggatttatctctgtacctgccggtaccagtacctgccggtacaagttgctggatgggagcaaccctcttagacatattagtatgaagtatctagataaacgttactctgaagaatttattgcacttttactttacgatagtcgtccaactttccggaccagcagaatctatattggttatctgaatatctgatgatgatcaggttgttcgtggcaatccgtatgggtattctgctgatatttggagccttggatgcactgtcttggagatgcttacccaaagaattccttatcctgatgataactgggtcagtaaatcctacagtactcatttagacttcttacagtctcttcaaattcgatactgattcagttctatcaggtatcagtcttctaccaaattggccgtggtcaacttcctccagttccaggctccatatcaccggtgtcacgcgatttcatccacaaatgcttgcaggtgaatcctgatgatcggccttctgcagatgaactgctgaatcatcccttcgtggctgttccagaaccagactagtatgctgcatgtttgcttaacattgctaggcgaagaacattcagtagctccttgtttccttcctgtaagttcagggtcagaaagtcagaatgcttgtggttggaaattcatagtcctatggctaatttcacgagtacttgtttgtacgacatctgttccttataaaaatatcccactatccaactttgcgactttgaccattagttgggagagcaatcaaccaatcatgtattttatggttgagacttacgacgacttgctactccgcgtctgcatgtctgagtctgaagtctgaaccgacggcgctgacgttcccggtgacgaaaccaaacagccacacactctgaatcttacaagcaaagccaattccgcaattcccacgacttggtactcggagatagcggttggtcgtaacgggagcagttagccagttaccgatgacgtcgtctcgatcgacgctcgggtcgctctcggggtacggggagggtagtcggctccacgccgttataaaaggccctcatccgcaacgcgggtctctttccggcgtcgccttgtcactcgctcgccaccacccctcggcgccacggcgagcagcgcaccgggtccaggtcaaaagcgcacgcacccacatcgcacggccgcgtcgccgtcgtcgcgcgtgagccccccgtgcctagtcaaaccccaccacgagcagaatcccccaatcttctcgcgatccgctcgctctgctgctgcgccgcgggagcgcgggggaggaggaggaggaagagggaggggcactggccatggcggcgcgccagcggccgcaggcgcagctcgcgcggatcaacgccatgaggcactcctacaccgccgcgggggacgatggctccggggacgacgtgtgtggggagctcgacgacggcgggggcgagtacgcgtcgcagaccagcttccgcatccgcggggggcgcggggccgcggaggtcaccgccatcttccgcaagctggggctctccgggcccgaggacttcaccatcccgcccgcggtctacgccgccgccatgtcccacctctccagctccgcccgccgccgcgcgtcgctcgaggtggcttccccgccggagcttctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42539 - DNA, 6211 bp, Oryza sativa
ttgcaaagttgatgtcatgagattatagcttagcctccttttcttgcctttctttttcggtttctctttcagttgcactgtaaagctgtcacaatttctccccaatcttaatacaaaagatgcgcaactcttttgcgcattctcgaaaaataaaagctactccaatcagcgagagggtagaggtggagccacactacactaaaaaaaacacaaaagcagcaacgccagtggaagaccacagacaatcctctgagaggatggactcgaaaaccacggagaccgaggagagcaccgagttgaaaaccctaaaattccgctcctttcacagctactaagagaccagaaggaccagagagtcgaagccgacacgaagatgttcaagtaatcaggccctagaagacggccaccggtcctgaagcgagctgccacgggcctcaaactctcaaagataatcccaaagaataatctgtgttcaccaactgcacacatcacctccaaacacgtacgtacggacgtaccatggccgccggcgacgtctaatccaaaatttccaaaccaatgaacaatagccggtttgacacgacgaagaagcgacagaaatgcagatagacgtgtcgaggccgattggctggcctcttggacaatttacgaggagtatctgtctagctgatggcctgttgctgcagaagtagcaattcgtgctctcccttttcgttgaaagagagagcgatcgagaggtagcaattacgtgctcaactgatcaattgacaaagcatactatacatttgtctcaaactgaaggattccgcgagaagatttgtggacttgttttcagagatgctaggcatcatatgaaacactgctcatgacgcagatctcagaaacttcagagttactagaggatcacattcacggtcatttttcgtcgccgttgtaaactagcttttactactacttccattgacaggcagggaaaacttcagagcgatccaatctgttcttttctgttaatggtactaaaatatttgcgaaaatctcatttggaaaagtgttctttgcactaataactagtactaacagaagcacttttattgcgagaataagacgagccatccaatggcaactcgttacgctggcacgagctctgaaattccgatctccacttgggcagcacatccaaataaacaagctgcttatgttgtcatctctgtccattactttgccctgcaattcttcgtgaatatcgttatctggaacatggatcagaacaatctagtggcagccagattagttgctgccattatctcttggttaattaaaggctaagacaagctcaggttaaagcgcaaaaggaagtggaaagaacaaatgagcgagctgaggattggttctgacttctgtaggagatgatagttgaagttaaaaaagattaaacttgagaccactcatgcatgcatcgaatgagctgaactgcactttgggtgatttttacggcagtagtatatctgatctgatatttgtttactctgaacaaagcagatcaactgcacaaatggagtgagatcacgcgcctctgctagccttgcagctggattagtacggcaactagtacaagttgacagtattgtcaatatatacagttacatctagtgcttctgttcgttcacagtgatcagttttgttctttttgaaaaaaatcagtgttcagttttgcgatcggtgaagattgcaggcatttattattattattattattattgaactgagccacgaagctatatcattattgatcgagataaaatagttgaaaaatgaaagtacgttttatatgatataataattcttgtgtctacgcagttatacatggggaatatgctggaaatgtgctaatggagagaagagaagttgatacggcaaggggcaagaaccatgtacttatcaaattgcaactatttgtctagcttgtttcagctttccagatgagtttctttcttgggctatggtaatggatgtacaagcttttgtaaggttaatatatcattaggcatctagtgttcacttcaatttgtactttctacctgaaaactttaattgattaaaatcaacttgcatggtgatatgatatctgtgtattgctcaaagataagtagtcactgtacattactattatggtatttcccattgttccaccagatcattaatcctactatacaaagtccaaattgacttatagctttacatcttaaatacattagaagtcttggtggcaagaatacgagtcatgacttatatccactgagttgcaaggacaactttactgtattccctccggtcacagaaataatggcagtctaaaatgaatgtaatcttacggtgttaattttcagctaaaagaaatgtcaaattttgactaattctagtgtataaatttataatttggatgtacactaatgtacaagtaagcctgtcataaagaccaccacttttagtgtataaatttataatttggatgtacactcatggtataagtaatgagtcttttacctttatgccattattaagaaagttggaggttacgcgtgtgccacaaaaaagttttgagttacatgtataccatgacacaaattttcgtttacctgtgtgccattccatccaccttctgttagagaatgagctctgacatgtgggacccacgtatgaaaataactaaattgcccctaaagcattttcatctccactactcctctcctccagtgcgccttgaaccctagccgccgctgccgccgtttgtcgctgtcgccggcacgctgctgcctcgcctcgttttccgtcgctggcacgccgccgccgccgccgccggtcgtcgccgtcgccggcacgccgctgtcgccgccttgcctcgccggcacgccgcagcgccaccaccgccgccgcaaaagtggatgaaatagaagggcaaaatagatctttcaaacctctgttagtctttgttagtgctaattccatccaaagtggcgcacaggtaaacgaaagtttgtgtcatgtcatacaggtgactcaaaattttttttgtagcacacacgtaacctccaacttttttaatggcataggggtaaaagactcacaagtaagcctgtcataaagaccaccactttttgttgactttgttaactcaagaacaccattcttccgtggctgttgggtgggcagggtgtaggtttggcaatgtgcccagagcctaagaagaagaaggaaaacgatgaactgctgaaagccttttcgggttaaaactgtttttgccataatatggggaggtacacaactgcgtctcttgcctaggcttagcctcaagtaccacctataaattcacgttaaaaatgaagtagtggagattttggttgtcaatttgatttgatgtatagtgcaaagaaaagaaggaaaagaaaaggaagagaaagagatcgagagacaagatgcactgaagatcaggtcctgagacgagtgctgtcacctcttcgcaaattgcctcaatgctgaacctatcctgattcagtgattcctgatggacacgacatggatgagtcgtccagaggaaaagaaacgccgcaccgagaaaaccaacaaaaattaaccctcatttgagatcatacatgcccttaattgaaacccatcgacagtcaaaagataacttttctcaagacacttattagtcaatcaagattcaagagcctggaaacaacagtcaaagtagatcttatacatactaatcaaactattttgcaacaaagaacatatagaaactaaccgatcgattgggttccaggagatcgccggagctccggcgagttcgggcattcggcaccagaaggaagagagtcgccggcctaactgataagagcaagtttaatagtatagcccactactagctccaaatcatctatagccaatgtaatagctaattcatacaatagttgcttactatactattaatatctggtctcacttgtcatagacaaattacgtcttggagtccattctgcagctggctacatatctgtagtttgctgctcttctctctcttactttatcttttgctcttctctctcttactttatctttttaaaatatatttataactagcttatagcccgctattgtatctgctctaatacgaacaaagaggagggttttatgaaaaacaagtcctactctctccaatgggattgatatcgaccgtcagatgataatcggacgatgaagagtgatccaagatggtcgcgatccaaactctcgggagtattctcaacgaaaacgtcctacctgcactcgagtccaaccaatctgaactgcagagtttgatcgaacggcgaagaggtattctagtcagatcgctaccattaatcgcgacccaattctcaggggttgtgaaagataattcgacgaaaacgagggtttcctgtgtaaatatacctccaccccctcaactcctctctctgacaggtgggctcactcgctgacccgcagtcaacggcggctttcacggtgagctaccgccgccgctgccgcgactcctcgccgtgccggcgttggtgagaggtgggcctcgccggcaggcggcagaagcaatcgcctcgacctcgagctcatgcctaatccgtcttgatcaatcagcggctaattaattcgtctggcttagcaatggacagagaagcaaatcgagctataaaatgtgtgaagagaatataatagctatgaactgtgagttcaactgataattatacatacataagtcgacctgtcaattctatcatacatgcgtctatacaagatcgatcaaaaagatcaagaagaagaaggggaaatcaagagaccaaaatcatgagatcgaaaacccggagcaaatcactaatcacctagctactgtatgccactccactctcctctcgtcgtgtactgtctctgctagctatagctaatcgctactgtacacgtacgcggggcgtcctcgccggcagatcgactccgccatggcgcacggaagcgagctcgatcgatcaggagctgactttggcgcgggtgcacggggagaaggagtagtggtggtggtggtgcgatccgccgccggcgtggacgcggtgcggcgacgacgagccgccgccgccgccgccggccgcgtgggtctcccgctccacgagcgagcggaggcggaggaactcgtcgacggagcaggggagccggagcgggccggccgagtcgtagccgtaggcgtcgcgcgccgcctcaagcaggcggcggaacaaggggtggtagaggtaggcgatcgggatgacgaaccgccggaacccgccgccgtcgccgccgtcggcgccctccaccccgaccctcaccgccagccaccctttcttcaccttcccggccttcttctcctccccctgcagcatggcggaagcaccaaccaccgaaacagacgccgtcctctcctccgcgacgacgacctcgccgccgttgcagctgattaacctcgctgcgcaagtgcaatcaagctacgcacactccacgagctggagctgatcgatctcgaattggggcgtggtgtgctctgccacgcgtggtgtgtcttttataggacgcggcccgtgcgggcgaggagtttggctttagcttagctagtggcagtggcgtacgtacgtcctttgctacggaagccggccgccactgtcatggcgtgctcgcgttccttccggctcccgtgtcgctgacacgcgggcctcggggaatatcagggttcaggtgaaccgctgcagtgaacgagagagagattgttatgctcaaaaacgggaaactgttttgaaccctccctcagttgtctcctcctccatctaaaaacaattcaatcagttacaaaaaattctgaaaaaaatagatgatatttatgcagcgtatatatatatcgctccacaaaatcttaggtcgttaaaactcatcatatatattactaagatataaaaagtttcagttggtaaatagtagtggcactatatatttatatccaaatttgtctctttttcttctttaatacgtaggtcgaatttgatgttgattttcggttaagcgctagatttcactgtagtctatattgttattttctttaaatctttttcataactatttgcatagaatttagaaggaacaaagtacacaagtctaaagg

SEQ ID NO: 42540 - DNA, 2122 bp, Oryza sativa
  unsure (1)..(2122): unsure at all n locations
acacgaatcgccgatgacccgggcggtggcgcccaccgggggatcgagtggggtggcaatagcttgtggtggaactgatccggccaagtgggggagggaatagcgtgtgttcgtgcagtgtgtgctgccccacgagagatggtggggattggcatgcagatcatgacggaatggttcgtcagattgttgttgctgctgctgctgctgttgttgagtactaatcactattggattttgttctttgtgcttctgcttctagctgtttcggttatcttttccagtgatggtgggggatgcgtgattaacccaatctcatctatggtgtgcgatcgatcgacatgactgcagatatgggcgttcctttaatttgatcgaggatgatacacatacatacgccacaataatctgtgtggttgcatgcagtgctattgattcagttcttctcgtcaatctttatctctgttgaaatatctctgttgtcgtcctcaatagttattctgaggttagtcttactggtagacagggaagttgtcacaggggaaatctcacatcattctagctccaaaccaaatgacaggtgctttgtcagggggtgtgatggattagcgatccaggattattccaggcagctagggccacaatgttttactaatttgtttctttgcacgagtgagagcaccatgcacacagatatctcgtactactactcttctactagtaatttggataaaatacgcaactactcctacctacgagttttctttttaaattttaacagatgcacgcgcctaatggttgtctttctcgaaaggatagatatcatatcacgatgagtagaccgacatcttggactgctggattgcttatctacatgtatgtcatgattattggttatgtcagccaactttgtggtcacaagatgtgttgtatgcttgtaaagttgtactaataaaactacccaaaattttcacgtaattctacgcaaatcgcaggttaaggttcatttacagtagaattgcatctgctatacaatttcgttgtgtttcgacaaattaatttaaaattgnggttaaattattanaanttgagttgaattgtagcttagactactttctattgccaatgtttcaatttatactatcttttgactaatcctttcgctttgcattagttaaatacttaaatttactctctctctctcactctggaccaccccaattctcttatatacccatatctaactacgcctccgacaaagatatagcttggggagggagtttatcagtgtattggaaccaatattggttattgatgtgcttaaaaaagtggtttgggtggtttaaatctgttgacagaaaacacgaggcctgggagatctgcttaactccagtgcaggtccaaagctcgtcttcgaatgtatgagcgtgccagttgatttaatcctgtaatcaacaagaaatagagacaaagaatttgtggttaaatctataaatgatagccgatcggctaagtgccgatgacatatcatttatctttgagccgatgtcatttatgaatcgatcagtggttataaatagatagtaaggaactaaatctattcgataggctgtagatattaacgatatatagttcttatattaatatatacttcaatcaaatgattgggatagatcggtcaccatgccgagacagtataaatcacttaaatcgaaatatatattaataataggattatatatgtttatagcatagccgatcagatagatctagcatgtatcggttaatactccgatactactctatataaagatatcaaaacaagtataatataccaaacaaaagcttaatatacttaaatgcaataagatcttgatataaagggcatatttaacatgtcactgaagcatatagattgaatatggttaaatcagataagatcggctgaaactccgatattaccctaatcggtaaccagaggacatgctagagattgatattctaagcacgacttaatagatcaaactcaactaatacagcattaagtatgaaaagaagaacaatatctagacaacaaagccgctggatgtttcataaagtggtagatatcttatacaatctagga

SEQ ID NO: 42541 - DNA, 1561 bp, Oryza sativa
atgctacaagatgccaccttccacaggtctaccatagaagtgactaggcctccccctgacggtatagcttggtcagatggagagaaaggagacatgaggggtgaggcgtgatacaccaaatccctacattaaatacctttgacttgcggtgagcatgcctaattaatgtggaatgatgggagcgagctattgcacgcttcatttgtacctgttgttagagcgtggtcatgtgatcccccaccgagggcgcccacgcgaccaaccattcgcgtcctcgagcaatcctcccgcgaatgaccatgagatggacgcattggcccctgaactgtcgcctccgagcaatcttcccgtgaatggtctcgagctaggcgcgttgccacatactagacccgagcaaccttcccatggctagcctctagcgggtcgacaaccacacgtcatttcctagccagtccaacctaccaactagttttctagtcaccctttcacgcagtgttatccgtacgctatcttgtgacctgaggaaaattgtaccgatatcttagcttccagcctagtcgtagggatatcaaggaaaattatactcattactttctaaaatcaagtgttctagtagtagtatagatgatgagaggtataaagtcatgtgtataccagattcacttcctccaatgtatctagccttttcaatgtactaatgcacacctaacagaaatggtgaaatatacacaccattcaccattacaaagaggatggagattggagaataaagaggcccaagctacaaactacacagtgctgtcaaatagtttttagggtgcgtttagttctttaggcgtaaagtttttgaagtatacggatgcacatttaaagtattaaacgtagactaataacaaaacaaattacagattccgcctgtaaaatgtgagacaaatttattaagcctaattaatctatcattagcaaatgtttactgtagcaccacattgtcaaatcatgacgtaattagacttaaaagatttgtctcgcaatttacatgtaaaccgtacaattggtttttttatacatttaatgcctcatatatgtggccaaatatttaatgtgacgttttttgctaatttttttttatctatgcaaggccttatttcaaaaggacagccagcagaaaaagcgactcacagcacggcgaatatactagtagatgcagatcagatcatcagagacgacggccacggccaaatcgggttgacgcgcacggcgcacacacactctcccccgaaggcctgaaaaccatcaggcatccgtatacagagcgcacagtgtgcagccagatcgagcattccaatttccaagctctctccccacagaggccgaggccgcaagcgcatccagagcgcacccacgccacgccgcgccgcaccgtgccgtgccgcgccgcgccgcgcggatgccatccaagcggccgtcccagagcgccatggacgcgggcgccgcgcccgcctcgccatcccctcccaggtcgtcgaagaagcgctcgtcccgccccaagccccgcgcgggc

SEQ ID NO: 42542 - DNA, 1582 bp, Oryza sativa
cccggcgcgtccgcgggaccgcacgaacgccgcgtgcgcgacctctgcgcgagcgtctggggcgccgacctcgagccccttgctgagggcgacgacgaaagggccgccgccgccgccgccgccgccgccgccgaccagccgcgcactgtcccggacgccgccgccatgctgcctgtgctgactgagatgcttgatgagtactggaagacggatgggcgagcgctgtccagtgtgtccctggcgaaggggttgtcactgctagggacagaggaagcaagattcatcgagggcaagtggaggaggcagcttgattcagagatacaaacgcagatgcggcgacatgatctggccaaggaggtctacgccttgctcatggacgccatcaaggccctcgggccttagctcgggtatgactgtcatctacacgagtaatttatccaaactctgccatttccttccctagtccaacttctcgctggagaattcgttaacgcattgctcgttcgttcaattacagtagaacttatacaatctattactcggcaattgattgttcttgctgactgttggggtattttaccaaaaaggataacacgattgtgtggtctgtcgtctgttcacaaagtagcaaagaagctatttttctccatcagcacaccacagatcgaagtattaagcaattatgcttcccatagcatgatggaagtaacagtcttataatcaggaagcaagcaatatcagcttgattttggtttctgtggtcaaaaaagcctagagaatttcatgtttcatacttgctttacatattctttgcatcaaccttgagcaaagccagaaatcaaccatgccaatcctaaatggctgcaacaccccagtttttatgcactactagtatgtatattgtgtctctgactggatagtttggattttggagatggaatagtagcgtgaaaggagaatttggagatgacacacaataaattatgcataacttcatacacatctaataaccaaatacagcacatgctataagccatatgatgatgatgatctcaattaagttgtcaaaaccaacaaccaagccaacagagtatctttgctaatacttttttccttgaggtgtatcagaaaatgaatttgtgagaggtcacaaacccaggtttttaagctacttcaaataaaactgtttgaatttagaaaaaacttctccaataaagtatgtgattgccaaatcaagtccatggcatagagaattctgccatgtattttcttatgttggtctcttggctttggcaggagtaaacacataagccgtacagttgtccaaaaaaaaaagggtaaaaagagagaagaagaaatgaccccactaagatatggactagcaataattgaccccacagggccacaggatatattttctggctctgctacttggctatctcatgggcacctgaaagaccagatatagatatgtgcacctgaaattttgaattctgcttggttagggaaacaaaattatcagagagatacatctacgaaatattagacacgagctattacatatgagattgatgactaagag

SEQ ID NO: 42543 - DNA, 1297 bp, Oryza sativa
gtccttgagcaccatatttgtcttgatgagatcctcggcatttctacccaacttcctgaacgtagcataaggcatcaaatttaccgcggccccaccatcaaccatcattttagacatcagcttcccattgacatagccatttatatacaatggtttaagatgctgattctctgtcccctcaggcttctcgaacaccgcatgttctggtgatagaaccaacttagccgattcctcttccacctcgtcgacatcggcttgatcgatcccgaattctgctggcaaggtaaaaaccatgttaactggtgccgtcacaatactctttccttttgccaacctctttgcctcatcggctgcaacatcatcggctacaggagcctgattcttaacacgccactcctgcctcggttttgctttcttcagccgatgatcaatttcttgctcgacctcttggaagcgttccctactcctcaatctttgaacccttcttttctaattcttcgtaaaaataccagaaggacaccattgagtcttcctattttcatcatcttccgaatcaccacgttggtttactgggcccaatctttgatgaacaggtactcttgtctgttttggtcgattgcctctatcgtacaatcggcttgaaccccctgcaacatcactgcatccaggacaatcctcgatagatggtagtctcataccttcattccaacagaacctgaagaactcacagccccaataaggatcaaagccaccattatcttcttcatgatgcctttcctgttgcttgtcgtattttctttgatatttgtttataattctagctgaacttacttgataatccctcatgcgccccgtatcagctgttcggtcagctgtgtgtaccatgttaacgggaaatgggttaccatcgaccctcatcggctttttggaaccatcaaacttaatcttgcctccctcaatgtccacctgaatctgttgtctaaaaaccttgcaatcgttagtagaatgggacctagaattatgccatttgcaatatctctttttgcctaattcctcagccgatggaatcgtatgaccaacagggagttgaatttgcttctctcggagtagcagatcaaaaatcttgtcagctttagtaatatcaaaatcatacttctctttctttccagaactctttacccattggcacggtatgacctttttacttctcacccatttggctgcagctatttcagaatcatcctcatcgtcatccgacccatacatgtaaggacaaacatgattaaccttcttagag

SEQ ID NO: 42544 - DNA, 6497 bp, Oryza sativa
atataatccggtataaaccaatcggctatcaatacaatatgatagaataagcattgatccgaaggttaaagcatacatcggctggaggtccaatgtcataaaatccacaagattggattaaacaatgaaacctttgttacgatcgactaaatccaatatgtatgcaatccttgtaagccgatgcaacgtccacataactcatcggctgaaaccccgatgaaacccttattggcaatcaagaagcaagctagagattatggttctaaacacgacttagtagatcaaacttaactgatgcagcactaagtatgaaaagaaacataatatctagacaatcaagccgttaactgatttttagggtggtagatatctaagctaatctaatctagcaacacgatttagccgataccggcagaaaccctaaagcaagaagcagccgatagaggcaaattgatatgctaagactagattaacagacacatatgataaatatgtaggcaaatatatcatccaaatcagagcaatccaagaggtcgaatgtactgatgcagccttgaacgacgccgacgtagacgatacaattgctcggaccggcgaaacattggacttaccccttcgctggagatcgaacaccgatgcattcccgcgtcgggtgccaagtcccgccggatgataaaataaggtagaaaaggtaaaaggggtggcgatgcgccgaattgtattaatcgtggagatagattacatagaccccgggtgtacatatttatacccatgggttgatacaagtccttgtcggacaagaaagaaactaacctaaagataaaaggaaaatataaagtccttatcagacactaaacacactttcctaaagataaaaggaaactaacaaactattcctaattaatagataaactgtcatgccgcatcctctttaaactcggtcacttagggataagcttcctttagtagattgatttccttaaccgaatatagcaggaatccgactattggcgacttgataactcccatcggcgagatgctgcagccgataatgattctaacccgatgacgtcgttgccgattaccaaatttcactgttaacaaaatcacaacaaagataaaattactagtttaaagtgaaaatatggtataaatgtggttcaaaataaaaaacttgaaaaatataagtggtccagactataatttattcactaattaatttataatgttatatagtctagaccatcacaatatactgcgaacatatttctttttctaaagttaacatgataaattataggtcatcgatgcaaacgtgttgattctttttttttagttggccccttttcagaacataaactttataatgcaatacatggttttcgtatcagctccctttcatgaggatactggtctatatatgttaaactaacctttagctacaaaagtaacgtgtacctttttttactggtatcaactttagaagataaataatgaagcaatcgattaaaatacaagaaggcatgcatgcacgccttgcatgcttactgtaaaaccacggctaactgtggttttgatggcaaaacttcgaatatatgattggtgataacagcaagtttagtactagtatatacgtttctctttaaaaaagtatacttttgtaaaaaaagaaaaattgaaagtatatcttccaatatgagtatggacttctcttgtcgactcatgctatagatgctaatgttggatcttcatggtgggcatgtaagagtatgctacacaaaaacccacggtgaatttaacaatgtgcactatcaacaatcgtatttgtttttttcctgcttgtataggtcgaatttagatttgtagagtgatatatatcatatatctatcaattttttttcaatttttatggcgttttcgtgacatgtaaaaacaagggggcatcctctttgaaaaaatagcttattcacactacaaatatttcgaccaaactatcataaaactacatatttaaagtgttgtattataaaactatacattaagtagctaaattatcataaaactataaatttagtaccaagttaaccacaaaactacgccatttatagctccaacataaatgtagtgttatggatttaaactctaataaaggttataattttttgatgacttcttcgatattaaatctatacttttatgatactcaacattaaatttgtagttttattataaatttggtactaaatctatagttttgtgataaaataccttaaatttgtaattttacgatcgtttagttaaaatggttgtagttatgtaatcccttcatccaaaagtctaagggtgtatttggttggggtgagtttttatgagagattagaagtttaaaaggatgaggttattaactattctatttggttgagagacaaatgagttttcgtgggatgggatggggaattgagggaagatctccctcctttttaatatttgggtaggggctagtaattgataggaaatttctcctttacgttgcctaaataaatcttagccatccattttcatttaaaatctagtcaccaactaaactccttgtcaattcccaccacctctatcaaaaataaaattgtgactaaaaatcaaattcacatgttaatctcaccatcaattccctcatctaaacttccaatcatttttcctcaagttgccaaaccagccataagacatatttttcttttgtcactaaaaactaaatagaaattaactcatacaccatgtgacaaaacgaaagaaattatacgcatgcaaccaatgactattaagatagcttttcaggtattggtcgataatttagtttagcacatagaaactacaaatatgtttatctcatttaaaaaaccagaaaataaaatatatcttaaactttttgatggagggagtacattttacttcaaataaatgatttcccacacaaagctatgtacactatacaaccctgattaattggcctcaatattactactacatcaataactaaaattagcatgcaaatcaaacatgcaccagcacaagactgtatacatatcctcttttattctccttttgttgccactttcgctattcacaaacagctatctagggtctatcaagctctgcaggccccccgagaaaaaagggcaaaccaacaggggagaaaaatcccggccgttgtgcacccgaacagccaaacgccacccgacccacgaacatggccacggtcgcgtcaccaccaagccatctcacctgtccggtggccaccccgcatacgtgccctattgcgcttggcatctggcgcggcatcatccattgtaatcctcctccccccaccaccaccacggtctacgagaacgggcctgtttagtgagcttaagattttgagaaacaactgctgagaaactagctggtgaaaatctgaagaaactgaaaaacttagcttctggcttctagtttattttccagattctacaagcacatattctcataatctaggtaaaaaaaactatactgtttgggagagcttctggtaactggagattctagaagaagctgcagctgctagaagctctctaaacagacccaacgtctgctccccccgtccgcgaaacgcccgatgggtgtaccgaacggttgcgtgattccaccacgcctcgcctcgcctcgccgcaactcaacgcaacgccgcagccgcccccacgcgagcgagcgacgtagtactacgtaacgtgatcgcgcgctcgcgcgcggagacgataaggcggaggcgatggcacggcaccacggtggggatggtggatgatggatgggtggatggacgcgggatcgcgcgtgtggccgtcgcgagcgcgagccccctctctccgttggcaagctgacagcgaggtataggtggtggtggtggtggtgcgcgctccgctcccggggcgggcgccacacggtgtttcgcctttgctcccgcccggctcccgttgtcgttgataggaacgggagtgcacgcgcgatcgatcgatcgatcccctcctgtgcggtgcggaagccgtacggggctcaaccgctcaagacgcgtcgatcggtggacgtggaggcacccatcattcgatttcgcccgtgcatgccggccccgcagcctcttgccacgttggctttgtcggtacaacgacgaaaggctcaactaaattcttcgaagaaaaaaaaaggagaaaaagctaaactaacaaaggaggaggatggcgatggcattgcgagcagatatccgctgtacgttggtgatcgatagtacgatgctcgatcgactttttatcagtgctcacaagatagtgtataataataatttcgtaaaggaaaagtgcacaaaatggagctttgcgagtttgtcacgaggtgacggagtacacctgctttggtacttgtttggctcgctcgatcaccacacatgaaaaaaaaaaagtgacctaccatggtaagtgggaagggcctgcaatcaacttcgtccccttcagatagctaccctttagagtaaccaatcaggacgtacatgatatcctagctagaaactccagttcattttagtagttattgttaattatcctacaactaacaaagcgaggagagatcaagacacacttggattagcacaactggcgtgattaactccaggggacagcaataagatcgatacgctcatgattaggcgccaagcgcacaaagcaaagtgccgtacgagtaaagcagcaaactccatgcaaaacacaaagccggcagaaagtgccgggccattcgaggatggccggggtcaagaggtcaacaagaaaatctcgagctagcgcgtgggcatctatgatctatctccatcctcttcttttctcttctcttcctctcctgcgtgctatactagcttgcaagcgaaagaaagctaagctaccggcttcgatcgatctccacttccccccggtgcagggcacggctcccgtcccatccatcatctcgaaccgcacaacaacaacaacaacaactagattgcaatgatcgcaatgtcgtggtcaccgagaccctgcaggatcatcagaacgatcgaagcagatcgatcgatcgatcgatcaatcgaacaaccgcatgcagcagcagggcaccgaataatccgcgctttggaggtgaaagcaacgtggggtatcggagcccagccacacgccgagcccgagccactcgcggatcgaatcgctctccctcgccgccctgctcctggcacgtacatcgtcgagggagatagcacatgtacaggagcaaatattcctcctcctccttccggttctttttccaaaagcaacaattcgctggatgattggtcagcaatcagcactgttcattggtccaagctagtagctgccgacccaagctgcctgaatgagggtactggccttttgttgcgcttttgacccagtgctggtagggaacgacgagacgcaacgtagggccgtacaggcaaatatgcaatgcaagagaggagaagagaggctcccgtgagacgggcggctcgaaatctccccggcgaaaagggacagaaaaacaggagtcgacgcgaccgtctagaagcagagaagcctggagatatcagtgcgtgtgtgtgtgcgtgcgattttcctgcaaaagacggcgcctcgcgcggctgcaacaacaggattcggtcgatcggttggagatgcggcggtggtggcttttcgaagggtcggtcaagttggagttggggggtcgcatcgcgtgcgccgcgcaccacaccgacatggcctgtcacagtactaccaccgtatcacggatgctcattcgtcccgatcgatatttttgctggtcggctcggcttcgtgccgtatactgtcgtgtcgtggccggatggctgcaagcctgcaacgagtcgtcgttgccttcgctagctgacattgtggctctgtttattgcctgctagtatatctcgcggcggtttttcacgcccctgcacgggtactgatctgtacagcaaggctgaacagagtagagaaattaacgtgaagcctatcaataaaatgttggttagtcctcaccctcctacgactacgagccagatgattccaacctactccctcagtccaaaaacaaacacaattctagatttgaacctggttcaaatttagaattaggttttttttaaggacggaggaagtagttcttttctgtcgactctgtaaatagctttatttatttgttcatatttgtgtaatcagcaagcatattactcagtgctacttttttactagtttcacaatgattattatctagtagttatcagggtatgaataagacatacctcagtatccttggggttgtgcagtgtacagatatgatataccctcgaatatacgggaaagttatcttagtcctaaggaattcagcagatatataagaaaactgtctttccaaatataaggtgttatagt

SEQ ID NO: 42545 - DNA, 840 bp, Oryza sativa
tcaagtcaggctaactgcttgaatgatccaacagcgtgccagactggctgggatctggtccctttttttcctttttggactgccaggccggtctggttctgataagtgtggtttacattatgtattttttgcgaacagatacataaaaccatacatttctcaatgtatgcgaacatccataatatccatttttgaagagaaattggaaaacgccatcgtaaagatatgcaaatagcaaaataccatcacatgtgagaatgacacatagggcatgggcctatatatattattgccacatatgataatattttccaactctctgatttttgtgatggtgccaagtatttgaccctttgtcaaaaaacattgcaggaagcataatatgcttttaatcataatttcacccttaattgacttatgccatatccacagacttcaaaaaaaggctgctaagaacaatgtaataagtaatactgagaacccaggctttaaagtttagttcacaatataattacaaaattatgtattttaagacactaagtacatgtgagttgacatattaagtcttagctgtgaagatggagtaagcagtgaattatatattaaactattgttcatatataatattttgtaggatagaagcattctatgatttgaattatctttgatattttctgtcagttttggtggcacttaaaactagcatcacatttttttaagtcctttaactagttatccatgtggttttcaggaacatgccgaacaccttttcatcctatatgtgcacgagagtccaagcatcaaatggagatatggggaaaatttgggtatcctaatgtg

SEQ ID NO: 42546 - DNA, 4644 bp, Oryza sativa
tgaagacctgtgctcagcctgcaaaggaaggtagaatgtaacaacttgatagtagaagtagaaaaaacagagactctgagcaacatgttacttacaatgtggtaatggttccattaacaaaacctccgtagctacaagaagaaacattgcagcctgcactggtggaacgagcgcttacattacctagcagaacattgctgttactgcactgcatgcttggacatgaccctgtcaatgaagctggtgtgcaatataaactgagacagaagagaagacagacattacgacccaaataatggttccatataatatcgtgttaaacagaaaaggtacaatctgaaaattacttgagattccctggcccgcaactacactgcacacagtttccagcagtaagtgcataagtcccatttgccacaattagtccatggtctgaagcagatttgggaaatgcagatgtacatgctaagatacagaaacaagcaacaattgtcactggaagaactagggagaaaatgctgatatttagaaaagataaatgatgcagcccaactgttgtcacagaaggcagaacagaagaattagcaatcaacaaaagatagagtccataaacgcagaggctcatcataatatgatgcttatgttttcttacaggatacacaatctgaaactcactgaatgaatagaaaggaaaactgaacagttcgtgcataactctccaatagtatcttcctaattcctattgaagagtaatcgattgcctaaacaaagttctatttatctgactccgatgttagcgaattgaaacatcgcatatactccttccgtttcataatataagactttctagcattggccacattcatatagatgttaatgaatctagacacacatatatgtttaaattgataaacatctatatgaatgtgtgtaatgctaaaaagacttatattatgaaacggaggaagtaccaaacatcaaactgcagctagtaattgggctactgtaatgacgacagattcataatttcaaatgttcagttcggaccaacatgaggaagactaaaatcgagcaagatggtgaagcccgacattaaactgatgtgattttctttactgtactaatcaattaaaccctagaatataagcagcctatgaagcaatcaaatattaaagctaaggcaccaatgcaatgtccactagcatgcatactgtttatatccccaatgatgcattgtctgattattatttattcagaacaaaaacatactgacgaaccaatttgcctgcagaaaatatgctcgtttgcaaagttttagctcaaaacagttagctcaatgcaataaaccatacggctcatctgcgatatcgtttgcaaagtttgagatgaacatgtacctggcaatgggatggcgagaatgtcgcccggcgcggcgatcgggcttcccatggcgttcacattcatgacatccgtgacggtggtctcgtagctggcggcgatggcgggcacggtgtccccgacctgcacgacgtaggagaggtacacggcgggcaggttgttgtcggaggagttgaagcagacgcagggcagcgggacgacgagcttctggccggggtcaagcggcgcgtcggggtccgcggatgcgacggcgttggcgttgcggatctggtcggcgaaggcgagccccgcgaagacgccgtcggcgacccccccggtcggcgacggtggcgagcgtgtctgcggggcgcgcggcgtagcgcacggagaccgacttgcggacgccgtcggtgcaggagcagcgggtggggacgcggacgaagaggcccatcgggaggatgcggtgcgccgcccccggcgccccaaagtccagcgcgttggcggccagcagcgccgccgggtccgtgccgaacagcgcggccacctccgacaccttcatgtcggcgtagagcgtgtagcccagcagcgccgagcacgagtccgaccccgtgcacggctcgatcgtcgtcttcgcctccacgccgcccggcaacgacgacaccatcacaaccacgaccatcgccgccgccgccgcgacggagccacacacccccgccattccactccactccactccacactccaccaacttcaactgtgcagtgcgtgactctgcggaagcgctggtatacaagctgagaggaggagggtgggggggatggcccaccggtcagcggcggaaagggaggagcgagtcggttgctgggtgagtaatggcgggaggacgctggaggcgtccgcttttggcagcgatgggggaatctgtgccaagcgaggggaggagggaaaggtatcatcagagcaggtacaatagcataatataagtcagctgcaaatatattttaaaaagataaataaggagagaaaagagcagcggtctacagatttatagctagctgtagcacggactccaagacgcagtatgtgtatgacaggtgggaccatatattaatagtgtagtatataactattgtatggatgagttattagattggctatagatgaattggagctagtagtgagttaaactattaaacttgctctcagagacaccatatctttgcctctgccacgcgttggtttcgaggctgagtcactgcctggtgggtccgaggataccatggagcccacatgtcatggagtggttttggttaaccgcgaggttgacggggtgcggtgcgtctttgcctttcgaaaagagggcgaaccggcgcaacggtcgacgtgagctgaactgggccgcgtggcagagaacggacgggacggcctcgcctgccgtgcgggctgtgacccggtcacgatctcttggcgcttgcggccttgcgggctgtcgctgacttggtggcagagtcgcgaactgtgtttcggattgggctgcaatgagtcaggcagcggtgtggcccaagggacggtgtggcatagcccatgaacagacgacctcacaagttgggccaggtagaactctccaccggcctgttacgtgtgcggcagcgaagtaggatggcccttttatatgttgagggacaggaaaaagtacaaccgaaggtccgtcaacttgtcatcgaattacaaaattgtcattcaaccataaaatatataacatctctcaatttaaaaaaccgttcactttagatccttcggtagttttgacatcaattttatctgacatggctactaagtcaatatctttcccctcttctacactgtgaaactgtgtaatattggttgctaaagagagaagaagaagaagaagcagacatgcagaattctactagtaccattgaaaaatgtacgtacgtcgacgtcgtcgctgtactgaccgatctacgagtacgagcagctagcagagggtgtttgactcgtagcctttccggcagtgcatgcatgttaccggccgggggcaggcgtggctctggtgcatggatgggagcacgaaccatatgatactcgtagctagtactcctccgatccaagttccggcgcctgtggcgcgcgacaagaccagacgaaggcaggagggatgcgatgatcgacgcgaccacatattataacgttctctccgtattcgcaaacagttgaccggtgttataatattccacgggaggattcatacgtttgccgtttgcgtaaactcaagagatgccagattgcctgtccacgatattggattggatgtttctcagtactgcactctgcctctctctctctctctctggcttccatctcgacgaataacttaaagatatcaatagtactccagtactatctttgattattaccgtcgatgtaaaattagtccgggtcagatagctgcagcatgcatgcatgtaatggccggccaattagcacactgttactccggcctgaaagagggttcagagacagtttgggtggacaaacgataaggctgtgtttagttcaacgcaaagtttagattttggttgaaattagagatgatgtgactgaaaagttgtatgtgtatatatgacatgttaatgtgatggaaaaggaatgaagtttggactttggatctaaacacagcctaagctggctagcaagcatgtatgcatgggatggggcacacatgggtgcgaggcgagcgtcccatcggagaggcagcatcctgatcaaatcacgccgactggtctgcgtgccttacgggacgggccactgtgcctgatgctacgttgtttttggatcgcctgctcgtgaatactcctttcttaagcagtagtccacttttctcgtcaatggctgtgtttagttccttctaaaattaaaagtttgggttgaaattggtacgatgtgactgaaaagttgtatgtgtatgacaggttgatgtgatggaaaaattaaagttggaagtttggattgaaagtttggatctaaacacagccaatatattgtttgtgatagtgtgatccccactgcttaattccaagtcattccttatttgctggttgatgatggtgaaccatatatatgcatgcatcgagaaatatattcacctttcaagggccatgtacatgctggatgttgattcgatggcttaaattaaattcatcagattaatttgaattgtaaaatttgtcaaagcagctattttgt

SEQ ID NO: 42547 - DNA, 2924 bp, Oryza sativa
gccagcaaacgcccccgcgagctcgtccgcaccctcggccgcttgccctccgccaacaccgccatggtcgccaccaccacatcctcaggtacaccaccaattctcacccccacactgtcaataatggtgacactgacgctgacaccgccatggttgtgtgcaggcgagggagacgggaggttcccgccggagctgagcgtggaggcggtgttccggtgcgtgcggatcggggcggtggacgaggcggacgcggagctggcgtaccagacggcggtgagcatcggcgggcacacgttcaaggggatcctccgggaccacgggccggcggacgaggcggcggggcagctgccgccgtcgtcggcggagtaccaccagctgacgggtcaggggagggaggaatcgtcgccggcggggagcagcgagggcgtcggcggcggccacggggcggcgactgcggcgacgtccgcggcggtgctcatggacccctacccgacgcccatcggcgccttcgctgcaggcacccagttcttccctcataaccctagaacctagcaacctagctacctatcatcatctacttccttccatgatcaaatcatcatcaatttgctagtttcatttgcatcatcgtctcaacaaaacaagatcaatcgaacaacaagaagaacaagaagaagaagatgatgatgatgagattaagagattatttgttatttcagccgatgaacactaatgcacggtcgatcgagagcatgtcattagctagagcttagctagtactactgcttgtcgtcgatgagcttattaatttcgagtttattaattaatgacttaatttaatgcaatgcaaagagagagagagaggaaaaaaaaagaaccaagtgtagcttcaatgatgatatcgaacttgttctaattaattaatttgcttttcccccttgattaaaatcccttcttttccccagttgattttggcatgtgatgagttgattaattactactgcatgcttaaaatttcttgagtaattaattaagtactccagcttagcttaacttagctagtactagtacgtgtacgtatgtgttgtgtgtgtgtgcatgggagaagctttctctggctttggcatgggtaaagctggcccttcacctgatggtgtttttttatatgatttgttgcatgttttaacccggtagtacctgcggttgtttttctttctttttcttctaccagtagtttgcttctttttaagcagctattctgtacattcagctgctgcctcatgccttgggatggatgagcaatcagcttctcctaccttagcttctttctcttcttcctgatccagatcaagggaaagtacataaattccatgcatttttttttgctgggattgatgtaggttttttttttctctttggctaatctactcgacaatgctgctactgccttgtgctatgcatcatctttggactctctttcatctctctctcatggtcatggcctagctattggtctctctctctctcctctctctagggtacatagtgaccttgtcacaccactgttccttcttttcctaggctactgtttttaatattcttatgttgaagtgacgtagagccatgttgcaatccttcaaaaaaaattaaaaaaaaacaaatgtaaaataatgcattataccaaccaatacaagtcacatggaatgatggaatgtcaacaatgtgtatggttggtttttactaacaaattaatcttacctagttagccctaagcaaccattagtctctctctacattgtctgaactgaatctatacaagctctgctaattaatgctaggagtatgcatgtttcgtcttcattctcatctctctgttcttcgatctgtacgtatctactagctagctagcactgtcttcttacaagagtacaatttttatttaataaaaaatatatgaaaggataaaagaacagttactggtatgatctcttgtccttcagtacagcaactatgcaaatttgcttcactcccggccggcctatacgtagagtgtagagtggtacagtagtgatgtatagtactgtccatatgctgcatctagctgtagcctcatctctactttgtttcttttactccatctgaacacttattctctttttattatggagaaaatcatcactgaacttttcatatgggggtgtcgtagtagctcaagtacacaatatagctactagctagcttgctaggagattgtaatgcagtgcataattcacagttgttcagcatatgtttggattaacgatgtacatacacatcaagtgcatttctgcgtttcaaattgtccatcattatctgtttgcatttgcactgaaacactttggtattgtgttgctagttattcatactattgcccacatgattaattagtatatatatatacgatatgttctacattgtgaggggcttttcaggagttcagattaagatttaatttgcgtaacttcattaaatgtgcttggagtgtcacaactctgttgcaagatacacattaactctatatatcgataaaaaaaagaattatacatatcgatcaaagagaggtatattgtgcgtcgctaaactacatgcatgtgcatatatataatactgtaagaaatgcaacacatttcccaaaataatcaaagatgaagttattttggaatagatggagtagcatatatataactgaagaacatatatatatgcacgtaccttcgatctgggtctgtttctgatcactgatttgagttctattatagtacaattcgtagcattttagtatactaatgaattctaagctagctatatatatgatataatttcatctaatattttaattatatgcatatatatgtattgatcttgttgttagtcatggttcaatt

SEQ ID NO: 42548 - DNA, 5768 bp, Oryza sativa
tggatcgattggtggcaatgggcatgcatgcacggggctcaagtagatgcagacacacgggagcttccaagagatgtgcacatgcatgtcgcatatatgcagggttcttcagctagctgtacatcagtggctgcaagctgctatagctgctgctgcacttgcatactactacagctgctacacctaagcactagcagagcgaggcatatgcggcgagtcagtctgctgcatactacaactctgatttctgatcgatctacctatatgtccttcttatattcagctcgaattattagtgtactgtacttcatatctttcataattgacgaactcgatcgatcgatcgagatcgaccgatccatcgtccatcgttcatctctgcaatagtctctgcaaagccgcatgcatgacctagctagctagcaggttaattagctaggtttggtacatttgtgctatgcatggtcctcctcctcctccatctgacagtgtacgtgaatgttgccagatcacaacacaagatccaattcagagttagaatccggacagtactgcacatatacgaaacatatcccgtcttccatgcgtgatcgatccattgattttgatcgtaaatttgaagttagttagtactcgtaaacgtgaaggcaaaggtattcaactaattagcaaaatggcttaattaagcatcacatcgatcgtatctatctctctcctttgctaattactgatatatcacgcgaagtgcacgaaaggaacgggagtgatctaaatgctgacaaaatcatggcattgcatcgacagtgtgatcatgatgtcagtgtatattatgcgtgtaattacttgattaattaattgcttgattgatttaatattccttgatgcttctttcgttttgtcggctagcttgtccctttctctttttagcgcaaattacggcctcttgctttgctagctgtttgcatttgtgagaagttctgtaattaatattgctcttactaattatgtactacgcgacactgccattaattcttcaaatgttcataccgagtatgattaattagactggattttatcccttatagaccgtatcctacgcacaatgcaaacagattaattattactcctaaattacatgaatggatcatgtgtagaggcttaacacagtaaacgaattgtcgcatctattcgaagagcattgagcgtgcattagtagtgcaatgatatgtaggtaatggtatctagctaggctttgaaagaaccatcaaaagataattataaattattagtaagagacactaaaccttccaaatccaaccatctattcgtccctaattaacctatacctacctacctagcttctagactctaattactgttgtaagatttcattcaccacacaaaatcttgtgcatgaatcatgatagcgacgaattctaattataattatatatcccagctaatacagtgcttaatctgcaaggaagatgcatgcacacgtcttactgaaatttggtgatagatgatgcatgtcatctatctcgtcgtcttctctgaacaataatccaactgctcctctcctcctttttttttcacgaagaaattattaacagtctgaagattttgcgtggttgatcaaccggacagtagtgtgttcagtttcgtcagacacactaaggggatgtttggatcctgccagattggatgtttgacactaattaaaagtattaaatatagactaatgtcaaaacctattccataacgcgttcgcgaaaaaaacctattccataactctagactaattcaagagacgaatctatttagcctaaataatccatgattagtatatgtgatgctacattaaacatgtgctagttataaattaattaagcttaaaaaaattatctcgcaaatttatgcaattagttttattagtagtctatgtttaatacttctaattagtgtcaaacatccgatgtgacatttagtccatgtatccaaacatcacctgagaaatcaagatgatgttaatttcaatcatctcatgatctcgagagagatatgatcgaatcgatggatggtatggatcaaggtgtccctgtcccaatgatcgattcatatatatattattacggttgcttctgatgatcatatgttgactatatgggctagtaaagatagcatccgaccaacttcaatggttgccaattcgtaacgacaagcttaggttgatccatagccatggtaggctcctgtgcaatgcaagagatgagcaagcaactttgtcccccagacatctgggccctaccaccaatatatacatatcagtcacattgacctatagctgcaaaaagaaactgaatatttattatatgtgttcacagtactctcatgagctaaccatatgcaactgctaaaacttaggtatttaataatacatatataatctgaagtagttaattactgccaatttgactgaaagaaaattagtaaagtggagagccccatacaagaagaagattagtgcgagatcaagtgattaacacttttaatttaaagggctttttttttattatcttggagaggcccaagcacctttgacgaggcccttttagctgaaagtccggtgcgtctgattgagcccagagcccagtcttagtctcagctggtgccggccgcctttaaatctttattatttaattaatcaccttgtgatgatgatgatcaccatgatgattatgattccttaatacgaccccatgattagcaatgccatatgcttagcacatgaacttgaaaagtaggcggccaaaagccgctgttaatttgtctcttctactttgcatttcttaatttccatgttgaacaggcgactgaaagtacgtacagaaaatttaataccttaatttagtcgaggataacattgttaattacagcaattatctccttggctgtgtagtgcactaacctgcggtgattacatttttaaacgaatatacattgaaaatgtgaaattttcgtgtaaattcaaggtgatgtttatatagaattttcgtccaaattctggtgatgcttatagctttccgtggtactgaaatcgaaaaaagaaatgcagtagctagcatggacgctgtccagcgattattaatgggccagagttaagcccaaataaggcccacacatggtttcaccgtggtatgggcccacgtgcaacgaaggaggcggagcgggccaccttggttgcgcgacaaatcggcccacggaagttaactctatcgggatgagcgggctttcacccagagtgggctactgagcagtaattgttgggctgtccagcccaaacaacagccaacaacggcgatctcctcgccctcaccggcgccggcgagggcgagcttgctgattggccacggaggtaatcttttttttttcctcaaaatcgcaaaagaattgtgcgccatttcattaagaagagaacataggaggtaaaaacctccccaaagagccaaagaaaaaacacacaaataaagagaaaaaaacaacaaaacacaccaagatgacacaagaccaacaacaaaatcccaacaaaacggactaagcgatataccacaggtgtaaataattactcggacagcagcagccagtagcccattaatgtatttgagctgtatacataataattaatcctttgagctaggtaactctctgatcagtagcttgatagtcaaagctaataaagcaagcgtggcaaataagtgtgaaattatccaagcacagttgcacaccacgcatacataatacaacatcatcagtaactggtacaaaatgtcaagagacaacacacggtttaaccgctggatcatagccacatcaagtggtttggtaaatgaaatgaagttcttgcgttgatcgataataatgcatgcgcatgcaggtaagtaacacgagcactgcaatttattcgtcggcttgttatctagatcgagcgatgatacggtgtccggcggccggccggccggcgacgagcaggccgccggcggcggcggcggcggcggcgatgatatatcaaccgaggcgcaggtcgtggttgccgccgtaggccatgccgtgcaggttgggctggctgggcaccacgcggaaggcgaacatgtccgccgccgcgccggcgccggcgccgccgtcccacccgccgccggtgttgtccacgaacccgaacgccggctcctcgcgcaacccctgaattaattcaaacattcatccaacagtagagttcaatcaaattagctagcctgcattggagaaactaattaacaaataattttctggctataactgaaaaaaaaatgcttgataggttaccagctcctgctgcagagtctcgtacgcctcgtaggagtgcttcacctgcattatatgcatgcacacaccggatcaattaatgtagaaaccaatctctattagctatagacagacaaattatatcatgtgcatgcatgtatagacacagggtccagcatatgtgtgcaagtaaaagtagagtgtcactgcaatgtgtatatatacatgtttgcatcttcggacagcatgctatagcacacaagaaacaatcgtcaagtttatttctatgaacagtcactcacataaaatttaagcaagttatcctctcccatatcacaatgacaaagatatatatacagattcaaagtcatcttctagctagctccatatcaaagtgcagttctttgttcagagtttatacactactctctgtcagctctctcacgtaacaagaccaaaggagtagctaatgcagcgaaattaaacacttgaaggtgattgtgaatttgtgatgtgctagcttatactatatgccaacatgcatgcttgaactggttaattttcacctcagccgacaacacagttagatatgcatgaatggttaacaatcccctcgatgcaatgaattacttattcagctacatatatatatatatatatatatatatatatatatatatatatatatatgtttaattctgaccagctaaccgcaggtaaaactacaaaacaatgaacaaagagtactccctattaaagtcgattgaatgtaaagtcaaaagtattcgcttttgctcggttgttcaagctgagtaattaattagtagtacaccccactaaagattcagtaagccagcggccgtaatggtttggtttccaaattcttgcaaatcataaagcctcaatgccgtcccttatctaccaaaaggtatcacgccgcgatgcaatctctcataaaaatccgtgtttgacatgctactctcctaaatagccgggggaccaaaataagcatgcatgcttcatcgtctctaggtacagctagtttatatagctaccgatcctggcttagttgtttgcttaacaggagatacatatacgcatatatatgcagatacatgcccaattcatactactgtcctttgctgtttgtcatgagttctagcttgcaaaaaagacagagaaaactgcatcgcagatcgcattatattgcgtgcgttgttcatcatgtaatgtataggaatgcacatgacaatgcatgctccaattaacatcgatgtacatctactgatggctatgtgtatagcttagactagatgtgtagatcaggtagcctcgatcaaatatattgatgtgtagatagtatggaaatgcacagacacgcatggtaatgcacactgtacattagcgatgcatgtttcggttgagaggcg

SEQ ID NO: 42549 - DNA, 1418 bp, Oryza sativa
tgcaagtgcgaacttattggccaaactaagcaaatttaagcagtgatggtggccacaaaagtgaagcaattaaagtaaggaattggggaagataaatatacacttatataggcttgtgcagatatctagatatacccttattactgcaccagaagaacatacatatatatactaatattgctgcattattaggcataatattggcagtattttttttaagataatggattgattaaatccggcctatatatccacaagagatgcacacatagtcaacagcttccaagggaaggaataaaatccacagtagatgtacacctatagccaacagtttcaagaggaaggaataaaattgtggtatatatatatatatatatatatatataaatttaaccagaaacaaatactgagaaaatgggcatggcttattcctgacctttttcttgtaggtttcagtctgtgtggtgatcacatgatactgcagaaattaaaaccgaattaatcatgagaaaactgaaacaaattaaaaggctaggatacatgaagcagaaagtttaatatgttacagtccaatagatcaatgagcatacatcctactagttgtaagataaaacaatagtacacataaattatgtttctataaagcataaaccttaaaattatcttgtttaatacgagcaagcaaccgaggccaaattaaaaaccatcaatataatttccacacatgcaagaagccaagaagggttcaagaaactcgtagatctgtagcgagaagcatgaaatatgcacggatctgatcatgaaccgtagatctagtgtgcacaaaatacaaggatctaccacccttgaattaaggaattgaacgacgttttagtattgagcaaattagggttcgtagtttaattagggcgtgcgtgcgtgcatgccttcctgtggcgaacctccttgagggcggcatcgacattttgctcaagaccgcgcagctcgtcgaactccagcccgtccagatcttctcccatcctttgcctgcacacacgtatggttgtttatattcagatccagcagtacatatcttgaaaaacgttgtaaatttggatctcttgttcaagctaaaatcccccagtaactatatactaagagggattaattaaggagaagagaggaaagtaattaaaggggtgaaatttgtgctggcctgatctcggtgcgcaggttgcggttgatgtccttgagatggctcagcgtgcgctgcatattctgatggatgaaaacaaaccaaaccaaccaattaacgagcagaaggagttgggacatagaattaaaggaaagaaactggagtgaaaattgagaagacgaatcgagcaaaagatgagaaaacaaatcataaggagagaatcgaagtgagcagcttggttgca

SEQ ID NO: 42550 - DNA, 18457 bp, Oryza sativa
  unsure (1)..(18457): unsure at all n locations
caacctcgcaggttcagaaatggctattctacatgcttgctgtaacagttactgatcgatcgacgtgatgggcgacctgtgaatctgtgatgcctttgctacggaggagaggggatgggcagctcagttccataaatgcaacggcgacgaggacgacacggtcaatcatgcgccattggacacaagtggaaacactcgctgcaactttctagtccaggcaccacttaatgcccacatactatcacttccagcactttgtatgtgacttgtcattgcacaaactacaggggtgagtgacaagagacctgtttccatctaggagtacctccttttcttttattaccagcagcaacgatacttttttttttctcttctctttcgtgtaggtttactccaatactcaatgggcattcatatgcttccattgactaaggtaggagtgcatacatatgtgatccaaaagaatacatattgttggaaattttgggctatatattttggtcaacgatgcttacatgcacaaaggtttctagcttgcattccttgattcatgccaagtatcatagcaattactacatcaagtaaaaaattctccagaaaagaaaaattccaatacatatagagaactttttacaatccttgaggggagacatagaccaaatcgtggccgtctattgagcatcatcaaatggctgagaatcatttcgtatctagtagcgtcggtgcctatcccaccgggtaccaagcctntcgacaccctataaaggttatgattaattttcttttcgcaccacccactccatgttcctccaatgcattcgtccttaacatccttccccgacgtatcgccgctgtcacctagcggccatagcgatgagcttagtgcggtggatgcagcaatggaccggctcgatgaccttttgatctcctccaacccggtactagcaccacagacacgacgaccataggggcgggtgacagaggccagcgtaaatctcttagagatattggatgccatggagaccgagcgaaaactagatagggaagatatatcaagccaaagttatgaccatatataatatcatgacataatagttcaacggttagatttgaatggtaactatactcaataccttaattacctggtggtacctccttaataatggtaaaaatcatcttatatatattgctatattgttacccgaacaactcatgtacaatcttataccaaactacccttgaagaagaaactagctactgccgtgcacaatattaccaagcaactccctaagaaacaacccatcccatagtgcaaaaactttataaaagtagcagtagccaagccacagtgcgccttaatttacactaggcaggagggcactatatgcacacccacctaccgtgcaatgctttcacctgctagccacatacatttcaggtatgacgctgatgtgcctttccaacggttgtacgagattgagacgttacagtacacatcctgcaattacactgtactcctacctgctgatgactttgtgttactgagtatatactttggttcagagatgactctttcaaaatggtttttttccctggtccttgaaagtacttattgagatgtcatcctcatattgtatatgtatttgtatcaaacatcaaagttattcagattccatcaccatcttgtctcatcagaattacatatgcatatacatttcctcaccaatctattgatgtggaggagatataatataagtgaaagagtaaaatataataaaaatattctagttgattagggttagagcattcgttatttaaatcattgcaaggcttaactgttgtatttatccttaaaaactcatcgaagtaatattgttactctgtctcttaaaagactataatttagtgtttagaatttatcccacaaagaaagtttttttagagtggagttttttttatgcaaaaggtggagagtttaccttgtaaccattggtggtcaagagttacaaggccaaatggccgaaacacagcggaaaacagaaaagagtgatatagaacacaaagaaagaaaaggaggcaaaaaaaaaaaaagggaaagaaagcgaaaaaggaaaacatggtgatcatcgtgtgggctaatccatctttatcgcccaacaacagatttgcgcatgaatatttggcttgacaagatgctaccagagctcaacacaatctttgatttgatgaggaggtgtacaatgttcgtatttccctccctgaatgtcatagcatttcgtgctttaatttcaaagattgtgtgagcatgctgcaaagcagagccaagttcactagacttctttgatattattttaatattatttaaaagttttcttctcattttagccgctgaaccagtgtgcatatccctcttattttatctccgcattttataaagagctagattactagtattttaactttgtgcttaatctatcttcgacgagctagaatgataatagttctttaaggatggagggagttgtaataaatttgttagcacaatataatactctcgattataagtcgtttttactctggacaaagtcaaactgctttaaatttgactaagtttgtagaaaaatagtaatattttcaggacaagcctaccgctcgggcgaccgatttacgtgcaaaactactctaaactgatttttctcctaaattaattatccaaatcatgatccgattgcaccattaaattcgttgcaattaaatcttcaaaacaagaccacacattgatatattccgacaaaaaaaattagcttattattgaattatttttaaatgttgcacgatgttccaccaggcatatcgggaatgtttcactaagtagatcgaaaatgtttcactcgtttaaatcgggtgttgtttcaccttatataaaaacaatgtttcagcaaatagcgaaagaatgtttcagttccctgcaacattagatctatatatagtgaaacattgtgagtacactatgcgaaacatttttggtggaacaaaaaataaactaaattcccttaatagagagtttccaaaatatgttgattttttgttgcaaaagaatattttaattcactgcaacattagatctataaatagtgaaacattgtaagtatactaagtgaaacatcttttgtggaaaaaagggagagagaagtaggtgggtccagcatatacggacgtgggggaggggcggtcgctcggagtagagtattatcgatattttcaactcaagacaaatatattatggaaatatattgaactatagatttaataaaactaacttggtgttataaacattattatatttatccacaaatttaattaaatttgaagtagtttaactttgaccaaagttaaaattaacgacttttaatttgaaacggattgagtagctagttaaacaaaaggaaatagtgaagagaagacgaaatggttgagaaaattagagaggaatgtcaaggagagacgacgacgcttctcctttgtccccccgattctcaagcaccccatgcaacgcaacccgccggcgagttgaggccccacgaccaccggccaggcgtggccccacatgtcatcctcacacccggacgcgcccccgcctcgccgggatcaccccacgctcccgggagctctgcgcatggcgcgccacgtcacccaccaacacaaagcctaaacccgcgccctcccgcactttactcgtccttgtccgatcaatggcggggcttggccggagctcgcgcggcgcctccgggaagcgcggcgccgcgtcctcctcctcctcctcgtcggtgtcctcctcctccgccgccgcctccgcgtgcgtctactacgccaccacggccgtgctcgtcacgctctgcgtcgccggcgcctacttcctcacgtccgcctcgtcggcgtcgcttgcgggctctgtcgtcgatggcgacggcggcggcggcggcggcggcggcggcaccgtcacgacgacgtaccggcacaccacgcgctcgtcgttcgcgtacgaggtcagtaggcccgagaggaaggcgcccccggcgccgccgcgcgatgtcgagcgggtcgatgacgcggcggcggcgcgggggagaatcgctgacgaggagggcgccgaggaggagcacggcgatggcgacgacgacccgcgtgggaagcccgatcttgatgaccatggcgccgacgaggaggagaccaagagcgccgtcgcggccatggacgacgcccagcgacgcgaggaggatggcagcgtgtcatccagcgaggccaacgccgaagaggaggaggcggcggcgacgactggagcgcgccgcgtccgcgtcggggaggacgaggaagaagccgcgcgagaagagagccaagagctgcacctgcagatgccgctaggagagtctcgccctcgcgccgccgccgccgtggaggagaagagcttggacggcggcgtcgaggaggagagcaacgccgggcagcggcagcgcgaggaggagcagatcgatcatggcgtcgacggcggcgcgagcttgcgccgtgaagcgcaggaggaagggcagatcggtgaagggtacgtgatggcggatcacggcgaaggcgaggagatgctgctcgagcagcagcagcagcaaccggaggaggagcgtggcggcgatgcagaggcggcgcgcacgtcggagtccgacgccggcggcgaggtcgacccggaggacaagccaaccgtgtcagagcggacggaggagatggtcgacacgctccccggcgaggaagaccgcgcggaggtgtccgccaccggcgtcgacgagcagaacgcgtgggcgacgcaagccgatcactcccaccaggagaaagaccggcgcgacgaggcggctggcgtcgacgacaacatcgccgacgccaccgccggcggcggcggcggcggcgaggagccggagtggcggctgtgcaacgtgaaggccgggccggactacatcccatgcctggacaacgacaaggccatcaagaagctgcggccggagaactaccggcggtacgagcaccgcgagcggcattgccccgacgagggcccgacgtgcctcgtccccctccccgccggctaccgccgccccatcgagtggcccaagagccgagacagggtatgcacgccacctgttcgatcgccatccattgcttaattacacattttgctgctgcttcgtgtcatgtcaatggcggcggcgtgcaggtttggtacagcaatgtgccgcacacgaagctggtggaggtgaaggggcaccagaactgggtgaaggtgagcgggcagtatctgacgttccccggcggcgggacgcagttcatccatggcgcgctgcactacatcgacttcctgcagcagtcggcgcgggggatcgcttgggggaagcggacgcgggtggtgctcgacgtcggctgcggcgtggcgagcttcggcggctacctgttcgaccgcgacgtggtggccatgtcgttcgcgcccaaggacgagcacgaggcgcaggtgcagatggcgctggagcgcggcatcccggccatctccgccgtcatggggtccaagcgcctccccttccccagcaaggtgttcgacctcgtccactgcgcgcggtgccgcgtcccgtggcacgccgacggcggcgccctcctcctcgagctcaaccgcgtcctccgacccggcggcttcttcgtctggtcggcgacgcccgtgtaccagaagctcaccgaggacgtccagatctggaaggccatgaccgcgctcaccaagtccatgtgctgggagctcgtcgccatcaagaaggaccgcctcaacggcatcggcgccgccttctaccgcaagccgacctccaacgagtgctacgagacgcggcggcggcagcagcctccgatgtgcagcgacgacgacgacgccgacgtcgcgtggtacatccgcctcaacgcctgcatgcaccgcgtccccgtcgccccgtccgaccgcggcgtcgcgtggccggcggagtggccgcggcggctgcgcgcgccgccgcactggctcaacgcctcccgcgccggcgtgtacggcaagccggcgccggaggacttcgccgtggactacgaccactggcgccgcgtcgtcgacaggtcgtacctcaacggcctcggcatcgactggtccagggtcaggaacgtcatggacatgagagccacctacggagggtaggtcacaccatcgccattgctgactttggtcaaactgttttatatttgactaaatttatagaaaaaaatattttcaatctaaaataaatttattataaaaatatatttaattattgatttaataaaactaacttaatattataaatattactatatttgactataaacttacttagaatagtttaattttaaccaaagttaaaacgtcttataacttataacttgaaatataacttgaaaggctcaaacggtggtagtacttaccacgaagaagaagactatgctgacctctccttgtcaggttcgcggcggccatgagagaccacaagatctgggtgatgaacgtcgtcaatgtcgacgcggcggacacgctgccgatcatcttcgagcgagggctgatcgggatgtaccatgactggtgcgagtcattcagcacctacccgaggacatacgacctcctgcacgccgaccgcctcttctccaagatcaaggagaggtcagccgccattgatgctcccttcgatcgatcttctcctatctttgctttcgccttcgccatggccggcgatcgatcgagaaatgttttttggtatctttgtgttcaggtgcgccgtgctgccggtggtggtggaggtggacaggatcgtgaggccggggggcagcatcgtcgtgcgcgacgactccggcgccgtcggcgaggtggagaggctgctgaggtcgctccactgggacgtgcggctcaccttctccaagaacggcgaggcgctgctctacgccgagaagtcggattggcggccggagttgctcgccgacccgttgtgatgatctccagcgaccggcgcgcggcgtggccatctcatctcaggatggcaaagcagcactccccaacacaagattagatagaactcttctcctcttttcttttcttctttttttttgtcttttttttgtctgcttctttgattggtagcacttgacatagttctgtagtggttattatcctacaaacacaaataatgcagccatcagcaacaacaatggtagtatatgcatggttttgtcactgttctagtatagtatgtgtaccttctgagcactaacacaaaagtacagaactgagatgtctgatggcttgggctctgttggtagtttcatcagttttatcccatattcttaatttgtatatttcaaacaattccacgtattagaatttatatgacatgatcaaacgaaactggtgtaaaaatgaacatgattgtagtggcaaccatagacaagatcacagatgacaatttcaagtaaaaatccagaacagaccaaatctgcaccagctcaaccagcaagcagctatcattctcataaaaaatcgaccgtatgcggaacattacaataatgcatgcaagtatagaattagttatacaccagttgttacagataataaggtgatcgtagtagttgctcaaaacatgctaactgagcaacaggtaaaaatgattactcaaaacttcctttcttatcaggaaatgtgatgttgcactacaacaatgatgtttcgatgtatactgatgtaagttaaaaccaagtgctttgttgctaaaatcttggttgataaattggtaagctatatgttgaatgatcaaaattggaaggtgatcatcaggcgttgcttgcagctagcccatttgatgtagtctgtaaagcattattgtttctgtaaagcggtattcctccaccaagatccttcagcctctttaccatatcatgcaaccactcgaaagtgagcttggactgagcattgagttcctccctcacttgaggatgcaccctaaaccagtcccctagcatcttgtgaacatgggatcgaaccattctccatggaacagggtactgctcgcacagtttcaaatactcaatgactagatcagcctggtctaagccactagcttcatcttcatcaccattttctttccattcctttgtccggaaaccagcaaacaatgctggattttctagaagagtttcagctgaaagcacaccatcagcaccagtatgttcaaggcaatccttcacatcatccaaatggcgaatgtttccatttgcaagtacaggtatcctaagagcatctttgacagctttaatggcatcccagtcagctcgaaatttcttcccatccttctcatctctagtccgcccatgcacagctaccagagaagcaccagcttcttcaagcatctttgcgtaggccagtgtgtcctccagtcgcgggaatatgcgaatcttgcatgatactggaacatggaggtttgctgatagattctgtacaagggattttacgagaggaaggttgttcatgagaaacgcaccatagtacccccttctagcaatgcgctgtgggcatctgcaagatttcagagaggtggtatcgccatttagaagagcatccagaacaaaacatggtatgaagtaatgcttatttatcgggggaactgacatttcaattaactgagcagaaaagggggagatctactaaacagtaaaatgccaaataagtcagagcagaggaaattttcagcatagagtagggaatacaacattacccaaaattgatatcgacatagtcgcagtacggttccacaatctttgctgcttgtaacaaaatgtcaggatcatttgcacaaaactgaacaaaaagtggacggtcctcctgtataacataccaccaattgtcacattctattttcagtatgttccataaccaatacaaagaacgattaatggattacagaggtaacaggacaataaaagctagtaattatcaaactactatctaaaataaaagctaattatcaaactactatctaatcctttgtgtagtgatatgacagatgtatcgctcggaattttctcggtaactacgaattatcaaagcatcatcaaaattattactccagtgaagaattagcttaaactactccgggcgctctaattgaaggatccaagaattgaatagaaaagaaatcgtataaaccaaccatcaaggagaatttaccttgcatgtggtgaactccatggccctgtgcttctcgttctcggagaagatgcgggagtggagcatgggcgtgtatgccccggtcgccccgtagcggcggcacagcatgcggaaggggagctccgagttgtccaccatgggcgccaccaccatcttcggggagcccagccgcctccagtgcgcccacgcgcgctccaccctctcctccgcggacaccggcggcggaggggcgggcaagggcggggcggtctcctccgcgggcgcgaccgattcggtggtgaagcagaggtcctcgtcgggatcggaggcggtggcgaggtgggcggcggccggcggcgacatggcggcgaggctagggtttacggagcggaggaggcggcggcggcgcgggttccggaggatgggagcgaatcgcatgctagtgatttgcctctgggctctggtcctggtgtgtgggccctacttgtcagtgggggagagacaagatggattccagttatatgggccttttcggcccatgaatatttatccggcccatgtagagagtagtaaaatttcatctgatctagtctgaactgaacaatttctgcaacacatgtctgaacaatttctgaaactgaactggtgtcatttcaaaatttctgcaacactttcaatttagagccatttcgaaaatgaaatttgcaattgagtaattattgaacccaacttggtgacagatgtcttgctgaattggagcttggaagcatcttgaagaaagaaaagttcatgaaaaattgacagtaattctgatgtgctcctttcatacccttgtggaaaatctatatggagtatatgtttagatgatctggattctaaagcttacagtttccaaagctttttaccagagacatttatggaaatgtttcctaacaaactggcaataaacagtacatctgtacatcctttctgatgatcagcattcactgttgatcaaactgaagttgcaacataatgttcagagctgtctggcgtcttcttaggtgggacattcagttattggttaggagatcaactttctctttaaaaaaagacaagatgtcctttccagatgggacaaccaattagtttgttttaatttatttacaagatatgttaaagaaagtactgcaatttgcaatgtgtagggacttaattcagctaccagaattagataggacaagcaacctgattattttgtgaaagtaatagccctaccaagatgcattagatgtagagagccaagatcacagctgtctgccaaattaacttgtcgatcttgtcggatctcacaatggtacatcaacacctgaaaaatatagttacatattcagaatggtggctcccgaggtaaaatgctttttttttttttgcttttcttaacatatataagtagcattttttttatctcaactggttgagatgatacatgcataatccctcacaattttagagtaaattagtcgtgaatatgatgtgttgcccaagttgctaccttgatttagattcagaggatcttgaacaatgacaacagcagctactacccataattattcctcggttactttttgtttgtgggagataaataagaatccttcagctcagctcctctttgcccaaatggccactagagctggctttgcacaaatctaatgagttttaaaacctactttgtgcttgagaataattctaaaaggcaacttggtgataaacatttttgctccatcggaacttgggagcatcttactgacattccaaaaggaaaatatgcatataattttccttttatgatgaaagcagtatggccaagttggtactatcaagtatattaattggaagttcttattcgaaaaagtatattaatggaagtgaataaacaaaaggttcagaaataactccagtatgcaacgctgcttttgcatgtgtagtttgtgcaattaattcaactttaaatcaaaccattgtcgtcagcatcggagagatcatttttacaccaataagtagcatcaattagtattatacgtggcacataataataatgttttattcaaggaatatgattacaaaaataaacagtgaactgttcagtctgaagattggaagaaggatccagaacaggtgcagatttttttagtagaagagaaactgaattagggtcctttgaatcgcagggtagaaaaaacggaggaatatgaaaaacacatgattctgacaggaattgaagtgtaaaacagaggattgcaaaacacaggaaaaacacaggaatggtcgtttgattggagcgcaggaaaaacgcaggaatcagatgagagagatagactcaaaggaaatttccaagaggttggagcttttgctaaatttcctccaaaatccacatgcaatgcgccattccataggaatttcatagaatttagaaagcttcaatcctttaaatcaaagggccaaataggaaaatttcctatagaatttgaattctatgaaattcctacataaattctttgatttaaaggggccttagcttttgaagtggcatgcatgtgcttagaaatgacatctaccaatctctgttgcatcacagaccattagtggtaattgagacagaaaatccaagaacatttctccacgaaaacaagtatctaccattctactccaggttagagccatcaggctatatgcacagtacagtcgagcttgacactagttgcaattaacaattgcatcacctcattaagacagtttggttccagaaaaaaataataattaagattcaacaaaaaaacaattaagagaaactccttttcgatcaatgcatgcatcattcttcagaaaatgattaatgatataatactatataatcttagtatgcatcaactgggtgtggtttgagctggaactaatcaattaaggatgagatagtactccctccgtattttaatatatgacgctgttgacttttcgactaacgtttaaatatttgttttattcaaaatttttgtgcaaatataaaaatattgatgtcatggttaaagaatatttgatgacgaatcaagtcataataaaataaatgataattatataatttttttaaataagacgaatagtcaaatgttgaaaaaaaagtcaatggtattatatattaaaatatggaaggagtagtagcttggctagctaagaaaagaaagagaagagcctaatcgtgaagccaatccatccctatctggcttaattaaaactggttgaaaaaaaaaagaagaaaaaaaacgctggagcgtgtgccgcgtggtgacagtgaccgcctgatcttgggcttgatcgccggcgatgagtggccgggaaagcgccggagatcacctcacgcttttgggttcgtgaccggcggtgagagcgatcgaaatgaggcggccgaaacgtaactgtgctactgcctggctaccaattaaggccgtgtttagttcacatcaaaattgaaagtgcggttgaaattgaaacgatgtgatgaaaaagttgtaaatttgtgtgtatagaaaagttttgatgtgatgaaaaagttgaaagtttaaagaataactttggaatgtaagctgcatttgggcatggaagtgagcaagcccggtgccacttccacctgccaaactgcatgcacattgcaaagagaagcttctggaattcggaaacagttgctactaccagcttcgaaatgcttggcacaacatgcagtttcttttaaaagagaataatggaatctatttcaggctttgctttaaaatgctacggcaaattatacagaggttctaggtcgtcgaacgactacgaaatacaaaatcaccgttttgttaaaaacaagaaaactaatataaatactcgagtaaagttatattgaacatctattgctaaacttttatctatggactattatatggttgatgagaatctgcattaattaccgttgatttgttcagcggtttgcaagttctatataatccttgcgttcctacaaaatatcttagtaatactagtctctgtgctagtatttcagtgattcatgatatattgaagatgatggttaccgagttaaaggcatcttttttgccaaaaggagactctcaagaaggtcaagaaataaagttaccatcagctgtgtactaaaagaaaattaaatctctttcaggttggcctgcatgtatatatatcttagaaacttgaacaaagctttggcgatatcagaaaccaaagttctctttggtgacagtggcgtctgtatctgtatcctatctaagatgacggtatgcagaggcgcctcccttaatagaacgacgcgcaagtcttttgcgtacctccaaagaaaaagacgacttgcattgtagaaatggtgcagatcactgaaaaaactgtgttggaattatgcttgcgtgcagcagctaagatattactacttccatttcatattattatataaatcgttttaacttttatataaattaaacatttttagatttaactaagtttataaaaaatatagtatttttaacacaaaataaagaaactatcagaatatgttcaaagttagatgtaacgaaactaaattggtactataagtgttattatatttttctacaaactttcgacttaaaaatgttaaaacgacttataatatgaaatagaaggagtagcacacattcctctccctttcactcgtgcccttttcattagctactaccaggaacatgcctggatcatgggatggcatctgccttggcattttgatcactagcagcttccgtttataaattcataatatctttggtcatatggtccccagaggccagattttcttcattcaggatgacacactaccctactttattagcatgcagaaagttagatgacaaaacaagggtaggaaacgaggagaattttactcaaggactccatatagcaactacagatatcaatctatttcgtgacagattttccttaccataattaactgtttgaggtttatctagccaaatttacgatcgtaatctataatttgattgatttttttttaaaaaatgatatgcaacatacacatggttgcttttaatccagacgaatttgccgaacgctcatccccatcttataaactagatgaaacttcgcgcctttctatgatagttttgtatgaaaatagtaaaaaaaaaaaacaaacatgtaacatagctagacgacataactttgtaatataggttgatcattcaaatacaaaactaatacgatgtggtgcaatgagagaaggaaaataagaaatataatacagattaatcgtccaaaggcaaaatcaaagtgatatgaatagataagagaagaaaatggcggaaataaattggatcatagatcaatcatcctaggactaaaaataattgagatgatgtggcttaatgagaaaagagaaaaatagcattaactatatttagtggtgatgaattttatagatatataggatttggctggggcaattctgcagccaccccattgaaaagagataaaattttcgccctagagtctaagttagcaaccttaacagtatattttaaattatctagatttgtttaatgaatattgtataattacatttttcattacatatgctttagtaatattgcaaatttactatgatgtcttaatgtaaagctatgaaaagcaattatcaaaatcactcattagaggcaataaaaaggttagaaataccaagtaaaaaaagaaaagagtactgcacttagatacttacaagttaggaaaaagtgcaaataccctcctaaactttagatagaagtccgtctagcaccctgaactttaaaaccggatatcaaacctcctaaacttcacaaaaccgttcatatattaccctctatggtgttttttacagtggtttttatctaattagtatataaattggatgaatttgatcacgtgacatacacatcgaacatatatattaaaatctccacctaaatctttctttttatcaacataataatagtacggtatcactgtataagtataaattgatggcttacagttgatgatatgcaaatatattatattagttatttaaagttgttcgtttaagcttttaaaacatgcaaaaccaccattcaaaaccactttagggggggtaatatgaacgtttttgcaaagtttaaggggttgaatatccggttttaaagtttaaggtgctagatggacttccatccaaagtttaggggggtatttgaactttttcctacaagttacaatgcttcaaggtgtgtgcaacatgtaaaaaaacaaactttggtgcataactggtctctcagaattataatgattttacagatggatgaatagaagactaacaatgcaaaatccaactagttaatgtggagggaataggagttgactgcttatgtatggagttgctgtacaaatccaaggcagcattaaccaatgagataggaaggggatgatgcgtttgattcagcttattgcctgagtcgcctcatttgttaatgctgcctctccgccgcctgcctcgcccgcctctccgccgccgaccgcgccatccgccgtcgtcccggcacagccgtacgtgcgcatgccgagagagagagaggaagaacgagagagagaagagagagaggaaaaggggaagaggagtatgataggtgggtcccatattttttaataaataaaatgctgactggattgccacgcgtacgccacgtatgataaaaccgctctggattgggtcgaggggggtaatttgtccagtattgaaagtttacgggggtaatttagttgaccacgatagttcgagggggagtaattcgtactttttccttataaaaacgattttgatgtttcacttgcgacaaatttttgaacctctatctttcagtttttcggttgtaaaatcttacattaagattcatatttatgtatatccaacctacatctacactaagtaacattagattttacaacaactttttatctctcttttaaaaaaaaattaagacgggctatatctattggttaaaatttctgcaagatttaaaactataaatatgttgaaagatgaataggtgcagtcccttgtaataaaaatgatgtaaaaaaagcttgtttccattttgttgggtaatggaacccaggtacaatgggaaaaaaataatgagaaaataataaaaaaaatctctcaccatcatcctcttcctctgttttattagcagtagccagtagctagctgagctgagcctgagcttattatatttccctccacttcgtcctcttcttcctcctccatccccatcctccatcggatgcactagtagctggccttgtaccctacctagcttagctacccacccatgtcctcctcctcgtctcctctcgctgtctgcctttgacttggagacctagctcgtcgatcgccggccatgcgggtgcagtgcgacgtctgcgccgccgagccggccgcggtgctctgctgcgccgacgaggccgcgctctgctccgcctgcgaccgccgcgtccaccgcgccaaccgcctcgccagcaagcaccgccgcctcccgctcgtccacccgtcctcctcctcctccggcgacggtggcgccgccgccgcgccgctgtgcgacgtgtgcagggagaagaggggcctcgtgttctgcgtcgaggaccgcgccatcctgtgcgccgactgcgacgagcccatccactccgccaacgacctcaccgccaagcacacccgcttcctcctcgtcggcgccaagctctcccccgccgcgctcgccgaacagccgctcccgtcctccgactgcagctccgacgacgacgccgccgccgccgccaccgaggaggagtaccactcctccgccgcatccaccggcgccgcagtgagcgcgcctcttgacgcctccagcaacggcgccggtggcggaggaggagtaggagggagcagcatctccgactacctcaccaccatctgccccggctggcgcgtcgaggacctcctccccgacgacgacgccttcgccgccgccgccgcggtgagtactaccaacccatcgctccgccgtgttcttgctacgtctccatcgatgaagccgagactaacctacgattccttggagcagcaggcggggaaagagaaggacgagcgcgtgccgttcctcgacgccgacctgttcgacgtggtcgccggccggccggagaagaagggcggcgcgtgggcgccgcacgtgccgcacctgccggcgtggtgcctcgacgaggtgccggtcgtcgtcgccgcgtcggcggcgccagcggcgacacctgtaaaggcgaagcagggacacgtgcgggacagccactggagcgacagcgacgcgttcgccgtgccggagttctcgccgccgccgccgccggccaagagggcgcggcccagctcgcagttctggtgcttctgaacgccgccgccgccgtacaatctggccgccggcgagctcgacgaacacctcgatggatcgatcgaacacctgtgtaatcactcagctggtcactactacaagtagcaatcagcaagcttgatgtgccactgttactagctgctgctgtttaattagtgagtactaagctactactagttaattttggtgaaaactatgctactttgttactatataatgaagtatgtgtatcaaactaaactgagatgttggtaattaattatcgtattttgtaatgtttcatcttctttagtttcttcatctaagatcaacaagctagctagtcttagtcaacccatactacaacatagatctgaagagaaaaagaaaatgatatataattaaccaggggagctaattaaattgtggtggttgtaagaaaatagtgctgtatacttgtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42551 - DNA, 2597 bp, Oryza sativa
atgccgacctagtattatctacagatttaaatcaaaaggagtagcactatatttgaggatgtttagtgcctgtgccacaacccataatcaaacaaaagcttttttgcaaatgcagggcaaagcaacagtgcaaaagtccaaatacttgaaaaggcaagtgtactcctcttccataaatggaggtattgggttttttgctggtaggtttgctacagtagcatccaaaaaggagcaggcaataatcaatctgatctgatctgatctgatttgcaagtgtatgcatatccctgcctttacacattgactcctcccccattggttcgtcggttggctggttgctccctactttttcgcacatacatcatccatcaattctcatcgtccctccgtcggccggcggaaaagtctatgtgtgattaactaaaaagtctatgtgtaatcgctaaacacacccgaccatttcacatacctgagcttgattcgttgtattaaactgagggaggagtagatagtatactctcccagtctaaaaggttaccgttttaaattggttatcatagattaaagtttcatgagaaataatataaaacattttattaaatgacatgtggtaaggatggggttaggagaaatatgaatgagagataattgatgagacaagtactttagagtgccaatttttgtagcacaaattttattttattttttaaaaaataaagggatggagggagccgtatatatcaaacgagaagggaaaaacaaaaggaggaaagaatgtgaatgtccaaattcagagagcagaaagttgctttgaatgggatctgctccaccatcgaatatcccaactcagatatgtcgaatcagattgtgttcctatgctttaccgtgaattcttttccaaattccaaagggtggcctgccaattatttttggcctaaaatgatcccaagattgttatgattatatgccagtcagcggcctgttctactataattcattcattccttttagattataagattattatagctgatagattatatgcaaattattcatgcccgttttctcaaggtatgatttctccaaaaatctttctgcacctgcattgcaatctcgagtcgtaggtaagtgtgtaatttgtcaaagaaatcagactcatagaattctaatagtactttcccagcgttgaaaatttgctgtatgatgatagcacaacgagaggtccaaagtgcaagagcagaagagaagatacaggggagatcccgatcgtgcagcttttgagtcacagaatgaaaaagcatcagcagcagccaaatgagattgtatatgtgtaccagctgctagctagagttcgtcaactcgatcgttttacagcattttttttcttcctttctggtggatggtgaccacgcaagttaactgacgtgtagttcgttttatgttgtcataaagtggatccatcattgcacagttgtgcactagctttgttatccttaatttgttaatcacagctgacgtacgggttaattttgttgcagtctgcactaatgacgcacttcctctatccatcaatcaatataaggttcctctgcactaaggttaaaagtgaaatcactttgatgctcatagaagtttgcctgcctagaagtgatcatgctcagggacacatcaataaatacatggaattattgggagatgttggactgggaaaatagtaatagagaaatatttgaatttataaataaattttggatgctagaaaatacttatatttatagatatagatgacttaatcacagctgaatgtctcgatctcgcattgtagacgtaaatagtgaaaactaaaactaacaagtactaccccctccatcccagaatataattatatctaactataaatctaaacaactatatgtatcttagatttataatataaaaaaatatattgcggaagaacaggtaatactaaatgtgcttcctctatgctcttcgactctgctctctcttccgtctccgaggtcgtagagtccattctctccaagggtcatctgtggtcgttagttggcgttgcttcttttagaatttcttgggagtatagtgtactctgtctctctcccaactgattagagttgcgctcaactgtcatagcattctcttccctttttcttggctgtgtgtttttctcttcccttggcaaaagccaatctggctgattgcgtcgtgcaacagattttttttataatatattaacatgtaattcttttaagcgttcacggaaaaaaaatcctcgttttcttttgctttttgcaacgacgaccaacgctataataatttccagctagttcgatgagtgatcctgagtcccctgatgcatgtgtacacgtcgtgcctaaaagctagccgcatgggcctgtgcagctgtgctctgtacattgtgtggaggcaacggcgacccaacgtcgcggctacccgcgttgcagcctggctgtacatacatgttgctgctgtgttagcttcgcttagcaccacacaaacacaagctgaccagtgacctctcctctcatgttcccatatctatggccgtatgggggaggtgg

SEQ ID NO: 42552 - DNA, 8911 bp, Oryza sativa
caacctttccggattaattgtaccacctcgcctacgcacatgcgtccgcccccaatataatactgctcctgctaccgccgtgctcgctgaagcaactcgggttcctcctctgatatagtagtattgcgaccatgatggccgcggctaagcgcccctactgcaagccgccgccgccgacgacgaccacgacggcgatcacttcctcctccggccagaatcacaagcggctccgcccttcgctaccagctgctgctgccatggacggcggcatggaagaggaggcggtggcgccgccgccgccgacgacgatgacgaccaccacgccgccgcagccgctgctccccgggttgccggaccacctggcgcagctctgcctctcgccgctcccgccgcgactcctgcacgccgtttgccggccgtggagacggctcatgtacgcgccgtcgttcccgccgtttttgtctctgtacgcgctcctcgacgacgcggatgccgacgccggcgtctcgtttgccgcctacgaccccttggctggacgctgggacgcgcttccctcgccgccaatgccgtcgccgccgcccatgctctggcacccctccttcctcgctcgccgcctcccgctgcagtccgtcgccgccgccggccgcctcgtcctcgtctcgggctccacgcagtccctgcaccctgcgctctcccgcccgctcgtgttcgacccggccgcgcccacgccgcggtggcagctcggcccgcggatcccgctatccccgcgccgctggtgcgcggccggcgcggcgcgcggccgcgtgttcgtcgccgggggcgtcggcgccggctacgacccggccgtcgcccgctccggcgcgacgtgggaccccgcggcctcgccgccccccgccgccgcgtgggagccgatcccgccgctgcgcgacgggcggttcagccgcgacgccgcggaggccgtctgctccggcgggaaggtctgcatggtcaacctccgcacccccggcgccaaggagggcgccgtgttcgacctccgcgccggccgctgggaggacatgccgcccggcatgctcgccggctggaagggccccgcggcggcgtcgcccccggacgacggcgagaccatgtacgtcgttgacgaggagcgcggcgcgctcaccgcctacgattggggcgccgaccgctggaggacggtagccgagtccgaccgcctcaagggggcggcggagatgaccgtcgccggcgggaaggcctgcgtggtggcccccggcggtgggaaggtgttgatcgtggacgtcacgccaccgccgccgccgccaccagcagcgaggagggaatcgtgggcggcgccgccgccgccgccgcgcatgtgggaggtggcggcgccgggcgggaagcgggtggtgtcgctgcacgtgctgcccaggatgacacgccccgagtaggcgaagctcgtctccgcatggatatgcgattcggtacacgtaacacagcacagcactgtacaaaaacgagagctcttttgattttgccgcagattgaagctcgattatttttttatattgatttttggagtaaattccccccaaaagctttgaatcatgcatgcttctgttcatttcaatcaacaaaagaagaagaagagatggatcgatggagcgaagaatttgtttttgtcgatccacacacacacacacacaaaaaatctgaatgtgaatgttcgtagcgtttttggataccgtggtccattttatgttgttactgctttagctccaaaattaggttctattctattcgtcccaaaagccatgaccaaagtggtagggatccccgtgggcgatggcaacggcggcggcgaatgaccgatttgctgctttcgccgtcgatctccggccatgcgcgcgcgcgcgcgaaggaacctcgcatcttttcatctccctttttgtgtggatgctgtctgtgatcatcatatcgatccgctcgtgggccatgcgtcgatcgatcgatcgatccggcgaactttttttggttggtcgccaccggcggtggcaggtatgggcgaatctacagtattaacatcggtgtcaaacgataccgacgactttcgataaaagttatggttaaactgcttgttcatatattacaatactataattataatatcgatagacacgttatgataccaatgaattatttttctagatcggccactgcagatagggtgtggttgccgtggttccaacggaggaggacccggctgtccaccgaccagtcctattcgccgtcatggtgacggcgacattggctggctctggtgtcctctttgtcttgttgtcggttataaataacgccgcaacgatagctcgaaaagtaggcacctgtcgtccatgccaacttgctctcgcttgcatggtcacacacaacacaagagagagaaagaagaggagggggcaaaaaaaataaaaatctgggtgtgagaaagtttatagctcattcattgacgaaaggcgggagagcgacgcgcgcgcggtggccaacgagctatttgcgtgtttatagctcttccccgccgtcggtcaggatggaacaaagctagcggacggtggaaacgagccaaaaacgggcgacccttaattgcggcgagatgcgatgattccttgtgtgttactggtaactaattgcgatggccactcgtccggcaagtttcgctcacgcctgatgtcatttcttctttctggttatctttacatcgggaaagtgattttatccctccatgggatatctgctcgtttcgtgcatgccacctaaatagtcaataaaaaatatgaaaaaattggcaacatagattaatatgaaatatataacttctataagttgtaacaaaaataacaatataattgcgaatgtgcgataactattttcagttaatttgttatttttgttacaacttgtataagttgaatttggtcttgcatgtttgtggagtgatatatttcgtattaatctatgttgttaattgtttttaaaattttttgataactatttaaatttaaatgacatgtaaataatgaggggatatcccctcgagggatgaaaatccacatccctctacatccttcttcacttgccaaattcttcaagtcccagatgctctgaaagtgatggcttcaggacggcctgattctcacacactttcagacaagacttcttttttttttccctttcatttccttccaaaaaggagaaagcttttcagacaattgtgtgacagaaactaagcaatggtactactccaactatcatgaccggtttcttggccagttaagtgccaacttgatttcaatcagatttcaggcgtttctcagagaacaacttgagctgcttgctgtgtaggagtatgttggtagcttgcagagagtacagtgcttgcttagaccatgtgccatcaagtaaaataaacctagaaagtgaaatcttcattttgttagctatcacctagaaaaaggtgaacgcaagaactgtaacaagagagtgatatttctaacaggacactcaaaaaaagactaaactgttatagtagtgaagagtaagcaagacactaaagcctgaaaatgaaatcctcacctggctcaagtctcaactgtgactgaacagccaaccaatatatgctaaggcaaatcatttcccaacactgccgcacgatgctgctacctcaaccggcctaattagcgttcctgaattaccatcatccaaatcaaaattaaggttaggaacagtcactttcttacacggttacacccactggcttgcttgaccgatagcagtatactaccaacatatactccatatagcaatggcaaccgacaaaccgataatttctcttgctcagcaacttgttcgtgaccttgtctagatcaaccttaattgtagcaattagctacaattaaggcatcttctagactgtctggacaagtttgtagtctcgtccatccctagacagaccggcgttataattgggattcggacgtgcggcttattgcaagacatttggggcaccagcacaccactacagttaatgattatgctcatttggatacattgcaaaatcactatagttaatgattccgctcattttggatacacaacttctcgaatatgctatattctcacgacattacatccgagttggctttcttacagttacagtttccaagcaaattgttgataggttacaacttacaagcaaaagacagctggggaaacagacaacatgtccactctctaccagcagagtgtgcagagtttctaatctggcaaggcagtccccctttcaagattgttcttgatctcaagagtatacttgccaaatgccctctcaaccttcttgttgaagtgttcgttccggtcattgatcgagtcaatgtccttgtcttcatggaacttgcgcctcctgctgaatgctttccgtttctcatcccgttccttaagctcattaaccatcctgtctatgttttcttccgggaccttagacacctgttcaacgcacaagccatcgataaggactccatgacagaagggccttaaattcaattagtacaaagtttggtacgatggcaagtaccttcccatattggagacttgaagcgtcccgataaaattcaggatcggcttcctttgctttgttgtatgcctccatgtcaacctcaatgttcttggtcctctttttgtatgcatcatataaggtcttctggttgaaaactgcaagtgagaacacccccatttatatagaggtacgaggtttaaattaaaaagatcaaagggagttcatggccaaactcaaattgtttcaaacaacaagctataaccatgggcctatggcggctaccttgatgctttctgatttctgactataacataagcatcagggatttccagatataaagaatcatgtaagtagacatctcatggtgccagacattcaatgcactatgtaacaagaaatgctaaccagatgttgcattgctgaaggctagacgcaaaaattatagggagcatttgtcaagagcatatataacatataatcttgtttaagaacatcagtaatttacacttgcaggtttaatatttaaatgcaggaaaaacagaaacatatgttggtaaagtttgcaaagcacaggttaaacttataaaacaaagaaactgatatgacaacctagaccctgatgggaaaggaacaacatgccatatactactaggtaacaaactgacaaacaattattcaagtaacttcagaaaattcatttggaattagcttaaaacacgtataataaacaccacaacgacaaccggccatgagagacagcaatatgaatacggatgtgtcgaaattcaccaaagctacagaatatgcctctgaatataaattgaatgaagaaattcgagagatggaactcaccatcccaaccatatggtgcaggttccttttcccacttcttgtattttgcttcggccgactcctgtgtatcgagcatgtaagactttgtcatgtccaggccatttgagtcaagaagctttccgatcttcttttttctgtcttccagccacttttgtttagaaacacctctactctcagcgcgaggctccatctcttcttctctgccaccatcgcttgctgatttgccttcctagcttcattctgcagcacgagaaacagcaaagagatgaatacccaagactgcacagacaacagctatgacaaaacaatggaattgccgatgaccgcaccatcttcagccgcaactcaaatagcttcttctgcttctctgtcatctgcgggtaaccgtcgtctgagccggcgtcctcctgctccgcatcatcatcaccaccaccaccctcagcttgggcagcgtcggatttgccagcgtctgcagaaggcggttcttgctccgcacgctccaaccctaaatcgaagccaatgaatcactccataagcacccaatacaggctcaggacgaatcgaattactcctagcctcgaattagaattaccactatagtatggattcatggacatcacccatggcgcaaattgctccgatcagaaaatacgtacagaagcgagaggaggaggcggggctagcacctgatttggcgtcggcgatcctcttgaagcagtactcggagcagacgtggtaggggttggaggcgttgatgcagtcggggtggacggtgcggtccaccggcggccgctgctcgtcctcgatgcgctccttggcctcggcgatcttgcggaggcagtagtcggagcactcgtggaacgggttcgacgagttgatgcactccggccgcgacttccccgacgccgccgacgacgacgacgccatcggcctccgagctcgggattcgtcggaaccctagaagaggattagctccgcgtgcgaattggggattgagaaggcgatggcggcggcggcgaggtgaggtggtgtggtgggcttcaaaccgggccgaagagacattggcccacccatttcccaaggcccatgcattccgcatcgcagccagcccatgagacccaggagttagttcaaaggcctaagatactttcactttggtccaacgatcaactcctacagaaggaaaaaagtttatttcggatccctcaaccattggctgagtttgattttcgtctctaattggcaaaatcgagcacagcgaatcaatttacctccccacaccgttttgagagagattttgggactgcctatacatttgtcgataaatttttcctcaaaaatttgacaaatgtaattatagcacaatcgtagtgtaattacattgtaacttgcgtgtaactacagcgtaacttatatgtaagtttcacataattttgaatcgttagatctattacaagatttgttttggtgaggaagaaaacaaatcatagcacatacatatatgaaagaatttgttcccacgacctccattttaccgaaataacatgttacggagagatttttaaaaattacatacaagttacactatagttacagtgtaattacatgcaagttacagtgtaattacactacgattgtactgtaattatatctgtcaaattttaggggaaaaatttgtcgacaaatatatagcaaaatcgacgtggtgtctacgcgacaaaacaaacagtagagcccacgtgtcaccatctcccccccccccggattgcggagtagtcggatggcgttcagctcaaagtctagcaagaggagactctatggttggtgtaaaaaaacagtagactatatggttctgttcttttctctagcaaaagttgttcttttctctaacaaaagttgaatgaaaattaaaatttctgtggcacgtttttcaaactgctaaacagcgtttcgtgcgaaaactttctatatgaaagttgctctaaaatatcatattaatctaattttcaagtttgtaataattaaaacttaatcaatcatacgttaataccacctcgttttgtgtaaaaaacttagtcttcatcttcggaagaaaagaacaccacctatatatgcgaaaataaaggatccaggtccaaaactcccaaagaacttgagcaaaagttcaattcctctccgaaatcttgaaaattgcaaattctatgccaattcttcgacgaactgaatgtagaagtaccgtcactaccctatgcctaagaatttaagatcctgttgcgaaacataaataagaaaacatggataatgattccgttcgggccaccgggcgggggaggaaaattcgggcgctccccccccccccccgcgcgtgcgcgcatgcctgcgctccacctagcccaccacgtgtccacacacaaacagctctattgcaaaaaaaaaacccacatattttggaaatcctctattaaggaaatttggttttttttcaaaaaaaaatgtttcatctagtgcattcacaatgtttcactatgtatagatctaatgttgcagtgaactgaaatactccatcacggtcgtccgaattacccccctgaaccacaaaaaaagtacgaattacccccggaactatcacggtcgtccgaattacccccctgaaccataaaaccgggcattcttcaccctcaactatgcaaaccggacgaattacccccctcgacccaatccgcggtggttttggtctacgtggcgtacacgtggcagtccagtcagcattttatttattaaaaaaatgtgggacccacctgtcatagtctctcatctctctctcctctctctctcactcatcctctctctcgctggtggcggaggcaagcggcagcggcggtgcagacggcaggtggtcggcaggggcgcgcgggtcaagcggcagcggcggcgcgggacgggcggtgggcaggggtgggcatgcgagcggtcgacgcaaacggcgcggatgggcgctcatggcggcgcggggacgggcagacgggcggtcggcgctcatggctcttccgccccacatggacgccgcgatgcacgcgcacgcgcacgaggtgttcgtctcccgcgcccgaggcgagctcctcctcgtcggaacatgtgttcgcggtgaaggagcttgacgcggatgacgaggagaccggggagtgcaccggggagcgggaggccgccatggccagcatctcactctaccgctgcaacctcatcagcaccgtcggcattggctcctcgcccgctcgacgcccgcccgcagcccgcagccatccccgcagccggccgcccatcggtgtcggctcctcgctagcccgccgcccgcagccatctccgccgtcgtcgtcggcagtcgcgccgctcgctctgcctccactgccggccgtccgctccgcctctgcctcagtcgcccgcctcgccgcatgcgcc

SEQ ID NO: 42553 - DNA, 3304 bp, Oryza sativa
tctcttcccactctctttcaagtgctgctgctgcgcttgcaaaagtgtcggtgtagcggattggcactgacttttgcctttgggaacgtttcatttactattcaagcccactccaaggatactacacgtccccacggacggcgccactgtcgtgaccttgacccaaggtcacggacaagattagggatagacgggaaaacccccttttcccgcctatcctaagaaatgagcccaaataccaaataaacacatactaagtgacaagacttttagtattccaagatatcctgcctgctacaggctttttgtctgctttatatagttcacagctttacatgtgagattacacttgcaccctttgttgggcccacatgaaattacaattatgcccttgctatatcagctaaccctaagggcattttggtatattatggaggtcattatagtcttttggtgccagctagatgaagtggttgagtggtcctcaggaatattctcttggcatctttgttgtctaagtcgccttcttcatgatcaagagtcttttccaccaccatgggtcttctcctcgaccgagggtcttttccaccaccatgggtcttttccatggcaaatagtcttttccagttcgaccacccttttcgacttatccggtagctgacctgttactgacttaggaaacattcaaaatggataataagacttagtgacaagaatttactcgaacggtattttctgactcgaatagtgttttaccgtttccctgttcgaatggccatttccactcggatacttagaataatgactcaatctctctctacagtgttttgggccgaatatggagggacggtggtcaccccctgctacaaaaagcccctcacgggtaagggcgatgtgtgttttcgaccgaaaccgtgttcgaatcaaaagctaggggagaaccgccgtcctcctattcggttgaaaaaacactaggatataaaattttgaagttcgaagctggttattcttgataatcattatgcgtttatttgaaccgaaaagttgtggttcgccgtagcaagtatcattcaactcgaaacatgaagcacattgcattttgaacacatgagaagttgctcttttctcaagcaactaattgtgatgatgaagagaaggaaatacattacgatgacacttgtatttttttcttttaattttttttaaatggcaaagagaacatcgagatggcagtttgcgtgacttcgtcgtcgagtttagaaaacgacgttcgaataatgcttcgagcagcattaatttttggcaaacctttagaccatctgagcgtcaacttataatatggaaaatgcgctactcaattgtctcttacacgggaatgccttctcctctcaatgtcatttttccttcttcttttccttttttaacaagcaatcagatgtaaatttgtcgtgtggtctttaataaaacagtttccgaatacttttctgatacaaaatagctaaggtaaaaatttattcgaaaaatgtcatcaagttggcttttcttctccgaagcgtgcggagggttttctcgatttggtatcgagttggattttcctctcctctccgaagcgtgcggaggattttctcgatttgctatcgagttggattttcctctccgaagcgtgcggaggattttctcgatttgctatcgagttggattttcctctccgaagcgtgcggaggattttctcgatttgctatcgagttggattttcctctccgaagcgtgcggaggattttctcgatttgctatcgagttggattttcctctccgaagcgtgcggaggattttctcgatttgctatcgagttggattttcctctccgaagcgtgcggaggattttctcgatttgctatcgactttgattttcctctccgaagtgtgtagaggatttttctcgatttgctatcgagtttgattttcctctccgaagcgcgcggaggattttctcgatttgctatcgagtttgatttttctctctccgaagcatgcggaggattttctcgatttgctattgagtttgattttcctctccgaagcgtgcggaggattttcccgattcacaatcacacaagacaactttttatacaggttcgggccttcattatggataacaaccctacgtcctgtttatatgtgttaacatcgagaagaaaagagaatcttacaaaggtggtcggtattgtacacttcaagcagcatgtttccttttattttcttttattttctttttttctttctttctcttttttttcttttttttacacatagaatttcttcaaggaaatagcattccaagtgtgctttaactcttctccatcgaggtgtgccagcttgtatgctcctgtttctaacttcctttttactatgaatggtccttcccatttcgattccaactttccaatagccacttcattgagtgttttcttgaggaccaaatcaccttcttctatttgcctgattttcactcttttttcataatagcttttggttccttttgtgctttgtgccattttgtctaatgcttccactcttatctcgtctaacatttccaaggtgatttctcttccttcttctcttgttacacattttagcaaaggggcagtgactccactcttgtacaactacccttctatcactttgtatttccttgacattaaccgtattcttcttgtttcttcttccttttctggaagttgttcacgaaccaaatacttcagaattggctctctccaatctatctcgccttgtatgttttccacttctcttttctcataacttggttgaattaacatatcaaagaatgaattctccaatggttggcctgtggcggctgcttttgcaagctcatcagcttccccattttcttctcttgttatagcttttactgttatccctcaaggaagtgtttttcattcagccttgcttcttccaagtactttgccattgtctcttattttgcttcaaatgtttttggaaaagtgacctgccaccagctttgaatgagttttgattatcaatcgtcgagcccctagtgctcttgcctttctcatggctaataaaactccttcgtattctgctgtgttgtttgttgatgggaaaactagctttgcggaatatttgagtgtttgcttcatcggtgtttttacaacgctgctacccctgcaccagtggcattgcatgctccatcagagtatactatccatggttttccatcttcttcctttttgtccaccctcattgggagtccattctgccaaaa

SEQ ID NO: 42554 - DNA, 12264 bp, Oryza sativa
aaaccaagtcctactacaacattttcttcaacaacaatacaatttcaaagtttttgaataagacgaacggtcaaacacgtttaaaaaagtcaacggcgtcaaatatttagggacggagggagtatatctgtagaccaggtcccatattgattgcatataccaacagtgcgaatgtggaagacttacttcttttacccaagccatctccaccatataatttgagcagttcacctgcaaatgttaaacccagcctattagagatcaaattcatagatgatggaagacagcctaatggcagctatttgttaatatatatctatgcactatgcaacgttccattatatggaatccagcaaacacagtcaaaacaatggacatgaattcagcatgaagatcacactacgacattgccctttttacctttccatcttccactgctcgagccatgatcattgaatccccatatgaataagaggttggaataacattaagtgcatgtgccatagcatagctagtctgcaaaattcaatagttgtaataaagtactttgtccattacattggtatggaacgcaaaaatatgccaaatatgtaattattttgagtcaagaaggattacgttctctgcaaaatgaagggcattctcttgcttgatctcaggtgggtaaacaacagggaggtactctacctgtaaaaagtatggttcatgtaaggaccttattgtgtaagtagttattaccaaagacatgaagattttacattctaggctgaatggaatgagagtgtgcacctccatgaaattgtgaaactgggtaaacatcttgaacatgagctttcctaatgatatatttcccctgaagcagaaaatgaacataaataaagcattgaggcaacaaataaggatttatttctgtacagataacttaccatgattgatcaaagtgcacatgtggatagcgcacaataacaggttgaacagggtagccaggtatgaatgcaccatgttggaaagaaatcagaaatcttccatttgttgtcgtgccttccgggaataacaagacacgtgggaagctattgcaagccgcctttctctgaaatcacatcctagagagtatgtaccatatgaacaagataacaaaacagaaaatcatgctttgcactattctaggatgagttgcatggcattgcttcctgaaatcaactgtggtgtatttgcatattgtagatgaaagaggaagctacagaaatggtggctgcaagcacaagtttgtctttgttcttttctgcctattattctttctaccccagaagtccactgtgtgcagtaatgataatttgacagcctaacagctataggcaacagaaagcaacaggataacttgcatatcaccaattaaaagatgcctgacaccatgagaccatcactttattaaggaaaaagcacatgtaatttgatgcagttaattaaaagtatgcagagcaacagtggggtcaagaggaatcattctaacctttatttcatttacagcagacttccttgaagctggcgagaatctgtcaacatatataacctatgcatttgttgtaaatttgaaacttgaaagtaacttgcaaaatagtgtcaaagaaagtaactgggaaaaagggcttttaaaacataatggatatacctgcattgctcggataattgttccaacaaatggtatggaatcatgagaatctgaagaaacgattgtcgggaacagctcatagaagaagtatatgggttctatgtatgatacatgatttgagacaactataggtgcaagctctctaggcgcgggttttcctttcctccttatccaatggtatctgacagtagaaaacaagtggttagcaaagatcagacagtaaacagttgtattgcaagaagaaaaaatgacaaacagtaggcactcagtcaggatatcccagcatagacaaggagcaaaagtgagttgtttcaaaatttcccattaaaatccatatgtgagattaaaaaccaaaactccagatcatggcccaaaggaaaactttagtataaaacaaaatccacatccaagtggtcttcgtcccctgaagtttgaacaaaacgttcatttctgcaactgcttacagaacacgaccaccaacactgggcagttcccttctcaagttctcattttactgcatagaagaactattggcagagatgataagctatgtgtgtgctttctcagcattgaccactcaacattcgctcgcagttttcaccattcttttcacaacaattgaaacttcaaacgtctcaaaatttgtgtgcagagtgtccaattgagcaattcccaggtgaacagcaatccaatttgaactaagtagcagccacattttcgatccaaccacacaacagcccacctgattagtgcctcaacttaattaattatcagcgccaaaggccaacaattttcagaatactttcaggaaggctttcttactctttctcactatcttcccaaaccacctagtagacaaggcatcatcattcatcgctagtccatctcgtttcgatccacaattgtagtgaagctaaccaaaggcgccgtgcagagatcagtctctaacctcttctgaaccaccgtggtaccctcccctcgttgtcggtctcttcccagccgcaattagtgcagagaaaacgaaacaaacaacatatctcacacacggacccttcacttcaccttccatacgctacgttgcgcccacctaacaaatgattgcagcaaagccacgcccacacacacgtgccccaaaaatcaccaaaccccaaaattccgcgaaaccaatcgcgccaccgaatcaatccatccacagatttcgagtgcttcgtctcaccacccgaatctaatcacctcaatttcattctataaacttaacagcggctaatccatcatccgatgcagatcggattaaagtttttttgttctaatttctgatctgtcatcgatccagactcgattctgagtgcgcgtttggtgagagggatgctaatccgagcgacgaacagcggaaactagaactcacccgaaggagaagaggatgcagcgcgcggagatccgcgtgatccacatgaggcggcggcgccacgccggcatgggcccggcgccctcctgcgccgcccgctcccgcacgtcgacccacccgcggagcgccacccacgtggcggcgtaccccaccgcgatggagagcccgaacagcaccagcctcgccgccgccaccggcgcgcacacgagcgccctcacgagctcgtacgccccgcaccaccccggcgtcccgttgcggaacgggtcggccggggacaccccccgcggcgaccaccacgccggccgatcctccgataggaacgcgaacgggtccccccctcctccgccatcgccgccgcacaccgttggcgactcctcgtcgtcgtcgtcgtggttatggtgccccgcgtggccgttggtggtgggcgtgggcgagatggagtcggagaggagcggcgtggagagggaggcggggctagggtttcgagaagccatgggtggcggaggcgaggcgagaggaggcggaggcgggaggccagcaatggaggagagggagtaatggcttttatgaaagcgaaagcttatagcaagaggaggaaggagacgttccttttttgtggtcgtaaatctatttaatttatttctttaatcgtcttcaaataaatcctttatttatttttgcgttctatccctcgcatttctgggtttttttcttctcgcgttgcctatagtcaagggagtggtcggtggctgctagtactattttttaaaagaaaattattggtctcttttcttaactgatttataaaagttttttcttctcttcacatgtgtttataaataaataattgaggtccttattaagttgaattgagaggtttaaagaatgcttatatgtgaaggttgaattagctttgattgtgtggacgtggatgctctagtcttccctcttgtatgctaaaggattaatttagatgaaattagtctttcaacacgtaatcctaatagcctttgaaagctgacattatatgatagagcctgttgttttaccaattactgcaacgttgccgtttgtagatttttgtgcagtttataacatggagtaaatcaggaagttttcgatgtgacatgctagattaactctaaatgtgggaataatcaaatgtgacaaagggtggaatagtaagaatgctaacgtgcctggtaaaaaagagaataatacatatgctatacgtgcttctacggttcaaaaaatttcaaaattaaccactttatttttgtcactgagttccatattctagaggacaatatatttaatcttacgattgtatttcagattgcattttccgtattccaaattttacaagatatatacgtacacttaaaagaagacttataaagcacaagcaacagcatgcaaaaagaatatatgtgtaagtgtttattgtcattctaatgcgatgctctgatgggtttctctttattattccaaaagatcagtggagtcggctatgttcttttcagctgtactccaccagattttatcttctgcattgcttagcttagatctaaactatttgccaagtttacttcgcctacataatccactatgataatcaggtcaataatctttttcaaacttgtagtacttggaaggaaaatagagcaaggggtgttggtgctatttaccaccgggccgggcaccaaacagcaaaatcacaagacaacaagcagtccagtagtcggacactcggattgcggtacgtgggggctcctccaccgcacccgcgacctggcacccactcgctgacatgcggccccacaactcctgagcccacctggcgccactccgcaaaaacgcgtgtttcgtggaatttttttcatttttaattttttttaatatttacaaaaaatattataccgacaaaaatattttgaaaaaaaagaccctgttgtccaagtagagggcagcaaggtgacatggcacacggcgccgatgtcaaaatgcaattttcgccgcatgcaaaattcccatgcccgctcagcgacctctagcgcttgctcacacacgtcaccctgccgctctcgaggagcgcggatctatttctatgaatattttcacccgtataatatttttgtaaatattaaaaaaaataaaaatgaaaaaaaattatgtttcgtgcggtggcgtgacagacgacgtgggcctccggccttcgggtgggacgctcgctacgctacgagtgcaaggcccgccgcgacgagagacgacgacgacggcgacccgcgcgccgaagcgatgcaagtgcggccgtgtccaatcgtcgtctgccaccagcccaccactagcttcccttgtgcaccagcctgtctgattctgatctggtcgaccactatctatctcttctagctcctcgtcctgcactacagtccactgcactgcattgcgctggactcatggtctcatgctatgctgacgaggctcgggtaattggacgccttccttcttgattatttattttttttaattttaaaaataaatacttttgaaacttattttcaaaacattttgatcatgctaacccacctagcgtggcaaaataatactaacgccgcacatcgcggggcattacagttttgtattgctatgatggttagagtgacgtggccgaataacgttgtcatgccaaccagatcgacgtgatagttttgtcttgccacgtcatccaaggtggtatggccaaataacactgacaccagccagaccggtgtgaccaaataatgttgtcatgccagctagattggcgtggtagtgttattttaccataccaattctactggcgtgatcaatgctcatatcttagaaataacatttcaaatggtttatttttaaaatttaaaaataaaaaatctaccatctcttctaattaaaatacagattttatcttaacttctattagcatatcttttaaaccaccaaatgttatgtttcctgtacaagttgttttaaaatatcaaacaaatataatttttaaatttataataattaaaactcaactaatccatgtgctaacaaatttcttgttttgcgtgcgctcacttcatttccattttaatgtatcacaagcatcgccttaatcctccgatcacaacctaatacaacactcctatctcttatggagattttggaattgtcattagcggttttcttatataaaattcgcccatggttttcacgtgaattggtaatttgatataaaaccctccctgtcaactcacgcctaaatctcctgttcaccaatatttaaattgctaattaaatttttaagcaacggtcaaaatgttctctccctcccacttgttcggttctctagcttgcgtggtcgtatacatagaatgttgattatatggcacgcccttctaatattttgaaaacgattgtatatgacgcttttttgactatcaaatgggcagatcttgcgttatttcacactcaaactgaatctgataattattcttgttttaattacgagaggcgttgattctgcatgtgcctaaagctagctaccctcacatgaacgccgggggatattctactgtatttgtgtaagatcaggatctggctttgctgtgcacacgacggtatccttgctggatccactggagtactagtttgagtgatgtttaatcttttttaagtcgtactgtgtaattaagtaacaaaattctcgccgtttcggacaggtagtccactgaaattgcacgttccccttggctctctttggacgtggtcacgttggtttgagctgttgttcttgaggtctcaattggcaggatctcgatggcgtaatctcttcaaaatttttgcccggttatctggttttgagagccgtggttggctgaccggacagattctccattcttcttcagcgtatagaagaattgctagtgttcttggcgtgaacaggtcgcggaaaaggaagaggaattgaacccgatgaaggcaccgccaccgtaataatccgatgaataatcggtcgtattagtatcgtacagcgacttttttttattaataacccataacctttatttccatttcagaaacagtgtacatgtttttatcgtacagcgacttggctaacgcttggcttagcagttagcacctgttcatgacgtgttttgtttagccgaccaaaacgccgtgggcgggcggcgcgaccaccagatttcgcgcgagacggcgagcaaaacaaccgcccacgtcccactcgccgacacgatgatcgctgtcacgcgcaccgcgtcaggactcaggagccacgacacaagcaacgttgtcaacttctcgtagattcaatcaaccatgaaaggaggcatcagttcatcagcaagaaataacgttgggaaaaggttaaattgagaagagatggtaattctctttatattccaacacttctctttacgcgaggcctcttcaagcctttagtgtgatatagaagtggattagcctttagcgtgaaatagaaatggactataatttttatttagttgcacaccagccataattcgaactcgaaaccttttactttaccttttactttgatatcatattaaattgcatgcaccgaacagtttaatccaaaaatttaagctgacgaggaaagatggaccattcattttttattccaacaataacacacagtaatcaatctgtgaaacaatttggcaccatatttttgacagcagcaggagaggatcacaacacgaaaatgacaccgaatcgttggtcgacacgaacgaagttacagaattttgcaaggtaaaaattgccagccgagatgcatgtctgatgcttcctagtgcgcgctctggcgcgcgccctcctcggcgccggcgacatcctcctcgtcgttgtcgttgtcgtccacccacttccagtaatggcgcttcacggtgatggcggcggcggctccatcgacgacgacctcgtcctcgtgctccccgccctcctccgtgtcgaactcgccgtcctcggggacgccctcgaccacctccgcgtccaccgcgtggagaacgtacctggcgtggagccccgggtaggacgccgagtcccgctcctccacgcgggcctcctcgccgcccaggatccggacgcggacgcgctcgccgagctcctcccggacggcgcggacggccgcggcctcgggggtctcgccggggcgcatcttctccgacagcgggcggagcccgccgcgggagcggagcgtgccgtcggagaggagctgcccggtctccatcagcagcgcgccgcgcccgttgcggatccggacgctggcgacgtggacggcgcggacgacgggatgctgctgctgctgctgcgatggcggcgccgcggcggcggcggcggagatgaggacgcactccccctgtgagagctcgaggaagaggttgaggagggtcttggttcccggcgccgtgccccaggacgccagcgccgacgccggcaggcgcgagccgaggaacgccgccagcgagtccagcgtcgggaaggccagcggccgcggcggcgacggcggccgcatcgcgattggtcagcgcctccgcctctctcagtggtggtggtggtggtggtgggtggaatcgcgattcgctacgaacgcaaatggggaagagaagggatcgcgttgcgtcacgtggagaaatttccaccagccacccaaggccgcgtcctacggcccaagtgcgagtatgggccataggaaagtacaccgaaggtccctcaacttgtcatcgagttacaaaatcgtcctccaagcgcaaaaataggtatctaacgtcccttaactaaccaaaaccggacacaataagtactttaggacaagtactataatatctcatatgttgcccctaagaatgccacattggattgggtgatgaggtggaggagagaagtggagagagagaagatgagccacccctaaatcaagaggcaacctccacacaaatttcaagaagtgtgtgagagtattagagatattggtatttgtgtgttagaggtgatacattgtatgtgttgcctcttaattcatgagtgaataaaatagataaatttgaagatggtagtcacatctaccatagcacttggcctaagtggttttgaccccggttttatgctacgtggcggctgaattagcatggacccacgtaggccccacatgtcaggctgccacgttagcctcctctctctctcccttctctcccttcctcatccctctctctcccttctgagtcagctggcgggaggaggagggcgtcggtggccggcggccggtgacgggcgtcgcggcgacggtgatggcggcgacggccgacgcgacggcggtgggtggagcggcgggcgggcggcaggaaggggcggcgcgcgggcgggcggttgggaggagcggcgcgcgggctccccccccggccgccgcccacgaggcccacgaggcagcggaacggcggcgacgactcggcatcgtcctcgttggaggtgagcgcggcggccccaccctcgtcgaccgcgagtcgcgcgcagccgccggggcgctgaagaggtaccccgccgcggcgtcgtagtcgggattaggagatgccgctgagaagcatcgtgccgatggcgagcggcttacggccgaagcagtcgaggagcaacgcaaggagcacgtaggcgggcatctcggcgagcgagttcaccgaccgccttgcagacgaacggcggcgggcgtcggcggcgatggtggcgacgggcgacgcggcggcagtggggggaggagctgtcggcgggaggcggcaggtggtgctccggaggacgacccgggcatgccgatggcgacgcggcacctgagctgaatggcgagggcgagagtgaacctcatgccccacgtcgacgtcgacgagccggcgaccgtgagggcgctgctcgagcaggaagaggaggcaccggcgtggccttcctccgcctcccctcggcctcctccgcctcctcttggccacgagccaccgcctcgccgctccacgctgtcctcctcctccgtgccgccgccgttcgcgtcaccggccgccgcgcaacgtcttcctccgggtcggcctcctgctccagctcgacggccagcgacctcgcgaccgcacgcctacggcctctacaaccactgcggagggcgcgagcggcggggggaggagctacgcgtggacggcggccggcgggggagcccgtgtgccgcttcccccaccgccgccgcgtcgccgccatcaccgccgacgcccgccgcctaggcgctgccggccacagagaagggagagagagatgaggaagagagagaagagaggaaaagagagatgagggtgttgacgtggccagctgacatgtgggacccacgctgactcagccgttacgtcggataaaaccgggttcaaaactaccgaaggatgtcgggtgaccggttttatataattaagagaactcgcgtatctggttttgcggttcgaggatgttttttaccctgattacaagttgagggaccttcggtgtacttttcgctagaataattaggctcatgcgttgtgtccttattgggatgggccaatttggatcgtatttacaatgggcctatgctttctattttggtgggccaaatgagaaaaaagatttggaacgagagacgttcctccaaacatttttaaaaagaaattataagtgtgtttggattgaatacgggatcttagagttgaaaccgcacacctcttaccattaccactttcatttgtgctgaccaaatttcatccgatggttgctggtaactcaaagggattcggtgacatgtacagtactacagtgtacacagccagcaggcatattactgaacaaagtcggacagatgattaagcatgttttatttggacagtacagaattaaacaactctgattcaaccgaggaactgatcgaccggcgaagaacagcaatctacagaagaaagaattttgccaatacaatcctatgtacttcctcatcatatagtagtgaccaactagcaaacttgaaactgctcttctggatcttaattactactgcgccatgatcgtccaccagatgaagctgaagcctaccaaggacgatgcactgatcaagctcaggcgatgcgttgcgcctccgctcgccgttggcttggccgctgcaagattcagcaaacaaaagagaggctcagttacaaattacagctacatgtctgtgaatcactggaaatttctaagcaagcttgaaatgatctcatacagagaggttttaatttggctgccagttcatactgtggaaaactgaaacataatctgaattgtgatgttctgagttgacagcgaaaattgttgttctaattaagcacaggtacctgtagatgcagcgtttccagtggaagctgaagaagcagcagtgctacctgcagtgccggcacctgcaggaattgaagagagttcagatcagcatccctctgtaaatgatcatatcagttttttgtgatctgattaaaatgccagagatcatgaattggaggccatgattaaattgtgatccatgattaatttgcgatctctcaattatcaggtgcctcggattcttgtgagaccggagagacaactgcatgctttagctggcactagctagctagagttggtgcatcaaacgacaaactctccagcgaggagaggagcactgttagtgttaaactaagcaataattcagaccattattactctagctaggagaaacaaacaaacaaacaaacaaacaaaagcagtagcagtcaaaccgcatcaaccactgtacgtatgtccactgcaattagtagcagcaatctagccgcatggatcacgccgtgatcgtcgacgagaggaattaattaacgagatcaaaacattgaggaaattgatggaattatgtgtgttaccggcggcggcggcggcggcggtggcggaggaggaggcggacttggcgcaggcggaggcgtcggtggtgacgccgcagcgtttggcgaggaggaggccctgctctggcgcgacgccgaacgcctggagcgcggccttgttggtgaggatggcgcacaagcacgccgtctcgttggcggcggcctccctgagcgggccgcagcacgacgccggc

SEQ ID NO: 42555 - DNA, 3756 bp, Oryza sativa
cgccgcctgcgccgccgccgagctcgaggctgcgcccacgaataaggccgcgacgacgaccaccaccacggcgacgaacgcccgcgccgccataggtgatcagagcgatcgagtgaggtcgcggtgatcgagcgagcgagtgagcgaggtggtgtgggtagagtgtacgtagaggcgtttgtgtgtgggttgggttggcggttggtgcatgatatatgggacgtgtcagtgtgacactgccagggaggtttagttggcggcttgtacgtcggctagctggagtacgtttctttctttccacagctaattaagctagttagatactccctccgtttcaagttataaactttgataaaagtaaaactattttaagtttgattaaatttatagagaagagtagtaatatatttttaacccaagacaaatttagggcatgttcactttgacgtcaaaaaaaaccttaccaaattttagcaacttgccaaattttggtaggatttcttatatagttaccaaaatttggcaacaaactaaatgtagccacttttttgacaactttatcaaaatttagtaaggttgaaaatgacatcaaagtgaacaggcccttaatataaaaatatattcaattattgatttgattaaattaatttagtattataaatactattatatttatttataaacttagtcaaacataaaacagtctaactttgaccaaagtaaaaatatattataacctaaaacggaggtaatagaactcatgcgacgagtaagttataggcattacgctgccaaataaatatttcaaactaaatttaaaatttattgatagttaaagttttacccatttgattttagtcattttttaaaaagtcaataaattatggaaatataatatattattgtactctctctaaagttgaaagtatttaacccatcttgtcgaccgacctgtgtgtttggaaaaatcttaaaaaaaaggtcgatcggaatcggaatggactccggattgggcttagctggatcatcacagaaaaaagcccaccttgttgctccaggcgaacgtggtagagattgtgcagtttttacggccggcgagcagttgaaacttgaaagttgcagggcctcgctcgtactttcctctattctaaaataagctcatttctcagcttacctacacatatcaataaaaaagtaaaaaagataaaaatatcattactgtatttaatcttaatgtaatgattcctttctttatctactttctctgcatttattcagtacttatacaaattctaatataatgattactaaaataaaattatttaggacaaacggtataggctaaaagaacttaggatgggggagtataccgcgggtagccactaaaggacctgttgaggttgtagctaaaatgaaccttactaaatttttgacattgctaaaattttagcaatttaataatattgctatgttttggtgggattttttatgtatttttcaaagtttagtaaaaaaaattaaatgggtgtgcatatttgacaattttattaaaagttgataaagtttatttcggcttgatcaggcccctaaagctgcatattcgtttggtcgcaggctactcgcgcgtgccgggcggtcgtattgctgtccagtacagtgcgacgatctcgatcactgataagatgagcatgcatgtacagtagaggatggttcgagaaacaccacacgcatgcatatgatcgatcgatagcgtcgagggcacgcgcgtaggacgtactctgatcatgcatgcatcccctatcggaaggacaacacagaccagctacggcatcacatcggaatccaatgcaaaactggagtgagtacacctcggcggtctcctctgcagtcctgtatgtactctctctctcttctataatataatggattttagaagaatgtgatacatcctatcaataacggacacacccattagacagggtgggtcggctggtccagctatggtctatgtagtcccacatctccaaaccttattttagtcctatttctaacacattagttgctagtctactattgaataatcaggtaaatcaagtattttaagtaggaacaaaaatatttatgaaaattcgtgtataagtagtaggatgtgtctattcattgtactaggatatgtcacatctacccaaaatttgttatattataggaccgaacagatggagtataatattgttcgacgaaacatggatatgtgaggatctgtagtaccttttccgtttcatattatacttcttctgttctaaaatattgttcgatgatacatggatatgtgagaatctgaagtactccttccgattcatattatactacttccatttcatattacacatccggtcaaaatctcttatattttaagacagagggagtaagtcatttgattttttccaaactttattaagtttgatcaaatatataggaaaatacagtaatattttcaataataaataaatatatttgttgaaggcatatcatgagaaccttcgaccaaggctgccaaaacctggtgggctcgatcgggcgaagcatagggggttcactaaaggccaagacacttttgccacctgagggcccataacaaagcccatcaaggagcccaaggcacaatagactctagttaccctcacaaatgcccatatcataagggtattcatgtaaattctccttactaattaactctagggtacatgaaccctgtactcattaactttaggttgcatgagtttgtactaaagctataaatagtccatagggcatgtaatgggggattcaaaattccacaaatcaatacacattgttttacttttcactgtgtgaaccacgtctttcgacgtacacagttgtcaatcgacaataatattatcaagatatattcttagttaaatataatgaaactaatttgatattgaaaatattgctaattttttctataaacttagttaaatctaatactttctccatctactcccttaatctttatatttcatcttagcagacggaggaaacggaggatttttgtgtcagcgaggccggcaactcgcctggatcgtcgcatggccttgtcgccgcatgcacgcacgcagctgggatcatagtctcaactgtacacactctcttaatttgccggctgcagtagcatgagtcctgttttatgtgctcgtttcatgtgaacacacacatgcagtatatgctctccagttatgctcctctaactagcatgagttctgttcagattgcaacctgcatatccaaagatgcactgttattaatgggagccgtctatgtcagagctataataatttcttaattaaagtctacctatacttccatttggtggtgcttaatctcaagttaatgcacgcagctgcttctgtcctttggagtccccactatatatgtatactcctatcaagttaggtttggttcacatttgctgtaatcaactaatcttgcatcaaacttacacagttacacataacacatcagttgctagagctatcagctatgtgattcagatcaatatccattgcgtgccatggtaatggcagttcagagctagctagagcagatattgatccattatattggttaggcgcccattattccacttggtaataatatcacaagccatagatggacagatcgatcgatgcatacatgcatagatagacacacatacagctagccttcatgcccatt

SEQ ID NO: 42556 - DNA, 1785 bp, Oryza sativa
ttggtttcattgtttcctgctctacatgcacagcacgagccaatcaagcatacaactacacaagacaagcgcagttcttccgaattcagacactatatgcagccatgcaggcaggataccctttgcattgcaaccatggatggatgggtcgtgcagtctgaaaacgatcgatgcttttcgttcgattaattgcttcatttttggtactacaaggctgctagtggctagccaagaaacaaatgagacatactcaaaccatcttataatataaggtatatattataattggaacagagaatcagtttaaattcatagtaataagatttgtcctatccaagcctaatatcttatattttaggacggatggatacatatataccttatttaagctctccctagataattactactatctccgtgtttcaatgtatgacgccgttgactttttatttaacgtttgatcattcatcttattcaaaaaatttatgtaattatcatttattttattgtgacttgaatcgttattaaatgttctttaagcatgacataatattttcatatttgcacaaaaattttgaataaaacgaatggtcaaacattgattaaaaaatcaacggcgtcatacattaaaatacgttaaaatacggagggattacagcttgcttgcattgcaggttctgtacatagccaagaaaaactcaaactgcaatgagcgagaagtgagaacatagcttagctagctataggggaatggtcagctgcgctacttattgcggagattgaggtatatatcaggctcttgaatgaatcttgattcccggcgccgcgagttcgttcgtcaaagcgtgatactaatccagaatcctaagtaaagaaccaactgataaacaaatcacacggcatacctaagaaaaaggtatggccatgtatcttctgtagtaaaagctagctcaacgcatgtaaaagtacatgctttagggcttgtttgatttagtgtcctaccaaagtattggtagtgccaaaacttacgtatgttttggcactaccaatattttggtaggatagcattttaggtgaatggatttggattgataccaattggaagccaaatttatattatactcaggaaagttctagaattataccaaattaatcatggtcattaccattcacttggcttcaaaccaaaccattacattcactattcaaactacgaaacaaactggtagggcacattttggcatcaatccaaaatggcccataatgcttatacagtaatatagtatagttacttttttagatcataatatagttactttctgaaactttgatgctttcacttcgatcatggccatgtttagttcacccccaactactctaaacttccaactttccatcatatcacatcacattcaaaactttcctacacatataaacttttaacttttttccaaacttttaacttttcccaaacttccaacttttttcaggaactaaacacagcccatatatcatgtactaaagaactgtgttcggatgctacttttcccaacctctctctctcgtttccgcacgcacgcttttcaaattgttaaacggtgtgtttttttaaatagtttctatacgaaagttgcttaaaaaatcaaattaatctatttttttaaaaaaataacaaatacttaattaatcgcgtgctaatggatcgtcccttttccgtgcatactgtacaccgtttccatccaccggtagcgaacacaccctccttcaagaaagtatagaaggaat

SEQ ID NO: 42557 - DNA, 2309 bp, Oryza sativa
aattttctgtttaggtcccattcttgtcacaaatgtaaccccttgccatgctctagttatgctcggccatgttttgtaataattctggttaggtcccatgttttgtaatttttttaaataaaatcataaatataaagttttaatagaaaatgtaccgtttaatagattgaaaaatgcatattcatgcatcatttctcactcttccagctaggatattgataacgtggatagctattcaacctgctgaatgttattgtacatgctcttaagagagaataaaagcctatcggtaaaaaagaagtaatgggggtaaagtagtttatcaaatttttttcacactgagctgatgcatgttgtggtccctttaacaaggtagattatctttatgcccaattgtctatctatagccaacatcagcatggagcaataaccgctctaggtcaaataatagccttgcaaattttaatactcactaaataactagacttttctagaaaaatctccaccatgtcatagtacaatgtctttatccatgcaaggtccaaactggaaaggaattttgtaaaaaatattaagtatttccaacagttttttccctctccttataaaagttggtgctggtcagtacaaaacaatcattcaagtgaccaagcaaacacacaaagcgccactgtgtagctcactgctcactcatcaaccaacttcctcaataatgtctcgctccagcctcgccatggcgctcctcctcgccgccttcgccgccgcggcgacggcgaacagcggcgcagcgccggcggctagcgacttcatccgcaagtcgtgccgcgcgacgcagtacccggcggtgtgcgtgcagagcctggcgtcgtacggcggggccggggcgccgccgccgcggagcccgcgcgagctggcgcgcgccgcgctgtcggtgagcgtggacaaggcgcggtcggcgtcgacgtacgtggggcacatatgcggccctggcggcggccgcggcggcgccggcggcgcgggccccgtgcgcgactgcctggagaacatggcggacagcgtggggcacctccgcgacgcggcgcaggagctcggcggcaacatggggcgcgccggctcgccggggttcaagtggcacctgagcaacgtccagacctggtgcagcgccgccctcaccgacgagaacacctgcctcgacggcctctcccgcggcgtcgacgccgccacccgctccgccatccgcggtaagatcgtcgaggtcgcccaggtcaccagcaacgccctcgccctcgtcaaccgcgtcgcccccgccaattaaacatctactcctcctataactaattaagcttttgttcttggaatcttggtcgagttcatcttcgtcatgggttaattagctcagttaatctcgatgcgtcgtcgttgctatggttgtaacatatactgtactgctagttaattatcaagacttaattaaaagagtcgatgtaatattgtaatggttgagtctttacaccgaagatggtgaggaaattaatccgtgttttgcttgctaggtacaattatcgattactgtttgattgattgttttgctgaatattattgtcacatgaggaggaacagaaacagatgagagaaaatcatcatcagcatcaccaaacagggaaatgaatggatcttgaatcgatggggacttagaacaggttaaggaaggcgacgtttctttcttcttgcgtggattcatcggagtttcttgttcctggttggatgaactgtaccaagattggatggagatggacaccaaccttgctgtcctggtatgctcgatcagtaaatgaacggagtgcatttgtctgctctgctccttacctatacgtgatgaattgatgatgatcatgtggtgtggacgttagggtttaattgcagagcagagccaaattgaatgtttgtcggattgaaccaaaaatctcgtgcaaagttcgcaaaaaccagttcgctgctgttcttctttggttgtttggctacaagaaaactgctggtcccatagacagaaatgcgagaaatttgcatgatttttttttgcctccagaaccaacagcaagatatgtatacagatcagaaaccattgtggcattgtacatctgtactgtagtgtactgatacgtggcatgggcgttggccgttggcctgccaattggcgacgcaattatgccagtcggattggtcggtgatgtccttatctaaattttagattaaatctctgaataatccctcgcagaagaacagtagtatgcccaaataaatgggacctt

SEQ ID NO: 42558 - DNA, 13911 bp, Oryza sativa
aatggtggtgatcatgtgctgtttagtagtagtgttttatgccctaattgcctctaatgctgctcccaagaataaccacgccatcattttgccactccttgcttgggagtgacctatgcatggttgaattgatggattctcatgtactactgtatagtaacagagatttcttcatttgtttatgtgatggcaatcatctaaagcttcaggtagtacaggaacatgtttatgccctgtgtaagacatgtagcagcacaagccaagaatgcgtacagaggatacagccggagtggagtctcctccagtgctggcatcaaatcatttcagaatgcaatgtactccgatcctacaacacaagcaggggtaatatcactgataagctcataatctttttaatttgcagcacagcataattaggttatgcactatatatatggttcaggaattggaaaggtggtagttgtacctcacagtgaagattttgtggttcagagaatttgaagcacccgcgttcccacacacattgcttgatgaacagcgtgtcacaaaccgcgattcattgatgcatgtgcaatgttccgcgagaccacatcaatcaggctatcaatgtttcgactccacaaaacacagagtcaatcaacagctgcgccagcatgaatgcgtgatgtaactccaagggaacaagttcatgcacacgtgcgcacggcgaaaacatctgtagctgcggcccccagaatgagcggaccatgtcttcactttccatagtttgaactttgaagcatacagttggtcacagtccctgaattatttgcagtgcatatatcggcagccgttttcatctgccaagaagagcaaccatccagtgagataattgtacatagtgggagatgcacagtcaggctgtcagcagaaggatttggcgagtaaaacagaacatgggagtgtctccatcaatctgaacataaaggaacctggtcgacacctaaaatatatagcatgccatgccacttactgattggatcatgtttaacaacactaggaattacagttctagattctaattagtggtgctcgaatccggtttctggaacctgttgaaactcacctctctcttccctgtcggcaagcagtcactacatctttttttttcttggaagaaacgtctttttttaaagtttaaaacaaagacggaagctctgccttatttcataacaacacgaacccaagaaggggggcacaccaatcacctgcgcaccctgaccaaaaatatgctgtgagctggttctgactaggttggttgaaaggacgacatctttaacatcccaagttcaaaatgtgtagcatagccacagaacatatccagaataaaaacttggaattgatattggaaagagtactgtgagcaggaaaaaatcaaaagaaagtgaccaaataaaaggaagttgagggaattagctagttcggaatatttgtgcaacgatgaaagtgccagagcagtacaagactctgaagtttgtggtacacagagcacagatatgttgtcaggattgtctaggttgttttggcatctatagtgcaatatgcacaataaaaatatagaacatttctagtagaattctagtgaaaacacaagatgtgacaatattataatgatactagtttcatgaagaacaataactatcaacacaagatatctggttttagtgtaaagactgatcttgacagtgtccttaacatagatttcttttattttagaaggtcaatagaagtaccaaatctcaacatatgcacagtagccaaacagttttcaatgaaggaagaagacatgctatgacaccatgatatcatgctcacgttcaactggaaaaaatacatgatcaggttgcattcgttttgcttcatggaacaaatataggagtctatatttccgataaaaaaaatataggaacctacatgtaatatgtttgcatcctgtctaaatggtgcatcgaacaaattggcatcattagctcctagtacaaagtgtatttgtagcgctttctggcgaaggaactagacgcacatacttccaaataaaaagctagagaactagacaaattcctgaaggagggatgatcaatgatgataaaaccaagtgacggggatttcattcttttggaaatttctggtttggttacccattcctaatatgctgaaccagtatgctgtttgaagcaagagaaatcacattttgggattcataaatcataaggaaacccagcttatccctagtgaacttcacttcacgttacgtatccaactattccattgtggccagctgtaaagtcatctcaagacttgcatcttgactatttagatacatgtacatcttttatgtttctgtctatcttgaaaaaaatttattggacctttttttatgggaattactgtcaggcatttgcccaacagtatagctttataaaagaataatatttacatcatacaaaaggacatgaaaaccgtaaaggaaaaaattacaaagattgtaaccaatcaaaaactaattgtttaaagggatccttcattctacacatatgcagaagaagcaaactcttgattggaccttgttcagtaaaactcttgattgctgaacagaaccaaaccatgagacaactttatgatgatcgaaccaggaaaataagcaacataaagagaatagtttatgcagtacacttatgtgacaagtagacaagtaaaaattaatcaatttctaagaccaacgattaagaaaatcaatgattaacggactaactagtatgttaataagttttgatcaactagagaggtcatcatactccataactcatttgtctggtagaaatcctgaacacctaattatttgcttgccctgttagagatatcatgattcttaaagcacgttttactttacaagtgatagtacttatgattaagagctggtttctattggtttgtaggccgtggccctgcttgaaaccagacacggaatatcacaatacataatctgttgatgcatgtctccgacggttacaatgtcaaaatctccatgtggtttagtaatcaaatcatacggacatgtgccctcatggtggtaacacgcaaatcgttcagcaatcaaatcatatggataaatgcaactcgtggtggcaatactaaatccatcaatccatcgtgtgtctccatgtgttactactgaaaagtgacaactacatcgtcttgagaaagctagtaaaatgaattagatttagtaaatagtaccatgcctaattgagaagttcagagatcaagcaaaagcataagcagttcagaattgcaacagacctgaaacgatccttgtgtgcgcctgattgaaacatcagcaaggtataatttccggcaagcaaactcttcaaaaatggatcaaatccctcgctcactctctccacagacatcagtaccggatcaaagccaacaaactgtcacaatggctgtaagggcactgcatgatcgatcgattcaaggcatattgcacgttaatccgagacaatgcaaaaacctattcagattggtatatcaacaaattgcatgttcctacttcagaagttcagacaggtattcaggctggcccgggggcggagtacgaggggagaaggtacctcagctgctgccgcgacgagcagggcgccgtcggatcctctatgaagaaccgctcgaaccatccggtgaggcggaggtggagggcgcgtgccgtcgaggagcgccgctgcggcggcggcggcggcgcctcgccgatgagggagcggagcccatgggcttttggactttggagacgacgaggctggcaaattgcaatgaggtccctccagttacctgtatttgcattttttgcgtggggaagcagcatctggtaatagatcctggccgttgatctacgaatgaaagggcaaggacaaaccacaaatcattagagagcgagagagagggggggggtacagatgtacggagtacaatagtggagtatcacttaaaatttacaattagctcttgtacacgtgttacaattagctgataatccatctattttaaaaacacaggcctaagaacaacattagctacacaaacttttcagaatttcatttatcaggtgagaacaatcacaaaaacatacaggcctaagaacagcattagccacacaaacttttgagacatttcatttatcaggtgagaacaatcacagggttcatcattcttttctgaagaaaagaaaagatggttacagataccacagagggctaatggaaaggggggctagaaaacgaatgtgggaggcaactacatacataagatacctatagcaagtagcaacacgaacaaagaacatctgaacatgcaatggaattactgttgttcctactatatcgaagtctaacaagggggcttggttccaagtcccactagctattcatcactgaaagaatgaaatcactccaggaaaaaaaaaagcctattgactgatcttgcacccacgaacataggtgtgctcgtagttgatgtactttgtccagtatggtcggtacttcgacattgcaatctccagccatggcttcatgttcccgttgtagtggatgacggcggcgttatctatttctgagcgctcgatggatgggttgtaccctaagccaagaacatgccatgatttgtccaggggatgtgttaacttgtagaatgttaggagacctggcggcagtgtcccaagcttccagagcagcctgttttcattctgtaaaaagaacaaagtgtgaagcacagtagtggaatttgtttagtactgtatgctactgtttgtgatatagaatgtgcatctcacaaagtgcatattatgcttttactagttttagaagctaagagggtgcatgaactgttgttagtgcagaactgcatatactacatttgctagtgaaaataataggaattgcagaaactgaaatattgcatgttatagcgaaagaaatttgccattgaaatttctacagaaaaatggaaacagtaatataaaccttatttcaacttaccatgttctgccatttgtgataaatgccagtaatgtccttcttcttccattcttccaaatcaaacatattcattccatacgcccagccacaagcattaggatcgaagttctgagcaatatttggatttgaaaaattgaggtacttgtcaaaacggtgaaaactctccccacatgtttccacagcaccatttacattcccatttagatcaacctcccagagtcctgtcaaatccttctgaacaactatgtcatcatccaggaaaaggatcttattcaacttaggatacacttgaggaaggtagaatcttaaatggttgagcatggaaagatatttggggttcctatatttcagattagaagaaccagcagagagagtttttggacggtctgccttaaaatagtactctttcatggccacagattcaagctgcttcagaacagggcaatatgaagagttcagccatttgaagtcatccacgttttcaacatggattgtcgcatctccaggtggattcaacaaaaaccacatgttcattgctccaaagttcagcttgtcagtaacaagatggaatacatgtttctcaggctcctgcatggtagaaaaatgagcagtttttaccgaatacatgtttctcagtcattgccaagaaattgcaattccaaattgaactctagattgcacttacctttgcattcatgatggttgagttcaccacaactgaagctgccaaaacattgtccgaaaaaagggcatagtgataaagatcaggattttctaagttctcactcttcggaaactttcttttctctggggagagaaggtaatagtctatcgttagccgcatggacaggcaatggatgccatttgggattgtcttcgccgctaactggcttaggaaggtgctctgcttctttaagctcctgacctgctcatcagctgactgaagcatcgctcttaaccgctgagtaattgccttgcaatcatataattgatctcttgcttttgctagtaactggcccattactttgactctctcagaagcacttcaaataagtaagaaaaattagtagtgcaaaaaaaggaaaaaaaaagacctaaagaagagtttaaacagaaattacctcttgggaagttcagcatcagcagtagcttccccaagggagcgctggctttccttaagcctggaaagtagatcctgatgaagatcgagcttgtccctggatttggcaagcacagaatatattctggccatgatcatttgatcacgcatcagacgaacctttgaatctgctttttcattttcattctcacgcctccatatgctatattttccaaggacagccgaatcaacggcttttgaacgttcaattccagcattctcaagcttaactagtgcttcatcatcctgctgtactggttcaatcttcttctttattctggttctctcccgcaatttctgtagtaaggaaatataaaaaaatgcttaagaaacataaggtctcatttggaaacaagtagtaatgctaaaagaaatggcataaaaaggatggacacttctgttcggaattgtaatacaagaaaagctagaatatccctagttaatttgcaagggctttaagtagaagaaagttaccctgtgagttacttcttctggtcttaccagcagctgaagtccatctgcattgagaaataaagcacccacattgaatggattgatcttagtagatgcaatcatatagaattatagatctgtcattgttcactaattatcaccttcttcagttaaggagaaattctgtagtttaatgttggcttgactactccagtccagtacctagtatcacaaaattgtggcagtaagaaaacatgcttcaataacaccaattaaagatgtagaaatgaaggataagtcttcaaacctgtttactagaataaagtgggtccacttgggctgcacaaagcaggaacacttattagaatgacttgatgggatatgctctaaaaccatcacgagtgtccagaaggtgattggatggcttaggtataatgaggaaacatttcatgagaaaattgttcctaacaagctaacacaagcgtataaattgtgaacagaaggggtaaagtttatttatcaatcacttccaagtccaaccccaaagtaagttaaactttaaacagagaacttaatagaatgatgaagggacattatcttcttaacaggtgagagcaatattcaaaaactgagagaattgattgcttccaaaactaaatggcaagcaatgccgtacagaaaaaatgtaatgataaggtaatgtggtcaggtcatacacgaatcctatatgtttgagtaaactgattaactttaactctgaacacaagaaaacgcgagcatatatataaaccctgaactttgtcagcatatgtcactgggatgcaacatgaagactataaattgcgtggagtataacaaacacttatgtctaggataaaattatatgcctgaaattccagcaaaatgttcctaggcattacgaagatgacaccagtagttattttccctataaatatcatgttctcgttggaaacagtgatggcctgacgggtatggaccctaaaacttgtcagagcatgctgttctagaaaaaggtctagtagacccatataatcaattggtaaggccaaatattcagtaggtgctttcactaaattatctaggcaatgccggatggctgggtaaaatgcaatccacctggtgaaacaacaatgtaggcaccatttggatacccaatttataaaggcttacttatgacacagccatgttgatggacacaaatggctcttcctagccattgtgcaaatgtcatcaaccgtcacttccagagcacagtaacgtatatctaaaatgttgcgtgtgaagtgtaaactactacagctagttcaatatgtactgtatcactttatacacaagataccgagtaaaaatacaattaataccaagtgtttcccatgcatgacagagagaatggtaatcacattatgtctatcaacagatattgcatgacaaaaattttccgctctccagtctccacttaaatttcaagatattctcaatatacggtcgcatttggcagctgttaaaaattagagtagctgagctgcggacagatcaacacatgcacataaaacgcgaattcaccctagcctgacaatcgaaagccaaaaatttccacattccacaaggagcaagataaaagtgcagcagcatcactgtaggtgttaatctgagcatctcatctagagaaacaaacgctggaaagaaagaaaaaaacgaaactcctcacctccggtgacggcgacagggaaggcggcgagggcgcagagcgcgacgaaagccatcgcgcgagcccccgccattcccggcccaatctagctcaaaatccacgagaccagccacgcactggccccaaaacgaaaacaaaatcgtaagtaaaaaaacacgcacgagattaaaacgagattgcccacacaatcggcggaaatcaagcacggccagggctgaaatcgacggaccggcgaggggagggcgcggcggcggaggtagatcggcggcggcggcggtggcggagggaggaggggtcgcgctccgcgatccgctccgggatgtcggtgaatcgcctcctcctcctccggcttttggagtggggactgcgagtgtgcctgccagccaggggtgaactgcattctgtttctgtgtgcgggtttcgttccatgggccattgggcctaaccatgctccaggcctgcttaaaagcccatttactcggtatgtgaccgacaattaggcccatttcaattgcaggggaaaggaataagttctcactttaggtcgctcactcaatttgtcgtcgactttcaaattcaaccttaaaccgcaatacctaaatgacgcgttactcaacttccaaaaccaaaataagatctcaagatggtttagatggttgtttcagctgatgtggcatctatgtaacatttgacgtgacatttaaactaaaaaaaactatgggacccatgtatcagtgacggtctggttaattttttttaaaaaaaaatacaatggacccatgtctccctgtccaatctcctcctcctccccaacatgccaccatatatgcaaagccgcagtcagcgtcgtcgtcgtcgtctgccagttctatcgcaacgaacctcgtctgtcggttctacctaaaacgaacctcattgtggcctctcaccggcaagtgccacactcgcacgaacagccaacctgcccatgttgatgctcgacagtggctgagcgagcatcgcctttgacatcacgaaatatagctcccccacccgaagcgactttgccgtgggccagcgccaacaggtggttttcaaagtagagcgcatcagagttgcgcatgaagaaggacgccgtgtcagcgccatcgttgtcactgagcacagctacacgggaggaaaccggggtacacattaagggcttgtgttaattactaacttaatttaacttatcagcgccacacaaaaaagatagatcattagcacatacataatttagtactgattattatatttttttaaaaataagtttatttaattatttaaagaaacttttataaaaaagtttttaaaatatactatatttaatagtttaaaaacatgctaacgaacaattagaaaattatagttttaaaaaaacgaagccttaagcttagctgaggtgtcgacttgaactttctgttacgagtgcgtgtgattaaatctttagcaacttgtttggagctaatctattaatcattccaagctgcctgctgcgattgtcggttcggtcatgtggttaggtgtgtgagtgtggcttaacttaattaccgttggagtggttgcttcatttctcccatcaaacaaaaaatggctggtttagtaatttgactgctcgtgttgccggtcaattcgacgataatttggttattttaatcacacacaaaaaggaaatttgattattttacttgctgctagaacgacgcatcgagatcgcgtggtggaaaagaaattgaaaaaggggtggtcacgtgctaagtgctgtactctttggctcgacggccggatcgtgtggtggccggccatcggacggctgagatgagagatccactggtacttttgcactatgctacctatgatctctcctatttacaactagagggcagaagcgtcggttaatacaaggagggaaaggaggtaattaattaacgcgctaatccaacgaaccactccaagtaaacgcgtgccgtgttacttccatgcgaagtattgagaatctatccgaaaacgaatgtgtgcgtgtgcgttgttcgacggttacgaagaaattgaacgcgacaacgagtgcatgtcatattcagctgttatatcatgtcatattatctatttttaagagggtatcatgtgttgtgtccatgtcctatgtggctatgtgtatatacatatgtacttatttaccaattcgagctatatgtctctatctacatttcattattgttatatctgcttaataaatatgcttttgacgtcgatagagtggttatgcgttatcagtttgcatatacaggattatgtaaggacactttcagaatgcgacaaaagttttcaaataagtagaaaccaaacgtctcccgttaattttatctatgttcatttaatgtttctgttggaaataattcataagttgccagaaaccggagattaaactatttccattattaagaaaaataattcctaaggttagtctggatcactttttaaattcgaacaaagaagttgacttttcgtaaagaaaatattcccacactactttgtttacatgtcaacgttgcaaattaacagttgagattcaactgccacaaattttatgtaaaaaaaaggattgcaaacagcaaccccatatcgttttcgaaatctttcgtctacttcaaaattcaaatgctcactagcacaaagtacaatcactagtatgctgtaagacaaagattaagaatgaaaaaaacacaattcgtgcaactacggggaccgaatcgggaaaaaaaaacaacgacataatctgcagtttacttgtacccacacccactgtctcgtattctattcctcattccttctctttttttctcgctttgtttctcccgtcgtctgatccaccaccgcaacgcacgcacgcacgcgcgcctcctcctccctccgcggcggcgaccaccgcgcgcgacgccatcgccgccacctagggttagggttccggcgacccccacccccggcgatcgcgcgagggatccatccgtcctctcctccatgtccaccgaccagcctcacctcccgccccccgcgcccccgcccggcgccgcggcggcggatccccccgagtccacccccgcgccgcctccgccgccgccgctcgagccacccgaggtgatgcacaagacgagggccgtcgacttcctcggccgccgcaccccaatcgtctaccagaacgacaacgggccgtgccctctcctcgccatctgtaagaatccccccaccttctagattcccttcgggtttcaattcgcccccgcgcgcgcggcgttgtgatgtgtggggttttgttttggttgctgcaggtaacgtgatgctgctgaagaatgtgatcagcttgaacccggacgcgggcgaggtgtcgcagcagaagctgctctcgctcgtcgccgagcgcctcatcgactccaacagcaatgtgcaggttcgatcggtccccgtggggttagagatgggggttgtttgttgtgttgccttgtgaattggttgtggggtgtgattcgcagggtaaggacgaggagtatgtgcgcaaccgggagcagaacatctcggatgcgattgaccttttgccgcgcctcgcgaccggcattgatgtgaatgtgatgttcaggaagtgagtccatggttcggtttgtcggttagcggtttgttgtttatggtgctctatatgttctgatatgattcgggctgtgggcgttgcaggatcgatgactttgagttcacccgagaacgtgccatatttgaccttctggatatcccgctgtaccatgggtggatagtagatccccaggtatgcatctccttatggcatgtttgtttggtttagccatgttgaacttctgtatctagacaactggatcggcgtgcgggttagagtttactgtacttctttcgacatggaatacaataattcttgtgcttggagataacttcatgtgtataccattcacagtttctgttatttagaacagagaccatgtgttcatgcttaccatcgcaacaacactcaataaaaagaagtgtaatatgtatgccagtgtacttgtccccccccccccgatatataccttatacgggcaatgtttaccattgttttgaaaactcgtttgaaagctctatcaagtagctacgtggtgattctatttgataactggtagcactcacagctattgcttggtttcgcaaatatgtatcacatttaattaagctagttttctacattgtttcccaactatgtactagttaagatcctccaatttgcaattcagacagtgcggaacttcctcgtcacaaatatatgttgttttctatgttgacgcggtcttcaaactacaacttctgatcactaatttcttttatgagtaaaagcaagacaatcactctacgttgttttccaactttttactagttaagatgctccaacctgcaatccagacagtgttgaacctcctcgtgtcacaaatatatgctgttttctatgttgacatggtcttcaaactacaacttctgatcagtagtttcttttaggagtaaaagcaagacagtcggactggctctatggttgcgttttgatttgagtattgtatgtgatgctccaacaaaaagcgtatacttgtgtctagacatgataagtttctgtagcaaccaaaacttaatataggatttatttatcttgtgcaatacaatttgttaagatagccagaaggatgctcgaacagcatagtcaatacctccctacatgctggatgcataagagatttcgcttgcctcttacgtctgcaattctcacctgcatgctaattctgattgtttcatatttttaggatactgacactgctacttccattggatcaaagtcttacaatgctcttgcatctgggcttgctgaatttaagtcgggggaatcaacaaaagagaatagacatgtacaggaggaagaaactgttgattttgctgctgcaactactgcagcactaggggttccttctcctagtgtttctcgaggtatatcatttgatgaaaatacactcactgacccagttgagttgcacataagacgaggcgatcgtgaggaagaagaggaactaaggagagtccttagtctatcaaaagctgaaaatgctaatgctgttgatggatctggttcctttgacacttcacagtctcattcatcctcaaatatggaggagacagcacacactgagagcttccaattagaggcagtcgaggcgatggattcaacaaataaggaggaacatggcaacagccatgctttgagcgatggccctatgttacaggacaccacaaatgctgctcctaatattaatgaagttgggatggaggaatcccaacaggttttgacgtctaatgaactagaagacgatgggaaaaggaatatcttgccagagcactctgatataaccattcaaccttcagagtctgtgcttgactgttcctctcat

SEQ ID NO: 42559 - DNA, 2529 bp, Oryza sativa
cgagagagagaatgagtgagagagagagagaggagagagagatgagagactatgataggtgggtcccacatttttttaataaataaaatgctgactggactgtcacgatcaaaaccaccgcggattggatcgagggggtaattcgtccggtttgcatagttgggggtgaagaatgttcggttttgtggttaaggggggtaattcggacgaccgcgatagttcggggggggggtaatttgtactttttccttttggaaatcccctattaaggaaatttggtttattttttgttccatcgaaaaatgtttcacctagtgtattcacaatgtttcactatatatagatttaatgttgcagtgaactgaaacattctttcgctatttgctgaaacattgtttttatataaggtgaaacaacgtccgatttaaacgagtgaaacattttcgatctatttagtgaaacaattccgatatacttggtggaacatcgtgcaacatttaaaaaaattcaataataagctaaaaattttttcgtcggaatatatccatgtgtggtcatgttttgaagatttaattgcaacgaatttaatggtgcaatcggatcatgatttggataagtaatttaagagaaaaatcagtagttttgcacataaatcggacgctgacgtcagcacccgatttcacccgctccctgtccggcgagcgacgcgtagtcgcgtccagaaaacattgtcgtgacccaaggtcacagacaagattggggatagacgggaaaacccccttttcccgcctatcctgagaaatgagcgcgaataccaaatgaacacacacactaagtgacaagacttttagtattccaagatatcctgcctgctacaggctttttgtctgctttatatagttcacagctttacatgtgagattacagttgcgccctttgttgggcccacatgaaattacaattatgcccttgctatatcagctaaacctaagggcattttggtacattatggaggtcattatagtcttttggtgccagctagatgaagtggttgagtggtcctcaggaatattctcttggcatctttgttgtctaagtcgccttcttcatgatcaagagtcttttccaccaccatgggtcttctcctcgaccgagggtcttttccaccaccatgggtcttttccatggcaaatagtcttttccagttcgaccacccttttcgacttatccggtagctgacctgttactgacttaggaaacattcaaaacggataataagacttagtgacaagaatttactcgaacggtattttccgactcgaatagtgttttatcgtttccttgttcgaatggtcatttccactcggatacttacaataatgactcaatctcacccaatctctctctacagtgttttgggccgaatatggagggacggtggtcaccccctgctacaacaaacatatctttaagaaatgctgataagaaaagtaaatttcatcctataccatacgtatcaaattatagtatcaaaattgtacaatagaccttgattcctattttccctcaattatatatgcttctctttgtctaatcaaatgagggcgtgagcaacgacaactagagatacgccgaggagatgaataaccaggagtgcacacacagcagctaccacaaaccgcagaatcgtcgatggccgcacccgaagctcaaatactagcttctgattctctgtcactgtcatcttcaggtaaccatcgtcgtcgtctgcggcagcgtcctcctcgtcgtcgtcgtcagtttgggcatcatcatcgtcgtcagcttgggcatgaacagcttcggacgcatgcggctcttgcaccggacgctccaaccctaaaacgaataacacccagtgagaaactacacaagcacacgatggatcgatcgatacaggctagctcaggacgacgatccgtggcgcaaaattgctcagatcagaaacaggatcagaagcagaagtaattgatcagaagcagacgatagatgatagatcgatacagggtcaggattactacctgaaggtgagggtttggcgtggatgatcctcctgaagcagaagttggagcaggcgtggtaggggttggaggcgttgatgcagtggggatggacgcgcgaccaccgatgattatcttccctggacttcacgatctgccggaggcagtagtcggagcactcgtggtacgggttcgacgagttgacgcaatccggccgcgacttccccggcggcggcggcgacggcttctccatcggacccacgattagctccgccttgccctagatgacgattagctccgcctcgccctcgtcggagaccgcaacgcgtgtgaattggggtttggattgagcgaggtggtgggtttctctatttgacttcattattagtattattctcctcctcgtttgcgagtaagattctaactgggccgagcaggtgatgggcttgcgggcgaggcccatttatttttctcgagccgttgggccaag

SEQ ID NO: 42560 - DNA, 705 bp, Oryza sativa
tatttatattaaattgattattaactagttgtgtctcagaatttttagcttttcgatatgcccttcaacaggggagggagggagggaggaatgaagaggaggcactgacaggttctagacccccaagtggtgtcaatgccgtgccaagcagcagctgctgcagcagcagaaagccaggaaggaaagcatatggtgacaacaagacaccaattaaaaacgccatggccaacaacaagccagcctgaagcttctttcactataacacatccattatttcacctctattttattctcttcacccattcagctgctgattgccgcttcgctagtagtattaatgctgtttactgtgcagtatgctgagctgaaatgttttactgctagctactgtagacatatgggccttcgaaaaggtaagaggagagatgaatggagatgagaggtgggggtgggcccggatgggcagcggctttcacggcccgaaaggaccccgacacacgacctcgattcccgccacgtggctagacatgcgccgtccgctcgatcgtgcctagacggccacgatggcccccaccctctctccctcggggttttaaactcatctagctacgtgcacacgctatatacttagctctgctgttgtgccgtcccggccggcgttgcaagaacccctcccctatagtctctttttttctttggactgtt

SEQ ID NO: 42561 - DNA, 706 bp, Oryza sativa
caaatcctgaggataaatctgaacatgatcatcatgtctagtttcatcatcagaatttgattagagttaagaaaccctcttcttattccttttaatttgggacaagaacacagtcaaatttcaagtcggattcgctcgaggaaataaatttgcattgtttgatcttgacatgtttgagactgatttgcccccacacttaatctggggaagcttcaggaaaatctacgtacgaataacctggatcaacatgatcgtcaaaatagggttggctagcgaattgattaagcccacctcattggtttgattgaagaacacgtcggtatcgtcaacgctgctaattaaactcccataatcatgatccttcttcctttctcctccacaggatcgtcgctcacgtcccgaccatcagaatcttccacgacacctacatacaactatttatttgattgtggaaaactgtttaatctgaatctatcaatggattatttctctatacttaaaaaatatatgtttttttttgtaaaaaaaatgctcttatgatgttttgcttagaccacttgttaaattcattttttactagattaaatggatagtactttgcaacaatagttctctcaataatgtaaatcaaataggacatccaattggctgttaaagtttttatcgctcaacataaaccaaaaacccaaaataaaattgtgctagt

SEQ ID NO: 42562 - DNA, 702 bp, Oryza sativa
cttgtgacagttgcttactttcgcgacaaatattcagcaaagaagcacatacgttaccggcttgtccaggctattattgttggtgcaacggtggctgctattgttctgttgttagaattcacaaagttccaattcattgatacctttaccagccttttggcttttcttccgactggctggggaatcatatctattgctctggtattcaagccttatctgaggaggtctgagatggtctggagaagtgtggttactttggcacgcctatatgatataatgtttggagtaattgttatggcaccagtagctgtgttgtcatggctgcctggactccaggagatgcagacgaggatcctgttcaatgaagcatttagtaggggactacatatttcccaaatcattactggaaaaaaatcacatggagtttgaggtatgatatgtggtacataatccatccctaaggtcagctcattaaatgtctgaaactgattgataaccatttacatcttgaggctccttatcccattattctccattcattggttattacaatctcagttattatgttttagtcctgttagttctgtttgaacatttgattgaattggacgtgttctctaacatgcagcttataagctaatagggctattaaatgattttcacttgcgagtgtgttcactttttagtttattaagctggctt

SEQ ID NO: 42563 - DNA, 2344 bp, Oryza sativa
gcaggttttatacaacgtaccgttatcgtaaacctcttccgaggtattttgtcggttttcatgaaaaactggtgaaatttggataaattttgtcaataagccgggttaaaacctcaaaatcccgaaaaccgcggttttctgacagtgacacgtataactaaatcttgggcttgccccgccgctcgtgttcacaattatgcgtgtgcggagctgtcgtttcctcttctcaagtcattgccttatattttcctcgtttttcagcaactagattggtaagatgctcgtttcaccactggaacgagtttttttagttatttcgtgctattttaaatttcgtactgattgaggctatccgccgctgcaacgattgacagcggaagttataatttccttctgcccatcgacatcatttgctatccactaaccctcgaagcacaataatgcaatccagcgatctctgttattttatgctaccttcgcagggttgaacttgaacctgagggcgcccacggagctaaactgagccttttgacacaggtaacggcattagctctcacaggtgcactcacaagtgataaggttacagttctcgaatggaattttacctctaagcacttgagatgcagatgcagataaccaagacaatttggcacttcgatgattttgcctactctataaagtacgagatgtgatctgagtacgatatgcgcatatccttggtcatccacgttgcaggccgggtcagtcagcgcggaattccgcggcagccgtcgtccacacaaagagcaacgctattgcggaatcgcaagggcagatcatgaaaagaaagtagagactcggtcccaagactccaagcacagcatttttgtgtgtttcacatcagtatctgcccaattgctaaccctggagacatttttgctgagttgattcgatataaacggtgcttctgcatttgcctttgcattgtacaacatgtaacagcttttatgtttgtacaaaccaatgttcctagacagtatggagaggtacaacaacgagttacagtcaaggtgtggctacccgttaattcataaaaagcaatggtacagggcagctgacataaattaaggtgtgtatcatgcccaaatcaacttcgcgctttactgaagcgaaagaacaacggggcaccagaagcacatccatctcactgttgacgaaatcagattcaccaaatcaggtggaacattgcgcttttatgggaaccagcgagaggaaacatgcatctagcaagaaaaactagggctacttgaacagtcagtcttcaaataaagtggagagcaccaggccttgcacaaaggttgctctgtcagtggcttgtttccgcttttgttccctttcctcactcgtgagcgatgagtcgatcctgccatggaaaaaataaatatttcatatttgcatatctcttaaggagtttataagctgctggtttgaaacatactaactgagcacatatatagacctgaatgctctactttacctaattggtctgaccatctgaatgctaggggaaacggcaagtattatgtagacctttatagttgtgaatatggtcaatcttagagctacttaacaattcattgacataatatggactgttttcatcaaatgtaaaagcgtacagctagtgaacagtctaaaaaatcacaaggacacaactgtttaactggtggttgatagtctttctgacatatgtaacaaaattgacagtacctgtctcagacaagaaggtaactgtgaacagtttgtgaaagtgctagctgaaaaataaatcatagagcatggcaggacatgggaactaattggctaatactcaatagtgtttgctatgctttccagacaaactaggatgattcttgaagtaatgctgttagtagtggggttttaggtggaagaatatcaggccactaatgtgattcggctgagcagtgtaaatatatataccttgattcccatggctgagcaggagtatccttatgaattgatgtatcatcaggaataggaactggtgcttttgatcgttcctctgaatccaatgttgagaagcccaggccaaacgaagaaagcagaggatcagcagaaatgtttgtggcagtagtgttgcttcttcgctgacgatgaccacctcctagaagtgcctgtaactgagcatcccgcagatctcggctcagtaaagaaagtgcctggctctcgggaatatcgaatctgcgcatcctgcgaccactctgtacatcacaaataattttgaaaaaggaatcagaacattcctaaataattaagaaaatttatcaaagaattagcatatgct

SEQ ID NO: 42564 - DNA, 1526 bp, Oryza sativa
ttggctatttcaagaagataccccgcaagtttgctactaccgcaactccacaagtagcccaaatattgagttcattcgccaagtcaacccctaaagctacagcgttcctactaatcgaacaaaaggagcagctttgccagactttgtgcgtcatgtcatcagagcgtcagagcaaggagccctgcggcgcagggcatggcggcgaggagctcaccgaggtgtggggctcgtaggggtggtcctcctcgaggtgggcgcagagggacgcgatgtcgtggtcctcgtagcagtaggggcaggccacgtccggccacgtcgcctcctccagctgcatctccagctccagctccatgccctcgccatcatcctccatctccatctccacctcctccattccaatccccgccatatctgcgcgcccaatccaacgaatcaaatcacaaatcagcaacagcaacagcagaaagccaaacaaagattcgagggaaaagtcgagatggccgcataccgtcgacgtgaccgagctgcgccgcgtagaaccgcttggcggcggcgaggctcgagatccagtgctccgagtccatgattccctgctgctgctggtacaaccaccaccccgcgttcgagcttaaggctagaccccctctcaagctccctcttcagcctccctaatataccggttccgtgctccgagtccgagtccgtctccctcacctgctcgagcttcgtcggatcgccgatcgagtcggacctgaatgaatcggagactttgccctcgggaagcctctcgtgattttctccgaagggttgtttgtttctaatccctcaccctccctctgcttaagccttgtggagattttttgatggagcggcggaggaagggaaagaggaggaggagacggcgaagcttcttatcggaaaggcgaggaagcagcagcgggtgggaagaaatggtgcgcgccgtgggattttttttatttttcctttcctttttttttctctctcttttcgctccaccggccgccgtccgagtcagcgccgggcgtgccaccaaacggcaggcgggctccggcctctcctcccataccacacgccacgccaatgacgggtggggcacgcgcgcgcgcgggccccggttgtcggtggacgtcgtgcgtgtcgcggtgatcgcgtcccgcgggaaaccgcgtgggtggggtggagggacgcgcgggcggtagcggtggtgacgcgggcccggccgtgcgggcgggtgcgggtgcgcgttgcgcgtgtggttggtttcggttcgtgggggggatcgcttgcgcttgcggggttggggtggaggtggagccgtgccccgattgcctcgcgtgggggagccctttcgtttcttttttggtgtggaaacgacggctcggcgcggcgattcggtcgagcgaacggcgggcgaggggggttggctggccggttgggtactttgggtgggggggcgtggggtcggtcagtggggcggccgcgcgggacccccgcggcgcacggga

SEQ ID NO: 42565 - DNA, 1255 bp, Oryza sativa
cctgcagcccctctcctatagacctgatgaagtgatgctaatgtatcaaaaaggtctatttgtttatccatctgcatggacagaatatgagtctacaagcaagatagttacatttatgattccaagcaaataaaagcagtaaggtcaattttttttgtaatttagcatctagtggaaaataaaatgtgcaaatcaacgttatggcttcttgtggttacactgtcaactcacacaacttttaagaactcagatctctttcactgaatatcacaaaatactacaagaaaggaatatatcacaggtttaccatcagaaggttcccaacattatcctcagatactgtccaaggctttatcgaaaatggctccttcagtctcaccggttcaggggggaatggagtcaacatgcctggatgaagggaataatcaatcaataatcacaaagtaccacattatttggttaaacttcagatattcgaaactgtttacaacagaattttcactaccaagcaaatgttaggcaaaagtagaaatggctgagctattcctccaatcactactagctaggcatcatttaatttgaagcagctgttaaggcaacaaattttagattactttacccaaaacatcaagatccaagcatggcctaatagtgtcacctattacataacacagtattctattttgattgtgcatgtatttctacagatctgttccatataaatactaatacattgtttttcatttcagtctggttatatttactctattagggatgcacaagaaactgaaacaattctcacaaagccactagcagtgaacttttacttttggcacattgtagtactaagaaagtctaaatttggtcagaatacctctaaaggaatcaagctgctgcaatgtgtcactatcaagactaagcatggatggcaaccctttgctctgtgcagccaattccattagttctaagcactcatcttccacaagttccatgtattcccgtgcaattctgcgtgctgtggctctttcattggcagccttttgccttgcagcctctttctcctttcggagctcctccttttgcctttgcttctctgcctgcacaaatataggcataacattatattactaaacagtggtactggcatagatactacactgcattgcagtttacataatatgaatttgaaaactaactcgtctagattgcttctgcataaacttctccatacgctcatgttcacgcctttgctctc

SEQ ID NO: 42566 - DNA, 10695 bp, Oryza sativa
ctccttgcgcatctgttcctctctctgcaagcataaactgtaaatgacttctaatcgaaatacattaagatctaatgatctgcactaataataagccatacctttctcttcatcatgtcttgtttttcaagctccttcctaattcgtctttcatgagcttcaacttcctttgcaatttttgcttcctcattgtgctatggcagatggtaaacaaattcaatatgtctataactaagatttaaggatatgaagaaagatgcaaatatgactatatggggtcagaggaaaacatacttttcgctttctatccactcgagagccgtcttcatcatgataggctcttctttcagacggtagaagtgagttttcaattccagcaacctgagaaataccatactggccttcgactggaacagaattaaggtcgctattggactgaatcatctcgtaatctgttggtactgctggaagcacctcacgcctgcctgattgaggcaaatggccagaaccagacatttgaccttggaaagcataaccaggtgctgcctcatcagatccacggagaagatgtgatcccggggtatgcgatgacatcctcgaattcgatgcttcaactggagtgtcataataatgagatctgcttgctccctcatgagatctgcttgcaccctcatacctatcacttggctgttcaggaagaaattgatactcatggactgcccgtgatccagcatgagggtgaactgggggcagattaccaaccattgacttttttttcccagcgatcgaatttggaacaaaagggtgttccacgctggggaagaaagccgaggcctaagggaaaaagaggaacaacaaaatattaaacgaggtatgaagaaatcaagaggcgaaactcaaaacttataagaaaacaacgataccaagagtacgctcaatctcaattctcaaatacagatctctgcagcgacaagctaattatgaagatagtagcacgggggctcaccaagaagacgatataaaagggccaaatataaataaggcaaaaaatcaataggcaagtgtgaatggaatagacagctagcatttccgttataaaaggccactggaaccacgaaaggagaatccaggtaatgccagatgagcagaactaatgcatgcacacaaacgtggtgttatttccctttttataaggcgaatatatggcgttaacaggacatgaaacactacaagataattgtgccatgccaatgtgttggcagtttggcaccaactcacacctaatggccttaaaacacgtgttccgtgcagtctagtctcgcagcagggcagggcagccacaggcccacggcaaccgtgcagggccccccaaaatttgggcctacccatgcactaaaaccagtgtctagttcatgtgggatgccgccgcaactcacaaggactacggcatagcctacatgctcatattgacaagcaaggaagacccagtcggccaagccccaaagcaagatgccaacctagtaggctagcctatgtgctgataagagccttctcgttctaccctctttatcccaaaacagatgactaaaggatgagagccagattttaaggattttcaaccaagttgtctatgatagtacgattctttcaattcgcaatgacactaccggagtcccacacagtcattgcatatacggtacctctctcgattcttcttccttgattaccaattaaataccccaggaacacggaaccagcactataagacaatatcctgaacttttttgtgattttagcttcaaacatctccattagggttgaaaagggtatagattagcactgcccaataatatcacgctttcccctacttgactgcaatctaactactaagcaacttcccattaattttctaactgtttaggatcatgtgtcgttactactgttttgaatgtagaaattacttcctgcgttttccatattcatggctccctgcaggtgatagatgatggatttcctttgttcctcgtgtatggggcaggggcctcaaagcacaggttaaggcctgatccataaggggcagctccccatctacaggggacatgctttcgtggcttttctcggcccaggtttcgggtgcttcttcttaattgaaatacctcaggggaagtctttcccctgggggccgagttcttttacagatgatgttcttctcaattaagtttctttttttggtggtggtggtgggtgagggggtggcatgttaacgatttccaaccaacttgtctacgatagtacaattcttttcatttgcaatgacactaccagaatccgatacatggtatctttccccaattcttcttcttcggttacctattatatactactgttccacacttccactggaagtctggaacacgacatcagcactataagggaatatctcatttttgttgtggatttggtttttggtttcaaacatctgcgatagggttgaaaagggtatggattagcactgctatttttttaggactgcccaattatggcacattttcccctactttactaaaatttaagtactaagcgaccttccgctaattttcagaaagtgtttaggatcatgtgttattattgctattttcaatgtagcaattgcttcctgtattctccattccatagtcatggctcgctgcaggtcctgggtgggggatgagttctcgacaagcatgttacagttatagtcccaaaagagtattgattatgagcctgtttctatgcatgtatgcaattttattttgcagctaaatggaaagtaattgtatgtgttttttctttgaataaagggcatccattcttgtctcgctcaggacctctaaaatgttaggactggccctggatgggggtgaagccatgaaagggggtttacatacaaactgggtaaagcggttcatcatatggccaaatctccaaaacattcttatcattttaaaactgccaagacattttaaaagttttgggtaagattacattgtcatggcaaaacattctgggtaagacacatgtcatttcactgccatgacatattaaaactgccaaaacattctgggtaagattacattgtcaattcactgccatgacattttaaactgaagcaatgctactccaaaaggtaagcacataaaaccagagcgggtttattcaatggaaaaaacacaacacacttcaagtcacaaacttacttttggaaatttcctaaaaatatacctttaacagctttgaatcatgcctagaatatatctttgtatcataagatcgcacatgctgcttttgttgctctggaactgttcataatacataaggaaaggaatgtcagcaattaaaattatatgaataaaccggttactatgtaaatgctatgaacagagtctacataatacttctattcaccaatagataagctcagcaatacaaaaattagactgcctttaagccaggctcatctattgtttcctagtataaccctaggctgagaatcgagtgtaaaaccctctttggggctctaggcccatcttgcaaaaacacactggccattggatgagattacaatagattgaacttaaagaagcttcatgtggtgggatccccataagtaaatttctcgatgctgttggatgaaaattatcatccatgcagtgttcaagactccttaaatgtaacccatccaagtctcatctaactgtatgcattctgagttcccatgatagcattttgggttcatattagatggagcatgagcaccaaaaacaaattagaaatagtcaatatacccctgccagttgtagattcaaatttgaatctgctcctttttttaatatatatagacctttttaaataatttgaaaccgctacgaagttcttctttctgaaatataccatcaacgtgttcctctgtttcaagataaaccacaatgggccaagactaaattgccccttcttccaccctctccccttagtcctgacaaccttgtacaaacggccccatgcacttgacgtcacccttgccctcctctatatgctctcctggccgaaccaccactatgcctctcactaactcatttaagagactacaacctgcctcagtcatcccctctccctcccagtcctcccctccctgcttgtggtaacctcaccatgaatgcagagacaaaacaatgtggaagattcacacaatgtaaattaaaaagaagatagctagaatacagaaaaaaggtaatttttcatgactaactactacaagaatgagcagtagaaaagcaaatgcacaaaatgtctattttcatgtactacaatgtgcaaagtaagtagttattaggaggctgtgcaacgatggcaatagagaagtgtagcaatgcacagggaagatgataaaataaaaggtaagagacaattgatgacaatgagttagggtggatagtgttataatcagggatagaactaatgtatatttactagtatatactattcaataaaggctaaaaggagccatcaggctcactttagaggtacagaattaaccatgttaatcataggcaaagagaaagatttataccattgatcatggtgggttcattaataacagtgtacattgatcgctgcagatgcatgaactgtctagctctccaaaatttcacacaaagtttcagctagttttgttaaacagcatggtagcttttcagtttatttaaaaattcctgcaatatgtcctttttgctaaattagtcattgggaatattaacactttataacatggtcttgctaacatagaaacttggcaactggccaaatactcaaaattcacctttgcttttgaaacattatttatcaatcaatcatttttgtgcatcttcgtaacaagtccagttgattttctttatttaactaaacagtgtccatcccataacatcctattgcgatttccctacttgcaggaacaacaagcaattaagtaaacaaaattatttgatttcaacaactgcagagcaaaacacagttggcttaacagtactataaaaaggtgacagcctgcaaaatatatatcactagcattcaagtttgaagttttagcttaatcctacgaagtgcagggttttgggatgcatacctattggtgcaccgaaggagccagggggaagtggatcaaagtcaattccgagcaccggcccgtcatccctcagtggctccccaagctgcgactccacagaatgaatcacccggagctcagatggcatgagctgcatcgatgccaccggtggtggcggcagcattactggtagaggttcataatacctccgcccaatatctggcgcagataacctgggcactgctgaggaccgccctgcaccccttcgcgagtgaactgggggcagcggcggctcatcatacgggctactagcaccgatcagtagctcgccacttgacagcggcagtgctggtggcggcaacactggcggaggtgccatcaatggcaccgctgcagcttcttcctccctccgttgccgctttgtggggggcttccgatccttcagccgccggtgacagaaccacatttgcagctgcctgtctgacaagcctatcttcgcggacagctccgcccgcaaggtctccgacgggtactgctccactgcaccaaaccaaaatcacatccccaaacaccaaaacctcaattccccacccaaaaatcctccaaaaaaaattctccaaacttccaaagcctcgcaaaaccatcagaatccacgcacctgcatacgtcttctcgagtacctcaagctggtaggggctcttcatcatgcgcttcaccgtcttctccccggaaccagacgcgcccgtgctacccgctgacacagccgccgccgccgccgcggccgcagcgggaggcgccggcggggctgtgtacgcagcagagccgtctccgggcgccgcaccgtcccgtcgtccatggccgccgcggcgatcggagactacctccccgcaaacctagatccaaactcctcctcccgaggccaccgccaaacaaaagcacggaaaaactcccacacttttcctcctcctccagggctcgctcgcgacaacaatgaaatgccgcgcccgctaatatacacgccagcccagtaaaaggcgatccgatgtgcggctggatctccgctaccaccaacaccgatcgcagcaaaaacagcggtaataattccaacttgaacaccacgaacaaggccaaaaaggcggcagccacagcagccgctgaggcgagtagtagtagatagatagggatataatgaggaggagattggggaaacagcaggaacagcacggcaacagggagaaggaggaggagagcggctgctaccactactactactgccaccactactcgaactggtggatgattattcatgcgcctccgggattgggttccgatttggaacgcttccattctatgcggccgcgcttaacacacacactcccctcgctcctataataaaaccaaacccttttctttttctttttggcctcctctcctcaatccaacttccctttttattttattttcttttgcgtgactttttttctccttagcaccggtacgagttctgacgagaggaatatttggatgggcagaataattagtggtggagtgcttggatttcttgggggtttgatctttgggggttgcttttgtgcttttgacgagcgcggggacgttttctggtggggggaaattggcgccgtatggagggtgacgggtttgttggtgttggtgcgcgaccgcgcgtgttcgtcgatcgatcgatcgatcgactctctcgtgcagtacgagggacggagggagggaggcgttcgttggacgaagcgtgggggctagattagaactcgcgcgggatcttctgcggcggatggacttgtggcaccgggcgtgtgcacgtgacaggggactgtgaggcctgtcagtgtccgggctgatgtgcttggcgtactgaacagggtttttgtttcctggtgtgtgacaagggcagtgatgagttcagacagtggatttaacggggggatatcaacttgagtggatgggtgagtgagacttggtcgcgagtcatgatggtgttggtgaatttatgtgtgtgtcaactgttaactgtgagcagtagctccaagagaaaatttccgctgtcaacatgaatactccatcaattcaaaatgcatagtaactccgtcacatgaagaacgaatctatgatcgaatgtattatccaaatttatagtattagaatatattattagattaactttatgttattagtttggtgttaaattttgcctaccaatcatttgacaactttaattgtatatactacctccgttctaaaataagtacagtcgtatatccgtgtaccgtccgtctcatatgtaaaatttattactttttttaaaaaatagtcacacataaagtactattcatatttataatctaataacaatataaatactaatcattttttttaataagacgaacggtcaaacattggacatgaacagtgtaaaactacacttattttgggacggagggagtactagccatttagattgatgctaacttatgccaaaatcaatagagttgatatactcttgcctaacaaaaaaaattggtagtacctaaacttacatctcggtagggttttaaaccaaacatgccctatgtcttaaagcggaggaaataagaattatggtatcacacgtgaaagggagagttttcttcaatacctatgctatacaatagcaacttaaaaaataatactcccttcatccaaaaatataaggcattttagatagatgagatatatcctaatactacaaagttggatactcccttcatccaaaaatataagacattttggatagatgagatatatcctaatactacgaagttggatagagagccatatccttataaatatggatggccatatcctatacaactttgaccacaaaccaaacacacccttatattttggggcggagagaatactattatgaatattagtagtgttcaacacagcggcccctagttccaactgaagatagagatgtagaacagaaactagagtaaataaacagagcaagaatagaaaaaaaaagtaaaatccataggctcaagcatcaacggagcatagcattcaacaaaaagtggtgtttactagttcaggatggtggtggagttgagtagccggcggtgtatagatgattaatggcgactagtagcatggagatggcacgttcaaagcaaagccaccaacaagggtgtcactaattcgagcatcgagagccttgacgcataggggcacaacaactggacttgggggaatcgatgaattgaggatatggacaaattgcgttggccagtagcagtgagttgggaacccaattcgtcctcctaatccctagccatctctgggtagggctctcaggtttttcccgcccactctaatttgggaaagatagagtttgtcaccttgtaaactactatttcgcaccccgtctagtcacctcggcacttgcctcgtcactttcgtgccatcgtgtgactaggcctactaaggtggtgtttggttggagggactaaagtagggctaaactttagtccctctcacaaaagtataagtccctaccatagggacttatccttttgtgagagggactaaatttagtccctagttcccaaacaccctctaagtgttaaagttgaccaccgaggtaatccaaccgcctagctcactactagtaggcaaaatggggcatcaaccccttacctagcgccaaatcaccacctagatatatttttttaacaccagatattaaacctttattgaaaacttttattggatttcatcagtaaatctattcaatcattttgtgcaaagaagttagatggaacatattgatacaaaggtcatagaaatgtatgtaggctacatttggttacatgtgtagagggtggctcgcacgcatgagttgtatgagatggatgaagattaagaattttgtggcacactttttaaactgctaaacggtgcgtttcgtgcgaaaactttctatataaaaggtgctctaaaatatcatattaattttttttcaagtttgtaatagttaaaactcaatcaatcatacgttaataccacctcgttttgcgtaaaaaacttattcttcatcttcagaagaaaagaacaccaccttagagtaagtataaaaagatgatgtaaacggactatataagttgccacatcagttgtgtgctgaattggagaagataaaagagaagaacgggctcaaccaagttttgtgagaaaaaggtggatcggttatcaatggtgttagtatgtatgtatagtatcatggtgaaaggcatgaatcctgttgacatgtttcctccctagcctcccaaggttttaatctcatgaggtgtactcgtcactcttccacggtcattaggaatgaaatatcattaccttttcgatagtaaattgcacagtgaactatatgtttttatcgatgtgatagtttggactaggggtaaggcattatttttagcttggactatatataagtttgcaaaaggtttcaatttggacccttattctccatcctcccgtatcaatactctagattgtcatgctggtgagctggtgttgagctcgcgatctttttgtagtgtctcctgctaccacatctatgacccactccattgtcgtagccctgaagcatcgcctcatcaccaccattctcagataactcccactgtattgttcaaaagcggctccttatgttgcagccatggagcaccaccgcccgcctccatcttatccctaagcagcctcgccatgcacaactcccactacaatgaccttggagcgtcacccattgtcatagtccttgaggactggtcttgccttcctttttgtccccatgctccgactatctaagcttgacctttatcagcaccatttcatcctcatgctctggccatctaagctcgatctctatcgctctatcggcaccatgagccatatactcaagctcatgcttgatctctacctagggcctcgtgctcggaacttagccaagcctttctcattaacacatcaaacttgaagagcgagagagaggggaggggaagagaaagggaaggctagagaagaaagcgttcaaactaaaatatttggtaaacttaccatgtccaaaatgaaaatgttattgtacccataagtgtggtaggctaatgcagaggccatgggcacacttatgctccaactcctcaatccctccccccccactcacctcctcgtctccacttctccccttgtgacttctctagccgctcttgtgccatgcgcacgaagtgcttaacgtaatgcgccgaacaaacgacagtagaagctggtttggataagacggatggtatgttgcgtgagcatgccttcgctaggaactcgcttgtgccttgcatgcgcgggttagaacgcacatcattatctatcttcttgatctactagttgacaaaccagggaacaggagaaaggaaaacacaccatggctttctcttaggagaagatcaaaaccaatgcagatatgcaagcctcctcgccacctccttttt

SEQ ID NO: 42567 - DNA, 1272 bp, Oryza sativa
aattatataacctggtttgaaaacaagcccaaagttgttcaagttcatacaaaaacaaaagagaaaagaccactgggatcaccagctttccaacaaaggcatcacacatctgcctcagtgctggggactaactagtatctgggttggaaactaactagtatctggcaagtgaacttgacagcttcctctggtggatggcagtgctggggactggcaaatgatactggaggagcagaatcagggccaacctctgggcttgcaaaggcaacagcatttctcgctgtcatgtccttgctccctcttgcatctctcactgaagcaagaccctcatggtctcttctatcccttgatggcttgataatgggccacagctgccaggcagcaagttgcctacccagttcaggatagccgacaactcagacatctagtaatctcctgccgaacttggcctgcaaaacaagtcagaggtttcaggggatgattagccaccaactagttaactgctcaaagcattaatgatatttctatctgtttataaccaaaaacatcctgaagagttctgttgacatcagtacaaaatttgatgcagggtcatgatggtcaggacgtcatatccaccctccgaaatggttcagcagctgtgcatgctgctgctttgatgaaagaaagaggctacacccatcgccgtagatctcggcaccgtctcactcctggtaccgtaaaatttgctgctttccatgtgctgtcccttgaaggaagtaaaggtctcacgatattggaagttgcagaaagaatccaggtttgtttccacacagatatgctagctcaattttgctttgtgattttcttctttttgttctatagttgaatgaatttactcttttttatgtttagaaatctggattgagagacctcacaacaagcaagacgcctgaggcatctatagctgctgccttgtcaagggatacaaaactttttgagcgaactgctccttcaacatactgtgtcaagtccccttatagaaaagatccagctgattctgaggttgtgctgtcatcagcacgtgaaaaaattagggcttttcagaatgtgatttctgactctgaagctgaaaaggaggctaatgatgccgagagggatgaggattctgaatgtgatgatgctgatgatgatcctgatggtgatgatgtgaatattgatgtaggagatggcaaggatccccttattggtgttaaagaacaggatggagtaccgattacaactatagtagat

SEQ ID NO: 42568 - DNA, 2668 bp, Oryza sativa
taataataataatgagataattgaccataacagtaatgcagctaatgcatcttatgagaggaatggtttagggcaggacatagctgcaacaccagatactttgtcagttcagcagtatgcttatgctgataaaacacggtctcagttgagagcatacattggtcatagagcagagcagctctttgtttatagatcgctgcccctaggacaggatcggagacgaaaccgatattggcagttttcaacttctgcatcaccaaatgaccctggttcaggacgaattttttttgagtgcagagatggatactggagggttcttgacacagaggaggtagccttttcttttaaatatctactgattcaacttgattactattattgctctcgagtaaaaataatgtcacattttcgactatgtgacgtcaaccttagtgaatcatgaatatttatttgtattagacatactgaaatggtacatgtagatttatcggcttatcgctaaaaatgcctccatgaaactatagtttccccgtgtcttacaaatatattacaagagaaataagttgtcatttacattttggatgtccttgaaactgcaagttagattgatatgctaatttgtatttctatctttttctatacgctataattgttcgaatgcaatgtgttaatccacgtatgaggattgtaccatattcacattgcttgataaacatatgaatttttgaaccaattacatgtccgcatgctccatgcacttatgaggattgtaccagattcatgtttcttgataaacatatgaatttgtgaatcaattacatgtccacatgctccatactggtatctaatatcataatgccctctggtcttaaactacacatagtgcaacagcaactgcttgttgaaatataaaccttatgccagtttttgccaccaaatggtgaattcccttgtacttgggcttcacactgagctatttatagttttgagtttaagacatgcataatattgttacggagattatctgcatttttttttaccacaagtgcctgctcttcatgcttttgcattacagtggatgtgtagttcatgataacctcattaagtagaaatgtgattgatctattgtcaatgtttttttttgcataatgagcagcattttgtgccagaactgtacataaatcgcatgctctctaaactttggacattgtatctaatgaaaatgcaggcatttgattcattagtagcttcccttgatacacgtggcagcagggaagcacaattgcattcaatgctacaaaggatcgaaccaacctttaaggaggctattaagaggaaaaagagtgcagttgtagaacaatccgctggaaggtatctaaagaatggagctacggaaatgattagggcaagtatcgtagtgattttggaagcccaagcagtaatctttctggtgtcacttctgatagtgctatagcatattcagattctttcaaaatagagcttgggcgtaatgatgttgagaagactgctatttcaaaaagggcagatgtctttataagatggatgtggagggaatgcaatgattgcaaattgacatgtgccatggagtatggcaagaaaagatgctctgagttgatgcattcttgtaattactgctatcagatttacttggctgaagaaaggcactgctcttcttgccacaagaattttaaatctattcacaatttttctgaccacgcatcacaatgcaaggataagctaagaactgatcataactggaagatgcaaactgcagatcattctgttcctataggagtgagattgctcaaattgcagttatcaaccattgaggtcaagtaacatgttttatgtttgtcacctgcttctaagttgttttttttcttttaccagttgaactgtttggaaacgtgttaatatttttgtttacaggcttctattccaccagaagcaattcaaccattttggactgatggttatcgaaaatcttggggtgtgaagttgcactctacaacttcgttggaggaaatatttcaggttctggatttgctctcctttagttaaaccagtttcctttttgactggcatacatctattacctttggttgcaaacttgaacatttgctggctataaatagctggattacatggttgacttgaggccttaaacaacctcaaacaagaatcaattgagaacaacctcattctttgttaatacatgttgaattgctaaaatagcttgtctcaccttagttatcattttatgatgcgggattttccatcaaattgaccaggcacatggttgattaaaccatgtaattttcatccttactgcagatttgaattaatatattgaactaccagtcccaaggatgaaagacgccaaccattttctttaagaatttacaatttattgatggctttcttgtatcttctttctgtttccttcttctgaaaactaatactacgggggtatatttataggcaaaattggttctgtagcatcgaaagttcccatttttacttttatagcatcgaaagttcacagcttactagaatagcatcgaaagttagctctgtttctcatatttagcattccgtcaacaactctgttagaatctcatcggtttcctttttttttaaaaaaaaa

SEQ ID NO: 42569 - DNA, 1318 bp, Oryza sativa
tggaatttttttttctcactggatcattcgaatcggccgtggtcggaagcaccgcctttttcctccacgctagatgcttagtgcgcgaggaagtccaacagctggcatcaaccatgctcaatctaacagctccgtgctccaggccatctcgcctccacgggaccatggttccgcccttgtctctttctccctgagatcgaactccactactgccgccctccaacatgctcctgcagccaccctcgagttcgctcccgcagccacaatagaccgtgccagctgccgctgctgagttcatcgactacaccatcctacacctcgcctaccgctgtgccatggaggatgaagaagacgtaggggcaagggggaataagtgacggaagttctaacggagtgttaaaagaagtaacggagatcacttttgatgctattgaagtgaaccacaaactttcgatgctataaaaacaaaaacaagaactttcgatgctatagaaccaattttaccttatttatatgattcatgttatgacagtatgatacttgtgtgtttgtcagtatatctgattgtctgtacagatgcatggatcacatacatattattttgcctttgacccttgatacctctttcatttatcagctttgcacctcaatatcacggctgatgttgtttcacttccttgtagatgttgacactgctggaagccgcaataaaacgggaccacctatcttcagaatttgaaacaacatctgagttgcttaacttgaacacacaagataatccatcccagaatcatgttggattgtctggatctgctgctgtacttccatgggttcctgacactactgctgcgattgcactacgaatgttagacctagactcagcagtatcatacatgcaaaatcaaaagatggagagaaatggtggagatttcatggtaagttttcatgttagacctcaaagtttctgtgctctggtaatcatatgtactagatgttgtagtttgtctgttaacttctccggctactgcatttatacaattaaaccatgaaatgttgtcatatgttagagattatgatttatttgtacattctgcactttgttgtttgtaatgctaccatcagtttcctttcagtttgtaaattgtttcctctgtttgtgcagaagcctccatcaaggtttgtggctgttaagaatgcacaagaattagatccactggaaacaaccggtttagacctttttgatggaaggtgggctactggtagtggccgtaggggtcgtggacgaggaagtagagggggtagcaggggaggcagaggc

SEQ ID NO: 42570 - DNA, 19992 bp, Oryza sativa
  unsure (1)..(19992): unsure at all n locations
tgccagaacacgctgccccagagtaacaaaacttgtttgctgggcagacatgaaccaagctagagaagacacagaaccagtgaaaacatgttcccgaaccccaaggatttttggcttgcgaattccataatggcgattgaactcctctagcagatttctcatcttgagagcttcttcaaaatagttgtcttggttcatatcaatagtttggacagcatcaccccttgtgaagatgagtgcatgattttggttctctggtttgccttcaccaagcttcagtggtccaggcaacttaacacgataaatctcaacctcccgctgcagttgctgatcatatttcacaaggacagagaaatattctgtttcaccaccattggagttcttttcatcaacataggcaacacgtagtgcttcataattcttcattagctctaaaatctcaaaagcatgagggtcattcttagctttctgctgaccgtaaatctggcatgcaaccacataagtgtatttcataaggacagtcccatactcgctgcctttaaataaggtgcttacactactgcttgccctgctcaatgcacgtgacgaagatgtcctgctgtaatatcctgacccatcagaacccacttcccgtctcgaagatcctatccttgatgagcccatagtagcaagctcccgggatccagtccgtaagtcatgttcagatgcagaatcaagaaatgtcagcatcttgagagcttcatagtagtacatcattcccctcacagtacgtgatagtgtctgccccctgtatgaaacccagtgccggagatctctcagcctctgcttctcactgtacagctccttgatattagacatcccctcacgcttcatacgttctacaaagaactcccattcatcaggatagatttgttgcagatagtacaggattgagatgccatcttcattctccttatagagctggtccttgctgtacaacacctcttcattgtagtatggcgtcaagacgctgaaggccatcatcttctccacctgggtggcccgtggtatgttcatgaacaacgaattactgaagaaagcaatccttcgacgagcttcaaggttctttgggacattgatcatagaatcccttgaggtcaggattgtgtgcatgcgccttacttgtttatagaaggtggggttcttctcttcatcaggcagaacaatagtgtccacgaagagaagcctcgtaggccttgactgtgctaaaccttcattcctcagttgttccatgctccttttctcagcctggaagtcacgaatcagaacatcatagagagtctgcagagcattgacaatcttggtaatgtccttctcaggcttcagaagtaagctcaatatagcaacaagctttgcatgcacatttggcagtacagacatcttgtactccacagtgaacttctccatgctcatggattcatcaaactcatggaacaattgtgtcacaatcccatgatcctcagtatcatccttgattatcttaagcagtaagtactttgcactatcatatacctcaatcactgcacatctacgataatcgttcttgcagatcttcctccaaagcttgcgatcaggtccttttacctcctttgcctgaccaagtgcaagtgatagctcattacagagcaagaaacatggccagcggattacacgcacattccacagctcaggtgggagctcaagaagctcaacttcgcgatcaccaacaatgtcctcctcccggaacttagtaattatctcattccaaacaagagcgaatctccgtgcctccacctgatttgactcgattttccggaatgatcgactgaagccataacgtagctgtagcctctgccagaaatttcgaagccggttgggcaagaaactgcgttcattcacctgctgttcctctggcataatgttgaatgacattgcacttgcaaagaactggaaccgaagacgcagctgtttcatgtccctgatctcccccagatgtgcaaatagccccacaaatgcacccgtcagtgaagagaagatagcataccaaatttggatatccatgagatagatcaacaccacaggaagccacaatacaaacacagcaaatcggttgctcttgccaaagaactcatgccaagcgtaatcaatctttttcaacttatatatttcctgtgtaggtttcacgagaggcctgatctggagaaaatagctgaacgcaaactttacagcaagcagaagcacccagaagacagaatacttgacattatcaaaggtgccctcacgcaaaccgcggccaacaaaacttcggctctgaaaccaccatgtaagagcataacatatcttccagtttgtcttctccaatgcattccgcacccacggcacaataaatagcacaatggcaaggacctctgggatcataaacactgctgctgcatacaggaatctcataatctgtgaattgctgttcctgttgttccaggcttccttgtacaagatcgcaaacgccacaacccagccagctgccacaatggccttgagcaccatgcgcacagcaagcatgcggccatccctgaaagcacgccggagctgtgtaccaatatccagtagcgcctgaaggaagcggagagcggcccaggtgataaaaatggtgagaacccgcacctgcgtgttccgattacccagactcctccacggcagcccctcactctcccacgccacgatggctgcggcctgcatgtagagcaccagcatcacccacagcctgtcgaagctccggtaaatgttccagaacgagcggacctcgactaagcccgttttccgcacgcggctgcggtcaggaggcgtgcggaagaactgccgcgactgctccatgggccacccgaggcggtcgaacacgtcgcggcgccagaagtactcgttgatgtcgtcatagtttcaccaggcgctgtggggcgcggtgccgttccggctggactcgacctcggcgcggatgacgccgtaaatgggcgtgacgacacgggtaaggaaggcgttctcgccgtgcacggcggggttgtcggggcggcccgtgtaggtgtcgatgtagccctctaggatgcggtgaagctcgagcgccatgtggtggtagatgtagcagaggcactccgggacgaagcggagattggcggcctccccccacacgagcaggtggagccccgcgaagagcagatcggcgcgcgggtcgccgtcggggacatacacgttggggcggcggccgaggaagccgcaccaggtggtgtagttgcggaggagcttcctgcggagggtgcgcgcgatgcggggctcgagcgtgtcggagaagtcggcggaggagagccgcatctgcgcgttggcgaggaggagcaccagatgctcccgctggttccgcacgttgtcccgctggaacccgaagaaggcgccgagccagtccatgaggtcctggccctcgcgccacgccgagtagggcggcgggcggagcccccccaccgcccggagcgctgccgccgccgccctcacctccgggaaccgcagcgacgggtgctccgcgaggaggtcgtggatggggatgatgttgtacggctccgccgccggtgaggcgccgcccgcggccgcgccgccgcggcgctgggaggcccgcggcgtcgtcatagtggcatttgggttttagggctagatctgggggcggattagccggcggtgagggagggaggaaggaaggtgagctgggttttggaccttggggctggtttgaaaattgaattctctcttagctggtgttgtggggaaggaggaggagatggaggggcggaagcggaagacggaggcggagcggaggagcccaaacggagggtcgcgtgagaaacagaggacgagcatgccggacgcgtgcgcttgcctgacggggtggaaaatgcaaaatatggcgcaggatggcgagaactgccactcgtgtaaaaaaaagatcttctgaagtagtactagctactagctgttgccccttttatccggggtaaatttttcttgtgcgcgtggcgcgtaagtatctttcttctctgcgataagcgtgtatgtatagagatcccacgttttatttgttacagtttataggtgacgataattattttctgagaaaaaaaatatcagaaggattagtacgcctctctggacatcatcgtggtcgattaagatggctatcatcagtgaatgcgccattaaaacacgttttgcggtcaatatagtggttcattaaggaaaagtatggctttaaattaagacggtcattcgcacaaccattagctataattgttggtgcactagcctgtttgctacctccatctctctaaatggtggtgttttttggtattttgtcactactttcaaacttatttttacaaaaagtattaaaatacaactatataaaagtttttcataaaagttctattaatgtttttttgcattttcaaatcctaacattttactttccatctattactacctgttttaaaatgtcgtcttttctagatggagggatttttttaaaaaaaaacaaggtaatcagtaaccatcagttacacactgaaatatactcttacgcgtcagaggatatgtatttgttttttctgatcatatgattatataaaatattgaataattcctcgatttcatgttacataatgtgttggactgtaaatagattaatgcaaggacgtatgtatatgttccatataagtgtccaatttatatatatatattagtgaatttagatgagaaatggatatgccgaaacatcttatagtgtgaataaacggagtagaatataagcggttttgaggttagagtgaaaatgatatatattactctataaagtatttcaaaagcagatttctagacaaaatctacccaagataattatcaccggtggagaaattgtcttcactcccggtttgtaaccccccatagtcccggtttcccaaccgggactacgaatccgggactaaagatcgctatctttagtcccgggtgaaataaccgggagtaaagatgtcccggttggtaaataaagagaggatagggacaataccggatggtccccttttctttttttttgttacttttttattttctcacgaatcggatggcatgcacatcccaaatcaaacctcaaatccccaaataaagtaacatcccaaatccacatcacaaatcttaaagttattatacacacaaatctaaaacatcacaaatcctaaaaaatttacatacaaatcaaatacatcacatattatacatctcaaatccatacaatgaatcacaaaattacatctcagtgaatcacaaaatatcaaaaaaaaagagagaacaagtaactttaggggagggaggacgtttgtgcgcatgtgctcccctgcaacgcacgtctgcgccgcacgccgcgtgtccgtccatccaccgcgtccgtgcggcgcggcctcatacgtctccaggggagggaggaggaaaggaaggggaaggaaggaggagcggcctcatccgtctccaggggagggaggaggaagggaagggggaaggaatgagaaaggggaggatctgtgtaagataggagaggggaggagggggagaagataggaggatcgatctgtgtgtgaggaagtggttgtgattgtggaggagaggatgagaattagggattatatactatgttgaattttagtcccggttggtaaccaaccggactaaagatctaagggagtgtttgggagagagtgggacttattgttttgtgagaggggctctntnccnnnacaccccctaaaactatcaaccgggactaaagtggtacttaagtaaagatcctcggtcccctgacatgcctttgacagtggatgaactgggactaaaaatcatatttagtaaagatcaatttttttaaccgggattaaaaatcatttttaatcccggcttttaatggaaccgggactattataaaatttagtcgaccggtcaaagatgatttctccaccagtgtatcatgtagtacatcataccaaacataatgtgaaaaaaaatatcgctgacataatcccgtcctagtaccgtatccatatccaatagtgcgacaccgaaacaaccaaccaacaagaccgtgtttacaccctagaggttgggaaaacttgtgattcgtcgtccctttcaaccctgatgatgcaacggtcacacagacgtgaatgtacaattcatacgaatttgaaaggtccattatttatcagaaaagaaatcgaaaggttcctgctgcaatcgcctttccagtgaattcctcgcctagtcgcctttattttttcacgtgaattcctgccgaacgcgtactctctcacggtacgtaaacataaagggttaattaaaccacttgttcttcccgtcttatactagtatcataggaacagtacattagcagactataaaccagttataaacatattttaaggagataaaaaaagaagatagaaaagtaatgtggctacagatttgtaaccagctgtagtacggactttaaaatgcatgtgtgtgtataacagataggatcagacattaattatatagtaattttataggtaactattatatgaattgactattaattgactataaattataaataatatgaaccaatagttagctatatactgttaaacttgctctgaacttcatcttgagtgccggcggctggctggttcttttcgcattaacaaacaccgtgtgcggccgcatccaaactcccaaagtccatgagcgaacccgcgtgagcatatacaacttccagtccacaagcctgtaatacggatcgacacttcctccacgcatgtccgtttccacacagcacagtacgtttcatgtactccctatgtcccacaaatactcaaaccctaaattttcaaggtgggtttaagaagagatacaaatgaccaaaatacctctaattatgaagttatattggtgaatgggtagatgaaaagatattgaagaaataaaatttctaaatttggaaaccaatggtagataaaagagtataagttggtttattttagaataaattttaaactttaggagttaagtttatttcgggacgaaggtagtatgccaaattgatgccttgtcctggttacgacggatcatagatccttcaatattcgagactgctaacaaaaagaaatattactcccctccaacttactattgcattggtgtatgtgaaggtgggaaacacgtatacattaaagtagaaaagttgataaataactacatcaggatttgaaaaaaatgataatatttactcttttttattggtatatgtcggattggtaaaaaatgaagttgttttgaaagcgtacattaaatagtcaattcataaaaaaaacaacttgcataaagtgatgtaatgtcttgtatatatgagtttttgattttgcataaaagcatcacacattcctgagtgcaccactaacacatgcttaaagggtggaaatcggcgacaaatctgtgagctcactaaattcatattaaaatcactagtatcgaagctctaatatcccgactccatcatcatgtataatgtaaaagtatcttatacccgactatgagcggtcgaaatgacgaatcaaaatggattagagatgacaaggggatatttcccaccagggaatgcatccccatctttattcccgtccccaccaactgcaatgggaacatcctcccatagctccttacccgcttaaaaacatatttatactttgatatatattatgtcaatatattagtagatatctattaatccatatgacaagaatacattattgtccacattcactaatcatagcacgctaaaacatgtatagataccacatggctaccatccctctttcctaataggagaatttccataggaaagggatgtgggcattgtcatccctaaaggctagaatggacatatatacaagtaggatgaaatctttgcttgtagagagagaatgagaaaaatgttttttctttaacgagtacggaattggtttcttcgtagctttcatatatccaaaagtcacggcttcgtgaaaacctgacgagaaaatattaattacggacatgacttgttgaaaacaattggaaactagtataaaatctacttcggttgaaagcaacacaaaatttcacatacaccggacgcaatagtgatttcaatgccttccttttcacttcacactatgaaaaaaatatggtccatgcaaagtaaccgattcaatatatattctagacaaaaagaaaattattttacagtactatatacatatattcttgaacatttttctgattaagacgcaaaatttacaacaattctgttagcatgtgttttaaactatgaaacgatacgtttcgtgcaaaaacttttcatataaatgttactctaaaacatcaataaagccattttaaattgtataataattaaaactcaattaataatatgctaattttttttcgttttacgtgtccttaatccttattttcatccgttataaacggggcctcaaagtcaccataagtaggcacgataaggttgtatatttccgaaaggagaacatgagttctagatccgtttggacgcagaaatattctaggttgtttttccctgtccatgcatgttgcctttatagagaaaagaaaaagaaaagaagaagaaggcttgctcggtcagcccactcaaccgccttggctggattctctgtcccatcggcgtggccctatcatcacctgtgcttgggacggtgccgcggtgggattcgccatcgaacgggcacggcgtgcgcgtaccgcagcagcgaaacttcaaaacctggagggcgaagccgataaacgcccatgtgcccgtccgcccgcacgtcggcagcggaaaaaggctggaaagccggaaaaagccgttgaacgtcaaaggagacgaccgttaacgtggcataccgaatttctagtactacttgcgtgctagtagtagtaactaacgtggacgtggtattaccgaatttcgccatgacctgggggtgagtacctgacagttggactcgtgactcgtctgcgcggagaagcatctgcctgctctgaggtccagatccggcacgaccggcctgggcacttccatgtgacccggccgcggggccctccacggtttgcctcgtatagcactctcctcgcttgccgtatgctcctgcgtgtacttgtccgttgtgtagtacttaggcggtgtttggttggagggactaaagtggggctaaactttagttctctcataaaaacataagttcctacatagggacttgtacttttgtgagatggactaaatttagttcctaattcccaaacacccccttacatgtaaagggcatgtacaatgaaggccacaagcataagtggttttaagacgtacatcacgtaggatagaaccatacaaagatcatactgcccggtgaaaaccactccaaaacgtatcttgtatttcagtctctgtttatttatatatcagcccttatgttgtatgttattatcaaacctattaaaactttatattttagactctataacaaccaaaataagtacatactatgcacccttaaacactatgcggacccattgtcagcctcttccccctctctttttaattctctctccctctttccccctctctctcttgagccatctctctccctctctcatttgccatatttgccggcgagctccccatctcggtggcggatccgggttctcgacggcggatccggacgcgggctcgacgctgccgtcctcctcccccacgacggtgcggacgagctcgccgacggcatggcgagcttggcggtggcgggctcgctggttctggcggcggggccacaacgcgatagttcctctccccctcccttcttcgcgagcgtcggcggcggatccggacgcgggctcgacgccgccgtcctcctcctcccacgacggcgcggacgagctcgccgacggcatggcgagcttggcggtggcgggctcaccggatctggcggcggttcctctccccctcccttcttcgcgagcgtcagcgtcgggaagtagcggtggcggcggatctgacaaccggacgaggcgacgcacggggctccagctctgccaccgcgtggcctcgggccgtggcttcgttcttcctgggctcagacgcggcgcttcgagcggttcctccgcaagcgcggaatcggtaatgcggagccatggtccccgctgccacgggtacacgcgtccgatatagagccgtgagaccatgagcaagagccacacgttgtaaatggcctaagactacgaagggtatgcttgtggcatggcagccagcgaaccataataacgggacccttatgttgttattatggtgatcagtattttcttatgttgttattttttaatgctataaaaatcatataacttgatttattttgcatcgaacttttgcaataataacatcgagttctaaagatttgtaaattcatcgtgaaaaaaattgtggtcaaaactcgtataattcagtcactactaatagttattaaaaaagatagatgtagcatgagatatggagtagttatgtaatattattagggtgcttttgattaggctaaaacgagaagagttattagcacataattaatttaatattaaataataaaaacttaaaaatattttttttaaaaaaaaagttattatagcagttcggtaagtgtaattaccaaaaacaatgtagtagccaactcaagaaactgattcaaactctagatgaatctattactactacgtcaacagtaagaaaacatggtatctttgttgctttcaaagttaaaaaaaaaagtccatcttgattcttgattactaaaatatccgaataataatggcaaaacctgtctctcaaatcctaataccagattaatcactcccctaagaagaagaattagagagatttattccacacctttaaatatggaaaatggaaatggaaacaattttcttgtatacagaccattttccaaattttaccatatatttacagaaactactattcttttatattatgttaattaccacatttttaagtatgccaaaatctatggtacatttctttctttgacatatagttagaagcccatgaactcttcaaccaaatccctatatggaatactcctacaaggttaaaaaaagataatctatagtttacatagtgtaacattcaatttatttcatcatattatatacttgtacaaagttaaatgtgtgattttagagtttaatattttttatatttattacatgtttttaatcgatatcgacatgtttctgtctgtataattccgtttccggctttccgatattttgaatttcgtttgtatttctagctgtacggttttcaactctatttttcgagaaaaatgtgattatggaaatggttgaaacgttttcggaccgttttcaaccctatcgggatgaacccctctctccatctcccatgcaaacattaagtacacaaataaaatagtttcagcgaaaaatgaagggaatcatgcagtaacccatactcctatgccagattcataagttgttcgggaagcacacggcctccgaggtttaatacatgtaacctgatgtaattcagcaacattgggattgccacacattcgtttctcagtaaaatactccagagagctagaataccttgattctctttgccgactgtgttcatcgttttgacgtttatcatttgtttatgtgccacataagagcgacgaccctcactataaaaatgttgcaattgatctggctattaattcactggtgctacgggtttccgacataattctgagatgatgagaaaacggattaaaataactttgtcgacaatgaggagatgccgtactcctgtctttggtcggcgcaacaggatagaccgatcaataagagtcatgtagctcctcctatccacaacaagcagctgaagaaaaccagagtttgttagactgttacaagtcagggtcatctcgtcgtctaaaattagctgaacaaccccatctgtccgaaagaacgcctgaaacaagcaaatgatgtgtgcacaggagataggaccaaatggttaagtatcttggatgtgtggcggtacttttaacaaaagcacaaatcacggtagctttcggtcttggattctgcgggaaagaagaggagacatgcatgcatgtcagcatgtggggctgaatcgctgagaaagggggagaggaaagggccatgctcatctactgatctatactacatgtgagcttgcccgatctgattcgctaggagaacagatggaaggcctggtatgcacagcaacaataatagatcctttcttaattactccctccatactagtaaagaaagtagtttataacagcgacacggtctccaaaacacaactttgacttattgtttctataaaaatatttattgaaaagtgatatatgtatacttttatgaaagtatttttcaagataaatctatacatataatttatattttcaaactcaacaacttaagagtttttcatgatttatattcctcagttttgacttaaacattgttttaaacgacttttttttatgagtatagtgggagtacgtgtcgacagaagagacaagttcaagtttgaagaactcaggctataggccgggcagctgagaccaaattaatcaagttcagactgaagaattcgcaacaaggacaaataaggttcatgacatgaagatacataaaggccaatttcaatttttttcttcaagtttctaactttttcgtcacatcgaacttttctacacacacaaactttcaacttttccatcacatcgaactttcctacacatataaatttttaactttttcgtcacatcatagaaaagttaaaaatttaaagaaaaaagttggaatctaaatagagcataaacacagccttaagttccagttctagctaaagcctcaggtacgggtcatatccacttgccctgaaaagtcagaacatcgcattcgatcaatacaagttagcgcgtaaatttagctgaactctcttgggggttaaccgggtaagcgacaagttaaccatagccgcacatgaagtctcagatctccgcaggggggaaggagccgagccgagcgaacacacacagcaccgaatttcctcgtttttccctacccgtcgcactcgtgcccaacccaacgcgtacgtagctgtagcggggtggctgtctggctgagctaccaacaagccagtgcaagtgggggatcggttttgtcctgtcatttatatatatgtaagcatccagcctgagatttgggtgacgctagctgatcgctgactgctaccgtgatatttatcacgcaattggggatccaagcacattaacaactatagacgacaaccccgatatgcatggctcattgttatattgctatttgtcaccttcgatccatcgatcatgcggtgtttgtatgtaaggctttcttacccccatagatttgctgctcaatttgacttgaccagctctggtgtgtgagatccaatccggacaacgggacatgcatgcatatgcacccatgggtgagtgctcttttttcttctgggacatgtcagggtgggggcaaattaaaggagatggagatcgagccggtcggcctttaccgggagagggcttggagctggaggacgcttttgatgccacgccacaagttgcgaatgcgtaaatgggcttcaaagcaaagcgcgcgggaatgccggatcgagcacggcgcggatgggataaacaacacagcagcctcgatcgccggggggcggggtatcgcggttttcgcccttcttttctgacgcgatcagagcggctacaatagcactattaaccagctgtaaacatattttaataagataaaagatgatagataagagcagcaggctacagatctgtagccagctgcagcacggactctacgacacaatgtgtgtatgataggtgagaccatatattagtagtatagtaagcaactattgtattaattgactattagattaactataaatgaattggagccagtagtgggatattttattaaacttgctctcagtcgatctaatctttgccgggtcgagcagacgagtaccgtgtatgtagatgcagtcaacggagagttttatgctacgcaaatggcagtataaatacatcggaggagattccagcgcccagtttatgattctagagtgagaaaaatatgttacatggtcccgttagctagcttagttatatatccagtgccagtatatgtcgttgacaatgttgtaaaaaaataccattgtcaagggcaaaccgcaaacagtgtcgtgccgcatccattgctggagaaagggtttttacccacggttcgcaacccccctatatcatgaatccgagactaaaatgcccatctttaatttcggttaaaataatcggcactaaagattcatctttattcccggttgcacggaactaaagaggagaatctttatgggtaacgccagtttttttttcaattgttatttgaatattgatttcacgccaaactcaccaaactcatcaaaatcacaaaatcatcataaattccaaatcgagttgctccctacatctccaaatcaaagtaacaacatcacaaatcataagattcatgtcaaaaattatcaaaaaaatacatcacaaattctaaaaaaaattacatcacatatcaaataacacagatccaatgaatcacaaattcttttttaaaaaacaaagaaacccccaaatcgagtcctccacttgccgcaagccgtcgtcgcctccccagcccgacggccgccgtcgaccccgcccggcggctgctgccccttctcccgtcgactccgctgtagaagatatgtggatgaggaaagagagagtacagagtcagcgagagaaatggcgagagaagatatgtggatgaggacgtctcgatctgtctagcgctaagagataaggatgaggaaatctaagtatgtagtctctggttcgatctatttaacacatgggagggagatatttagtctcggttagtgatatcaaccgggactaaagatcatatagtccccgtgtacttttaaatcgggactaaaaatagtttctagtccaagtttttagttgaaccaggactattgtagattttggccaacctataaaagatagtttctctagtagttgtgatcacatgcatataagggttgcagttgttcgtaagatacacggtgttacttcgcaaagaaaagcaaatgctcatgtattgatgtacgtaagcaacatgttcacaaaaatgatgaaagcatagcaagagctgtctcgagcgttgtcattgtaagatgccagcttttctcaaaacttgcattaatttggagtgcacaatactggattgaaataaagaatcaaatctgtttattatatatattcttttccttgtctttttggaggcagatgcaaccatctatatatcctcagctatggcggagatttaacaacccaaactgttgagtttaggaaaaaaaatcaaatgggaaatagaaatgggccagtgtgtgggcgagcgcgccttgcgggccacgaaaccgtgaacgacatgttccggcctgcccacgagtcccgcactaatcgatgtaccccttcgtctcggcccgccgccgcctcctccgctcgagccgcaccgcgcagccgccggcccaaaccctatggctcgcaaagcgcgacccgcggagcctcctacaccggggcggaagggcaggaaacctctcccctcccacgcgccgccgaccgaagccgccgccgccgccgccaccgccgccgcctctccagccgcagccaccgcctctccagccgcagacgccatggaggccgaagcgggcggcgtggccatcgtgtacgacgcgctcccggggctgacactggcgttctcgccggaggaggaggagcacctagagggtgcgactgccgacctaggcggcgcgtcgacctccgcctcggctgcggtggtggaggaggtggaggacgccaccgcggcctactccgtgttccgcaacgagatcacggcggctggggacgcgctcgtcgatatccccgcggcggatttcttctccctcgacgtgtcggcggcagttgaagacgagccggccaccccgcgtgcgttgtcgccgcagcctgctccggaggcgacgctatcgggttctctagctcccgctgagcagccagcgcaggggtcggagcgcgcgtggtttcggggagggaggcggttcaggagccctatgctgcagcttcacaaaggtggggataattttggctttgccatttgttagtttgaatgttggaaaagaacacgatttgtaaattgatttgatcagcttagagatagttcaattcgaattttagcttgggtaggcaatggacttgtttcaatgggcacagattatgcgaatagtttggaactgattttagtttggttctgaaatcttctcagttcagcctaggtggagattgatatttttttaattgtattttgatatcaagctactcgcgatatgctctttcatgacactcttgaagtgttgcctggaaactatggtgttataaacttgggagtgtccacatggtgttaataagcttgagtcagtttatatggtttcaggctggacattttgactgacgcaatactgacatattgtctatttcttacagagattcttgacttctgtgactttatatcaccttctgctgaagaacaatcttcacgaacagctgctgtgaaagctgtctccaatgttatcaaacatatatggcctcaatgcaaggcatagtaacacacattgtccctctcttgccatgtgcgcacgcatttgatcagcattagctgcaagtcatttggtaattctcgttttgcattgcaggtggaggtcttcggatcttttagaacagggctgtttttaccaacaagtgatatcgatgtaagggattttctttttgtgctctccagtggatttttgagcatttaacttgctgttctgttgagttgtatgatcccctggagcataacatttactttgatagcaatgctggaatcgtcatacttaacattttgatggatgaaatagcaatacaggagaaaaagagtaaacacagaaggaaggtgtagctcagcatgcactttctgttttcctgttttgcagaacagggaggaaaaaatgggatgtatataattagcaatgtttactcagttttcctggagtaaagtatgaaatatgtttctccagagtgattttcacccttaattgcattgttagctacttccactttcatatcaaagggatacccttcttctgctattctatgattatgattagaagaaaaccgtgatgcatagcctgttacagacgtgttaagtgttaacccctacttttcacctgggaacaatgaaatacgaatacatggaaaatgtaccctattttgggaaactctctcctttatctgtgagtttatacatggttttgtgatgcaggttgtaatatttgactccagggttaagactccacaagttggcctgtatgctcttgcaaaagcattgtctcagaaaggggttgctaaaaagatacaggtccatttttcactctatttaactctagtttgcaacacttggtatttgcaagactttttcttttattttgttaaagaattactcaaaacaaagccaaagagacaaaaatgcattttttttccaatgaaggaaaagtcaattttctgtccaactgaaatatgcatgacggataaatagctaccttgaaagagaccaaatcccactgtttaaactttcactctgtgctgcagttgtcagttgttattgtcaatcaagtagattccagcttacttatttttctggtggaccattttttttttctttcatggcaggtaatagcaaaggcccgtgtgccaattgtgaagttcgtggagagaaaaagtgaaatagcttttgacataaggttaaattgtgtttctcatcaaatattcctttgtttctagttttttgcgggaatgcttatcgaataatttccctttttctttttccagttttgacatggatggtggaccacaagcagcagacttcatcaaggtactttgtgcagacaaattggctaattacttcactggcagcgtgtgttcgtgaagctaattcgtggggcaaatgattgcatatattttgaacatcatttttactctgtactgcaggattatgtgaagaagtttcctgctttaagacatctgtgtatgattctgaaagtttttttacaccaaagagagcttaatgaggtacaattacttaaaactattagtcgttccattctaataatagattgtttgtaattatggcatttctagatttccaattaccatttcactctttttggtaggtctatacgggtggaattggttcatatgctcttctcactatgctcatcacacatttacaggtaaagctgagtctgttttgtactctaacgtgataatggcctttttttgtatacctgaattgatttgagttataattccttaaaaaatggttgaaaggtacacattgtgtttttcctgacatttaagatttttcttataaatacttaagacacctaacaaacataaatttgggttgtttatacactgcatcgctaatttgttcactgattcagtctaccatatattacttactatggataactgaactttagtgctaagtgttctttttgttagttgatctggggaggcaaagatatactggggtatcgtaaaaaggagcacaatttggggattcttttggtaagcaatacttgttttaaatgtttaacagtaatgcaatgttttacattacaatgctttgacttccgttgcatgtaaagttccattggaaatattcatttcatcgtggtattaaccataatgcatattacatactgcttccgaccatatcgttctcagtatacacttttttacgttgtctttgctaatggaaaggacatgcattctctttataattaagggggcatgacacatgattgcagctctttatagttatttttccccttcatggcagatcgcattatttgatttttatggacgcaagttgaacaattgggatgttggaatatcctgcaattctgctaggacctttttcttgaagactgataaaaagtaaggtgtttactagcgggcttagaccaaatgaatatacaataaaattatcatcttcttagtattttgttcaactgaaaaaaaaggataattttttcagtattcttgtgtattgctgtagaacaagaatatctcatttgcttctaactaggccattctgttaaacacttaaaactgttgaaaatctgctctgtaaagatttataggtgaaatgtcattatataactgaaagaaaatttgatgcgggtgcaactgtttgagttgctaaaattttgactttgttgtataagccatggaacttgtttactgatcctgtttgtgtctctctgcttttcaagctttgcaaatcctgatcgagcataccttctagctattcaagatcctatggtatgatctttggccctttccttttagtcttggttagctttaacatctccagcttcaatggatttacctattgtttttcttatggcctaggtaccagataatgatattgggaagaactcatttaactatttcaaggtattatttcttacaatgttgtttgtgctgtggttgtgatacttgaagtattactcgtttactggctcataataatatatgcaagcaatatcgatgaaagtgttcc

SEQ ID NO: 42571 - DNA, 2424 bp, Oryza sativa
aggctggaacaaggacgctacaatacctgacatgttaacagaaccctgggaaccattaccccgtcagtttgatagcgataatgatgcagtctataattggcatgtgatagatgatgaaccactgcccaggaatactcgatcctcatcggaggacacaaggccatcacctacacaaaaaaggaagtcttccaaaccaaaacagagatcgcggaaaaaggccaaggctgattcttcgagtggtaacaatgctgaaaatggtttcaagcgggggaaaggattagcacaatgtgatagatcgcatcaaagtgcaggaagcagcagacggagcaaagggccgagagagtatgacagatttacaaataccctcccacaatatactcagcacattagtaggtggtgactttaggctgttactgatagcatttacagtacagttcgggattgggagatcccacgaggttttgacaggcagaatggcgccttggcagacgtcgaagttcaagcagctttctgtagccatatgtatgatttattatttatttgtttgtctaaggttattcggtcctttgtaacgccgatgaaaccgatatattcagttatattatcatcgtatgaactgcaatttcgccaacttgtctatggcaaagtttcagactattaaaaattatctttggctggaacgtgaattcataattcataacaagacgtcacttcggtgacatccgataaaaataattcataacaagacgccttgaaaggtttaagttttattaaacgaaagaggaacataatttagattgtcgcagctaccaatcacactaaatacatgattggaagttaaataaaatcaagcttatagtcgaatgaaataaaaaggttccaccttcttttcccagtttagaactgaacaagtaaacagctttgtttaccgttaccacaacgacactgcaagcttaatacagctagctaccgtcttttactcgtctttcttctgtgcgaatcctgggggaaaggactccagccttttctattccgctcaaaagaataaggaaatataacgagaattgtatatgaggaatacaggataatcagctatcaagcactttgtgttcaaatatcaagcctcttatacctctgctctattttcctttcgagagctgctcctatgttttttccatagtataacggaaaaaaaaggtcaatcaacaatatgacaggttaaataaacattgaaagtaaaaatgcaaaacaaaagaagctaataaaccgatattgtaaggccacccaacaaacagctgacaggatcaagatggtgtaaactcgtcaaatatattcataccgcaaagacataagtttaccaggttacaagcaggtatgtccattaaaagtgaggacatatgctagcatcatcacttaactaatctaccattcttattcagattgacccttcagctgaaaaaaagtagaaggatttgcaccaatctgctggctaattaaaaaaaaaggaagccagattgaagtggccttatggagagctgataagcttccagtccatattagaagtggagatcctttgtgagaccagtgaaacatctcaatatgactggttcattctgcactaacctgaccattctcgtggggatgtaacattgctacctgcattgagcttatcagccatggcaacagagtctgcaggttgggctgcagttaccactgggagagctacgctctcaactcgatcccgtggataccctaccacactagctgtttcaaacatatttccaaatggctgattatgcacgacttgtggtcccaaatgatgaaatgccatcggaccactcgctggatgctgaggcagaacagcaacaacagtagcagcacagttagaaggattcttgaatgtggcgctgtaggattggccactaccttgaacggcataggatgccacactacagtggttgggcttgcttggttgaggtgggcatgagctcaggccgtgttgctgcaatggttgtggctgctgatgctggatgttaaggtctgtcgatggaagcaaaactgtattgccttggccataaaaagaaggcatggcttcatgatgcttctgctgaggtgaagagtatggcgagtgcacaaccatgtttctcagaagtggctccgttgtagcactggcaggcttctgagaagagtatggaggatacaagacagcgacttgaggagcactttgagcctgaggagatgatgtttgctgttgaactagctgtggtggaacttgctgaatattgtattgctgcggttgcaccacaaggggctgtgttcgccatgcttgtgactcaacctgctgagcaggcagatgtagcctttggtcctggggttgagggtacaattctgtcacctggctagatttctgagataggtcaactg

SEQ ID NO: 42572 - DNA, 2081 bp, Oryza sativa
  unsure (1)..(2081): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttcgagttagtggttcatgagcacatgagctataggcctacctgaggaatagcactgcatccccagatactagcttcttcttgttgataaacccgctccatccagtggttaaaaggtgcctccgtggttggcctgtaacaattagaggcagacctatgagatattcatggaccataattttctcaagactcctccaaattgcaattagcttaactattagagattatgtcgcaatagctgtagaaataggtagtctatgcataaattaaaataatttattgaaaacactcccagagtaagtgagcagagcctaatgagaaaaaatagcatagtttgctcatttttatctcatccagccagccaagttacagtttggtttgcttgtttcgtctaaactggacagccatctcgcttccaatacctagacatgatagatgtatctaaaaaggagacctggataatcttactaaaagaaaaaacatatatatactaatgcgttattcggtgaacaaagtacagtagttcaacctaaacagcctgtgatgtactataggaagatgtaggactgtacagcccgtaggttactaggttctctcacgcattaagaaaattaatcccatgttcccagggagaagcctaacaaccaagctgtatgacatatatatggtagttagtgatagtacggctgatatcccagtcaccaagataggctaaaccggcgaatcacctcgatagatatgtctgaacctccattccgtgccgtgcagatcctttgccacgagctcctggaatggcctctgcaggctgtagtcctgcaggcgccaagctgaacagagtcaccacacaagcaatcaaacagatcacggtgaggtagcttgtcccaatcgatatcgtcccgtaccagcggcgggaagcagtcctcggcggcgcggcgaggcacggagaagccgccgtgcgtgctggtgtcggaggccgtgagcgtcttgcagaacatgtggggaatccgggccggccgcttcacggcgtcctcgccctcgccgtcgcaggccgcgccgtcctctccctcccgcatccgcctctccacttcctgaaaaaaccacccagaaataatgttcgtttgagctactagcactgaccgaatgtcaaagatattcatcccatttttggatcagcacgcacgcaaacgcacctcgttgtcggcgaccaacgagacctgcgcgtacacctcgtccgtcgcggcgtccgcctgcaaacagcacaacgggaggagcagaccctctctctcaatcaatacctcgaacacattgcgctcgcgcgagagcagcaagcggcgagcgcactcacgtggaggctgacgtcgacgacgcggcagaacacgtgcggcggcaccgcggcgccggggccggagccgggcgcggccccgaggtgctcgaggtggccctgcggcaggtacacgacggcgctgcccttccgcggcagcggcgccacggggccagcgcaggcgtgccacagctccaggcacaccgcgccccccgccctcgcctccgcaggcgccgtgacggtgccggtggcgccgccctcctcctcgtcttcctcctcctccacggtgttgaggtcgatgcccaccatagccgcaaccccccaccggcagctcgccgcgccgccgccgcgcttgcttccaacgcggtcgaaagaggagagacggggagggaagcgaggaggggaggcgatcgaggtccctcgcttgggtttaatggagcggagagcggagtgggtgaggagaggcggaggtggggaggcgacacatggtggtgatggccatgaatggctgggctgggtggtggtggggggggggg

SEQ ID NO: 42573 - DNA, 4318 bp, Oryza sativa
aatttccttactgcacggccagcccgatcaatgcaccgtcattgaacaccaattcaaccggttggttcaggccttatttagatgagaaaaatttttaggtttggttgtcacatcatatatacgtatatacatttgaaatattaaatgtagtctagtaataaactaaattacagatcttgtcagaaaattacaagaaggatttattaaacctaattaatccgttattagtaaatatttactgtaacaccacgttatcaaatcatggtataattaagcttaaaagatttgtctcataatttacacgtaatctatataaccgtgaaaattctttgttttaggactaagcaaggccttgctcatgtctttatacctgcctggcagcagcatgacatcacataacattatgtggcatgtaagggcagtcccaacttatagtgtccataagcagtgtctatggtaccatgtcaataagacatcacaatagaaactacactctacaactcattgtttcttaaagtggaccgttaataaatacatcatctcttttctctaccaatcatatttattattcatctattatgaagacagtattatctctcaatgtaaaacttgatagtgtctagtgcataggttctcgtgttgaagttgtgtcttgcatgagacccaatttcttcctctcttcactctctctcttaattaatatagtgccacataagttaatagtcctacataacaatgtagttaatactatagacaccatcctatatagagggttgggactgccctaaataaactactcctggttttgaccatagctaaaccgtttaagacaggtccgaatcgtgcagggggagacgatgctgaatttgctgagatgcgcgcggcgtgacattggcacatcgctcatcgcatccaatcatccttccttccccggaatataacacatcatcatggatccacgctacgacgacgcgcccatgtcatctctgtactcggccgtgtatacgattgttgacgcatgcacgcagctgccaaaattttgatgccccccctgcggccctgcgccaggctgccactcgctcgctgctgcggcgctgccactgttgactactgatgaatgatgcgccacgccaaccatacgcgagcgcgacggatgatgcgcgcgcgcgcgctagctcgccgtcggcccgtggggagagaggctgtggcactggcagccgtgcatgagtacgtactactgttaactatacgagcaaggaacagggagtaaaagaggaaagacctccccggccggccggctggctggcagctggctcgtcgtagcgatgcgcgcgggagggaggcaggcagtgtgcaggtgtgtgcagcggtagtagagggggggtgttacgtccacctcgcccgctcgctttcgcgctcgcttttatcgggtgtgtgtgggtctctcaagcacagcagtgacagcactgcgcggctgctgctgctgccctcctcgccatggccttgcctgcctgcctgcctggcgacgcccctgccgctgcgctgcgccatcctgttccattccctggaccgcgtccatgcctctgcccccccttctcacgactttccaatctctgcttatcatattctttacaaatttgcagcagcgtcgcgttagtaaattgcggatttcgcaccacctatagacacctagattgacatgagttacactactccatatatatagagcttttgacagaaacacagagtcagtccaatgcaatttagtatactgtcgacttctatcgcccgtaagaatcgaccataccgggaccgtgagcctgagaacggcaccactccgctagtctggctgagtggcagtgaatactgtagatatgtactgctcaaatttactgtagagcttcatccaagccattgcctcgttgggagatcgatgagcctggctggcctaacgagtaacgacattactgtagctctttccctgccatatgtaatgaaaatttaggcaatgtgttaattaaagattctgctaggagcctaggaggtgtcaggtagcaaaaatgatcactactccagttcttttatgaccgtagtgccgaaagtcaaattgcatgcaattcttggagagcttatttccttttctttctttcacgaagaactctctttgaccataaatattgatacggttgactttaaccataaatattttataaccgttcattttatttaaaaatttcgtgcaaataaataaataaataaataaatacatatatatatatagacacacaagtaataacataataaataatatttatataaatttttttaataagatgaatgaaagtcaaccacgtcaaatgtttataaccggagagaatgtttggaaaaatctttgcatagaatagctactccactttgccagctctggcattttgtgtcactgttgagtattgaattaataggtggttatcggcaaaaaagaaaaaaaatgctcaggaatctaaaaacactagacatgaaaaacgtaagaatcaaaatggcatgtttagttgatcttaggaattttaaataattcctaaaatgcaggaattgtgtgaaatatgttatttagatgcttcataggaaaaatacaggatttttcgagagagataacacaaggaaagtttcccatgaggcccaacctcatgatagaaatccttaaaataaattatgattcaagccaattccataggaatttcgtaggaatctcaagtgctcatttctttcttccaaatgagcacctatgaaaattttccattggatttcaatcctaaaaggtcttatgttttttctttgttccatgaaagccctaaattaatttttttgactctcctgtctcgaacataagttctcgactctttccaagttgtaagctgtttttttttactttaagacatttttgcaacttttttccttgtatgtccttgcagataaatgttagagtaaatttcactttgagctacttttatcaaccaaagtttcccaatagactacgctagatttatcttttcacgtaacatcacagcatatagttacaatcgttcacgctttggacaaggttgaacaacatgcgttgatatcttaattttcaagcagtgaaatatgatctttgaatgttcatacatagtaatgaaatatatattatctttgaatgttcatatgcagtaatataatgcaattccatttattttataggatgttgtatacctgttacatttgatgttcttgtgctaacttgtaaaccctagtttaaagtgtaaagagtggtggtaactgtgctaagtgaaaatataagcttggcggtccatgatgaaacttcggttcactggtggagaaatgctttttagtcccggttcgtaaccccctgtagtcccggttttccaaccgggactacgaatccgggactaaagatcgctatctttagtcccggttcaaataaccgggactaaaaatcaatctttagtcccggttaatgttaccaaccgggactaaagatgggagaatctttagtcccggttcaaataaccgggactaaaaatcaatctttagtcccggttaatgttaccaaccgggactaaagatgggagaatctttagtcccggttgataacaccaaccgggactaaagatattttttcttttttttctgcttttaatattgaatattgatttcacaccatcccctcccatatccaaatcatcacatattacagaacatctccaaatcctcaaacaaatcatatccaaatacatcacaaactcttaaaaaaattacatcacagggttctaaaaaattcatcacatattcacatctcacacaaaaatacatcacagattcacatttcaaaaaaaaaatccggccggcggccactgccgcctcccctcctcccatccgcgccggccggccagcgtcgcgtcggtcaccgccgagcggccgcccaccgcagccgccgcctccgcgcggcccccggcatcgccgcgcggcctcccgcgccgccgcgccggccgcccaccaccgccgccgcgcggtcccccgcgctgccgcgccgactgccgcgcaggccgcctccgcgccgtcccccgcgtcgccgcctccgcgccgaccgcctgcactgtggtgaaggaaaaaaggaaggagaggaggggagttagagataaggaaagagataagaagttagagaggaaaaaaagagatagagggaggagtttgttgtgtggacgggaaaagaggatcggtactatggattatatagtgtgttttgatttttattcccggttag

SEQ ID NO: 42574 - DNA, 9293 bp, Oryza sativa
agtcccggttggtgttactaaccgggactaaagatcatagggccctgacacagcctgacatggaatcaaccgggagtaaagatgatttttagtcccggttggtaacaacaaccgggactaaagatcttcctcttattaaccgggactaaaaatcatttttagtcccggtttttaatggaaccgggactattgtggatataggtcgaccgaccaaagatggtttctctaccagtggttattaaaagtggttcaaaatgaaatatactctaaatgttactatgttagtatccccctcgtaaatctcagaaatgtaaaaacaaggagtaagcaagttgttttctcaattcatatacacaacacaagtctaaacaacttacatggtatatttaaaatcagcacgagtacatttatatttttcgagaaagatgcacacacatacacctcattgcctgtgcagcaaacacccgtaggtataactactcttaatacacgtttaaagagatgagatgaagatcgatgacaaaattttctcacagaattcatgtttaagccggcctggcgctgtgctgaaccctcctgtactccactccactccagccggcctttcggagagccggacgccgttgtccgatcagctcgcgtcggagcctcttatctaatccactgttccacggaccgagtgcacgcagtgaacgaagcccccacatcagcagcaaagctgcgtgaccgtgtccgtctcggcgtctcgctcgatctctcctgggaactccacacgttgtccgctctgcttcgccggagaagaccccacgcgcgcgccagctgctcccaaagcgcccccaacagtcaaggcattgtttgctagctagcttccgacgaccgcgcataaagctcacttacacaagcggttaatgtgcggacggcccccgccgtcgggcgaacgcagcgggggacatcaagcctgcaacggtgacaagtcggggaatccagcgacgtacacgggcgctcagtcgccaactcgccaccaccgggctttcgttcgtgtttagctctgccccgctgcacgctcgcctcctctcctccgcgcggttgcatgcgtacgttggtcctttttatctttttcagatcagcgaacgcatcgcgtctcctgtgcctgatacttttcggggccccgctcgattgggcgggcgatatatgtggggcccggtgccaggctctggcgagaggatcatggggggcttttggatcgactatgacgcgcgggaccggggtgtcacgttctgctgatgctgatactgctcccccccggtttaagcgcatctttcatcagcgcagcccccggcggggtcggtcgtaccgtatgatgccgtgcatccacacggtactggggccggtgcttcttcgccgtattgccggcatgcagtacggttccccgcggccgccacgccagaattttgcgtgtttctttgtgatttcgacgatcaacaaggcagtttgtggattatgccccactgctaactctgatgagccgtataacccgggaaagtaaaccgtagcccaagggctacgaaaggaaagcaacaagaacgacatgctgcgcgctagtggcgaaaggtttgaagtagctcgctagagcttagatcgagatggttctaattatggtatttttggttatgtttgccgtacaaagtaagtctatgagtagctagccatctcattgttggctagcaaacttagaccccttttgattgaaaggaaattcataaaaattttagggaatttcattcctatatgatttttttttcctatatagccttttgaatcaaaagaataaatcctatggaatcctatgaaatgcctcttcccatgtgaatattagaggaaatttaacatgaggtagaacctcatggaaagaatactttgagtctttatctctcctcaagatggccatgcagcaatgtggttgccattccaaagtataaactttcaaacccaccccgtacttttcagattattttgcagcttattgcgatgggttttaaggggtaaccaaaatatttttaaaaataaattaaaaagagtttaaaagttaaaacgagtgatctaagcaatatagtagaaaaagtttgtagaaaacatattctttttaaaagtatataccaaataatccgttttgataatccaatgaataatctgaaaaaaaaagtaagacattgttgtggcactctctcttctaaagaaaatctcaacacctttgctttctactccctccatcgcaaaataaatacagagagtactctagaactctagtaccatatgcatgttgtagtatgatttgattaaggtatccaagtactcctatctaaacaaccaatccaatcatgcaagcaacagttcagatcagtcagttcagtcttcagtgtgcatgcctaccactattgacttgtatgttcctctcctaatatatgagcccacttccaacgcttccaggcatccatctgccagcccaatcgcgagcgcgcggacctcgttccgtggcggccacgagagctatccgcggcggcaatagcaaacctacgcgcggtcgggcacttgggcaccagttgggccgaaataaaactgggttactcgtacgtgtgcgtgggcagccgttggatcggttaggacgcacaaaggagatcggtccaatgttcagcacttcagcggaataagtgcacttttggtccctcattttaacttcgagtttgcatcgtgtaattgaatggtaataccagatataacatatcccacaacttacaaccagagtacccgaggtcgcaggacagtattttgaccgattttcactcacatggtgagttgactgtagtcaaaatggccgtgagaccacatgaaacctatgtcagggcccttacattcttccccatttcttcaccatctctccagggcagtggctatagggaaggctcagggacaacggcgccaaaaaaaggaaaggatatcataaaggaggaggtaggggaaggggatgaaaagggaggacatggactgttgcggcgatagagcgtaacgaactagccatggtggccttctcgttgtctgggtgttcatcggatgttatgccgtcacgcggggttgggagtcacatcgcagctcgtgagcaacctcatctagccgcgcgtgaggaggttgcatgctgacaacgataaggggaatcaatggggatggtcagtcgtcatctgcatgcgcttcgtctgctaagatccgcttgaaagactgttggcgccactaacggctatgagtgagatggcgacgagctcgagagggcgcaaaggaggatcagggcagagggacttgggaaatcaaagttcgcagtggcggcaacggcgatggggagcgcaacggatgtactttgccgccggctgctcgttgtttcctcctcttttttttaccctctagttgctgaagagggcttactctgagtcatctctcaccagacgtgataagaggtccaagttgagctccctccacatcgcccctctccgagatgccatcgaggcccaccgccattgcctagctcctctaccgttggccgtcgtccttctctatgtctaccgccgtcgtcctagggagatagggaagagaggaaaaccaggagaccgtaatgactggtgccctgtcaaatgggtttcagtggttcccaagctgattacgtggccctaaccaattaagttggccatgcagcgaatgtggctatcattttggcctttcaggctttttgcgctgtgccactctctcttcaaattaatttcagcaccttttctgtttgttctagaactccaagtagcataagatttagctaaggctgggtacgcccttcgaatatagcggtatcagagccactaccagatttgggacctaccctgtaggagcgaaaccgtcagaaaaatagttttcccgtcagaaattattttcctgtgggtgaatcgacagaaattgccgacagaaaaatcaccacggaaaaattccattttcctgacggtttccctacagaaaaacaatttctgtgggtatttttctgatggaggaacacagaaaaaatccactgccgtcacgtttttgtccccataattttgacgtggaaccgtcagaaaaacaaaggtagaaccgtcagaaaaattaacttcaaggcagaaaaaaaaaaccaacaatgcagttcatatgtcaatatggattactgaacaatactttctcaacacattatagcaatggagttgtttcctatatatatatacacagcaattcacatgcacacaaattcatccatcaaaatacaagcaaactttcagccctgtaacttataagtttataaccaatttacattcaacaagaatcttttatcaccactgtaagttacgagttatgggagttacaacttccagtaccaataatacaagtagatgaaacagcaaatgcagataacttatccctcttccaagcatttaagctctagctattttatcatcttttgtatgtctttgaaatgctacatattgaggagggggcttttaagcaacaggctttgcacaaactatatatccttcactgacatattcagaggaacaagaaaaataaggcattaagtattttaggatgtgtcaattgagaaattctgaagacaattctgacatgcataaattttcccgagtcacaaaaacattgaagtacactgtgctacctctagaaacaagcagtacattaatatatggtgcatcaacagcttcagttcagtgcatactatagatagcagtgacgttagtaaattggcaaaaaatagcatggcaagagaaaaaaaatctgttgcagtagttaaataagtccacaagataaggccaagcatatgtgtcaccacttcaccagtacatagaacaacccttgaaccccaacattggacttcagactccatctcaacatttcacaaaaaatcagttcatgagcaaattaactagtttaatgccatatttcacaacagcttcagtaactgcattgtcattaggatcaaccacttctgttctttttcctaattgattagcaatgatgcagtatacaagtagaatgtaccatgaattaatttgtgatttacctcagtttgtgattctgtcagaagaggaataaaggcttaggccacgccaagcctgctcacgctaaggaccttcaaggacagcaatggcgttagcaaattggcaaaaaagagcatgccaagtgaaaaaaaaatagtttgcagtagttaaataagtccacaagacaaagtcaagcatatgtatcacctacgttgtactcccctcaaaccccaaatcacttcagattccatctcaaaattgcacaacaaatcggttatgagcaaactaactagtttaatgcaacattcgactcaagtagatgcttcaaccaatcgagaaaaatgagcaacttgtgctggacactaaccagacttaaacgaggagatatttgtgcaactagctacagacaataaattagccacgaaaaataagatgagaaataaggagatataggaactaatgcataattttaatgacaaagctttgactactaaaatctatgatattattaaaacaactttgaaaggagacaccacataagaagtttcaacataagaacccaatacgagattaatcaaaattcaaaataaaaataaaataaaatctaaaatttaaaaaagaaaaggatagtccaaataggaatacaatttttaaataggtgaaattcggaattaaaaataaggaatattaaaagaagagtccatataagaacccaatacgagattaattaaaattgaggataaaaataaaaataaaacccgaaattaggaaaaaaaagaagagttcaagtaggaatacaatttaaaattagctaaaatttgaaattaaaaataagcaatattaaaagaagaatccatataagaacccaatacgagattaattaaaattcagaataaaaaaatataataatatctaaaattagaaaaactaaaagagagttcaagtaggaataaaattttaaaacaactgaaattgaaaataaaaaataaaaaaattaaaagaacacaatacgatattaattaaaatttgaaaaaaataaattctgaattagaaaaagaaaaataagatttcagttaggaatacaatttataaataacaaaaatttgtgataaaaataaagactattgaaagaaaagaccatctaaaacacatgacgagataaattaagtaacaggcctataaaggagtagcgtggtggtggttgatacgacatataaaaactgttaataaaacaccaaataaaatcctaatgatgattaaaaggagggacgacaggcaggccgtgaagcaaacgagtaaggcggttgacgggacttccaaaaagtaaaaaaaataaaccccatcgataatcatatttaatttttaaaatctcaatgacaataaaaaggagaagcagcgggtggggtatataggagtatagttacaaagccgccgatggttgatgagacttctagaaaataaaaaatgaatcccaacgatagttatgttcgatttttagaatcacaatgacaataaagagtagacggcggacatgccatagaggagcatagtggcatcgtttgacgagacttctaaaaattataaaaaataaaacccaacaagacaataaactctaaaaactataatgttcaatttttaaaggttcagaacttctaaaaagtaaaaaaaataatgataatcatgttcgattttaaaatctcaatgacaataaaaaagggaggcaacgggcgagccgtatagaagtacaatggcaaagccgctgacggtttggcgggacttctagaaagtaaaaatgaatctaaacgataattatattcgagttttaaaaatctcaatgacaataaatagaagagacagtggacgagccatagaggagtataatggcaatgtttaactggatgtctagaaattataaaaacgaaacccaacgtgataataaactctaaaaactataagatccaatttttaaaggttccaaggagaatgaatagaaatagtggtagatcgagcaagcaaataaagaagaagatgacataaggggtagcaactggtgtgacttttaaaaaactatataattagaaacacggggatgataagatttggtctttcaaagtcttaagacaatgagatggctatttaataaattataagtaaaatcatattaaaaaatatatgatttgtttgggtgctagccgcgcaattgcgcgggccacccggctagttataataaagcaaaggcatcaccggatcttagcaagtcgaacccaatatctctagtcactagatcggaaagcctattcccaatctgtagccactacggtggggagcacggatctgaagccatggcaggataacaagaatttggagaaaaaaaaaagcttatctttcaagatgaggatgaggcaatggacatcgaggagggggaaggaggcatcgcccactctcctcggccctcgtagacggatctggcaccgcctgtgccaggggctgccagatctgatgcgtccgagctgcgccgcatactcggtgggttcacgcttgcccgcccgaacggacataagatgaagggagagtggatccggccaaagccagacgacgaggggcgcggccgcgcggggatggtgctcctcacctgacaagggcaagagaggtgtcggcgcttcttccttacgtcggggcgacgaggcgcggggaggtggccgacgctgctccctggcgttagggcgaggaggtgcggcgaaggtggatgctcccttgagtcagcgagcggaggccgtcgtgggcgagatccagtgagggggcggaggatgggagggtggcagcggtggggaagaaaatgccgaagtcttctgggggatgggcgaatgttagggttatctctctcttctccttagtctcatttacctgtagggccgcaccgccagaaaaatgaattattctgtagggataagtagaaccatcacaaaaatacatattcctgtgggttggttgcggaacccatagaaaatataacagcccacagggtagttctcaagtgtggtagtgagcagatacaatagtaggctatatgccagctataaacacatatcgagtagatgaaagaagatagagatgagcagtgggctacagatttgtagccagttgcagcacgggctccaagacgaaatatatgtatgacatgtgggaccataaactaatagtgtggtatacgtttatatattactattgtgtatatgtttatatattactattgtataaattgactattaaattgactacagttgatttggagccagtatttggctatactattaaacaacttgctctcatgcattttgtaacctggttcgatgagatatccgaattactactcggcatctaaatagtcaatccaatcatgcaagcaacagtgatcagtcacttcagtgtagtgcatgactaccacgattgactactgtagtagtagtgttatcctcttctaacaattctttcaacgcaatataatcgcgatcagcacacacaagtacacagcaccgctcctcctcgcgcacatctgagaaacaggccctgtgcggcggtgcgcacgcgcgtgcctcgggacacgcgacgcgagctatcaggcggggaataagttcactccatgaccctcaaatataattgaaatctaaaccatgattctaaactacaaaaccagatatctcaacccccaaacttctaaaaccggtgcaatttgactccctgagcggttttgggagatggttttgctgacgtggcgccacgtggcgcctacgtggtaatattgaccgagtctttgttacacgtggcgttgacgtggcatctacgtgacggtagaaataaaaaatatacgtgggacctattagtcattcacacaaaaagaaatatgggcccattgacatgtggggcccacatgtcagtcctccttcctcctccctcactcccttctctctctttctcttcccttcttccccttcgccgccgctccctaccaccggcgagctccagcccctcccccgcgcgcagacggttggcgagcccctcccccgcgggcagatggtcggcgaacctctccccacgcgcggacggccggcgagcctctcccccgctcgcggacggccggcgagcccctccccacgcgcagatggccagcgagcgcctccc

SEQ ID NO: 42575 - DNA, 19159 bp, Oryza sativa
ccccccactccctccgcaacttagtgcctcctcgtccacctcctctcccacaccaccaccgccgccggatgcggacgccgctcgctctcgctgtccccgcacgccaccggccaaagggaagaagaggagagaaagagagagaagggagagagggaggaggaagaaggtctgacatgtgggccccgcatgtcagtgggcccatatttctttttgtgtgaatgattaatgggtcccacgtatattttttatttctaccgccatgtaggtgccacgtcaacgccgtgtgtaacaaagattcggtcaatattgccacataggcaccacgtggcgccacgtcagcaaaaccgcctcctaaaaccgctcagggagtcaaattgtaccggttttaggattttgggggtcgagatatctgattttggttttgtagtttagggttatcgtttagattccgatcacatttgagggtcatgaagtgaacttattccatccggcgtcggtagcatgcctgcgcgcggtcgaggacgggccaaaaagagttgggcttacgcgtacgtgcgcgcgcgtgggggcagcgctgggatcgggagaaaggagacatgttcagcgtcagcggtgcaccgcgcgggcgagctagcggggcgcgaaaatcattaactcgggtgttggactgcgcgataagatttcgatccaggtctgtttgctttgtttgtctgtacgtgtatcggaaaaccctgcctacgacgtttccgtttcggatggctttgcatagttgcacggcctatatatctctgtggtgagttggtaactactccctcgtgcgacgtgttcgtgttcatcgactccctcctccatggattggaccaaacttcccacggacattttgatcgagtttgttgatataaaaccagccccgaaatcgacatcggtagctaaacgcggaagaaaacgccataggagatccaaaacgatgacgacaccgagacacgatatttggtaacggagttcagccgtagcctatatctccggggcactgattacgggcgctcctccctgatccagcatatacagcgtatcagagttacaacgactcacggccggtcgacgccggcagccgctccctctcgctatgctaagtcgccatgcggttacaacaggcacgcccctctatttatgagggatcctagaatagagttcgactcatactctagtcttaatacctattacaactccaagtcctaaactgtaaccgtctacgtacacatattcgacacaaactctaacaaactccaccttggcgaatatgccacgccaatccgaatctgttatttgctcgaacctccgtgtaccaggacttgagttggttctgccgcagctcacgccgagccgcccgtagagcttacgccaggctcgccgccttcaggatcgtgcacagcaacaccagcatacccatcttccatgactccacctgcaacagcattcccttgtaacttgtacaaacatgagcttgttctctcaccagtcataacagtcttgccgtccttcatgatattcatggtcttcctatcaaaatccacctgatacaaccaacctgtctcatgtaggctcccaagcgaaatcaaactcttccttagtcccggcacgtgtctcacatctgaaagtagcacctcgtttccatcatacatcttgaacttgacatcgtccactccaacaacatgataactcgtgtcatcgcccaagtaaacaacaccaaaatcaccagatttgtatgaaaagaaccactcccgcttcgatgtcacgtgataggaactagctgagtccaacatccacgcttctccagacttctcgttagacactgtgagaatctcatgactgctgctatctgaatcatcaccacgagctgctaaacttgcaatgccatctttcctcttcttcagtaacgggcaattcctccttatatgtccaaactcatgacacttatagcaccgtgctcccttctcattgctcttcgacacccccgcttcatgatcatgctttgccttgaccagcaaactctcagcctgagaagcctccattgcctcgtttttctttgatcttctcaagtctcgtgcaagcaacgacgaaattatctcctcagttttgatagtatccttgccgtgcgtcagggtagtcaccacatgttcatacgacggtggaagcgagcacagaagaattatggccttgtttcatcatacagattcacatctaacttacttagatccacaaccaactgattgaagacgtccacgtgcttcctaagatctgactcctcttgcatctgcaaaccatacagctgttgtttgagatacaacttactcgtcagcgacttggacatatacaggcttgccaacttgtcccaaatttccttcggtgttttttcatccatgacctgatacatgacagaatccgagagactcaagcgtattgttgcagctgcctgcgccttcatctcctcccacttgccagcatccatcttttccggcatcgtctcctcaagagccttggatatcccctgttgagccaacagatccttcagcctcatctgccagagaacgaaatttccagtgccatcgaacttcaccatctcaaatttggaaaccaccgtcaccgccatcgacgataatcaactcaacagctgttgccctgttaaattgatctgccttggttcaatcgaccccaccgactaactcgaacagtaccagccggaccgaaccggtttttttttctttctccaaaaaaccggaccggtttcttttacttggtcaaccaccagtcaaagaaaaacagatcgatcctgtctcccttcttcctttggcttcctcgctcctcccagaaaccgcgcccgcgccgcttttcccgatgcgccgccgcctcctgctcctcacgctgccggccccgcaagaagcaccatgccccccacctcagaaaccgcctggggcgccgccgcctcccgccgctgtcacctgcgccgaccccgcgaggagccgccgcgtcgcctaccttgggaagccgccgcctgccacctgggagcgcctgccgccgaagtccgccgccggttcctcgccgggaaccgccgccgccgccgccgcaagctcctgcctgagctgcgacgaacgtcgccgagtaccacgccgccgtgcgccgcctacctgcaatgacgcgtctccagccgcccgtgacctcgccgcccaaaccacctttgcctctgcgaaaatcgggtacgaatctcgccctctgctagatgatttgtttcgattgcgttgttgcaatcctgtggtcctctgctgcttttatttgggaaaaatcgagtccgattcatgaacgaatcgtagtcctcgtccgattccccttccgtgcttgactaggtctctccctcaatctatttctctgttgtgctatgcatccgagttggaaacatatccgactccttccatgtcacaacctctccagatcgagtcctgcgcaatccgacttcctgctactcgggctctggccacgttccatggtcccggcttcaacaccaacacgtgcacaccgccatctccgtgacctcctcagcctccacgcacccgtacgacctctagcgcagccacctagcctcccgctgaacctcgctggtgacgaataccgccggtcagttgcaaccaatgcttattgctgtgctaacatgattgatcagcgcattgacggtctgaaattgactgcccttctgcctgattccgttgcttttcgtatgtgcgccttctccgtagcagtttgtcacgcaaatacctcgtcaacacctccaaaacaacctataggatccacccgctccgactttcgattgaacgccatcaatctagtcgcgagccgaagccgacaagtcgcatgccgtcttcccagccgccgaacgacctgagcactacgtctagccatctccctgtcgaactcaacacatcgaaaggcccgggccaccccgcccagagtgttcgaatccaccgatcgagaacgccgattgcctccagcttcaatcaacccgagcgtgcggccgcacgtctccctatcgagagtagctcaccggaaagtccaagccacccgcccgaagtgtccgacccaccgattggatcgccaatcgcttccgccgccatcaacccgagcaccatgtctagtcatctccctgttgaaggcagccatcgacggttccggccgccgccagaagtgttcgatccaccgatcaagactccgttgatcgccgccgtgctccaccttgcgccaatgcccctccctgggcattatagcaggctacgcggtgtggagcacctccatcgcgcctctaccatggacctcccgcaggctctgataccacttgttataaaaccagccccgaaatcgacatcgatagctaaatacggaagaaaactccataggagatccaaaacgatgacgacaccgagacacgatatttggtaacggagttcagccgtagcctacatctccggggcactgattacgggcgctcctccccgatccatcatatatagcgtatcagagttacaacgactcacggccggtcgacgccggcagccgctccctctcgctatgctaagtcgccatgcggttacaacaggcacgcccctctatttatgagggatcctaggatagagtccgactcatactctagtcctaatacctattacaactccaagtcctaaactgtaaccgactacgtacacatattcgacacaaactctaacatttgtaacccgcctagtcctcgcagactggatcaagtttggcgccgtctgcaagacgtggaagcgggcggcggatacggcatgaacctccgccttcatccgaagcctgaaccgccttggctcatgctaccggccgccggtgattccccccaacatctagccgtcgcggacttctactctttctcggatggacggcgtcgctcaatcaccctgccttcccctgccatccaaagccgtatgtggattggctcggcgaagggttggcttgtgacaacagatgacaagtgcgggctgcacctccttaaccccatctccggcactcaacactcgctgccatccatcaccactaccggttactttgatgcccttccaagaactgacggtgatgaagctaggttcttgtttaaagtagcctcattcgtggaaacctactggccggagggccacaccaggtttgtcggatggtgctccgacattgagatttctgcggaggaaatccggtcatctcgtctccttaaagccgtcccgttgtgggaccctagttctggtgaatactttatcatgatgatgcattgtccaaggaacagggttgtgcttgctcgtgggcgtgatgcaaaatggatgcccttgcaaacgcgacacatgtatgaagatgtgatcgtttaccgaggacaattctacatggtcaccttaggcctctcacagtgcgagctatggggcccgtagctctcgccaaaaaagttggcccaaagacacccaccccacagtgcaagcacccatactatgtgtggcttaattggatggagccacaagtgaagaaaaccgaacccacagtgcagcgttacccaagcgtgtagacacggggtacgggacgaaatttattccccacctacccctagcgactttctcctcctccactccatcgccatcgccttcttctcctcccgcgccgcttcgcttctcctcccgtgccgccgctccgcttctcccctgcgcctccttcccctccctccggtggccgaggcgaatccggcgaccgcgccgaggacgccgccgccgtgcgcctcgccgtcgaccgcgccgctcgcttctcctcccgcgcggactcgggagcggtgggagcggcgggagtggacgatgcgtcgccgacgggcggccggagacgggagcagacaagcggctgatggcgggcaaaagcgcggcgctggcctcgtgtggcggcagaggaggaggggaaaggctcgagcggggcaagcctccaccgcaacgaccttgccgaagggggacctcgagcagcgccgccggaccccggggagcggcggagccgcgcggcacaggccgccgcggcgagcccggcagccgccgccgccgcgaggaagaggagcatgagccgtcgctgctgttcttttcttgcactgtccagatctgttggtttggggtgatttgagttgatttcagcgtggtttggggtgatttgagttgacttgagtggtggtttgtggtggaattcgccggcaccgccttctgtgatgatttttctgtgatgattttgccgtgaatccgatctgtttttctcttccaatcttcaagattttcttgctttttctcttccaatcctatctgtggcgggagaaataatgttgtggcgggaggggattttgggagggtgaataggggatttcgccggccgaatcccgcgcgagagcaccgggcggcgagggaatgacgcccacagcgctagcgcctcccctcgattcctctgcgcggtcccttttccaggcttggttttgcgcatcctagtttactcacgagcgtccaagcagagaagcgtggccgagcgacacgggtgaaaaaaacctacgtggcagtactaagccacgctacagctaggagcactgtgaggggccttagatggcgtagtccaaacctgggaacatgatgacgtcacaacaccatttaacccaagaaacgttgctccacagtttatgtcccgagacgaagacggcctgcccctctacattaggaagtacctagccgagtcaccgaacggaaacctgatgctcattttgagggagcatagtaccgatcgatgtgactctgaaagcgatgacgatgtcactgctattgaggaggaaaatgacaaggacaattacaatgcagcccacaagtccacaactaccgctatgatccggagccggagcctgagcttaaacccgatccaacagtaaaattccaagcatttattcttgacgagcgtcctagaggaagcgagtggagagaggtgcatgattttggtggcgcgtcaatcttcattggtagcaactcggcaacattctttttgagtgataggatccccggattaggtgcagattgcatctacttcactgaagacaatttaagttttttttgggaccgtaaacaaatgccacgtgatattggagtttttgacttgaaggctaaggtgatgaagccgatgcctttaccaggagtacacatgaaaagttggcccccacaaatttgggttactccttcgatgctatgatttcttttctctaaatcaaattaataatgtggaaaaagttattgatgcacctgtgtgcgctactatccgattataattttatcattactaaaaaaaatggcccgtgcgttgcaacgggtaaaaacgttttggatcgctatatattatactttttccttactttggtttaatttttttgtgttatttgatatagactttgaatgatatttgtcgcttgggtttttaatcgacattcgattttgtggtttgcccgctgtatgtgattaggatttgattcgatctctgatccctgattttttttttcctttgacctgcgtacgcgatgaacacctagtgagtatggggacggagggcgtgtgggttagtgttgttaatcaagtgtttaaaaatcttttatgcgacacgtaaaacacgaaacacgtggataaatgaaaataattaatttgtgttggctcaattaattacaaagttaaacagaaataattcatgaattacgtcactgtcaggcataaataatttataaacatgaatataaataaaacctatatgaatttataatcaacgttggtcataaaataaatacacatcatgagaaatatgtaggcaaatttctagttggtttagtttatctagaattaaattaataaacagtcataagcaattaaaatgatgcttgtcagggttacgggttaggcataccctttgcccttcgatatacgttacatatcgatatgtcatatccacgcgcatgcgaatatttcctgtatattgtaaggaaacctttcacggaatttatagacgggaagaatcctactcgggcagaactgggtcgttggcgtatcgtatagggtctgatacgtccgagttctacgtggagacctctagatctgcgatataaaagggaccccctagggagggtttaagatatcgaatctcagagccaacacaacctacacagcctatgaagccggagcctacgaggagccaaatcgtcgagggctagtcgaaacaactcgactacaatctcgccggatccgacaagttcccttgttccctttgtaatctgtgttttctaccatataatcccacatcaactggattagggttattacctatcaaggggcctgaaccagtataattcttgtcttttgtttgcttgatgtcgtactacgtaggtccttgtaccaacgtaccccaataccctctatatctggtctacgggtatcacccgtcgacagtggcgcgccaggtagggggccttggtactcaaggttctactactatgtcatccagcttcgtcgacaacaacgtcagcactagcctcagtactccctgcttcaacaatgctggtatggactcaagtcggcgaaatcgtcttcccggtttacaccacgacgccgatctcaaccagtcctccaatgactggagacgagaacgcagtggctacgaaccaaggcgattccatgtcgaaaaatcctcccatcgagacgaagaacggaatatcgatgacatctaagctcgagaaggattctgatacggtcaaaccttgtccttccgacatgaaccacgagtcgacaaagatgacttccgaagccacaaggtcttggtgtcctatccacaaaaccaagaaacacactctgcaagattgctgggttttcctcaacgtccgtgttgaaattcgcgcctgcaaagaacatggaattcaacgtacttctccaactcaggatgtctattgtcctattcacaagacaaagaatcatgacctctcgagctgcaaagtctttctcggcgccatgaaagctccgtctcctaagtcatatgtccccatcagggataacagcaaggaacaaggagcgactctaacttcagatcgattcgttggggtaatcgatatcgatcctcatgaaccatcggtcttacatctccttgaggactatgggtcatcgacaacgagcgcgccgtgggaggtattggctatcgatgacgttggcacgtcagcgcacgccaacgcagaagtggggaatcaatcaactactctagcccagcatatcagggctgttcaagcgatactgaggaaaactccttacgatcccgttctgaacgttgacctcgagcgttggacagaacgactacgggaatcggtgactaacctcagcaacgcgtttgaagaagccactaccgcagcacaccaagagcagccaccaactggcgaggccaatggtgaagatccggaacggagggaatcacctcaacgagctacccctccacctcgcggcactggcgatctccgagatcaaatcaacggccgccgagaagcacgacgcacacgagacaacgtgaatcgctctcggcgtcatgtctcttcacggtgccatgataacataaatcgaggagaccgctcaaacgaggaccgggaccacgacaaccatcacgatcacaacgatcgcgaacgacgggtgccagacaatactggtcatggccgccgccgtatcgacgacgacgatggagatcggcgccgagacaacagcggaagacgacgacaggattcccgagatccaggccgtcatcctcgtaatcgtacgccggaaccaagcgacccggaagccttacctattttctaattaggtatagataaagatatatggatatagatttatgtttgaaataaaggccaaaataaaatttcattattgaaaaacatataaatacagagtatatgaatttgataaccatatatatgtatacttttaaaaaataatcactattatgatcagctgtgaccattgtttatttaatcgcttgccttatacacatccgtaaagacttaagtgctgaagtacatcttcaggtgaaaaaagaatctgctgcgcctgatactactctccattgctccatccatgctgtacggtgcgccctggaaccactgtgtcaacggctcgccgacgcgagacagagaggagtcccaactcccccgtctgatttgtagcgataggagcgatctgcaggctggtggcgcacagactccagactttgtgggccgcattgcgcagcaaaatcggagtgacggaggtggcgacgtacgccggataaaaatcggaccgaaaaaatcacataaatgaatcgtaaatacaagcatatatgtaccaaatgtatgacttaagtagaccaaatgtatgacttaagtagacagaaactaatcaattgagttacttgacctcgctctctcgatattttatgggcctgttcagattgtagccaaaatggtaatattgtcaaaattttggtaagattttttatatatttaccaaatttggcaacaaactaaacgtagatatttttttgacaactttaaaaaaaatagtatggctgaaaatgacatcaatctgaacagcccccgtatctttttatctttcggtactaaaattatttgtcatgtgctaaagatggagtccaaatatgtaagttatttttgttattataaatattttgtttggatccaatcgagctaactggtgttgtagttttttctgtcacgttaaagtacacgggaagcaactgtacatcaacggtacattaatcgacggcttgacgcacatagttatctgctcacctattataaaaggggaattaggcaacacgatcctctcctctcccccacttgtcatccccacattaacccctcctctctctcccactggtcatcccacgtcaacgcctcctctcccccacgtgtgatcacatcgaagacatggagaacgggcagggggctggggcagctggatttttcacattttggtccttttgaaaaacttatttcgcaaatagacccctgaaaaaacttatcctagaaatggtccttttttgggcgccagagtggctggcgccgtcatccaacgggacggcgccagagaggctggcgccgtcctcctgccacagtggcgcacgcgaaccgacgtggcaggaggagggcgccagccatgctggcgccgccgcctccattcctgtttctctgtatgaagttgcaacggtgtcatttttattttattttttcggatgttttttcacacttaggatcacgatacaaccaaccacaaaaaaaatttaaactcgaactaccacttaactaagtctgaaaatagctagcataccactcagtctactttgcaccttcactaaaattagaccataattcctttagtaaaaccctttgatcagcatgttaaacataatgcactctaccactatatgaaattacttaatctaattcaaaatataaccacatgaaatgacatatataagttaaacagtacatagagatgtaattttttttatttttatttcatttttttgatatttttttcacacttaggagaacataggaaccaaccgtataaaaaataaacttaaacggacaaaatatgtgacttgtagaattttccaaaactctaccgaaacggacaaaatatgtcatctaataaaataggcgtaactttctcatacggactcggaatcaggcaaataatatatgcacggacatctatagaaaatgttacatccgattctctctagctttgccgggttcggcgatattaaaacctccaaattccgcttgcaagattgtgttttcgaggagagaagtttttcggtagaactttggaaaattccacataccacatatttcgtccgtttgagtttattttttacatggttgattcctgtgagttcctaagtgtgaaaaaaatatcaaaaaataaaataaaaataaaaaagttgcacatctctcctttgcactagttcggagagagaggagaggagaggaaaaattctacaggtcacatattacgtccatttgagttcaatttttctatggttggtttttatgtgtccctaagcgtgaaaaaaatatcaaacaaataaaacaaaaataaaaaatttcgggggggggggcgccagccactctggcgcactccctagccacctcagcatcgccccgccacgtcggcagggggacggcgccagagaggctggcactgtcctgttggacgacggcgccagccactctggcgccccaaaaaggaccatttttaggataagtttttctaggggtctatttgcgaaataagttttttaaaaggaccaaaatgtgaaaaatccaggctggggcaccagcaccaccggtgctttctctgtgggctcgtggtcaccgattcttgtgcagggtgtgtgttctttctgacgacgatgagacggtgacagtaccacgcctcacgagggatgacatgtggcgccactatcgtttagagcaccatcgtctgatcttgccattcgtttgccgcaattgcggtaacaggttccctgctcagcgaggacctacatgttcacatttcgctcaatgagtgtcagcgctgagcgccgatcgtcggtgccgtggaattttcttgtgtttcttggttcgtggttggacgcttgaacattgtgtcgtttgatgggtcggactatgtgaacccaattctgtacttccttttacgtgttgaggccgtgagatagcatatgcgtcaacaacgcgggtcgaactgccgacccaagaggcgaagatggtgaccagccggttcggggagaggcagccaccgcgacggcttcttggcgacgacggcggccccagcgtccacggcgatggcttcttggcgacggcggcggccgcagcgtccacggcgagggcttcttggcgacggcggcggccccagcgtccacggcgactgcttcttggcgacggtggcggccccagcgtccacggcggcggcggccccagcgtccacggtgacggcggcgcccccaacgtccacggcgacggcttcttcgacggcggcggccccagcatcgacgggaccacgacgacaaagaaggcgtccaagggttcatatcggcggcaagaaggcggccggaatccaagaatgcacgagtacaacaagaacggcgagaagtttcggagcgcacgaggtcctggcggggcaacctcaagaacgcgaccagaggccaagaaggcggttccgaagatcggagatgaagaatcaccccgccgaagtcggagatagaagcggggttcttggcgaatacggctggatcaagaacgcggcggcagaaatcggagatcactgaagtggcgcacggattcttgcgacggctccaacaggtacggataagttgttctttgctttcacctttgagcatttagttggttgatcagtgtgttggagacctaatttttcagcttgttcagcagtagaatattatcttctccagttaactagttaagcatgctattgtcggtactcagtactgctttgcttcaataaaatggtatttatggttgtgatcgtgcagataattagattgcattggacgtgctttgcttagcacacaccctaaatcttgtagaatcagttcacaacagctatatcctttatcaggttttgggggaagtgggtcatcatttgcttcagatgatccattttcctccaaataaaggtcatcttagaatttccagttatacatgtataggtgtgtttgttgcctttgagatatccatgtaagggcttcgtgcttcctgaatatctttgatttttttgttggttgatgcaatgtgatcgatgtggtcttgttgtgcaatattacttatgtgacctgtagtctcatatcgcccttttgcaaaaattcctattatagcttttatgtcattatttacttattagtcaaaatcaagctggttaacccattctctctttggtatattaaattgcacattgggtaagttatttttaccaaactttcatcttagaccacctcattggcaatgtttcagattgcggagatccagtgtttcaagaaaaaaaagaatcgccgggcgtgtttcagaaaataaatggatgatagaagatatgctagagttgctgctgctggaggaggggtatctgttacagtaagccacctccccttgagctgaaatgaccaattgtatcccttgttgtgattggtgtcagtgtcagagatggagttctctgacttgttgacaggtaagtgtgtaacttttaattatctcatttcatgaacgaattcttatggaataaagtttgcaaagaagaaaaaggggtgttacctttttcttatggttatcttgaattacatcgggttgtaactgttgacactccctttttgtaggtatatgtgcgcacatgccttatcctcagccatcctggtataggatgtcggtgccttgcaggatatgtcaatccagttagtgtcgcgaatggtatatgtttattcttagaacattgcatcttgttgacattttttagtgcgagacgtaaatatgtaatactcccaaaactaattatgcagggccactagacttggtcgtgagcaccgatgacctaactaagtttatgctgggaatggatatgctgttgaagcatttcatcatttacctggaatatccaagaggtgcatatagggatgaaaacggagcggatagtttccgtccgctccggacaaaaacggatacggatacctttcggatcggataattctcggatatttcggatacggatacgaatatggatattttctctcggatacgaatacgaatatggtatcagggtttccgtcggatacggataataattcggatatccggtgaacagtgctattcgaatatccgcaggacccatgagatataccccatttctttctaactctataaccttcaatatacctttatagattttaatagtagtttatctcttaacactagtccatactattaatattatttaaattttaaaaaatatttataaattataccttattttatataaaatgagctaattatatatgttgatatttgtttctattagaagttgagttggttttcgtgttccgagaaaaatttgtttccgtattcgtgtccgatcatattcgattcttatttgtattcgagataatccgtatttgtttccgtattcgagctatccgtattcgagttatccgtattcgtttttgtatccggtaaaaaaaatatgaaaacgaatatggtatgagcattatccgtccgtatccgctccgttttcatccccaggtgcatattatttctcagttgctttatgttgatatgcttctatttaaactgtattgtgaaattacgtgtactggttgatattgacagaaactattctgtgtttcttcatgaattcaaacttctgctgatattcctcaggttggagttcaatctcaccctgcaaagtactaaatgacttgaaaaggacacttgcatgcttttgacaatgaccattgccaggatgtgggacaagaaactactgctaccgatgttacacactttcttaagggcccgtttagttccctaaattttttttccaaaaacatcacatcgaatctttggacatatacatgaagcattaaatatagataaaaagaaaaactaattgcacagtcataggggaaatcgtgagacgaatcttttaagcctaattagtccgtgattagccataaatactacagtaacccacatgtgctaataacggcttaattagtctcaaaagattcgtctcgcggtttccaggcaagttttgaaattagttttttcattcgtgtccgaaaaccccttcggacatccggtcaaacgtccgatgtgacacctaaaaatttcctttttcccaactaaacacacccttaatttaccagtagctaagcaagaaagtatggcagatggcatgcaagggatcgatcttgaagtttgtcaacgaattttcagactttatcgatgccacagagtccaccagacaggctagcattgctgagattggctgctgcgacttctataaagcgtgcttttacatggagaaattctacgaggtctggcactccatgttggaaaccatgaacttactaggctgtcggtatgttactttgaccaaaatttatcagtagtaagtttctattattttttgaaacggtagaggacaggagggctgccggttatattagaaggaaaaagggcaaaaaagagttgttacaacgttttaaaggggcttagatcagggggagaatacaacttaaggatacatcggagggaaagaaagaaaggaaattagggaggcttgaaggcaaaagtccgtaagtctaggtcttccttaattagcgttgctacttcctcaaaagatttggatgtttccattaagaattttggttcttgtcaatgactgtttttgtgataaagaaattaagttctcacccacatgatctcgtctgcaaaagtgtcattattagagagttgtaccacacacaagtgtctgtaatttccttctccagtttgatcacattttgtggaatatggagtggcaaattgttcatgcatgcacatgataaaaccttatgtttccttgtttgcatctcataagttatgtgctatacactgtctttattcatatttcgattatgtatgtttaagcaagctatagcatgatcagtaaaatgtcaataggaatatgtgcttagacttattttagggcgtatggcttgagcagaccaatgaaccatgaacctgttagaaatacagaggatgtgcattgatttctttaagagagagagagagagagagagagagagagagagagagagagagagagagaaggatttgcatattttccaatcctctctcatgagtttagccaaaccattaagtgttttttattcaatctgttcgttgttgttgttgccctaaagaattcatttgttatttgactaaatgtgctcaaatatatgtattatcaagcacttacaaaggatctttcacttttcagcccatggtcgtctatcattgaggaatttagtcataacgcggaataagatgctacagaaggagctggatcacgcaccaactgttaaggaactgatgctgctgcagtgtttttcggcctcctctatctgcacctcctgttgcaattaaaagatctggtgcgaaaacttggcctgcctagcaatatagtacccctgaagctgaggactgatcgatgggtcaatgatggataggtagaagctaaggttctccaatggcccatggcactcctatgattcaaggcacccgataatgcagggcactccctgactcaaggaacctctggagctcctacatttgaaggtgctcctgctgaaacacttagagggtatagctagaagcagcagacaatgccgagaaaatagcagcaccggtgatgacggacgcgacaagtgatcttgattctaatatcaccgttacaatggtgcaccttctaccgaatcagcagataagccatcttcaacacagccatcaccagcaccacctttcctgctatataaatctgtcggattcgattcttttcagtgtgacgatttttttcatatgcagatgtatgcgttccactgtaatttttctgtactggtgtagtttttgcattgggcagtatctgatagtaaccctgtacgtccgctgtccacatcccaaagagggagctatacatacattgtgtgacatagcgtttgttgtctgtgacagtctaaagttttgctggatgaactaatatgtgtcctgccaccaatctgcacgtttttttctctgtaatgttgattacttctctttctatatagcgcaagtgctgagcagcaagccgtcgactgtaaaatctcaccagtttatctatctaatatatggacagcgagcattctagacccccctatcgcttgtactagtactagcagcgagcatttggttgggccaaatttagttgagcttacgtgattgggttgcgcagggttcggtacagtgtcaccggtgcaccgcgcaggcgagcggagtgcggaaactctcggcggtcaggtgctgggtgttgctaacttgtcgtgttggccacttttttttcgccggaaagaccgaaggaggtcattcaattaagattggaagaaaaggttacaagaaaaggttttacatcgatagctggttgtcgaggaaggatgtgcactagagcacacgccccgaaccaagtgccaaccgcaaacacacgctacagagaggggagccgagcaccgaaccggccgtcgctatgcgagaccgatcgccaccgggccaacaacaccaccacgacgcgaagactctaaaacgacgccctcaggaaggtcgcgacgccaaaagacgccgtcgtcatccgtcccaaaaacggaacaaggttttcacccagagctccttgccaagggaggaggggtacctcaaccatgccctcaggagggttaccacacccgaaagcgacccgaaagcgtagtcactgttggcccaaaggttgggctaagctttcgctcggtaccccctaccgccatggtccgttgcccaatccgaaaccaccatctaaacatcggcggcacatggcttccaccacacccaaccgacgccccaccgccggccggcttccagtcttgccaacgacaagactgccacagcaccaaccacctccgccaggtagctgacccaagccgcctctgccacgccgcccgccggcttccccgttgaatccaacttaagggagtccggacatggaacaacattgcctcggcaacctgagttttccttgtcaactgaccaccgccaccagcctgtcaagaagctccccgcagagaggggaggagctcgccaaacagggttagcctggtcgacaacaaggaagacgaccccgccgccacgccctagcacgctgacccaggccaccttcgccacgccgccctttagcctccacgtcgaatccgacctatg

SEQ ID NO: 42576 - DNA, 17814 bp, Oryza sativa
  unsure (1)..(17814): unsure at all n locations
ccggtgagcagcagatgccctccgcttctgcgctcgagccaggccgaccgagctgtagccgcatgccgccgcgccgcctcaagccgcgtcgcgccgccggcgcgccagatctaggcgaggggtggccggatttggccttgggggcgccggatccgccgcctccccacgcctcgccgccgtggccgcctcgcccgagccgcgccaccgcctctgaccgcgctggtgagggatggtgccccgtccacgtcgcgccgaggaggggaacaccacgaaggagagaagcctcgccgccgccttccttacacgccgccggcgagctccggcagcggcgaggtgagggggaaggagtggaggcgtgggcggctagggtttttggccccccgagccgcccgcgcgagagcgacgcggggagtttttctgaagttctccttcaaagatgtttcgtgttggccacttgggagttgggaactaggaagcaaatcctctgccatctgttacagttggtttgatatcggataaagcgtgtgcatttcgcgcttcggatatgtgattatgtggccaactagcccctaatttgtgtgacatacgcactcatctacctcatgcatcatggattggaccggagtcggacacttcccacgcacattttgatatgagtaatttgcgttggctgtataagaacttggcaggtggatacaattaggtgcaaaaacttaaaagccgagtatagcagtacaataacttggctaggtgggtgcgctcatggtgcaaaagttgccacgccattgttccacctcagcgaaagtgacacatgagcattgaccttatcattttacagaaaagtccctagtaacttttatatttcaattacttcttttttagatgtatctgttttcctcgtgtcgcaatgatcaaaccagtccatcttctcatccaaataaattctactactgccaactccaaaaaaagaaaaacccaccatgatgcagttcaattgtgaattcttctttctcatggcctgcactacaaaataattggttgatgtgatataccgcataaggaaaataatacactaagattatttgcagattatccaactaactatatgctgctgataatggtacaacacatctagcaagaatttctcattgccaatgttactcttatatcgtatacagctacaggaaacaccaataattttagtgcaaccaatctcgtggctagtaccattagatcacttcattgaattgtaataacaaataatatgatattcaagtgaaaacccaaaaaaaatacagccattgtatagatcaatgaaacctttactttgcaatcatccatcaaatgaacaaaaaatagaagtctacaaccatcagcaagtgatttaccataacaagctaggagcatatgctccaaaaactcgtcgagtcggagctatcccaaagcttgcggcgatcacgtcgacagcagcaatttatcgacttgaattggtttggttattggtttagggattgaactaatgtgacacacggagccctcatcgccaccgcgatgtaatggtttcgctcgttgtcgttgctgtcgcggccaccgccaccgccaccaccgcagctacctctcaattaggatcacgtcaagaaagatggaagaagatatgcatacgtttgttttgtttattgagttaaaaaggaatgtgattggaaaaaaaaaagctattaggggttttctatgaaatgagatagttctttcatgtcaaagctgatgtggcaattttgctaaggtggaatagtaaggtggcaatttcttttacgtggctacttttgcaccatgagtgcacccacctagccagccaagttattgtaccgctaccactactacgaaaaccatctttcgtggtggctattttgggttttcgctggcggaatttggagccgccacaaagcaaaggccagtgaaaatcaagatcttcgctagcggttatcgaccacaagcgaaaaaacattttcgctggcggccgccttaagccagccgtcagcaaaaatccattttcgctggcgactggtttaagacggcagccagcgaaaatgtttttttttctgacggttacactataccagccgccagagaaaatactgaccaagtttataagaaaaaacgacgaacggagcgaacgctccgtccgcctccacctccatcaaagctccatccacccaagcatgagcatcacaaaaatttgaatcattagcacgtggctacagtatggcatcaaccatcccaatccattcacacatcacaaattcaccccaaatctcataatacattcaacagattaattcacaaatcacaaaatcaccacaaattaacacatccattcacaaatcacaataaaataccaaaaaaattcatccgttgttcttaaaaaaaatccaccgcctccacctcgccaccgccgctacagagccgtgccgcagcctccatcgtggcccgtgcgccagatctgagagagagagtgtgtggtggtggcagagagagacctgggaggtgcgccgcctcgatccgtgtgctcctccgctccggatctggtcccgtcgccggatccgccgcgagccgcctcgggcaccgccgccgtgagctgcacgagcgccgccgcatcgcgacgcacgggcgccgcctcgatccgcgtgctgctgctgctgggctcgtcgccgctgctagtggggagtgaagggggaggagagggagaggtgggtggagagaagaggagagggagaggtgggtggagaggactgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaatccctccaaatcaaattcctccgcaaaagtccattttgcctcccccagggtcgatgggccgattttccctcggcccatcttcccctctctctcccggctctctctctcgctttccccggcgcgcccccgctctctccctctctccctccgctccgccccgcgccgcgcgcgcgagcgcgtgtcgccgcgccgagcgcccctccctcgcgcgccgcgcgcgagcgcgagagccgcgccctgcgcccctccgctcggccccgcgagccagcacgcgtaagccgcccgcgccgagccaagtcctccctcaccgctccctcgctgccgcttcccgcgcgccgtgttcgcgtgcgcgcgcccgcgcggacgccgcccgttgcaagccgcgcgcgcgtgccgaatggtcgaccgcccggtcgccgccgccgtcagcctctgcacgcgcctgtcgccaatgtcgccgctccgctccaagccgtccccccgtcatcgtcgtcgtcatcgcccggcccccgccactccgcgcgcaagccgccaagggacggagccgcgcccctcctccctctgccgcgacgctcccgctccccttcccctttttcccgaatcggcaaaggggcaagcccctttctccccctcctttttccctttttcctcctcgccggcgtcatcctcctgccgccgctttggctgcaagcgccgagcgccagctcgcgccttgaccgttcaatgtcggtttccctcgcccaaaccgacattgccgcccatttaagcccaagccctccccctccaaactctctcattttcgcctccgcgccattgccgccctctgtttcgccgtcgccgatcgtcgttgcgcgtgtcggaggagccggcacgagcaaggacgcggaagaggactccggccgcgccctctccttcctcttccccggcccgaggccggagagattactcccgcgccgtcggcctctcgtcacagcgccccgtcccgcacggtagtgcctccctccgttcttcctcctcgctccatctcctccccttagatttcggtagtagctcgagtagcctccccgtagttagccggcgccgccccgactgttgccgtcgctcgccgtgtgctcgccgccgtcgccgcccgagctccgtagcacccgctcgtcgccggcctcgctcggcgtagttccgcccaatccgacgctagcgtcgagttcccgacgccgcgtagatgctctcaccgccgggaatcgacctctcgtgacctcgtcgccgtttccctcttctcccgccgccggttgccgccgccgcaatccgccgccgtcgagcaacctccgacgaatccgagccgttggctcgtctccccttgtcacgtgcagccgcccggtgtgctcgcttttgcctgtatcaccgtggttcgctccgctgctcgccgccgccacccgccgtccattcgcggccgggtcgtcgtctacctcccgccggcccgcgtggcagccacgtaggcgccacgtcggcgccagctcagcctagaccgggtcgagcccaccccggtcggtccctccccgtgcgcgcgttccaccgcgagccgtgaggctgcgcgtgggcccgccgcatccgcgtccaccgcgagccgcgcgcgtgcaccgcgtcccaaccccgcccgcgcgcgtgcgccgtgcgcaccctccgcacggtgagccgagccgctgacaagcgggtcccacccgggaccacgcgtggtgagcccggtccaccggctccctctctctcctccctcccgcgcgcgcgcgcttgggccgtcttgggccggccggtccgttaagctcggccgagctgccccaaatctcttgggccgcaccctagccacccgagaaaagtctatattccctccctcctttcttttctttttcttttccaaaaaggatttaattaaatcctttttccgttagaccaaaaatccaataatcttagaaattcaatatcttcccacccgtaaatccgtttgactccgttcaacttccaaaattcctcaaatctcgagatctatctaatggcacgcttagaggtcattaatagggctttattttcgccgtttgttgagttgttccgtttcgcgtgtagttccggagcccgaagacccgcagtgcgaggatttcgaggatcaagctccagatctcgagcaaggcaagccacctttgaacatcttgagcctatatttgaaatctaattatattgcttgcaaaatattatgcattgataggatcgcacttaatctattgttccgtctgcaaggcagattggcggacctacctaaattgttgcatttgatcctttccttgttaattgttacagcatgtccccttgtaaccacctagttgcgtcttgatattcgtgcatcctgtgcgagtatcgacggacgccttcaaacttataatctgaataacaacttgggtaaaacttgggttttacgaaagatttggaaaacccgacacctgggtcggtgcttgcgaactaaatgaatttccagaaccgcggaccggggaacgtaccgggtgtacggtttcccgctctcgcacttaaggaccgatttccttggaatttcatccaaacataagataagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgttggcatatggtaaacctgtatcggctttcaaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaaggggttcgatgtttgaaaaatcagcagctgacgggatcagctaggcccgggtggccgtttgaaaagttgttggcccgggtggccgtttgaaaagttgttggcccgggtggccgtttgaaaagctgttggccgggtgccaaccttgttgcaatcctaaagagtgacacattgcacatactccgaccggacgagacgcactgtctcatccgagtcgtttgagaagcactcacctaatcattttagaaaagagttcaaataaaataaattgcaaaaataacagcctttccttgaagcctgcattaaacacttatttcccctggcttgctgagtactcccgtactcacccttgctctatataaataatccccccccagttgctgaagaagatgaagtggatcctgctgacgaggagttcttccaggagcaagtcggctacgatgagttttagggtttcggcctagttcccaagtcgtgcctgtgatgattggtccaagtcctggcttccgctttccttttgtaatgcagttgtgagctcgggatctgtccgcagcccaacatgactatacttctactctttaataaagagacctctgttgctgtgatactctgtctccctgtgataccagcactgtttcctgggactggtatcgattaacaggttaatttggagcgtcacgggctagttccggtcgggactagttcggggcgtgacaaggacagaggagacgcagtgggtggagataagacacgatttttctggcggaggtgttagtagccgctagtgaaaacacgatttttcttggcggacgcttaagtgctccgcctcgaaaaatagagtttttttatggcggatctcttagcgtggccgccagggaaaatatacttttgctggcggtccgtagccccccatcactcgttacatttttgctggcggttttcgcgtacggccaccagcgaaaattatagggcgacgccatgaaaaatcgtttttctagtagtatacgtttggttttcaagtttttgcacctaatcgtacccacctgccaagtttttgtaccgccaacgcaatttactcttttgatatatttggtggtccacttgtcatcgaaggctggatcaagtttagcgccgtgttcaagacgtgggagcgagaggcagatacggcaggggatgttgtgtcaatggcctgcaaacgtgtctagcccatgtgccggcctcacttcaagcctattaggcccacaacgggttacaagagtgcgtacgcagagttctgagctcatttgacatttagcccagctaaaaattaaaaaacttggtacatgaaacttcttaatagcaacattcagtatacaataggaactttatacataaaagttggcatagaaattttatacataaaaacctttttcatagaaactagtgttgcttgaggaggatgcaaaataaatgcttgaggatgcaaatgcaatataagtacaaagtaataatgatttactggggagggttctacatggtcaccataaaatctactccctccattctaaaatataacaacttttagccctcttctccaccatcattctattcccaaccaatcacaacactcttctatattcacttttctcacctacctccactactcaaccaatcacaaccctccaccattcaattctatatatttttttaataaccgtgtctaactctaaaatgcttattatattctaatatggagggaacagaacacgacgatggcacgatacctcatttattccaagaaactttgctcccacagcttacggaacaagaggaagataacctggtcctctagctaagtcaggggacggaaactagcgatcgaaacgatgactctgacagtgagggcgatgttgttggtacaaacgagaaagacgatgagaccgattgcaacacactcccacagtgactactctgatcatgagcctagctcacctgggctcacttggctggtgggaaatgttggttttaactgtcaggtggaagaatgtggatctttttatcgtcttgaatttgtgggttaatttgtttcttaataaactagatactaaaatattacttcctatacctatacatagattgtcaaactaagaaaaaaattcaatagagaattattgtttgggctgggatattcttactagttgtctagctaaataataagaaaaatgatactttacacatgcataacattttttttatatttatgaaaaagcaagtccttatatttaagcgatcaatgtacaatattgaattccaacattatttttgtatagaacaacatatatatatatatatatatatatatatatatatatatatatatatatatatatatatatcattaaacaaaaaaattgagaatgtcaagttatatatgtgtacacatgtaacaataatgaacactgtaagaatatcgacccccctacgcttcaacatctgtgcagcaactcactcgacacactccttattgtccagtaatacgtacgtagacggtttagtaaactccttttttttcactcgatgcaaattacaccatgctagcatgcatgatgcacatttgccatcatatacctgccctgccctctccatctaacctatatatatcatcagtcaaatatgtttaatttgctttgttttcttccatccatcaggggccaaagcctgcacctcctgtgtgcacctcaaagttaggcatcgtcaaatgagcagaagcagccgccctgttgttaggagccgcctggctgtagccgattagcgccgccgctgggttgtagaaatctacaatgcctgcagcttccttcagcatgctgctgttgttgccaccgtggccgccgccgccgacgccgtcgttatggtggtgttcagcagcagcattgctagccttgatgttgttaccggcgacgaggtcgacggagaggtccttggccgtcgctgccgagccgccgccgcactgcctcggctgcgtctggtagaacaccttggacacgacgagctcgccgtccttctcctcctcgtcggagcccaggtggtactggtgcatcacccagttggtcttctccggcttgcgctgcttgccgtagttggtgtagagcaccaggatcttcttgtaccccttcagcttgccgccggtgaacaccggccgcgtcttgccggtcttgtgccaccgcgtctcgccgccctgctcgtcggtgtgcaccttccgccgcttccgcgtccccgtcgtgtacgccttcgacgggcggtggaagaagtgccggatcaggccgtccttgccgactcctgaaattaacagcggcagaaagagaacagtacggttaatatggtagagtgccacactgccactgctctcacgaatgagttaagagatgcaaatgtaatcaattatattacgtgcatgcatgcaacagcaggtcagcaacacaacaagagtggcttcgtaatcgtagtatccagttgaccagttccaatgtcctgacggctgacggctgacgcagcataagaccattcagtcaaactatatgacgaatgggcccagttaatgatggttttgggccgactccagcaattctctgattctatctctctccccctgaactgttattgtttagttattttttgcgtcctttccatcataagaaaaatacttgctcggtgtttcaatacatattctctctgttccaaaaataaatttattttacactcatcccatatgtaccaatataaaacaaaaagacataccctcactttatcaaatcttaatgcaattattcctcattttacctacattccagtgcatctattatttactttcacaaactctagtgcaatgagtgttcaaaaataaatttattttaaaataaatgggagagacaaaaataaacttattctgaggtagggagtattacactaccaactttattcgttcgtatagctttgactattttttttctattagtataacaataatgtgtaacaaaaatttagtattgtaaaagtacttaaaaaaactgctcttttgatttttattttcaaattaaatacatatttgagagatgttgatggttaaactttaaagtttcaccgaataaaattatatttaaagaggaggtgggggcgtatttgtgttttgcatctcttaacatagaaatgaaatttcccaggttgtaaaaaaaggaaaagattatgcatgttaactacaaccttaaacttttataaaagtgtgatagacaatcctagaatcttcatacattatttaaccataaactatcaaaaatagattactttttatacaacggactgaatttaaagtggtttagtggagatatggcgctgaagggtgaaactatctttgaatttaaagaattactcaccgataaacttcagaaaatccttatccacattatggagtacttataatataatgtagatagtagtggagccatgctgtgaccctgtaaggtcaattaaccccgatagaatttttgcaatcaagtactattagtaaaaaaaatatttgcatttcgcgcgaggtggatcttgatcttggctcagccactgaatctaggtaaatttggtgtaatataaataaaatgtatatnnnnnnnnnnnnnnnnnnnnngaactaaataacacatttttatttgtcggcttaattattttcttacagatagaattaatttaggtcagctgtaatctatgaaatgtaaagaaaattactttgtaccatggaaggagcatcccctgcatgcacattgttttccagctcaacacgcatatgtctaacagactaccacaccaatattcccatgagaataccccacgaacggccgctagctccagcaccaacaaagaaaaaaaatgtttgcgttgtaaacgacataaagagccacttgcattggttttttaatcataattaattcttgctagataaaagtatttgtaatatatcattttctactggattaatatatagtacaatggtgacacgtggtttattattgataactgcttatatgaaaatagagttccatgaaaataatatgatcagtgcactataatgtctcttggtgcaatatttctatcactatggtagaaaatagtacaagttatcctgtggaatggaatgcaacccccctgaagaatataatattatatttccaaaagcaggaaaggcactcataataatttaaagtatctgtcagttattcttaggccatgtttagattcaaaaatttttctttaaacttccaacttttccgtcacatcaaatgtttagacacatccatgtagcattaaatgtggatgaaaaaaaaccaattcacagtttgcatgtaaataacgagacgaatcttttgagcctaattatgccatgatttaacaatgtgatgctacagtaaacatttgctaataatgaattaattaggcttaataaaattgtctcgcagtttatagacggaatctgtaatttgttttgttattagtcttcgttaatacttcaaatgtaatttgttttgttattagtcttcgttaatactttaaatgtgtgtccgtatagttcaaaaaaaatttggcacacaaactaaacatagccttattgcacaaatatacaatgactatcctacccatgcaaatacaccattatatataggcaaattaaatactaggaatataaaaggataagggaaaaaccagttcatattgcaacaagtcttttcaaagtttattctccctttgatctgatgttgcgtgtatcctgcatgacgtggacctttgatgcactgtgctgtcacaatcactcgttttcaatgtgaaataaacttttatgcaagtaggagaagcaattacttcaaaggcaaactttagcaatatttatacggtatcgtgctcaaatgcaacaacacacgatcggacatacacgaaattaatgaaaaacgcaaggacgatcgacatgtatataccctagtgtggatgttacaaatactaagcggctacgcatgattgacatatatgaagcaaggtcatcaaattggaaacgaccagtaaaactttatatcaaaatagggaattttaaactgagaatcaaccaagcaagaaaatgttttgtcaggagtacttccgtgacggacagcacctatagtttccacgtcccgtccagatctgatcatctttgcaattgctatagctgatggcacaatgtaattaagcatgcaagctagctgatcgagacaaatgcacttatgtagatcatgaactgatgaaactaaaactgattcgatatatgtcgatgagtcgtaggaaaagcatgcatgtaagtatattatacgtgcctggaagcctctcgggatgggtgtagcagatgccgttctcgccctcgatggtggggatgaactcgtcgatgagggggtggagcttccgcgcgtcaggcctcgccttcccttccaggtgctccagcagctcctggtccgtcgggtcgaacttcaccccggccggcagccccggcaggtcctggatcgtcgccgccgccgctgcctgcaactgactctacaccatgctcaatgccatccaacatgtacacaggagaccgatcgatcgatcgagcagggaggaagctctagctagctacctgctcatactgcgcgcggtggccgcaggaggggcaggtcttgatgaggttgacgtgctgggagacctgctgctgctgctgctgcttcttggccgcggccacggcggcggcggtggccaggttgttctccacggcgcgcacgtcgttgaagctgttgcaccatgtcatggctgtataatccaacaagacgagagatcgtgcagagagagcgagccagaaagcctctctctctctctctccctgtccctccctccggcctacgctttgctcgtcgcccccatatgcggcaaacgttaaggcgagaccccgcgcgcgggaggagggagagagaaaggaggagaggagggaacaaagcggcctgatcgacgagagggagaacaaagagaaaagagaggggagctataggaagcttgtccctgttaaaagctactcctactagctgctaatcgcctaatcctccctgcctgccttcccggcccagctgctgcgcgcggctactgattttctatctccatctggtacagaccaaggaggagaatgaaggtggattctaaacactaatcagagtttgatttgttatttttgttacaacttatagaagttgaatttgaacttgcatatttgtggggtgatatattacatatgaatctatcttgtcaaatttttttgaatttttttcatacacatttagttgacatacaacaaatgggtgtatctacctaggtgattaaaagtgtttccggaggagaatacatcaattctcacaccaacttttcggttggcgcttcccaggaagatcgccacgagctgatctctctctctctctctctctctctctctctctctctctctctctctctctctggcgaggcaggcagaggcagaaccggcagtgcatcagctgtgtagtgcaggcaacaactacagaaagaacactccacaaaaggagcaagagactaggattagagagagatcgagctagctataggggacgtacgtgcaacagctagctaggagatcaaaatgaaaggctaaagcgatcgattaacaggctgaacaatgagcgtttgacagctatgggcatggacggatatgtgtcatgtgtgtcgtcgtcgcgaggtgtgcggcaacacgcgcggatgataaactgacaataaatcaatcaatcaaactccatagctaattaagctaggcgaacagcgagagcgaatcatagaacgcaggggatcgatccgggcgaatgatgcggtgttgcttggccctcaagtctgggcttgctaatgcaaaccgtatacgtgagccgcaaaccaggcgccggattctctgcgcgcgagttgctgcgtgtacatctcccgatcgagatatggacgtccggccaccacacgtacacaccacaccaatttgacggttaacatttacacgtcagaaatgacaccggccggtgttaatatagcttagctgctgctatagcgctggtcgtacgtactactactatagtatagtccatggccaaaggcttgcgttgcaagaaagcacctacacttgcgattaaccggaagacccgtacaccaaacgcatatgaaatgcatgacgaagcgattggtcgaggagaaggttgcgcgaaatgcgtgtactttggctggggtttaaattaaaggcggcaggatgacctacattctcctccgcgcgcgcgagaccccggctggtacggtgcgcgcagggtgtgcgtgcgtgcatgtacgtgcaggtagccgctgcgaaatacgtatacgcacacatatactaaccactgttcatcgtttcaacacggttagctagctctatagctatccaatcagttggtaaacaaactatacacgtacactttgattaatattattccattcgatctgtgatttatggtgtgtatgacgttcgatcgatataactctatcaaactgggggattgcgaataccctaagctatttcgcaatagaatacagatgagagaggagagggttgggggaaaaggcaaaggagggacagagaggaggtagctagatgcatgagagagagggaattagaccggctggccaaaagcgtacgtgtggaggagggggaggaggaggaggagggtggagtggagatggggcaacctgattcgatcgcgaggacgtcccaccacaccacaccacaccacaccgccccacctgcaacacgcacaacaccctactacttggcagcacgattgatcgcctgtcagtcagtcgtctctcgcggatggatcgagtcgcggggggtggcggctgggctggctgcggtgtgcgcgcgcgtgcgtgaccgcgtgagatggggatggatttgggagagagagggacttttagatatgaggtcaccgtagagtgtcttggaagagagaaatgatgatagtagtgtatagagcccagcccccagcgacaaaaggactcctgaacgaccgagccgggggggcgcgcgcgtacgtcgtcgatccaccggtcgagacgaggcgcgtccgcgcgtgtattgatccgtcccgtacgttgatcgatctgggcgtttgggggccatgtgcagatgcgtcgtggcgtgcgtgaacatgcgcacctgcgggatttggaccggtcgatctaagtttgagggcgtggatttgggaccattgatcttcggcgtatcggtccggccggtcgcgatgagctaagcgatacgtcatgcccctggatcagattgacaggaatcagagattagttaattaagtataatactccctccatactcgtaaagacagtgacacggtttccaaaatacaactttgacttcttatttctataaaaatatttattgaaaagtgatatatgtatacttttatgaaagtatttttcaagacaaatctatatatataatttttacatttttaaactcaacaacttaagagttattcataatttatattttcaaggtttgacttaaacattgttctaaaagacttcctttatgagtatggagggagtataagtagtactaggcactactccctccgtttccaattaatcatcgtattataggagcgcaccaagatcaaaaaaaaaaagaaaaatccataactctcatatacttatatttactttggtaacaaactcgatgcatgtggacaattctcactattttctaactaataacaaaccaagacatcactttggttgtaaaatattatgtgcagggatacatgcaccaatattatttactcccatacacagataacgaatagacttatgtaatgataataatatgatgatcacttgggaataaccccaaaaaagttagatgatgatcaattgggaatagagggagtatattataagacgttttggcatttccatcgctcgtttagatccactaacatctatacgaatttggacacatatatgaagcacatatatggatccatgcataactatattcaaaatccaaacatcttataatgtgaaacaaatgaagtaggtgagaattaacaagggtatttaaggtatagcattatactcccaaacattgccacacctccttacaaaacctagccaaaggtgtggtcataaattgatggccacacctcttagacaaggtttggctaaaagatgggtgtaagacatgtgggcctttgaattgaaaaactatggtatgccataactttgatagtgaaacaaatatactccatatgtaccatatatggcaattttgtactggatgagacatcctaaaactacgaatctggacaggggcatgtccagattcgtagttataagatgtgtcacatccagcacgcccctatccaaattcatagttatagaatgcgtcatatctgacactagattgctatattaattatgggacggaagtggtatatcctagaaagggtggtgaagtttggcaaaataagggagtgacccaaacaaccacaagcataacttcaggctgattacaacgtgttagtcgccaacccttgaggatattatatggactataattactggtattttaagattgaaattcaaatattatgttaaatgtatgatcactcagatttaaatgtcttttaaaggatgtttctactttaaaagtttctatatatataccttgtgtatataaacttaattaagaaaaaaataaaaccgtgtgagcggaaaaaaatagaagtagggtgtttgcgaggggtcattagacttctctctcaaagtgtctaattagtaaagaatagatagatagatagatagatagatagatagatagatgtagatgagtacatggttaggctaccttttagcatagtcgacatgtgtcaaattagtacaccagatggggcaatagatgggagaatgtatattttattttgaaagtttaatgttgtatggtttgatcaataattagccagattcgtgcatttagtgtattaaaaagtaccttgaattgctttagtttcagaaaaagtaccttgaatatgttttacttaatggtcaaagtttaaactttaatactttttagaaaataatatacagcctacgaaaaaataatttaacaccctttcctcaacccccccaaaaaaaaccaaaaaaaagaacagttgaggtatattattcgttttcttcaacgagatttgcaacctatttctacacaccaataatattatttttcacatgtattttctccatgcatatttggttgaagaaaaaaaagtttaatctgagtatataatctcattgtgcttctcaggagggcatataaaaagcacaaagtgtgcacgtatctgcttctccctcgaagagttaaaaataactggtccatatgtatcttgacatgcaagcgtctccctattgttcgactgtgacaatctttgcgttagactacaacaaatatacgcgtcgtcgattagttggagaggtatatgcgtcgttggtaagtagtgtaatctaatcaggtactccactgctactaatactatttaatttaacttgtagggcaagtctcaccatctatagctagctccgtcatgttgaaaaacggaggcagtacttcgatccgagagaatcggaattatgttggagtttgacattttaccacactttttcaacagatgggtatgaaaatgcacaaagacttcaaggatgcaatcacttctccaacttgctctctgactctaccatg

SEQ ID NO: 42577 - DNA, 7985 bp, Oryza sativa
tctccaccttgctctctgactctaccatgcgccttaaattttcgcagaaagctagaaaaaggcacgtttttttttctcatttctcttgatatttcagagtacttttctcaacatcaaggaatgaatgaacgatcggtatgaaatgaacattggcagtcaaagatattactagtaatttctcagtgacagtctctcatattttattcgagagaattttaacccccaaaaaaaatctagagagcagttaattactacgaatacagggattgcttttgtaggactttcatgtgatttggtacatgatggacaacgacatatatcgaccattggcgattagatgttgcttcgtgtgacactgacactggacttgcttctgatgcattccatatatcgcacgatagagtacatgtacctaactgaacctgatgtatccatgtgagtgataccacctctagctaagctaccacgaagaactgaactcgcctagtgaagccaagagacaagacaaatgttacttacactgaagctttttcagaggataaaaacagttaattaaggggcgtcacacgcacaccaaggcaattcggtatgcagatatacaaagctctgacctttactagatcattggctacaactaaagctccgggcatgatcatgccatgatatgtgcaaatttaaagggatggaaagaaggaatcacatgattaaagccgtatgctgtcgcctctgatgatcggcagcttttaatttacaatgttccccagactcctggtagcagtagcacactgtcgcctcatgtcttgagaattgcagatgcagcttggttatcactcagagatcagctaggaggaccactgcatacatgcaggaggatttgtctcaaggaaagtgttttacttggaggagcctaaactgttttgttccaatggtctttatgtggtcgcctaggtgaggcaagcatgcatgcaggtttgtctctactctcaaatgctgttgttctgttctcaaaaaagaaaaaagagtgctgttgttctgaagattgtcgaggatgatcgatgttctctttgcaggctttgcagccttatattgggctgggctttgcatctatgagtttggatcagcccatttttgcctctgacatatgcatggctcggtggatccacatctatgagcaaggcattgtagttcttcataccagatgaaaagaatcaaaccaaatgcataatccagttaagcacggctaggagggaacatctatttacgtgtatatataactgccacagaacaattttagacccaaaaaactgttctttccgttaccaatgtgcgtctacaactgttggagctcaaaaaagagaaactggaacaccaaacattctcgcatttcttgccagcagaactcccagttcatttaatttttgcatctttcttgcaagaaggcatccataaacggacaacaaacagaaacagagtaacagaccattaccttccttcccttcaaatcccttccttttccattgataaaatccctagttgcgtctcctctaacaaaagatcaccaacgctaaatagaacgaactggacgaagaggacagctactatgtctgctccacaccaccgtcaccacaacatggaattgctggcaggatcagaggaatcctcttttgttgaatatatttgatcgtaccagcaacatgagcccatgcagaaaacaatcgcccagacataagaacatcaaatttcttccttcagacactgtccctgtcttccaattcctggctccaaccttggcaacggcagcacaaggcccctgcagtgacaatgttacattcatcaaatggtaacatgatggttctttgtgcgttgccctgctttgttctcagtttcacagatagcttcagggataaggaagggaatgcgcgctataggtttgtcgcattcaagggattgtggggtcatcgacaatcaagcacctcttgatccacacgttgtagttgaatgaatacaatttctagactttgtccattgaactgtttcagcaatgacttttgtttctatagcgctgttagaccaaaatgtggtgtcttgcttcaatccaataccgtaagagtaagcaaagaaagttctcataatattgctgactattatagtggttattggcagaatgcagtttgtcagcttcccagccacccaccatgacattggctttccactctccacaacagtctggtaatcaaagatcttgctcgctcaaattcatgttgattgatcaaacaggtgtaatcccctcaacatagacagaaaaacatacagtagcatgtatctcaatacttgatattttggctgttgactttttctcatggttatactcctagccaatagaatgaagatccataattccatattttgcgatgctgtttagcctgttccattaagtgaattcatagattaagcatgttagacatgtcataagcagaggattcactatgacaattaagcagcataaactctaaagaaagctatcagaacaaaagtacagtgaatttcttttggaaaacaaggttattatatgcaagtggaaagtaataaacatatttgatttaatctttatggagggaaccgatggaaaacatcactagaaactgtgcatttccagggaggttcacattgtagagattttcttttgccgtgcaataaacctgaacaattgatatgctactcagcagtccataagaaaatgaaagaaaaatgaatagaataaaatcgacatatgaaaatatgaaacagtgcaataacctagctaacatttcactttcccaataaatctacctaacattggttgtacaatatgtcaataattacatttgacttaactgcctagcttgctatgcaatagtttgagctacaggttttgatcatttatcaccaaactccacatatatgaacaattaaagttaatgcttagtatatttacgtatgtactccctccggtttcattttaattgacgctttggacaatgacacgctctacaagatatacctttgaccttatttttctattataatatatacaataaataaatgcatgtttacttttattatagtgttttgaaagacaaatctatatatgtttttctagtttctttaaactaaatatttttaaagttattgatggtcaaagttataaaaatttaacctcaaccatgtccaaaacatcaattaatatagaaccggagggagtaatgaacaagatgtatgggactatggaaaacaacatcgcaccatacctgaacactgccaactgctcgtaacttcaaaaaaaaacagatatcattacataacctggaaaagtgaacaccaaaatgtaagatctatcgacaacaaatctcccacttgtgtaacagcatagaaagagtaagaagtatatgacctctgagcacaatgtttgcttggcaacagctcgcgcatacgatgtatcagtggagtgtagtctgtacctttatttcaatttgaaacggttaactggctccacatttcctcagcttcttgtcttacctttttcttactccaatatgcacgtacaatcgtatcccatgtttccctctcagggatgcatctctctgataacatgtcacgcacaacatgagcagctttctctaaattgttctttttcgataagcactcgacaaggagatggaaagttgttggcttggtagaaattccacgggtacgcatgctctggtacacctgaaaagcccttacaacttcacccttagaacacagtgctgtcaccactgcatcatttatcctgccatgcaggctccaagtcaagcggtttggtcggatgccagcaaaattcatctcatcgaggtaatttgaagcctccaaagcccttcctgcatcacatagcccaacaattagcttaccgaacaacccagcatcaggcttcctcccctggagacgcatccggtctaaaatctccatggcctgacccagacagccctccttacagagcccatcaataacagaactgtatgtgattgtatttggaagcttcctctccttaaccatcctgtccagcagctccactgctgaggcggcacgcccacccttgcacaatccatcgatcagtgaactgtatgttaccacattcggcatgatccctctcctagccatttcatcgaacagtttcagagcatcatcaaagcaagcctcccgcgcgagccagtggataagagtggtgtaagtaaccaccgttggtgcagtgccattcgcaatcatctccgcgaacaggtcgcgggcctccggcagccggccgcggcggcagagcccatcgatcacagtattgtaggagcacgcgtcgggtttggggatgttccgaaaaacgcgaacggcgtcgtcgatggggacggcggcgtcggagcagtgggccttgacgaggacattgtaggtggcggtggtgggggcaaagccggcggcgcgcatgtcggcgaggagggagcgggccagggagaggtgggagtgagcgacgagggcggcgaggaccgcggtgtaggagcgggcggagtgcgggaggccgagggcggagggcgcggagcggaagaggtggagcgcggcgaggggctggtgggcgcgggagtaggcgcggaggagggagaggaacgggggctcgagctcgccgggcgaggggaagagctcgcgcgagcgggagaggagggaggatgcgagcgggaggaggctggcggaggcgaggcgggacgtgaggagggagacggtgtcgcgcgacgggaggacgggcgcggcggcggcggccgtggaatcgtcgggcggggacgcggacgagggcctggcggtggccgcgtcgaagagcgccagggcccggcgcgggtcacgctccgcgcggaccaggcggtggaggtggtcggcggtgagggtcttgggccatctggtcgccgagggggtggccggcggcattgggctgcggcggcggcggcgggatgggcaaagcctgcgtgtacgaggcgggacagaggtgttcggcggaatgctgccctgccctggcaacacgaggacctctagcaagtgcgcgcagttgcgtgaccgaacatttgtcgggccggccaaatgtcaaagaaaaggatgggcctatttcggccatagctgaaaattaattagggcctgcttgggaattaaggacctttctcgaccggaataagttcaccagaggtccctcaacttaacagcgagacttttgagatcccctaaccacaaaaccagaaatttccacccctaaactttacgaaaccgtgtaaaaaaggtcccagggcagtatggatctctagtttcgctgatgtggcatcctagttagcaaaaaaaaataaaaaaaattatagggccacatgtaagtgagaagaaaaaaatgtgggacccacacttctttttggttttcttttctcttttctttctcctcttctcttctcttctccggaagccgccggcggtagagggagcctgggagagagggggcaggggtgggcgaagtggccactggcgagcgcggcagtgggcggctggagaggggggaagaggtggccggtgagcctgcgagggaggagaggggggcggcggtgggtggagcagcagcgggagagaagagagagggggtcgcgccggccgagcttcacttgcgagctcgtcggcggcaatggcgtccctccgcgcgctcccccttctcgtcctgggcatggcgttgtgcgcactcgcgttgttccccttcgtcgcctctgcgtcccgtgacctccgccaccatcccgcgggcttcgtcatcggcgggagagggtagagagggggtcgagccacccgagcttcactcatcggcgacaatggcgtccctctagccaactgttgttggtgttgctgatgctaatgcggcttcctccgccgcctccccgcctgcaccaccatctcgggcagctccacgccgtggtcccgcacccacagcgacgtcgtccgcagcgccctcgctgcgcactgccccagctcctctcccttcccttccccgtctttcccgccgtcaaagcagcacaagaggcacccaaggcggcgacgtcgcctccctccgagcggcagcggcgaccttgtctccctccgttcttgcccgtcgccaccctgcccgccggcctctcaggctcgggggaagaagagaagaggagaagagagaacaaagaaaagagaagaagaaaaaaaaagaaaaagaaaagaggagaaaagggcgctgatatgtgggttccaccatatgccacgtcagctaaacgggggaaaattagatcagtactgtttagggacttttttttgcacggttttgtatagtttaggaatggagatttctgattttgtggttaagggatctcaaaaatctcgctgttaagttgataaaccttcggtgaacttattccttctcgacctggtaaaagaaataaaagcccgtaactttcggccacctaaagtaccggagaatatattcaatacccttcctgttcgggagaaaaaattggtagaaataacttatcggagcaatttgggacttcgaagtagacaaatagatagataaaaaaactatgatgaataatcaaaaataacatcaaactcaccaacagatgttcatgtaatgttccacatgttttcacgtaaatcttcattgtagttcgtaaagcaatgtctcggtgcttcttcgtttgtacttatatttcaccggtaattaggaatgcagtttttataggcgatatataccgagaacaaaatggatatccttaaaaaaacaaatggaactgatagatctcgatataaaaagtcacctaataaatctatctattatattattaaaacagctttaaaaggagacatcacgttcgctgtgggagctagaaattctcatattaatcggagaaaaagaaaaaaagaaaagaagagtccaagtagaaatacaatctaaaaatagctgaaattcggaattaaaaataagcaatattgaaagaagtttctatataacaacccaatacgagattaatacaaattcgaaataaaaataaaataaaatccaaaattataaaataaaaggaagtccaagtaggaatacaatttaaaaatagctgaaattcagaattaaaaataaggaatattgagagaagagtccatataataacccaatacgagattagttaatattcggaataaaaataaaaaaaattcgaaattagcaaaaagaaaaaaagttaaaataggaatacaatttaaaatcaactgaaatacgaaattaaaaataagtaatagtgaaagaagaatcaatataagaaaccaatatgagattaattaaaattcagaataaaaaataaaaaatatccaaaattaataaaaaaataaaagagagttcaactgaaattcaaaaaataaaaaaaaataaaagtattaaaaacactatacggtattaattaaaaaaatttaaattagaaaaagaaaaaaagatttcaattaggaatagtggtggcagttgatacaatatataaaaactgttagtaaaacaccaaatagaatcctaatgatgattaaaaggagggacgagcaagacggttgccgggacttctagaaagtaaaaaaaaaacccaattgataaacatattcgatttttaaaatctcaatgagaataaaggagaagcagcatgcggggtgtataggagtatagttgcagagccgccaacggttagcgggacttttagaaaagaaaaaataaattccaacgatagttatgttcgattttagaatcctgatgaaaataaagaataggcggcggatgggccgtagaggtgtatagtggcatcgtttgacgggacttctgaaactataaaaaatgaaacccaacaagacaataaactctaaaaactacaaggtccaatttttaaaggttcggaacttctaaaaagtaaaaataa

SEQ ID NO: 42578 - DNA, 703 bp, Oryza sativa
tcaccgccatcgacgataatcaactcaacagctgttgccctgttaaattgatctgccttggttcaatcgaccccaccgactaactcgaacagtaccagccggaccgaaccggtttttttttctttctccaaaaaaccggaccggtttcttttacttggtcaaccaccagtcaaagaaaaacagatcgatcctgtctcccttcttcctttggcttcctcgctcctcccagaaaccgcgcccgcgccgcttttcccgatgcgccgccgcctcctgctcctcacgctgccggccccgcaagaagcaccatgccccccacctcagaaaccgcctggggcgccgccgcctcccgccgctgtcacctgcgccgacccaccgattggatcgccaatcgcttccgccgccatcaacccgagcaccatgtctagtcatctccctgttgaaggcagccatcgacggttccggccgccgccagaagtgttcgatccaccgatcaagactccgttgatcgccgccgtgctccaccttgcgccaatgcccctccctgggcattatagcaggctacgcggtgtggagcacctccatcgcgcctctaccatggacctcccgcaggctctgataccacttgttataaaaccagccccgaaatcgacatcgatagctaaatacggaagaaaactccataggagatccaaaacgatgacga

SEQ ID NO: 42579 - DNA, 3617 bp, Oryza sativa
taaaattttatcacattttgaatgttagtggtataatattagtcaatgacttcttccaggtcaaaaaacctggattggagatggccaccgagcagagtgaacttgatctgtcatacgggatgcggtaccaaaacgtcaaaattccagaggcatacgagcgtctcatattggatacgtgcgtatcatccttctaattgttcaaaatatcttccgttaaaaagatcttttcaacttcacagataacgtaatccgaccatatgcatttgatttaatacccacatatctacaggatacgaggagaccaacagcacttcgttcgccgagatgagctgaaggtttgtcagttgtcaccctgcatacctaaaacctctgaagagaaacttgaattctgtttccaagccgtttcgtttccgttttctccctaacatatggcacatgtgtgtccaggctgcttggcagatcttcactcccctgctgcacgacatcgacgaaggcaaggtgaagtctattccataccagcctggcagccgaggccccaaggaagccgatgaactgagcgagagggttgggtatatgcagacccacggttacatatggataccacccacccttgcatagacagacagacagacagacagtagtattgtttagctaggaagagtgcctctaaactgttattattgcggatatattcgtttcatattttcacgataacgcctgactagtgactacctggcgttgtaataatgtgttgcttcgtaagtataactgctattgtgaaataaaagtgcatgtttcgatcgatgaacagtgtcaggttttgggcattgtagatacactgatgatgaatggatggctgccaacattgttgtttgatgccttatgtccactgcatttgcaagattagctggtagcaactagcaagataagtaaagttgccaagaaaagatgatgaaatgcatgctcaaaagcggcagagcaaaatgaaccataaactgaagggatgtgcttctagatgtgctgaattgtttaccactgcaacagctgcagcgcgaatatctgccaactttgcatgcggcaagaaaaactctaggcaaagttaggatcgcattacacacacacacacactcagcaagtaatagcactccatacggcagaaactactggcgtaacttcacggtcatgagtcacaccaccttctcacttcgtcttgaccagcttcttgattatgcttttaagagctggagcactagcactgcatttctgatcagtgaagcatgatcttccttcctctgccgccttgcagagctggggatccatgggaaccttgccaagaaaagggacctccatttcctggcacatcttctcagcaccacccttactgctatcaaacacctcactgcatgcgacaacagataaaagctctggggctttctccttgatgtagttcagcgcccactcggtggcatctgtttctcccgcctcacttggcttcacaaatttcatgtctgaaaatgcctgcctcaagccactcatgttctcgacaactcccaagacaggaacgccaaccttcttgcaaaagtttatctccttcttcacgtcgatcagagaaacttgctgcggagtggtcacaatgattgccccatcaattcctgcgatctggaggtactgtacaattgaaatatgttcatcagatgttcctggaggtgcatccaccacaagatagtcgatctccccccaatcgacatccttcaagaactgtttgatgagtccgttcttgcgaggacctctccatataacagcatcatctgggttgggcagcatgaagccaattgacatgacacctaggttggactcaacatacaccggcgaccagccaagattgctttgatgaatatcttggccttcaaggcctaacatttttgggatgctaggaccacaaatgtctatgtcgagaaggccaacttgatggtccatctcagcaagggcaaaagagagctgggctgaaaatgtactcttcccgacaccacccttcccagacagtaccagaatcttgtgtttcacggtattcattcgctcaatgatggcaagcagatctggaaataaaatgtccacttgtaagattgtttcgcaaagaacaaatactatatggataggcatagcaaattcacaataacttgggacagggatagtacatatggtaggacattcacttggataaaaacatttacaattaaaaatacagttgcttacgtgtaatggcgcctgaaagttcatacagcatcattcattaaggttcataaacagtggttcacttaacatgtagatatatggaaaatcttaagtgcgattataagttcttctaagcacttgatcatttaagaactagagaacttctatccattgatcaaattgacttggaatgcagatgttccaatatacatccatggttgcaacagttcataatcttcagaaataaaggaaccaactttgatgggccaacaaataggaatttgtcggagagctcatgttctttgcatacttcacaccggactgttttttttttcttttcatagctcacacaatctaaacttcttcaaattcatcaatgccacagccagttatactacagaaacttatacatgctggaagcatgcgactttgctatagatgagctaccgactaccaaactctgaaatttcctgcacacaactgacacgaggctctgcaaaaggatgctcatacaagcataggctgtatgctccactaaattcacactcgattgcagtaaaaccaaactaaaccaagcatcgaagcgacacgccgcggagcaaagcatcacatgctgcgatcaaacgccaaaacaacactggtcaaagggattagatgggaaacagaggtgagctatagatggcactgtagatttaccgggatcggggcccttgggcgcggtggcgcagatctgctggttggggcacccggcgcacgcgtccgccttccccgccgcctccgactgcgtccccgggcaatctgcggcggcgaaaccacaaaaaaacaattaaaaaaacgatcaaaaaacccgcaaaaatcctcgaacacgagaaaccctgaggaagcaagtggtttgcccctacggtcgttggcgttctccgggacgtcgccgccgccgttctccattgccgccgatggattgattgctccctcctcctctcgctgctgctcgtgaagtcgtgaggtttaggtgcggatttttcggttttcttttcggaggcgtggttaagcacagaaacccttgggctgacccggcagagcatcctagccgttcgtgctagatcggacggtgagatgcggtttccgaggagaattttgcaaccgcgtccttttggctcagggaccccagcgttactgcggaaatttaagcaattgcaaatgttaaaattttggatgaaatataagcaccttaaaaggaaaaacctaacccaacttatcactgctagtgaggaatatttgtacaaataaaaataatcatcaaccgtaccaagttcagagcctgcaaacaatatttttcaaacgcatggcttcgatattggtaccattggagggaaactcaactggca

SEQ ID NO: 42580 - DNA, 16947 bp, Oryza sativa
  unsure (1)..(16947): unsure at all n locations
aattaagggaataagtaacaacaaattgctaaaagaaatgttgatccgctggagcatgagcatatatatagtggcaaaataaacgcagcagcatggctaaaggaatgaaggattgatcgcaacgatcaagtatagcaactggactctggacaggagggcttgtggtcagcatgtcaatccactgcgatggtagaggaatcaggaatgaaggccgagtattcacctgattcatttagctagaggatggaatatatgtagtgcaagtgcagtggaagatggaaggcctgctgcgtgagccaatgaatgaatatccaacattttggtttcaatcaggagatgacctgtcaggaacagacagtttaactgttgaataggcccctttgtttttttagagggaacaattttttttttagagggaacccctttgttaattactgtcgtgcatgatgatcggaatttaaaaaaaaaaacgaagaggtgcatcccactatcgctctttacaccctcatctgcaatccagcgactaggtggaatctatctgcaatccaacggcttggtggaatagaggtgacgtggatcactcctagagcaggaaattagttttaattgcagttagtggggatcacctatatagactagtaatttgcccgtgctaacgctacggtgacatttaataacataattcaagcaacctgctaacgctatggtgacatttaataacacaattcaaacaaccaaaaatatatacaagactatattgcatagttataagatcaagcaaaaattaaaaaaactatcactatataaataagtcaatctgttctgtacaatctgttgtacgcacataaataagtccaaagtaggtagttctgtacaatatataaatactgtgcaggtaataactatcactacctttgaccagtagtgaaacacatattgtttgctacagatcaataacaaggcaacatattgcatacacaccatcacagttcgatcatcatcgatccattaaagcagtcatggtcagtgcaaggctagttttctgtaactcaagacattttgatcttcagaatatgtttgcacggcctcataaataaaggagaaggcatattcacaaatcttgaaatacaaaggaggtaaacgaaatttaatttgttctatgacagtaatctgaaatctataacactctaagtatgacatccaacaattatacgagtaggtagtcacaacttaaaccttgaagccgaaacccttcattttgcttgtcatcgtccaatgatatgaagagattccttttgcttgtcatcttatcctgcgaaggaagtgaaaaacatgtttgctccattgtacccgatgcacagagaacaattttggatcatagcaactacagttatgtttgctccaagtttatccttgtcaatgcaaacatagtgtatttacttaccaacaaagattgtttcttctttgatttcatattgacaaacagatcccttgaaagcttgctatttgaagaggatatatgcctcggtccattcttaaacagtgaataaatcgtaagggtaacatatataaaaggctataaatttgtcataattttattcttttgtctctatatgattcatgaatttgaagatatgattatccattgcactatctaatactctgtgaatcgcatttgacgatccaatactcatgtgttcccagttgagtaaacacatgatagttctgtatatacaggcatgttaggcctcaatgcatggtaggtctgaaattagtataacggcagaaaaaatgacaaaacattagtttgacaattagcctataaagacgacttctctaacccaacaattaagagttactacaaagcttttgttgaggtaaatatcctctgcatgaaatgactgacaagtagtacttgcattatacacataacataatttgaacataattccgttcaacagccaagatgtggaggcggcatcaggctctcctttgccgcatctcgccgcttaagcatccagcgggctggcctgctagggggatcggatgctactacgccaccgagccggagggcaggaagccaaagacggctcctttgcaggtaatttctggaatatgttatctctaggctaggctcggtgcttgctatcatggcaaatccctcccttttgagtaatgaatgcaggtcattgccgaaatacgtgtctcttaccttgagagttttggcgacgagttgtatatttgtacgaaatatttcggtcaggatatagacagtgagaacaacggactgaacacattatttaccactgcagctcaacagcataataagaatttctcataagcaagctatcgttttgcctgaattactactttcttacacacattccatagagatgctttgattttcagtggattttaacttttttttaatcgtcccaactacacttgtgagaaataacaaacttgcattatgtaaaagtttgacaatcggaatatactgaaaggcacccattctttggggtttcaagaaatccatgtcatcagacggatatagtaagaaacatccatactgaaatttgcagtcaaggggcatggtggataggttccgtttgcgtgccaaaggtggtgatggcagcaatggctgcatcagtcttcctcgctccaggtcaggatcgccaaggcaagcctgatggtttaacaactcccctgctgcacagcccatggaattgtcacatggtgctagcagtaatctttttgtgtatttgtttgtggtgtaataatgcctggtcgtgatcaacattagcctagatcttagtgaaaaggagtaagatctaggctaacttccttccccatctcacagattgctaattgcttacaaaataaaattcagcagcacctaagtagagtaaactatcagatgccctgtttttccacataatgcataacattaaatttatttctttctgaatagtctccagatcacaatgaatgcattggacaatatgtcggtatttaatcaatctaaatatcagttggccctaacacattgacctaacttaacacttacctatgatgagatcggatgacgagtgattgacgacgacctgatggctgcgcggtggagacaggacggtgagcgatccgatggcggaacgcggtcaacgcgagggtgcgctggcggcatctatctggaggcgggaatcgacggcggcgcgatggcgaccggatggagagcggacggcgatgggatcgagaaatccggatggacaacggacggcgatggagagaggggcggcgcgcggcgggagagagaggggcggctggggtcggcggcgacgtgaatcgcggcgggggcggcgtgatgttggagatcggtggcgggctggcggcgcgtgggagggagagaagagagattagggctggggaggcgtgggctgggatgggggagggggcgcggttgagaggtgcgaggtggagaggatctgagcgttggattttacacagagatgatccgaaccgttccacaaggaatgaaaaaaataagtgatgagtgatgagtgaaatcatttgttgaactatagcgtagatatataggattcggtgagacagatatgctcaccagtcaccaatagttttgattaaagcaaaagaattgagcaaattgcgttcatgaattactctgtttttgttatgaccttccatagccatgagagcatagaatttggatgatgttgtgaaacgttatcttgtcatcatgtctattatattatttatataacttttggtattaaggggttgtttggtttgctcccaaagtttgccagagcttgccacaccttatgttagacaagtttgatcaagttagcctattgtttgatttatagccacacttatggcaagattcattattatctattagagtcctacatgtcatcaactcaccaaagtgtggcaaaattcaattttgctagctaaggtgtggctcactttttgtaagccacaacttagtcaagtgtgacaaaaagtatggtgaatgatgacaaacttaggacagcatctaaacatcccctaacccttgtactagttccatagttcaacgattatagggataaaaaatcactagaagcagttgccaatccataataaaaattactactaaggttcgacatactaattatataattattagctaatataataaaaacagctagaatagaataatttatacgagtcccgtaacactgagaaagtacacttagactttgttcgggagcctcggcacacaaaataaaacagcattttagtgcgtgattaattaagttttagctatttttttaaaaaattgattaatatgatttttttaagcaactttcgtataaaaactttctgcaaaaaaaacgcaccatttaacagtttgaaaagcctgcgcccgaaaaataagaaagaggagttgggaacttgtactgccgcacggagccttagatatgcaccggcaacaagtgatgttgagaaggtttcgcagtgataaattatttgagaaaagttgtatgagcgtaaaaggccttcaccactggcatagttacggccatgggccatggctactacccaatgtacttcctccgttttacaatgtaaatcattctagcacttctcatattcatattaatgttaatgaatctagatagatatatatgtctagattcattaacatcaatatgaatgtggttaataaatctagatagatatatatgtctagattcattaacatcaatataaatatgagaaatgctagaataacttacattgtggaacggagggagtagctcttaccatgggctataaagttcaacaacagcagcagctgtggctagctcagccaagcacctcttaacttgatcacatagttttctctttctttttcctttcaattttaaatccttagatagcatccccgttagcttgtggggtttgggtgaggagccattttatttaccgagaagacattcaattagcatatgatttattaagtgttaagtattataaatttgaaaaaatgaacatgtttaaaattttaaaataaactttatatatatatatatatatatatatatatatatatatatatatatatatatataaaatattgtttagcagtctgaaaaataccacaacctaataagaacggagctttattacatttgacaaaaagaaaaacgtgtagcgttagatttaaaagcttttgttttgtagaagtgaaataatgaggagatggtggactagactggaaaaaaagcaagcaatcccatctcgtatagtcctacacttcctattcatccccaaacaaagcgccgcgctaaagccgtaacgtagaaaaaggggggacagaatgagagcggcggtaagcgcaccccctccccacagctgctactcccgccgcggcgccactctactggacgcgcgccatgtgctcgaccatatgccgcagaggcgcgagccgccccgggccgctggcctccgtgccccgccggcggccgcggccgcgtcctcccggaggacaccaccgctgcgcgtggccgggcgcgccgccgccgccgccgcctgtccggccgcttcaggtactagaagggatggagccttttttcttggttgttccctcatagccacaagacacgtcgtcctcgatggctctggggtgaacatttgcggccttttgtctggatatctgtgcctgggtgggcgctgcgtggttagatggggcttgagtatcgggagattgtggtttaggacaaagtcttttggtggtcactaggtggggaagtgaacgcttaataatggcatgaaagtcttgggggagcttgcaactacaaaacaaagtacggaatgaaaccaaacgattgctccattgaccattaggatacatagtacattttggttaactgaatcttgcaattggggacaaggacactcctagcgttgattttggagcgcatacaagttaattgagtattggtgccaaatgccaaagggattttgggagaaaaagaaggtatatgaagggataaggcctaaggggaaatgtgaaggcttataagatttcaatgctctcaatgagttgtaatttcgtttctgaaattcttacttgccttcagaaaattgttcaaaagtatcctgctaattcatataatgtgtatagctgtacttatcaattcttcagctttatcaggggtgtgacttaaatttagcttcacctcatcatcaggactgcacttgaatagattgtttcagtagtatacaattatacgtgaggcttggattcatgttaaatactgactgaagtatgctctgcctatataatttgataacacatagataaaagaggcaggagacaaatatcccttgatcgaactgtaaatggaatctttgttgtccggcataagaggttagagctatttgcaagttgtcgtttttcatcttcctggagtttgcttcattgtagtatatactccattgcttgagaatccgggatctcttagcccagacttttacttgccccaagcaagcctgcttcctaaaatcaagcaaggaataaacccttgctagttgcttgcattattcttgcaaaaagccaagcatgttcatcatataaaaataagtatagcttttcatgtatgccacattcagaggttaaccattcttgttgagcacttcctgcatgctttctcagctatgctatatttatccagactgcaccgtcatttagcatgatgtctaaccattgctcagttccttatttgttcaggatactcctgccaattccaacagcctttcgctcaacaactcgtgtgcggttgacctcacctgcattcttgccatcaagacgaaattttgaaggctatattcctcagagctgctcaggttcatcattgcagatctatagccggtcatccctgctatctctctcaccatcttcagctctcatggtgtcctcccagctgaactcttcggatgttgctcagcgatcagaggaatggtttgctctccgcaaggacaagctcaccacaagcaccttcagcactgccttgggcttctgggctggcaacagacggtcagagctgtggagtgagaaagtatttggatcaacagaaatcaagttggaggatgcggcgaggtctgctatgaactggggcacggtgaatgaaagtgtggccatagagcagtacacaagcatcaccggacggtcagtgggttcccttggcttcgcagtgcacacagaggccaactttgggtggctcggagcttcacctgatggcgttctagggtgtgacccagatggtgggatcctagaagtcaagtgcccgtacaacaagggtaagcctgagctcgctctgccatggcgtgctatgccatactactacatgccacaggtgcagggcctgatggagataatgggcagagattgggtcgagctctactgttggactcccaacggaagcagcctgttccgagtgccccgagatcgcgggtactgggagctcatccatgaagtcctgcgtgatttctggtgggggaatgtgatgccggcccgggagctggtgctgctggggaaggaggccgaagctagatcctttgaaccacagcccaagcaccggtcgacaaacctggtgatttttagaagcaggaagctagcttctgaagccaagttgttgtgcaaggatattggcggtcatgtagaattcttcccatgagtagctctgccaatggctgcacactgtattcagattatttattctttcaatcaaaaacattgaattgaatgactagttctcaaaccgttggtgtttttactgtggttttagagcgttataaaatgttccgtgatacgtcttgtcatagttccacatgttttttcggattttcatacttgaaacaggtggcaatgaatcaagcagacttgcagattagccaaacaggcacaaatgtaatttgcctttttttccctatgtgccatagcctaactcaacatgacgatctcaaactgaactttggtttttctttccttttcatttgccaaatgtaattgttgagttggccttctctttttctttccattgtacgccaagcagcagcaattcaatccgacaggtgttgcttgcttccaggatattcctatcctatcccgggagacaaaaaaaaaacgggttgcaactcgacatgccggttgcttctcagctctcacgacccctttgttcttaccttgcatgtgggacaagcaagcaagcctgaccatgatagatacacaactcaaggagcaggcaacaaggcaaaggtctggggctaacctggtcaagaccatttggtatctgacctattcatatcaggggcctaattgaccggtaacccgcgttctcagcactgctaattgcagccagttttctgattgtagtgctgtgaggtaacggccgatctgatgatgggtggtgtgaccgggcaaaccattgtggtgtcatgcaatggttttccgagttcttgtaacccaaaaaaagaaaaaaaaaaaaagagaagagacttggatgatttagcacaagtgtagggtccctatatttagagtactggacaacgagactccttttttctccatgcttgacagagtacaaaagatatgttcccattgccatggcggtctccatgaccaaatttcgtggcactcagcccacatgtcgaaacaaataccttcaagatataagaaaaaaaaggagcacgcacagcaaatcgcagagaaaaagaaggaaaacccaacgaggggaacaaacgttacataagtacataaccttttgcataccatcctgaccaagcgatcatgttaccacttaccaacgaggacggccattcaccatagtttgacaaaaagaaatgatgggataacaaaccaagccatagtaacttaacgtcctaacaagcgatcatgttaccaccgaggacggctattcaccatacttggcaaattgacatgatagcaagcgcaagtttggttagaagtcatttatttctctgcaagtagttgtaaattacatggtagtgtgacaaatgttctcagaactacaacaacattgtggcacgcatgtacaaggtaaattacagcagtcctctctttatttgctctggtgagaccgtgaaaggagtagagcagttcatcttcgatcttaacattccaagaacagcagcagctgctgcaatactgacgtaaagttcacgctgtacttccgctcttgaaccgcaatccctggaagcaaccccaaaccaaagataggaaatgagctctcacataagacttaattcaatgggatgtataacatcaaagcaatcaggaaaaactcacctctgaaatgtcaccagtcagacaatagtagcgaaacaatcttttttttcctttttttgctgaatcaaactaactactattttttgttctttttcttgcaagaagctaatgtagcatgtcaggatggctgcgccttcaagaataacaaactcttcgttttttttttgtctgttttctcagtagaaatgatatgttaagatggcttgcatgacagcattgcatgctgttctctgttagcggaggaagagtattcattgggggacaaacccctatttcattgggggagacagatccttcttctcttgacaattagggcaaacccagtccagagaaaatgactccttgaatgccaacttgtctacacaccttccacactcataacatctcagtatgcaaacagtacaacctttgcaattaccagatcttctgtcatcacatccttcatctgggcaatcataaacaagtttgtagttctgacaaatagggcacatctcaatatcaagagcatatccatcattgcaatctgataaaaaccgattagcatgaaggaatcttggcccccggttatgcacctcctgtgtcttgtcggtattcaacaaggataataactcttcgtactgctcctttcgtaaactgaagagtgttccaactctgaggtgcttaattccaaacaccgccttcgtattaaatgacttgagattggaaataaggccatccaaagttaaccgtgggcagcccaaaatgctcagctgtgtgaaatattttgtgttagataaaaattaatcaagaggaatttctattaagttagaaggcagaatagacaaatatgtatttacaattagaatgtcaaactgacaaacatgtaaatataaatatcaaaagtgttcacaaaactgatggcagaaggtttcttttgtgatgctcctactatgaaaaaaaaaacaatataacaacttaaacaaatcgcagtgctgaacttagctaggtgctcttcagcaactttgcaccatcatgttgcatgtcatataaaacaaagaatcgcatgcaaattgcggtcagctacaaagtattaatgcaaatatctgtaaccactattcagattcgcttttatgtattactcaaaaaacatctaatcaacagcacttgcaaaccatgcataattgtctcatctaattagtttcactttgagaatattatctagcaggcatacagataagtgaataatattagctaaaacaaaagaaagagcatagacagggcggtcactagagaaacaatggataacctaaacagtagtcatgcaccaaaaaggtatataagatagcaaaatagcctacactacatgcaaaactacaatgcagatttcctttcccattacagtaacaaactaagagtcctatggtaaacatttacattggattgatgggagtatgttaagatcaaacgtatattggtatgacaatgaacatttccaagcaaacttgttgatacagtataagtgcaatacttgaagaagtttgattaagttatactaacctttgttaatcttggattactttctaaaacagccttcagcccctggtctgtgatatttacgcagcacgcaatacttagacactgcaaagtatctgggcacttctgtgtcaggtgtagaagaccagcatcagaaattctctggcgcaaatccccttcaatgtggatggacttccacagtaagggctcatttctgacagccgaatgcaatgtcttacacactctctcaacagaaaggatgtcacgaaggccaaggtagtcaagggcaaacagcattccctcatgtggaactcctccctcctggacaggaacaacttcaactgcatcgccgcactccaatgcagcatttccagaggtaggaggggtctccacgaacccaaaagaatcatcagcatttcctgaggaagaagggttcttcatgaacccaaaagaatcaccttcaccagcagaaaggcctccaaaccccaaggggccttcaaaaacaccccgatagccaccaaactgaaactccggtgatagaacaaaagccttattcaagtaataactcaggtcggcaaaaacagcatcatcgcggctgtctccaaaacgcccagcactggacatgactgtgaggtcctcaatgcaactggcgatcgccgcggtgaacgtggtctccaggttcatgccgaaggggtcggtaggcaagaggtccacagggtcgaactcctcttcctcttccagctccagctcaaactccagctcatcccaccacagggagttcaccccaccggatgacagcggcgaggcctcctccgaccagcacccgcacccacacatcatgccagcgcagtcctcgttcatcaggaacgagctggtgagcgagcacgacgagtaattcagcgccatagcctccaaactctcctccactctccccctctctcttttttttcctctttctattttttttgggatttttttcaactaattttctgcacacagaaacgatacagaacaagcaaccctagatctccccaagagaaccctccattcctgatccgggccgataaaaaaaattcccctaggaccaaaaacttcaccgagcaatctcgatcatggatcccaatccaatccaatagcagagaaaaccagggcccctcgatacaccaccaccaccacctcaatctccctcccaaatcgaaacccccaactccccccaatcaacaaaaccaatccacggccccggcgcggcgaatcacgcctccagatcaccgagcaacacaaagctccaccccccaccgaaaccaagcggcggcggcggcgaggaaccaaggatcgatccccggaccagaggcacctcgagacgggaaggggagtcgttggcgggtaggcggggatcgatggatacacaccttcgaatgcggctgcggcggtgggaggatggggtactgggaggtgaggcggaggaggagggggaaaccctaggatgtgggtaataggtggaggcggaggatggggggaagaggaggaggaggaggaggatggtggtggcgtgggggttccgcggaaatctcgaagcctcctttgcttccccttggcttccgcgccgcgcgaggggaggagaggtgaagaagaggagaggaggaggaggagagagagtgcgtgtgcgtggcctgcctgctcgttgcgctgggtgggggcggctgggctggcttggctaaggtaaaggcgagatcgctcgcctcgcgtcgcctctccttttcgcttgcgttttcgttggggggtttggtttttttttctcttctccgagcgagagtacaggggctttccggcaaatacacgcctacctgcctaccggactgcctcgcctccctccatgcaaaacctcctttgaacggccgtgcggaattggcggccccttggaacggttggggcacaaagaattagttttaccgcttgacttggtaaacatatatcggatttgacatatgcttcgtgaataattgcatataatatgaaactagtggaggatagtaaccatgtacgatgggaaagtttataactgacgaaaaaaatatagtagtattcatgaggaatgataatatgttgtgatgttttagatttgtgatagtttatgacggttacataagttaagataagaatacgacttataactattacgtaagtgaagagaactagcgagataaaacttatgtttaggctattacttatgtagttttaaggtgattgaaagtatgaaaacaactcctgaaaattaaagaaaaaagaaatatactccctcccctccggttctagtttaattgatgttttagacagtattgcaaataccaatgagtaattaattaggatctacattttcaattatacccatattaaatacattcgaggatgaaaatgaagcagcagatgcatgcatctttactcctggagtaccagctgttggtcacagatggaaaccaagcaacaaatgtttgcctcgggagtgtattgtgtttgcatgcatgcaaggatagtgctgggaaactgagccttgagctaaaacgtcgatttttcccatacaaaagctattaagctataatgtcagttaaaaaagaactggagggtgtactattcttatctccacataatatgttatctatagacttaattacatttccatataggccaaaatttggcgtggctataacacctaagttaacgggaagaaagaaaatctaaataaagggggttatattccagacctataattggcgacggctccaaaatagttgggcccaacaaaaccgcacgcactaagatatgaggcttgtttggctacaaggtatggtgttgccttgcagctcgcctgacgtctacggcagcttcatttgctgcatggtgtaacagtcgactggctgcatggcagcgctacaccaggcagccgaccgagacaatgtaagtagttttattttggcgcgactattggcctaaaaacaaatatgggtatctattatatttctctatgtatataaaattcaacttttacaaactactctatgcgtctcaatataaatgtatctaggatgatctccgtggcacattaaaacactatagctacttatagcatgtattgtgaaggtttaatgcattatttctcttctatacgcaactccagctttcaacaataatcatgcggggattgctcttacgctgagtttgtgggtgagcgcacaatacgaagtgatggttagtgcatgattaattaaatattagcttctttaagaaaataattagtataagcaacttttttatattttttttataaaaaacatatagtttaatagtttgaaaagcgtatgcgtgaaaaataagagagatgggttggcaaagcaaggaaactaactcagcctaagcgtttctcatattacaaaggagcatttcctcagaaaccagggggtttattacaaaaacacgaagcagtttgcaccccacggaagcccaaggacacgaaaggatccatccatccactgacgaggcggggcctcggctgatgtaaccttcccacctctctctctctctctctctctctctctctctccatccctctcacgcgtgcaagcacacagcagcacatatccaagccgtggatcacgcaatagcagcaaagccaagcctccggccgcaacaagcaggagcaggcagggcattgattcgcgacgggtggatagattagagcaagtataatagtgagttataacaaaaaaaatcaagaatgttggctatcatgtaagagctagcttaatacaagtttctaggcaaatacattaaatgcataggtgagagatagagggaggagaagatagttgtagccaactttataactaatccattatatatgttagctttaagatgggctaatagtagtaagcgagctctcctgttatcttgctctaaatggatcagcggatggcaggacgagaggttgttggccgctccgccgctggccatctatacgcgtgtcccgccctccccgcggccccgcccacgcacgtggcgcccgccatgaccgcatcagccgcagccgccaccgtggcgtgcgggtgtggggggcgtcgcgccgagatgggccacgcgtcgtcatgcggtcatgcgcgcgggcgagccacgggctcacggcccacgtggtgggacgcgtcgatctacggctgtacctgtgcgcacgcacgcacgtcttgcgttggaccgacgggaccccaggataagctggatatggctgaatggctcagctgatcccttcccgtcattttttcttgctccggtgaaaattcggctttggtttaacggtatacatcagctcatcaaggcggagctacggatcatcaggtcgtggaaaacgtggtgcttttatgatatttttgttgagtagcataagccccaagatttgtatactacttctctgtttgcaggctacgtgcagcggtggataactggatatacgatacacatcatgtgatgcaagcatctcccgggcctattcttccccttgctcggtgcgcgcgcctagtggcggcaaccggagaggagagaagagaacccttcctacggtggatttccttcgtgccaaaagtacgcttcggcgagcaacttttcggcgcctctcaccatccgggtggtaagcgctgacgcaacgcgcgcgttcgggctgcttggccggcacgaaagctttcgctcgctggcacgcaggaggagcggccaggtcgcgtcgccgaggcgagcagctgacgggtgccgttttggcgggtactccaccgtctccgcgtcgagtgtcaaccagagggaggaacagatcaaaagaaagtcgtttctttaactccgatgctgaaccagctgctgcgcgcagcagctatttttggtgcgggcaaaggcatatgtgctgtgtggccgaagcttccagcacaaccggttatgtgtaactctccgtagtagtagatcagaacagaacgacgtttcgtgatcatttacacacgtttggtttatttaccaactttttttgtattttgtttcctcgaccgggtcgatcgaattgccgtgtatttctcagttcttgatgatcatatatcaatatgtgtatgccattccactatgagttggttaagagtgcttatgtttgtttagctttttaacgatatgtgaaacaatatgagtcattattgttgattatttaagtcttaaatattccaaactgaaaaatgtatttgtttgtttctatatgaaacaatttatatgaaaagtatttgaaaacaagtccttccgtcccaaaatatagtaacttagaaaatgttgcatacgccactaagttttttatattttgagacggaggtaatagtaatttggaaaatgcacaaatgataaatgggggagtagttatttcgagaaacattttagcgctcaacctaagtagttcttgatgaaaattaaaagaaagtttagttgtgcagttgtaatatacgacaactaatattcagctctcaaacttgtaaaattaattcaaaatgatatcattttttattatttgtttgaaaacaacatttgtaaggttgggaattttttatattttgcatttaactatttagtgacaactttaatacgatacaacataaattagaaaaactaagtttgaccgtaagaaacaatacaacttttttaaatggtatcggtacgatcgaaaattccagttgtcatcctcaaacggacggaaactatacatgtaccaccattgttctttctcgaacgtacaagccaccccacgttgggccaacttcacagccacggtctcaggcccaacaagctgacaaggtagctaaacacggaaaccaataagttaactttacatcacttaatttgtctgcgagtctaatattcacacaatttttgacaatttgatcatttgaaaaatctaattttataaataaactgtcgtcaaaacttatttcaaaaatgatcattctgtttagcgccaaatcgtgtgacgctgaattganacacctcagcgctacacaaca

SEQ ID NO: 42581 - DNA, 19335 bp, Oryza sativa
cacgatttggtgctgaacagaagggttttgaaataagttttggcgacggttcatttgtaaaatagttttttcaaatgatcaaattgtcaaaaattatggtaatattcatctctgaacccaactaccaaatatagccaatcccccgactcattcctgagtagaaaactggttggttttggctgacgtaaacccattctagttgtgagacaacttcaagagatctaaagtgaacttattccttttcgattcagtgacgacttccaagtaacaaaagtgaacttatttcttttcagctagggacaactttcaggctcataccatatgccattggatcttcatatggtgatttattttctctttttcggaacacttcgtataacttgctacgtcgctggcgtcacggttactccctccgtcccaaaaagaaggtaaactatggtttctgtgtccaactttaactgtccgtcttatataaattttttttataatttatatttttattattgttagatgataaaacatgattaatattttatgcgtgacttgtatttttttatataattttttcaaataaaacgaacggagttttatttttttttttgcacggagggagtacttcgcaagagcatagagatgaaacggagtgagacgagactcgagaggactgcaagcgctacgaggcgtgtgctttgagattgtggcgtgagacgtgtcgcacgcatacacagcagaaatttgcttcccacccaggcacccagccgagaggtttttcctatgtgtcattaaaaaagatggtgtaccactgaaaagttcgagcctctgcagaaatttgcttcccacccaggcacccagccgagaggtttttcctatgtgtcattaaaaaagatggtgtaccactaaaaagttcgagcctccctctaccatcgtcgaattttatcgtgccctccacaccaccattccgtcgcaatactgtttggatttagccatctggtagctctgacgtgtaggcccgggtagggaaaatgtcgctcttgccctttcactctctccgcggcgtgcgcgtccgcttcactctcagccggcgcccagccgagcgtggccgagccgctggacgcccgagccgccacgccggcctccccttccctcgtcgccgccgtctccgccgagccgagcggacggcgccgccggccacccctccaaccagcacccgccctccacctttgcccggcgctgctctggctcctccaccccgacggcctccgtcgccgccgcaccggccttcccccatcctcctcgccgccccggcctccttccccgacccgccctactcgcagcgaggaggacagtgacctcccgccgccgcggcagctggccgacccgccctactagctggggcgcaccatcctgggctacgacgtgcggcggtcggcgtggctggcagcgcacccggagttcccggcgcacgtggcgccccgaacccacctcgctcgccgcacgcccgccgcgtggagacggcgcgagagatcgatcgaccgattcgacccgaccgatggcgagctcgctgtcccgcgtgggtgcggcgctgccccgggcgcgcccgcgcgccgcgctccgatgttcggtgagcaagcttgatggttccagggcatttgattcgctttattagaggggagatgattgagagtccttggcggacttaggtgctctctgatgcgtttgcccatttgcacaacgcacacactcacggagtcatggttctgttgcctgctggtaatcgaatcgcatacttagattagaacaactaattaaactgcaaagttacatctattgatgaccccgagttctcctctgcatttcgtgtaaaatttgatgatattttaggagtatgtaattcgggatgcatacttggatattggggtattatgcttgtgtatccttcagatgccaaaacggcattaatgttttgttgtttggttttgtaattttttgtagtttatgtaactaattgcggtacgcggcgcacaacctcgttctccatggctgggaggccaaggtgttcgacgagaagagctggatcggcgtcaacaccggcagtggtcgctcgacctgctcgacgcgtgggccgaccggcgcccggccgccgcccagccggggcaccgcgccgccctcgccacggctcacgccgctgtcgcctcggcccggtcgctgttacgaaaatagatgcacaacggagacacgaattttacgtggaaaatccttgcgggaaaaaccatgggcaccgaccggcaatgatcactatagagaaattttgatacaaacgcatggaatacattgggctgtcgcaccctccccatgcggcttacaagggatatatatagcagaaatctaggagccctaataggaaactaatcatataaagtagagtcatattagataactaatccgaatatattatgggcccgaaattcggatcacatatttaacaatcttcaccttgagacgaatttcccttgtagcataaaaatcttcaatctccaaagaacctcgtgataataaaatcaatgtgcgccaaatagtcacttggactattgtcggtgacatgggaccgggagtatcatgacttagggcatccacaatgtaggggagaagtgggtattaggaattaaaatattcttactactaggtaagatacatcgtggaagtagtaaataactactaccaagccataagcttgctacaggttatagcactttgtggtgggtcctatctaatttttaattgtgacatggctcatgtttggggttctttttcagataggtcccaccttattacccactctacacatatatacattgtggtgcatcttcaatctactattaccatcttacatgggcccaccttactacctacttttgcaacatacattgaggatgcccttagagacttgaggcagacacgatcacccacgtggcctaaccccctcggggggggggggggtcgggcccgagggtgatacggccgcccttctctgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgccaggatgagagcctccaagcactcgtccctagccggagccgacgtgttagctcctggagatggcacgttggtcccggtcagatatataccaggcttcatcctaaccattacaaacaagacattgtatgaagaggggcgaacatgcagattgataaactgacacgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttataaaaagataggataagtccccacaaaaagagagagatggtgcatgtggtatccccttgaggtataaaaggaggaccttgcccacttagaaggggattgattttcggatccagaaggatcagagagggagagagtaagagctctctggttctccagctcttttgtagcttcttcatacatagatccacaaaaacacaggagtagggtattacgcttctcagcggcccgaacctgtatacatcgcccgtgtcttgtgtgtttccattctcgcgaaccttccacacacagactaggagcttagaatctcacccagggcccccggccgaaccggcaaaggggggcctgcgcggtctcccggtgaggagcccccacgctccgtcaactataattcataacacccttaatccagaagaggtagactacacttcaaactcgccattgggaacaaatcctgaatctgttggtatgacattgtggaacccagcagagatgcgaaactgatgcacaaacttcaaactcgccatgggaataaatcctgaatctgctggcattaatttctagaatccaaacagaaatgcgaaaaattcttgtgcacaaaaacgaagtacttagatcccctgataacctcctggtatgttgggtacaatggtagcaaaattcgccggacaatttgatcaccttgtgatctagacaggagcgaggctacctctcgacgacttgaatgtacttttttttttaatctcaggtgcatgacttatcctccttaaaacatgcgccaacttgcatcttcacttgccataacgagattgtatctcaatccagaagtcgtagatcaaacttctaactcgccttgggaataaaatcctgaatctgctggtacaatttgtcaaaccctaacagaaacgcgaaacactctgggtgcataaaacgaagttgatctccgtgcagaacctcctggtagactggcttgtgaatgtagcaatttggaacgtgaatttgtgttcccctgaacagaaccaaaacaatgcaaggcttaaatccctggtgcgaagggcgtgtgcacgtaataattccaacgtgaaatttaattcacatgaacagaaccgagaaggctactgaaggcttggacttttctccttcctcgggatgcgtgcggaatagatcaatggcttcaaccctgctgttgcttctgattttctcctgcgttgcttgatggacgtgattcagatcgatgtgttggagcacttgcttaaatcgatctggtcgacaccgcttcgggtttgcttcaccggtgattcaatctcaccgaattgatttctgcgacgatgacgacgcgttgctgttgcggccgattcttcgcgacgtgcgctgctgctccttccccggcggcgtcgatgacgaggtcaatcagatcgatatatactccgatccgaaaaatcacaccggtggctgtgtgattagtagatcgatctccaatgctttgataccacttgttatgaaaatagatgcacaacgaagacacgaattttacgtcgaaaatccttgcgggaaaaaaccatgggcgccgaccggcaatgatcactatagagaaattggatacaaacgcaggggatacattgggctgtcgcaccctccccgtgcggcttacaagggatatatatatagcagaaatctaggagcactaataggaaactaatcctataaagtagagtcctattagataattaatccgaatatattgtgggcccgaaattcggatcacatatttaacagtcgccggccgcgccgccgctgcaccggccgcgcccccgaatggctgccctctgaatggcacagaaggaaacaaatttcatcaaagggcaactaagtcatttggctataccgttacccaccgttaccatcaaaaatggacggaatggtgtggagggcacgataaaattcgacgatggcagagagggaggctcgaactttttagtggcacagaggcagacaccatcttttttaatggcatacagggaaaaacctccccagccgagcgtcccccactccccactcactcgccacccatcccgaaccccgaggtccccgacgcttgcacggagcgccgcaaggccccgcagcggcgcgcctgccgccccattcaacgtcgaccggcacccgcgcgcctgggcaccgcgattccgcaagacgaatccacgacccgtcgtttgcccgtttccgtcgctgcgtcgttggtcggtacggtaaggacagtaaggtttctaaattttgaatacgaatcaccattgtcgtcccaatagaggagagtcaagggacgacacagaaggggacgcagggagattataggattgatctcatctccccatagcgacgcgtgtgcgttgttgatgtgaagacgccgacgttgctcctatggacggaggtggtgatcatcgggctttatttggctatggctaatataaattgatctaatgctaatatcagtgaaatctgatctatggattatttgtggaggctaatagatgcggcgccccagggagattataggattgatctcatctccccagggcgacgtggggatcgaacgacgttggtctctaaggctctgataccatgtggaaaaaatccaatttgttgtattttgttgttttctcatctattacatcgactctctcatggggtatatatagtagtacataggggatagagacttggagtacaatataagtaagagtagatttatctctaggattctatctctaggatatatcttatctctatatttgcatttgactcttacctctaactaacaatagttctaacagtccctccttgccaccgcgggccggtcggcctgcctccaccgacggccgacggcatgatctggttcggggaattcaagccgcgtgaatcgattccaatctcgtgttgttcgtcttggtggatcagattggcaagcgagggcttttgatcactcgagatgtcgtcgtcgtcgtcgtcacctcgggcgccgggggacaggaagcgctgccgacgcgcctcgggccctgtgcctcgctgggcgtcgctgcccgaagatctggtggacctggtggcgtcgcgcttgcttgccggcggcgacctgctggactacgtccgcttccgagccgtctgcaccagctggcggtcgggcaccgcctccccgcgcggccgcggcgtcgccgaccggcgcttccacccgcgccgctggatgatgctcccggagggccacggcctctacccgggccacccgagcctgcgtgggtacgcccgattcctcaacctcgacacggggaccctggtccgcgcccggatcccgctcctccgcgatggctacgtcgccatcgactccgtcgacggcctcctcctgctgctgctggaccccgacccgaaccaggagggcgccgttcgcctcctccaccctttcaccggcgacaccgccgagctcccgccgctcgggacggtcctcccgcatctcggctcacggctgctggattgccccgcgccgtacaggatcaggagcctcgcgagggtcgtctgcgcttctgtctcctgcagcgccactggagctggagctggagccatcaccgtcttgcttgcactctccgtggtgtctcgtgtagccttcgctacttccctggaccggcaatggagcctgtcgacctacgaatgcgtgatactctcttcaccgatcgcatcccatggcaagatatacctgatgcacacagacagatcatgtggcgagaagatgcaccagattctccggattgatcacccacctgcagcagcgcaggatgggtcgggctcgggcgcaggtcgtgctctacaagagccaaagctggttgccacaatccctgcacgcaagctcgaccattttcaaggtctggtagaatgtggttcagagatcctggtgcttggttacaagaactggtctacgtcgcggatttcagttttcaaacttgcggaccttgtgctgcaaaggtttatgccaataaaaagcatcgggggccataccctgttcattggagaaaggaacataagtgtctcttctaagatactgcctacagtcaagggtgacaatcttgtctaccttaattcaggacttgtgaaataccacctcagtagtggcagcttgtcactggcaattgataattgcagcctgtatggccgtgcaccgggacctagtagcctcgtccactatatctacagctgctgcattcgtaatcggtggtattgactttattttcttactgctttatttctccctactgtcgattgtttttgtcctgggctagctattaatatttgcattatgtacttgtaggagcagaggactaatatgcagaaaggatgcaccagagtggttagtgcaagattgaagactagttcaataatgaggctagtccttcctcccttgttttctgtaccaatacgtgatgcaccggtcttgagctagaattttgctgataatcttttttggatcttgcggttatagatactttacatgccagatcttctgctactcacaagctatgttttgtatactgatgagtaagctgattgcgataatgattgacaagatgaatcagcacgctgttggaaaagggaacactaaaatatttagtagtgccaaaacaacaaaacatgtctggattttggcactacggatgttttggtatggcactgaaccaaacaaacccgaagagttaaactggaaccattctcttcttcttttttccattgatgaagtgtacctccaaatatccgacacgcaaacccccatcgtttggcttatcggaggaacaagcgaaacgacatgtttgcaaacgaaaaataatttatgagtaaaatttttatatacgtgttcttagcaatctaaaagcaaaggctgaaaaataaactttaattaagaaactctaaaattaactccaaatttaaagttaaaagttcaaattttaactgataaatataagtataagcgaaaagatgaggctggcagtcattcgcagcttcaaaagactaggaatcccctcatgcctatgggccattagtgaagttaaagcttgtacattttgatgggcctgacccactagtccatgcaggccatggccgggaactcgggccgggccgggccgaacgtccaccgcatcttccccgagtccccccggttctccccgtctccgctcccccactgctgccaccaccgctccggtcacctcccccatcgccggcttccccttcgcgcacggtgccactccccgagccccgccccgcccgccgcggccatgctcctctccgggccgtcgccgcagcagcccaccccgccgctgctcctcccggagagcagcggcgaggacggcggccacgactcctcctcccgcgcggcggcgtcgggcggcggcggcggccccaagaagcgcgcggagacgtgggtccaggacgagaccctctgcctcatcgcgctgcgccgggagatggactcccacttcaacacctccaagtccaacaagcacctctgggaggccatctcggccaggatgcgggagcaagggttcgaccgctccccgaccatgtgcaccgacaagtggaggaacctcctcaaggagttcaagaaggcgcgcagccacgcgcggggcgggggcggtggtggcgtgggcggcggcggtgcgggcaccggcggcgggaattgccccgccaagatggcgtgctacaaggagatcgacgacctgctcaagcgccgcgggaagccgacgggcggtggcggcgccgccgtggggagtggcgccgtcaagagccccacggtcacctccaagatcgactcctacctgcagttcgacaagggtatacctcttccagagtttacagtcttctgattaaaatgagcatgccttgcattgatggatcgaagagaggcacttcgaactacttgcattgtctgaagagcatgggacagcttacaactttggtatttgttcaatctcttgatgcacaactcataactcagcacagagccacagactaactgcaaatagaaccctaaacttaggcacttagcaatcagaattgagttttctttacaccatgtagctcagtaagcttgaacagatgaactaacagctgtaataattttttcaggtaatatgaataataaatctccagcctgtattcgtagtgcatccagccaaaaaccagaaaaatagaagagttgttggacaaaccccaacatgcttgaactgaagcagaacagtagaaaaagtctagaataagactctaaactggactaacagttatactaatgtatgtcactagtcactagtcagccaatgaactacgcagaaagtaattatgctatgctgtgtacttctgacagcttattagctagtaattcgcgttgaggggataaataaattgtcactataaaactatatccgcatcgtagtaaacctaaatagcccctccatgactctaccggttgtaccagtattatcaccaccagtagaaatgatctcaacaattgatttatgagttatatcagtagttgaggtggtagtataaattgatatgatccattgtattagaaaagatgaatggtttagattgattctacttaaagcagagatcattgtaaagtgtgcgggcatgattttcacaattgagggatgtaaaataaacagtattgaagttagggtggaaaaatgaaaattaaacataagcaatattttcagtcttcatgcttatacttgccttctacagttctgcttgtttaattcggttgttttctcattgactaatattatgacccttgtctaggttttgaagatgctagcattccgttcggccctgttgaaggtaccaaaatgtccacatgcaataatttcagatatgccatagtcgtttacttgcttggctaagttgttttgacatagtaaatttgatgcaaagtcatttgcggactagtcattttccctttttatggttgaccatccaaaaaagtgctccaaaacagtgagtttttagtgatgccatttttcttagtgtcatagaagagctttcagtcctagctcattaatttttctgatggcgtatgatttattgttctcaaaattttggatgaacctaacatttaatttgaattgctcgatgttgttgtggaattgttgaaattctcgctttctcatatgaagttacaatcaaggagaaaaaggcacctgttactagcacttataattagttgtttgaccagtaacaccaataaagtataatttcatttttaccatttttattatcagattcatgtgttttgtttatccaactcctgttatcaatgatactctgatgtaactgtggttatgaagacagaaccatgcatatcagtgcatcatatatagttttactctgattcttttgctcttttctgttttacagcaagtggtagatcattgctaagtgtcgaagatcgactagaacctgatagtcatccacttgcattaacagctgatgcagttgcaaccaatggtgtaaatccatggaactggagagacacctctaccaatggtactaatccaaatccaaacacactaaaagtgataataataatctggatatttatggcagaggaattggactggttggaaatattgctgcttgactgtgtacttatgaacttgattcaacttccattggataatatttattttgattgcatgaacttcctgttctgctgagaaatattatttcaaaatatttcataaaccactgaatttaactatttagtcatatctgtcattcctgaaatatggatgagctattggatacttttttctttctaactgttattgtttcaatttgtttctacgcatacggctaatatacaccatatactttatttttactaatgaagctataagttattaatttcagatggtactaaaactctataattcttatgttaattaattcgtggctccttgttttaatattctgtattaatcgggaaacgtgcctcatacaggtggagataatcaggttacttttggtgggagagtcattttagtcaagtggggtgattacactaaaagaataggcattgatggtactgcagacgcaattaaagaagccatcaaatcggcatttggtctaagaacaagacgggccttttggcttgaagatgaggatgaggttgtccgttccttagacagggatatgccggttggaacatacacccttcatctcgataccggtaatcggaaaacgttttctctgcttatggacaagactttgttttctccacaactaggaataccgtagtagattatttagatttgtaacagtattttctgtattgtggtgttgttgttgttgttgtgtgtggtggggggattattttggaacatatggcttttcagtttgtgacttggttggtgcagtagaccctaactaagaactgaaagcaagtggcaccacacagaagatttgcatccattaactttaaatgtgaatgccgatttcttgtttgagattcttcttgttgagctaactagttcatgttggtcatctgtacatctaactagaaagtatggtgctaactagaaatttcttttgggggtatttgtatactagtgatgtttgtcagtatttatgtttggatgctgccaatagtgaatgacactctcattaccaacaaactgtaaaaaatatcatgttttatcagttgtaatttacgtctcaatttacgatgctattttgcgtccaagttgcgcattgccaactaaaagatttagttttttttctgaagttttttttttcaaactctactgaaggatgttcatcaacactgctcccttttgttccaaatatagattactttagacttctcaacaatttccttagtaagtcatttaggaacttctaagcacttattcaaaaaaaattcctccatgattgtccttccaaaatagatgctccttctctcataaagaaatgatacatattttccaatgtaatataaatgaaggccaacaaggtcaatttgagttagtgcacagatctaaaacaacttattttggaatcagatagagttatattgattcaatcattgctgcattcaatgttcacaggaatgaccatcaaactatatatgttcgaaaatgatgaggtccggacagaagacaagacattctacactgaagaggacttccgagactttctctcgcggcgtggttggacactcctcagggagtattcaggctacagaatcgccgatactctggatgaccttcgtcctggtgtgatttatgaagggatgcgatcacttggtgattgatttggtgacattgcctgaccaaggcatataatatatccaaagtagatatggagcatactcctaccttttaatgcaatttgaagccaagcaaatcatgggttcctggttattgtaaatttagcttttggcatcttgacctaagctaattttaaatgtccatgcagccgaaggggaaaagttatactggatatacattggttacccgaagtaaatagccttggaagttggaacttgaaagttggaaatatgatcattcaagctctctgaagatccaaggtgctttggctgagtacaaagattacagcctaaatgaggacctgttagttgctgccaacaggtcctggggttcctctggtttatatgtaaatgtaaatgtagctctgtagcatcttggtgttagttagtttccaatgtgtttgttacccatgctgatactgggttttacatttgtcacaaatagtcttggaagctggaaacaaatacattcatcagaagtgtaatttgtccggacaacgaaggttgtctggcaaaatgtaagatttctgatggattgttgcaaacagccttggaagttccgaagctggaataaattcattcagcagaagtgcattttgtcttgagattgaagatggtacaaaattacttctaatttaatatgcaagttttgacaagaaaaacggtggtcgatataacataaactttgaggatacggctgtcttgagattgaagatggtacagaattacttttaatttaagtgcattttgttattcacagagcatatgacttcaaaacaccttgaatcttttgagattctgaagtgagaaacaacacatataattgaacaacacagtgaagaaatcgtggcacacgatcacgatgcattcaactccagtggtactttcaacccaggatttcaaaggctgaggaaaaaaaaatcatggtgaagcagcgatacacagtcgattctcccaaaatgcggtaaagaacaagaaaagggattctcccagagcacacgagttccgatagggctagggcgtgaatgaacgaacgattcacacaagcatcacgcctagcaagctaagctagctaaataagctagcagcaataaactagcaagggggtctcctcctcatggctccaacctccaccggcggcttctactcctcgtcccactcgtcgaccttgtaggagacgagcgtgtccaccttgtgaatctgccatggcaagaacacggcgctgtaacgtcagcaatctgggagaggcagcgaaaaaaaagaaacggagtcgattcagtgatattcaccttggtgtcgaaggaatgcagcttcaccatctgtggattctcgatgagcttggcgtcgctctccacccaggtgaagggcaccgcgacgtccatgtcggtgtacgccagcacgtcgaatatgcctgcaaaatcaatcaatcaatcaatcaatcaatcgacgaatgcggatgagctgggaggaattgggggggagagcagaggcgatgaacactgaacactgaagaagtagaggtggtggtaatggcgcttacatggctcgtcgaggcaggggaggtaggtgatgcaggaggcgacctggcgcatgatggcctggatctccctcatgatctccttgtcgctcttctccttgatgacacccttgtcgaccacctccgggtcggtctggatgctgaagttccaccgctccagcacctcggaggtggccttgctcatgatcaccagcacgatcctctgcagcttcccggcctccagccactctgcgcgcggcaacgcaggaaacacaggcaagatcaatcagcagcagcaaaagaaaaagaaaaaagaaaccaaatggagacaggcaggctagtgatccggtgagtgaggccagacgacctgagagctgggtgttgaggttggcgatgaaggtcttcaccccttcgtcctgcgtcagcagcatcgtgaggccgtacttcttcaccttggtgaagctctcctccgggtacaccccgcggttgtacaggatgctgcgccacgcacaaaccaagaacacaaaacaccccggatcagaaattaaccctgaatctgcagcaaccgttttttatattttttttctttcaaaggaaaccagcatcagcgcagcggcggccgtcgatcctggcacccgcaaccgcgcgaagcgcgcacctgttcgcggcgtagcctgccacacgagaaaaggcattcgatcaaacacctatcgggcgcgcgcacgcgtgagaggagccgagggcgaaaaaaaataaaagaaacggaagcggagatcggcttctaccgaagaactcgctgacgatggcggcggagccccgcagcgtgatgatgtccttggacgccgtcctcgacgccatctcctgatccgcctcaccttcttaactcctcctcttgcctcccgtgcggcggcggcggcggcggcggatggggggagaggaaagaggaaagggggggaaaagccgggcaaaggcaacggctagtgtggagcggatcggctgcgggctgcggcgcttgggaacttgggagcgttgtttgtcgatgggtcgtgttgggtcaggtgcgggggagagaaggtgtcggcgtgcgggtgggtttcgggagtttttaaaggtgggccggacctgcgctcccaacggtcgtgtgggcggtgggccagtgggcttcggttggcgcgattcgcccaagccgcgcgctctcttcgagtcctttacctcttgttgatgatgaattgtactggtaccagtagactactagtagaaccgtagaaacaccattttcttggagaaaatgctcctgggtggctgggtttttgaacttgttcggacggttggcctttagggcagtcccaacccataacactagacatagttttcataaactctacatcatcaagaaattagtactagacactactctttcaatataaacaccactattccatacttcaatttaatgcaatttatcttacatgatattttgtgtagaaaccatatctcatgcaagacatggtttccttctctttcctcatttatttacttgccacatcattttttatcctaggtggcaacttatataatgttatggacatcatcctagacattgggttgggaatacccttagaaacggagggaaggtatttgccctttgccgccaacaacccctatttgccctcatattcgtccgtttagcacagttataacttaccaaacaattttggtttcaccaaaaaaaatagagtaaagctggttagagtgttctcgcaaaatgagcgtcttaccaaacgagacatctgtttcttactgtttttctgggcttattcggccgaattgtaaatcgaaaagtttattcttcaccagactaaaaaaatacgcttattcattatattatcagagcatatcatttgattcacggtttggaaaattatgttttgaaaatacaaaaacttatactgtagtccttccatcacggcacaacaacttttttccatgtcttgtaatataaggtgtgtgtgcatgcatgcacattaactatcacctcttagtcctttaaatttggtttgttttaaaccatctaccatcaagcccccaatcacactgcttgcctgtacggatgtgatctaaccgatgcgataatcaaattatttctcggtcttttgcgttagaagtgatttagcctaacacccattttggcatgtagggagtattacttagaccactcattttagacatattttatcttaaaatattaaattaaccactataatcggttatataatggcgataataatatactcaataatctaaatatagtttttaatatatttgtgaactatgtgattctatactaaaaactacccctatgccttaaaagccactgactagcactgacattctgtttgccttttgtttgaaagttaatttggatgtatttaaaattcaagtaggattatattgtttcggtagagattatttttcaagagaaagtttcctttgattttttttggtgcaaccttttttctttacaaagggaacttttctaatgtttgttagaagttttggtatatagctaacttttttatttctcttgtagatttttttcctatgaaaaacctttatagttcttttggtgaaagttctatcaggccctgccatttttactggcacagcttaagaaatggagcactatgtttgattcattggccaatgtatgcacggtaaattgttaatgcatcgtatagcaaccaatatatacaactaccagttgtagaggagatatctcgtttcagtaaccgccattttttcaccaaccaagtcacgttttaataacattctaatcgaacattttcaatttataactaaaactaaaccagaggaaatgactgtattctaggacaaaatatacacggatcaaatcacgtcttattaagaaggaatatttctcagtatcggttcccttgctctaaatgatactgtatcaactattcataacaccgtttatatgtttcttgatcagcaggacgatagatcttcaacggctgattatcatcgatcttcttggggaggaagcctacctttgccattatcttttcgtgggcccaaatccagcagcggtccaacgtttctctccacccacaggaaccttctggaaacccacgccctctctatcccctctcccaatccagcgacgtggccgcatctcccaccgtccacttcccccctcccgattcaaaccaacggccccgatcccatccttgagccgcgggcacagagccctggatcccccggcggagccagttctatataaaggcgaggccgccccagctggcaccacccattcctcgcgtcgcatcgcacttgtagctctcgacccccgcatctcatccctcctctcgcttagttcagatcgaaatcgcaaatgggtaactccgccatctgatcccgcttcctccgatctcgatctggtctccccgttcccgttctgttctagtggagtgatttttttgcatttttttctgactttttgctggttggttttttggcttctgcagcgaagattaagatcgggatcaatggtgagttggaccttcgtctccagatctgtgttttgtgccggtgtttgcggggttttgggggtgggttttgattgttggatgtggattgtgtagggttcgggaggatcgggaggctcgtggccagggtggccctgcagagcgacgacgtcgagctcgtcgccgtcaacgaccccttcatcaccaccgactacatggtaaaccctcctgccttttgcttttatctcgttagctgcacagatttgtggatagatgcgaggggatgtttggtttgttttagatctactattccaggggctagtttgtgggtttaggtgttaggaggttacagtcccagtgtgctcttgactggcttgagcttgacccagcgtattgatttgcatacgcgagttagttttttgtggctgcttatcatattgttgtcctaattagatctgtgagtttggaatttggatatcagtgtgtcgacctgtcgatcaaatagtcattgatatgtcttcagatgcatttgcacatgcaaaatcacagattgtgccggttgctttaaaattccgcacagcgatatgctttgctgtggtactggcttctgagatatgtttgccacatccagctatttgtttccagtttgttttggtttgataatggcccttcttaaatatctgtgattttccttttcatctgaagtgtgaatccaatcatctagacaatgcggtgataacttttttttcaatttcctgcagacatacatgttcaagtatgacactgtgcacggccagtggaagcatcatgaggttaaggtgaaggactccaagacccttctcttcggtgagaaggaggtcaccgtgttcggctgcaggtttgctgtttttttccctctctgctgttgtctgatgatatcatgagcagtataccatatcgctcaaccttaatttctctgctcaggaaccctgaggagatcccatggggtgagactggcgctgagtttgttgtggagtccactggtgttttcactgacaaggacaaggccgctgctcacctgaaggtattttctgcgaaacccaacatgtcattgtttgattgtggtgtcataacaattcatatgaagaatgattctcatggtatcatatgcgtttcaatatagggtggtgctaagaaggtcgtcatctctgctcccagcaaggatgcccccatgtttgttgttggtgtcaatgagaaggagtacaagcctgacatcgacattgtgtccaatgctagctgcaccaccaactg

SEQ ID NO: 42582 - DNA, 10175 bp, Oryza sativa
  unsure (1)..(10175): unsure at all n locations
acttgccaaggtgtgttcctcactcattttcacttgtctactgttgcaaattgtgtggtgatgttaagaaattggtcactactaccatatgaagccttgtccttatcaaattgtctgcctgcaggttatcaatgacaggtttggtattgttgagggtttgatgaccactgtccatgcaatcactggtatgatctttgaagtacctgtgatgttcttcattgttgtggcgttgcttagcatttctttgatgtaacactgtgctgtaattcttacagcaactcagaagaccgttgatggaccctcgagcaaggactggaggggtggaagggctgccagtttcaacatcatccctagcagcactggagctgcaaaggtaatcatgagatttaatattatcccatatgctgaggtcagcctccatgatgatttctgtctgtacatataatataggtgcattagttagtaatgattagtcgctcacttaagagtcaactctttgttaacttcactcgagttggtaggctcaacctttgtagcatcaacaatgatttgttaaagatctctttgaatgcattagcatttggtgtacatgtcagacaaaatttttaaacacgtttacttataattgaagttaaagctactgactccctatcagagaaggttcaaagtacattgtcctgaagcaactgtactaatttgaacacagtttctgcctccaaatgcttctttgtttgcatcatgtttgttaccttcagcataatctctggaagtgcaaccgtatgcatctaagttgtaaattcaaaatttgagatcattatttaagaattttgtttatagtcttttcgcctttgtgctaatcctgtttcggggaaatgtttgtacatgttttaacttttgctataaaacttgttaggctgtcggcaaggtgcttcctgctctcnnnnnnnnnnnnnnnnnnnnnnnnnnnnnnnnnnnnnnnnnnnnnnnnnnnnnnnnnnntttgactgtcaggcttgagaagccagcatcctatgatcagattaaggcagctatcaagtaagtgtagcataaattagaattgcccttacagaaagtgaagaggctaaagtattgggtaccagaacgtcatctaagactagcaattgacttttgtttgttctgttttctagggaggagtctgaggggaaactcaagggtattctgggttacgttgaggaggaccttgtttccacagacttccagggtgacaacaggtggagatctgtttaaattcgtcttgtatttggatactcggttactcgaagcccctgacctcttttgctctgtgtaacaggtcaagcatctttgatgcaaaggccggtattgctctcaatgacaactttgttaagcttgtgtcttggtatgacaacgaatggggatacaggtaatcatttctatgtgcattagaaagctatacttgttttttagttcatggttgtttggttcatatcgcgtaggctagctctccattagaaagctatactggctgttttgttcatatccttggaattttaacatgttctatggtagttctctgaactacattaccttggtcaggttgaacccttgttttctaatgtattactggttagttgcagttcttaacacaaactggatcacactccagtgtgccctctttcttttgctagttggattcaatattagagaattctgcactagtatctttttgccatactgttcaaataattcgtacccactccattttattactgtccaaataattcgtacattaacccactcctttttatttcagctctcgcgttgttgacctgatccgtcacatgtacaacacccagtagaagatggtcactctttcggaagaaatggagtagagtgctactgaaaataagtcggaccttttgcgagctactccagtagagcttcattagctgtatgctgccttttgtttttgctggcttttcgcatgatgttttattaaaactcgatgtaatgttaatttgtgtacttcatctccggcactttataaatcgtggtttttgaatttgaaagttcaagtggcattagacgaataatttcttgaggattagttggctgcgctgttgattgtagatgcttggttcatatccatagttgttgatattcacggcacgggtttgctgaaaaaatgtcgcctttttttctgcttgatttcagtcggattctttcgtctgatcgctcaagtgctcgcttgctctctgctccgactacattggcccgccgccatgtactcggttgctctttttttacagccaaacgtgcgaagtgttttcatctccttttttagaaaggagcctggggccctgcttttttatagaaggcaaatcctttttatagaaagcaaatagagtaaccaatttatcgctggggactccagctgaaggacactcgcagctagcgcccaaaacagagaacttggctatcggaaacaacactaaccagtcccgactcttgctggacgagggtcgttgaataacttcacgaatgttgtctaccaaagactgggtcggaatttcttcagctttcaaaagtggcgatgagtttgcagcgaaaaatcatatcatttctgacacggcggacacgcgggccgcgcctagcttaacgcactcgacgtgcaggcgcgtgaggcccgcgaacacgcggggatacttgtcgcggtaggacgcgaggcgcgccccttgcctagcgacgtccctgcccgcgcacagaagctccggcttctccgacgagacggtgaaccacaggtcgtggatcctgcggccgcgggccatggcgtcgtcgaccgcgcggacgatgccgaccgacttgtccctcgagaagaagctcaggcccaggcggcggatggcgtgccggctctcgtgcgctgccaggatgctctgcaccgcgcgcaccatcgcgtggttgctcctcgcggactcggatagggtggatgtgaagccgtcgtcggggtcgtcgtcggggtcgggtgcgaaggagtcgacgtccagctcgatgttggcgagcatgccggggacgcggctccaccgcctcgagaggaggctgcatcgcacggcgtcccgtgtgtccagcttgtccaggatgaggagcaggacgtcgtcgggcagatcgctcagcagcgtcgtcatcgtgtttttgtcgcggtctggcgttcgttacctgtggcgcgcgcgcgagaccgagagcaagcgccggcccgcgcctatatctttctcgtttatatgtccgcgagacgccgagaccgcgacgtttggtcgtctgccgctgcaatgctgcatgctttagtcgtcttgactcgtttccgattccatattttcgccaccagaatcccgacgaccgacgtgggaggtggcaggaggcgactggttggttgacagacccagattggaatatgggctggattcactcgttccaagttcggcccatgccaaaacagcccacttcatcgaattggatcacaattcctgatttccaagcccaatatacctataatccatacgggttattactttgagatattctgtctacaaaaacaaaccggcatacagccttgagccttctgtttggaaaggtttaggcccctttaaatcaaaggaaaaaccataggaattctaaaggattttatcctataggaaatgggaccacctatacatttgtcgataaattttctcctaaaattttgacagatgtaattatagtacaattatagtgtaattacactgaaatttatatgtaattacactgtaacttgcatgtaattacaatgtaacttgtatataagtttcacgtaattttgaattgttaaatctattacaagatttgttttggtgaggaaaaacaatcatagcacacacatatgtgtaaggatttattctcacaacctctattttaccgaaataacatattatagagagatttttgaaagttacatacgagttacactatagttacagtgtaatcacactactgtcaaatttttgggagaaaatttgtcaacaaatatatagcaaaatcgatgggaagggacataatcctatagagtcctttgaaacaaatgattgtttcctattaattcctttgaaattcctatggagtgaaccttactaaagcaattttggaggaaaacaagcatgaggtcgagacctcatgttttcctcttcatgtgtctaaggttcctgcgtttttcctgtgtgctaatcaaacgacagttcgaggccccctttgaattggaggaaaaatggaggaaaacaaaggaattgaaatcctactctattcatgcctttgattcgtaggaatgagaaaagaaaaaacgtaggaaactttcctattcctacaattctaaaggaaaaacgtagaaaatttaacatccactcaaacctcttggaaaactttccttaaatctatctctctcatctgattcttgcgtttttcctacggtccaatcaaacgatcattcctgtgtttctcctgtgttctgcaatcctctatttttacacttgcatttctatcagaatcctatgtttttcctattcaccgttttttcaatcctgcgattcaaatgggccctcagggatctaataagtgtggcattcaattcctacgtttttcctattcctctgttttctcaatcttgcgattcaaaggtgcccttaattgtgcatacaatgaagtacttgaatatcgtgattatcttgtgtacttggggggatgatttgatactatttataagaaaacacgtgaaacttctcttggtatcaccttttgtgaataagggaataacatgtctcctcgctatgctatggaaatagatgttacattcgtacttcttatatgtactaaaacacttttttatcatataaattttattctaaatataaccttccacccaccctttcatcttaaccatcttccatttgattctttcactaaggccctgttcttttctccaacaaaacttggataaaaataaagatttttgtggcacacatttcaaactgttaagccgtgcgtttcgtgcttctatatgaaagttgctctaaaatatcagataatatgttttccaaatttataacaattaaaactcaatcgatcatacgttaataccacctcgttttgtgtaaaaaacttaatcttcatcttcattttcagaagaaaagaaacaccacctaagtctctcatctataagtcataaccatctctcacttaatttctctacctattttctcacatcaatcaattatttaaattttaccttaaacttatttttttccaaagatagatatgttgaacatgtgttgggctattgtctattcacagctccattgtttgtttgttggtttattagctacaaccaaaatttaacttttgaaacttaataaattagagttaattttgagattttttcatcgtatttgtttttttacttttaaattattaagacacgattttaaaaatattatttgtaaattattttttattgcttccattattttttttttgaaagcttagagatctagagcaaagcgaggccgatcttcagtgctcaaccgccgcagcttagcgcgccaaaaatattgctatcttctcaaatttccctccaattcccctactcccccttccgtctctctcctccctcgtcggccccgcgccggcgccacaatctctgcctccgcagccgcgcccgccgcctccggagatgtactccccgccccacgccgccgactcggactccgagggatccctcctctccgacgtctccgcctccccgccacgccgccgctcgcctcctcgcccggcgccgcctcctcctcctcctcctcctccgcccaagcaccgtactaggcccgccgcccccaccaaacccaagctcaagcccacgccgcccgctgcctccgcgcccgcgcccgccccgccgcctccgcctacgctccgcgccgccgcgctctccgatccgcacggcctcgccgcgcgcatcgccgccggctctgctctcaccgcggcctccggcactgcctcgtcgtcctccttccgccgtctcgtccagtcgcgcaacccttccttcgatccagccaccgccttcacggctcccgcttcgtccgctccctccgaggttccgagcgccgctccgcggccgcccccgaccgccgccaccgacgcgccgccgcagaccaggcccaagcgggtgcaccccaactccgtgtcggaggtagcggccgcgtcggcggcggcggagcagccgaagcgggcaagagggggatccgagggcaacttcgtgcggctgaacatcaacgggtacggcaggaggaggacgttcaagaattcgcaggccaagcgctcgacgaaatgtcgatcctggcggcggcagcgcgccgccggtgcaacaccccgttctcagggcgacgaggaaggggatctcgtggcggaggccctgctggagcgggagaagcaggcagctagcgatagtgttctggaggctgtcgagagtgtgagggaggacccatcggagcaaaatctcaagagcttgctgaatgcagcatatgggcacgattcgttccgccaggggcagcttgaggcgatccagcaaattgttgcaggggagtcaacaatgcttgtgctgcccaccggtgcgggcaagtcgctatgctaccaggtatgcttcaaaatttgagctattaagtttatattggtcggtgctgaaaagttgatgatgctattttctcaggtgcctgctatgattttgcctggactgacactggtggtgagtccactgctttccttgatggttgatcaattgaggaagctccctgcatttctgccaggtggccttcttgcgagcagtcaggtaaaggcaaaatgtttgcagttgctgctagttccatccattcttgttttgactattgtgtaacattacctcatttatccagacatcggatgagtttcatgatacactacaaaggctgcgtgcaggggaaataaaggtacaattttcttaatgtcgacatctgatcagtttaagcattctccagtgactacagccttgatgctgccttatctagagaacatttccttactatctttatcaattcttccagtgcagcatttttcttggagtaactagaacatgaatcattaagaagcacaaatgtattttttttttgcacttcaatgttttgctaggttatgctgagattctttatttttgggatcaggtgctttttgtttcccctgagagattcttgaacgaagaattcctcctgatatttagggacacactaccaatatctcttgtggcgattgatgaagctcattgcatttctgaatggtgagctgacattgttcttagttcagttgagaagacatgatacttctttacagttggtactgtgttattacttttgtgttcacatcatttttgtgatacatcttattaattttaccgttgttttgttttcctagtttattattcacttgttgtgtagtgttagacagttagtacaactgtcttgctaagtttataacttattcctgactgaatgtacaggtctcataattttagaccttcatatctgagactccgagcgtcactacttaggagaaagctcaatgttcaatgtattcttgcaatgactgcaactgcaacgacccaaaccttggaggagataatgaatgccttagaaataccatctgataatctcattcaaacatctcaaataagagaaaatctacagctgtctatcagcacaagtgataacaggtaggccacttctctttgcacccatgaatgcaaccagagtcagtttaatacgtatttacatgtgaaagaaggtatgctatctggttttcaagagcatttgcacgtatgcagactgaaagatttgatgttattattgaagtctcccccttttgttgacatgagaagtattatcgtctactgcaagtttcaggtatgttttttttttttaaaaaaaatcctaaagatgttccaaagaccacgcatctgtctatataccctaaatgtgtatgcactatatgaagatttgacccctttttaattattgcgaacaggcagaaactgacttcgtctctaagtacttgtgtgataacaacattactgccaaggttgacattaatctttagcttgatattaatttgctgcgccaactttaattacatattctattgttttatagagctaccatagtggacttctgattaagaacaggagccgtgtacaggagctattttgctctaacaaaataagagtggtatgtggtttcttctttagttctttggcatgaccttttctcgtcaaatgcattatgtaagacgtggtgtctaacatttgttttctccatccttgagcaaaggttgttgcaactgtggcatttggcatgggtcttgataagagtgatgtcgaaggggtatggatatacatacattatgatgctcaaactgtatgatagattgcatttgctccttgtttttaagtgaacttcatttctacactatctcaaattttgtgtatctcataacgttaagcataactaaattatgttaatggtctgactcgagcattccacccttaaaggtgattcactatagcttgccagaaagcttagaagaatacatccaggaaactgggcgtgctggaagggatggacggttatcacactgtcatctacttcttgactcagcaacattctataagatccgtagtctttcacacaggtgaatctttttttcctaatcaacatgctctgcctgccacagttttcctataatttcaccgagcaaccttttcttggcagtgatggtgttgatggatatgcaatgagcaaatttctttaccagatattttcctctgagaacacaactgggtgcatttgttcattggctaaagagttgacctcacgcaagtttgatataaaagaagaggtttgcaccttcggaccttcctcttcaggccagcatgcacctagtttcttatgtcatgcactcatcctactacctacataggcctagtttgctcgcactatgttatactgaacgggtcaaatggatatcaatttttggggcacgtgtgtttgatggctatttgctgtgctctgtaagaatttgcaatgtcactaaattttatttcttagcttaaatgatgtcttagtggatgagctgtctagcattcaattgttcagaacatcatagagaaaattatcggtatgatgccccaagaagattccagtgtttagtttacggaagttgtttccacattctattaatctcttaatgttactcttccagtcaaaaccacattgccattccatgcaattggaatcagctataatgcatttaggttccaggaatactacaaggaatagcatttatagactttttctctgaagccgttagacagtttcttcccctaatattttacatggaatccacctttcccaccaatatcttcatgcacttctttataatactcttatcctaaagccttttagttcctgaatgaccgaaaatattaaatggtccagcaaatttttagattcaatgatcttatcttcttatttttctaacaatgcaggtgcttttgacaattctcacacagctggaaattggtgatcaacaatacatccgtttacttcctcagttcagtgttacctgcacactgtattttcacaaggtatgccacaggcttctccagtgatctggaccttttttgatttgcgtgtcaagatgctcagttgacgatcttcttgtctgtcatgtaacaatgagtgatcttaattgttcaccgcctagacacttaattaacatggcttgcctttacttaaaaaaaattcatggatttaccatgttcattgttattttgtcaagcaatattcatttttctttcatatcttgatcattggattaaattgatgcagacatcaccacaactgcttgctgacaaggatatactaattagatcggttttgaataggtaacacactatcaacttttgttccaaaattttttctgaatgtgctacacatttctaagatgtcgattctgaattcgtggagaaagcagatcagagatgaaggatggacattatgtctttgacataccaagaatagcta

SEQ ID NO: 42583 - DNA, 4948 bp, Oryza sativa
  unsure (1)..(4948): unsure at all n locations
ctctcttgaatattcattttgcttcatattgtaaattgccaatctttactacataagttctgttttcttttgtaaggatttaagttgtggtactaatacaagtttggtcttatgactactaaaaaagggtcttatttattttgagcaagaaagcggattcaatgaaattagagtaaaaatagaagttagatatactgattcatggaatctgctgttcaaacagatcagtaagttagatgctatgtttgctcttgcaaactttgctgtcaaagggtgtaaaaggacgggaggatgctctggttcccagcacactccgtgcattcagaagaagattatggagtacttcagcaaggacgatggcacctcagagaatgattgccgcactcagctgcagaagagcaggtttctgtactctttttctagatcgaacttaacagagcattacttgccatttgtttcttgtgatgttccaatctaaaatttatccgactgaagcatttcatcttactttttttgcagcccattcttgcaagccgatataaaggtaagcactgatgatgtgatacatttcccttgtgattctgtataatgcaataattccaattgtatctccaccatacttctaggtgttcattcaaagcaactcattcgcaaagttcaccccgagggctgttgcgaggattatgcacggcatctcgagccctgcttttccatctgtcacttggtccaaaaatcacttctggtctgcctctctggctgccttttctcattattttcctctgtcacctatttacctgaacctgaatctttgctgacaggggacgttatgtggaggttgattttccactggtcatggaagcagccaaagctgaactggttaaacttgtcggaaaaggggaacagtgctagcagttggcgatcaagaacagttcttgcccccagctacctgtacatacatactcgtatgcttgcaagccaccgcggccacccaatcagataggcatctaaaggaggtctgcgcccactggccactgccctgattgtttcctttacttaaaactactctgattgtcttgtcgtacgcttgacactgactgcaatttgtccttcaccttgtatatatataggcacgtaaagaaggcgttgcagtgagcatcctcctgcagaggaaacttctgctaggtatgcgtgtgtctaccccaggaacgctttcccgtcgagctggctaagaggcttttctgccatatgattgaggggtgccagctcagtaattctgcttgggtgaagagaatgatgccgctcgcacgactggagtatatcggaagcaagagtcagaagcagaacccattcttcttgtacagacaacactgctccatatctaattatcgttctccttttcctttccaaatgagaatcaactcttcgacgggcgggtaaagtgtgaagtgtcacagtaaagcaccggaaacctggttgccactgcagtatctcctctcttcaccatgggccatccttgcgtagacccaattctgttacgtttccactgcaaaaaatctccccaagtcccaggtggccaggtacatatctatttccccgccctcctattctcatttgcttactcccttcgacccaaagttaacatgacacatgatgtatggtgtgatatattttaatactacgaatacgaatttaaatattatgtgttatatcttgtactagattaatttatttcggatcgaaagggtattataccctgaggtggatgcgtgctagtgtaccgtagcatttgccatggggcgccccatgtgctttccttctgtctcttggcccattcttgcgcggcttcacttcacgtggagcgagagcgagccattcttcacggggcatgcggcttcacgaaaccagattcatttgacgtgcgtgcggtgattgctcgtcgcttcgctggatctgagtgacaaagggtcctgcacttgattgcgtattttcaatcagtatagctggtgtatgtacgcctgtacgggggcggctgtagccggggacaccgtgtctaacctaatctatgtgcgacgaaggagaaccgtgggctgctcaagacgatgtttgtgaggttgcatcaaaagatgttacccgcacggttgccgcagtttaccaggctgacacgacacggcaaatgtatttttagcgttaagccatgtgttagcaggtttaatgttgggattaaaaccgctgaaaacgaaggtggttgttgccttcagaattagattagaaagatgctccacatcaatttactaaagtacagcgacgtgtaaggggagcgaagaggcatattcggcggctccaacctggcgacccgaagcatattcagcctcctgcccaacaaggcatttagcaccgaagtcctacgtgccaacgtgcagggaagttcctcgtgctgtgcacagtgcacattgtttctttgccgttgaagattatacagtacattctttttgcaacacgtacatattatgctatgtagcccctttggaacacataacttcattaagaaaaagaaataattatctttcagggtacaatacactaccatatttaagataactcgagattttaagaatcaattatctttcagtgtacaatacactaccatgtttaagataagttctacttgagttatgtaatgaatcacaatgccttcatttaaaaaagaaacaattatctttcagtgtacaataccatatttaagattactcgagattttaagaaacaatcgataggctgagtagtcaactggcgataatatgaaaaaaactaggtcttctagcttcgggtttattttttctaaattttataattatttttagctataaatttaaataaaagtgagggattatatctataatctttagaggaactaaagattactcaatagaagaaatcgtatttaccataagctcttaaattagaagcattattgtttagagtactcagaggtgcatgggtcttaaaataacagctgcgcctacaatttaatacacaacactacataccttcgttacagagaatattcgctcctaaattatgaaaacttggaggcgagaaaagaagaagagaaaaaagaaaacgagcaagcaaagaagaacctaggaaaagagctcgcaaacaaagaccgaaccgttccaaaaaggaaaaaaaaatcaataaaccccagaagaagcctctcctcctctcgactcctctcctcgccgctctcgttgcttcctcgcggggagttggaaccccctcccctctccctctccctctcgctgactcgctcttcgaggagaaggcgaaggctcccgcgccgcggagtcggagatggccgccgccgccgccgtggtgaactacccgctcgtcgcggcgctcgtggcgttcgcgctcgcgcagtcctccaaattcttcaccacctggtgagtcgagttgccctacctctccctctgcgcccccgctcggcggccgctcccctccacgcgctgcgtttgtgggtgacggtttggctccatgacagtggccgttctcgatcgctggagacgtgtggttcggtgtttttgcattgcgtaatcggtgggaatcgtgggggcgaggtctcgttggcttcgatgttgcgtttcgtggtttgcgcgttggtagaaacaaggagctgacttggagaattgagatttgaggcctacgaggagctgaggcgtcctagatttgttttttttttttggttcgctggcatggtttggattgtagctagcccgtagatcctcacggaggttagagagatccttttcctatttctgtattttgcttggctttgacagtgtgatctgcagcaactgcttctgtagggggtagaactgcttttcttgggatacttttgtctagaagagacaaacaggatttctaaatccagcgtgatgtgagagttggacggctactgtagtgcgcttgcacgatttcgtttacatttttggtacgttttgtcgtgaactactggttgagagcattacttgagaggcactaataacagggtgttttgctacttagtgccttattactatagcctgagggcattttagtgccctgtgaaatttttactgggcaatttgatatatttttctgactcacgttggttctactttatagtacttttaggcaagagttgtgcagattgcttgcaaataatgagtgtagtaaaattattaattaaagtaagcttggtcttccttgatatttctggaagatttaagacaatagttggtatctgttatgggcgtatcagacatgaaatagtcgtaattgttgtatttaagtatcaagtgtctcacatttttgtgttgcacagtataatatgctttgttgtgcaggttatttttgaaatcactaggacaatagttggtatctgtattctgttatgggtttatcagacataaaataggcactattgtagtatttaagtatcaagtgtgtcacatttttgtgctgcacagtacaatatgctttgttgtacaggttattttttaaatcaccaaaaatcactaggtgatttcaaaaataaatacacattgaattggcatcaggacaggatcttttgttttcaaactggaaaacatctatctttctaatttcattaagtaaggaaaggaaaaaaatgttatacaaaattagtagataaaggactagaccaggaacagtatatacaaggactacatatggccctcgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42584 - DNA, 7816 bp, Oryza sativa
  unsure (1)..(7816): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtccttgagggcagggtcctcaaggagcagcaccatgtccttgaggtggtcactgtcctccctctccttgcccctgaacaggggcctctgctccctgggctccagccctgtcaccatggatactactgccttcagctcacctgcacaaaatgcaacatcacatgtttagatcttgatgatcaatccaaatcagcacaccaattaggttttattttgttgttgttctaacaaagaaacaaacaaactataggacatcttttttttttagagcgggtaaagtatgaaggacttttgactgggatcctgtggtaaagcaataggtaaagtatgaaggacttttgactgggatcctgtggtaaagcaatagttgtgctttactgtcacgccacgcctgtataacgtttacatatcatcgtgacatttttttcgattaacatatactcctatcaccgtgccgtgtttatgtaaaatggtggtgccataatccccttgctcgtgcctaacaacttggggaaagggactcttgacttctagttttagttttcttattaattccgaattttagttagttctaaattgtatatttgtatggactctagtatctttttcctgtattccctacttttaattctgattttttgttatttctaaattttatttctaaatggactctactttttatttttatccgattaatgtgagaatttatgagccgtgagagcgaacatggagactccttttctattaatttaataagttaatagattcatattggtcatccaaactataaaggacaaatttcaatttttattatgttgagtggggaaaattctcttgcacctcgctaacatgctttgcgaagacatgaaagttggtttagatagggttcttgttacttatgatcagacgagttttttttttttaaaaatgatcagacgagttagacaatgacttgtgagaccttggaagatcaactttgtataattgtaggtttccatccaggtcgaatttgtctcccataattaatatacagtttaataaaaaatgcttctgcttgtaaagttcggtttgtattagttcaaggcaaatatgtttggtttgtaggttacaatttttattattctcgtgactatcttattagcaacaatacaatagtccctccgttttttaatagatgacgccgttgactttttctcacatgtttaaccattcgtcttattcaaaacatttacgtaattataatttattttgttatgagttgttttatcactcatagtattttaagtgtgatttatatcttatacatttgcataaattttttgaataagatgaatggtcaaacatgtaagaaaaaaatcaacagcgttatctattaaaaaatggaggtagtattttttttcaaagtttattttcttgcctgagtatcgtgtttaccttatttgctcttttataaaaaaaatatatgttgtgatttgcattacagaacacagtcgttgcgttagaactgatgtattactagccttacaaagttctcgggtggtttaaggtatgcatagagttgcgaaagggcctgtagcctagtaatttaagagcctcagtagcacctgaggtcctgggttcgactctccatgggggagcaaatttttcaggatttaacggcgctgtgctttcagtggtaggccatgggagcgaatttttcagaatttaacggcgctgtgctttcagtggtaggcgaggtgcctgtggtgacttcgtcaatctctccagtatttgccggcccggtaggcgaggtacctgtggtgactaggggtgaaaacggagcggattcaaacggataatagctataccatatctatcctaaaccattttttttaagcggatgcggagcgggtgcggatgacgtgcggatgcgaatgcggagcggattatttcggacgtcggattcggtgcggagtcggttcggtaacggacaaaaaattgtcggatgtcaagtttgtattcaatccatacaacaagggggcagcaatacaattagcccggtctcaatataattcaaggtacatccatgatccataaaaaaaataatataagtgttcagttcaatagctcacttgtcactgagttgcttaaaatggaaaaataaaagtcatcactcatcagcgtgaggcaaggcatacaggcatacaacatagagcacatagagcagtagagcacgcagcatacagcagtactgcagtagtagtacagcacacaacaggcatacagcatacgacagacagcagtgaggactgcacgtgtgcacacaggcacacagcctcgtcgttggccatcacctcgtcggactggaacaggggaacaacagctggcgatggggattgcgcaggcgacggtgccgcctgggcgctggcggcctggcgccggcgacgggccgacgggccgacaattgggatggcgcggatggcgcgggcgactgtactggcactggcggcgacgccgaggagccgacgacgaccagcggcggcgccggctggagctgaggaggagcggccggcgcgctaggaggaatggaggatcggcggcggtgccaccagcctgcagtggcgttgcggtggcgcgtgtgggaaaagaggcgaagaggcgactcgagagagagatagatggcgcacggcattcggcagagagagagagagatttcgggaggagtggattaggtcacaatagatgggctaaatgggttacaatatatgggttgaaagactgaaagttgcggattatccgccaaatagtgcatcggataatccgatcaaaatatcggataatccgtatccgtcggatatcgttgataccacatttacatgataaaatccgcatccgcatccacatccggccgaatatctaaaaacttttaccatatcctcacatcggacggattcggagcggataatatccgctctattttcacccctagtggtgacttcgtcaggcgagatacctgtggtgacttcgtcaatctctccaggatttaccggcccggtcttcgaagatgctcataggggtaagtgcgcgtgtgttgtgagtgtctgtgttgtagtgtgtaattaaaaaaaaagatatgcatagagtttgcagtacatgtttcccaattaaaatcctggaagaagagcgagagctcgaccagccaatcgaaggtgtatgttgagtcaacttcaacgaatcgaacagcgatgcatgcacgcgttacgcgtaggccgctacatgggctgaagcgtaaagcctgcacgacactactgctctcaggtgcggcccagataatcaactgaaaatttacgcgcgcgagggccataggttatcttttgttcggcagtgcaggatgaaaaactatcccacgtgattaattaagtcttagctattttttttaaaaaaataattaatattatttttaaattaatttttatatagaaatttttttaaaaaaactcgtttagtagtttgaaaaatgcgcacgcgaaaaatgatagagatgggttggaaagatgggaatccggaacggaacagacgagtgcgcaggatgtcgtcgggcgtgggctggccggctgggttggcatcggagagctgggccgcttcccgccttcccgtgcgtgcccgtggccgactatgcaacgcatccgccacgcgtccagtccggatcgaattccatttcccgtacctacgtagtacaccgtgtaaaaaccgaatcggactcctcggccaaaaccgagcagtacgcgcacgccggctgcgccgataaataccatgagcgcccgctgccgccggacgaacagatacgaggcgcggcagcactagtggtacaatttccacaccatccgttgtactgaattcttgtttttcctcctcatggcatcaaacggcaccagcgtggcagaggtaactacactaagagcagcatttcctcgtcttccatgtgttcctatttatgtgtgtgttttttttacctttttttattatttatgagtattaaggtttggtttacatattcctcgagaaaagaaggaatgtttattccttatgagatattaatgtcacttatgagtgcctacaaaagtgcagaaatacttattatgtataatactaatgcagggtgacaaagctaatcaagaagacaggctcagtgcacttcccgacgacattttgattcatatattggatagactcaaaacacgtgatgctgtgaggactagtgtcctctcaagacggtggaggcatctccctggcgtcctgtctaagatcattctccatgttggatcatttaagcctaaggatggttccatgctagccaaagacgatttgagaataagaagcaacatctctgtcatcgaagcaacccaaagtattctagcacataaaagtcagtgcaaaattaattttttgagcgtgggattctatttgagggaggaatctatcagcatcgcccactccatcaatgatgccatggcaaatagagaaatcgtcagtacgaagtttatgattttgccagaaaaacatggaatacaacggatggaagatgacaagatcatatgtggaaaacgtttcatgtcattctcttatgcttgcccccgtgcatttggttgcctcaagcaactaatcttaacctgtgtgaggctaggtaactcagacttcactgatgtgcttagcacatgcaagaagctagaatacctccaactaataagctgtgactttcagccatcagtattgcaaatggaacacccgacgcttattaaaatggagcttgtggtgtgcacatttggaagtgtcgatcttaaatctcttccgaaactaagaacattgattgttgacacgtggatgggtttggaggaaatttatccgctatcatttggttatgttccacaactttcgaccctaaagctaacttataaaggcacaactcgggacaagaatatcaagctaagtgagtttcttggtaatgcggctataggcgcactgcatctggattttgaatgtggaagggtgagtttgaaacttttttttttgttaaaaaggaaattgttttaggttagaatatcatggtttgatcattagctgtatgttgcagatttggattcaaccggaacatccgaaactattggctcctgtgttgcggaatctgcagattgctagtcttacttgcattcatgaagagtgcaaccttacttggatattttttcttttagaagctgcgcctctattggaaaccatgcacataaaggtatgtgttcttaggaatacatcggtagctatgtaaataatataatggcataaactataacgtgttttccttatatcagaatgacataaatatgtcaccattcaaaagatattgattcataacaactgcaacctcaatttttttttgaaactaaactgcaacctcaattgtgttcttcaatactcttgttgacatacattggcagcaaatatagtttatttgatttcttaaaatattgtctattttttttgttaacttggtttctcctatacgcagatgtgggaccatgaatgcaaaacgagtgaggatgaggaactataccaaaaggaaggtgataaattattgaagtgggaatcatctcgtgattttaagcatcaaaatttgaatgttctcagaattgtgggctttcaagttgacgagaagtttatgacgtacataagacgggtaactgaaatagcaattaatttagaaacagtattactctttgaaagtgtttcttgcaaaggctgtcaatttcgcccctcgacgagatatccatacaccggtgaggaaaaggttatgacggtgaaacagatttgtgaggggagatctttgccgattaaatttcgtttcggtggccatgtaattgattaatagtattattctttgaaagtgtttcttgcaaaggctgtcaattttgtccctcgacgagatatccatacaccaattgaggaaaaggttatgacagtgaaacagatttgtgaggggagatatgacagtgaaaaggggagatctttgccgattaaattttgttttggccatgtaaggccatgtaattgattaatacagtttcattcagataagtgtgttgttttcttgttagcttaatgggtattacaaacccacggcggaaagatcttactactacccattttactacctacatccacaacgttgaaccggaaagatcttgctactacccattttactacctacgtccacaaccacaacgctgaaccagatagttactacccggtagtaatcctcttgttatcttttttttagcatattgtgaatgcccgttgtgccactccttgtactattcaagtttcttatgttctttcttaactagtctggtgctcgtgcgttgcaacaagtcttaaataacgtgaaacacaataaacttgagcattattgttctgtaaatatatttgtgaatacaataatagttactccaaaaaccttcaaatgttgtcaatcaactataacactatgaattggacaatctaaattacaaagcatatacaatcgatctaaagattaataatagactgtctttagggagcgaattatagaaagtatgcaattagaatataatcagattgtatggcaaacaccaaaattataggcggatatgtacacttaaaatggcagccaaacaagtactcgtattctttggagcagtctgtcattatacactcatgccagataaccaaatgtgttaatcaagattgccactagattgttcaccctgattatgcaaataacaacttatttgaagtaccgccataatctatgacccgcataataacaacttatggcatgcatgactccatcaacggtgtcacctctgttgcttctgttccttgaatgaaacacctcgaatgttgctcttgcatctgaaagtagcagcaaattcagcttttaatttcagatggtagtatcataccactcatcttgttgaattgatgaacataaaattggcaaatgactacaaacttgcaaaatactaataagatttcagtcaagtttttcaacacaagatcgtagccatttttctgaagtatgtgaagggccattcacatgaagaacccccccccccccccaagcccacacatcccctgagcattctaggagagtgcatagctatgctgtaataaaatcaaggaaaaatctcggtactcctgacctgaccatagaggcacatgacgacaaaaaatagagtaaatcatatctatttttgcagggacgtttatagcttccatgcgcaagaatataatgcataaaaattggagggctgcagg

SEQ ID NO: 42585 - DNA, 8583 bp, Oryza sativa
  unsure (1)..(8583): unsure at all n locations
ttcctgcagcccaaacttcaatttaactttgcctcaactcaagtgcaattgcagtatgtcatgcaaacatcaccaaagattgccatgcaaatatcaccgaaaactgatctaataccaacatctgttgagctttaatttgatttaggtcatattaaataaatttgaggtgaagtaatgaatatcattggcagaaaaaaaaacaatctaaagaccatcaacaattatactatgatccctacattacatatcccacgaacatttgtctgatttttttgtgtgcagggactgaatgagcatctgtgtgacatttttttaaggagaatcacacattggcagaatgtaattagagaaatcttataaagtaacgaactaaccagcaggctagggctgcaaacaccacgacggggtgggttggtgtggggaagggggagcctgaatcttccactgttacagagttgcaggcattttagcaagcatacagatggctaacatcacggctgaaccataccacaaataggggaggaaaatcagtgtaggaacactgtgcaaatcaatttacaagcattgaatggtgcctgcgtttgcagtgcaaattagattcggagaaatacttgctcccacgctgtggacgggaggtcgaggggaacttgggcgccgatggagttgttagctagccaacagcagcgccccccccccccannnnnnnnacagcttggggccaataggatttctatgccacagccaacggaaactacatccgataggagcccaccggccgatggctgccactatcgccaatgggagctggcggcgccgccgatagaagctctgcacatatgtaggtttcattgatcatgaggccagcattatattccaaacagtaaaaaaacaggcttagagcaagttcaatagtatagccaactactagctccaattcatctatagccaatctaatagctcattcatacaatagttacatactacactattaatacctgatcccacctgtcatacacacactgtgtcttggagtccgtgttgcagctggctacaaatctgtagcccgctacccttctctctccttatttatctacttaaaatatgtttgcagctggcttatagtctgttattgtacctgctcttagaaagtagtataaccattcaaagccccacgattgttgtaggattaacaaaattaacaaacagcaggtgctattgcaatgctgcagttccattgagttgtatcagctttgcacactattggccgaaatttttcaatttgtaatttcagaagaacaggggctacccattaaaaccagtattggtctatcggatgaaaatagccaataggcatgcagaaaacatggttaaaaacaaaatgaaggtggaaagattttgttcctgtaaatctgatgaaaaattcaaaagcaaactaatgagagttaaaataaatgattctgaacttaactctgaaaagagcttagaaaagttgatgatattcgcaacatcatattccttttgaataaataatatgaactccaagcaactattatctacgtttatgccatcgattaaagacactttccattaggagatagatatattagttgcacattttgtagaactcatgaatatttggaggtactctccatgcattggttatgtatttgtgtatttctggtgatgacctgaatttgtttcagattacaccaaactctcaatatattttgaggatgaattatgaatacactcagaggtctttcttggaaggaagattactgtgatctcactaagaacaacaataatagtgcagtatacacatatcagttatcaatgttgataattcaaaacaacaatgcaaactttttggtgggtcaaaatgtgcgagcagatcatgtgaaaatgtgcatatattctgttcggtttcagaatatgcgaaggacgaaatggactaggaagagggaggctttatcgacggcctggacgaaatggattaatataatattttaatcaactttccaatataactttttataaaatacgtaccgtttactagttgtgatctcactttgaacaacaataatagtgcagtatacacatatcagttatcaatgttgataattcaaaacaacaatgcaaactttttggtcggtcaaaatgtgcaagcagagcatgtgaaaatgtgcatatattctgttcggtttcagaatatgcgaaggacgaaatggactaggaagagggaggctttactgacggcccggacgaaatggattaatatgctattttaatcaacttttcgatataactttttataaaatacgtaccgtttagggcccctttaatttgtaagaaaaatgtaggaaatttgaaggacttcaattctatgaaaaaaattcctatgaaagcctttgaaacaaaggattaggattgaatcctatactatcttttaaaattcctatggaatgtgtaatcctacagagattttggaggaaagttagcaagaggtccaacctcttggaaaaatttatttgagtctatctctctcatccgattcctgcgtttttcctgtggtccaatcaaacggtcattcttatgtttttcctgtattttcctctattttacatctgcattcctatcagaatcctgtattttttctattcctgcgtttttccatttctgcgattcaaagcggccctcagtagtttggtaaatatgtgtgtgaaaaacgatagagatagttggaaaaggtgagggaagaacaccgcctaaacacaaaatcaggcacacccccatatattttggttgcatctgtcgctcttgctagttgtggtgttaacaactttcgtgcatgtggtgaggggcgtacctgactgtttgacacgaacgaggaacattctctcaaaggtgcttttacctttacctccttcagccagctaggaaaatcgccgacgtgtcaagccggacagcgtccttcctaagccactcgcccccacacaaggagacgcgatatgcaagtgcgtgtatacgatcaaatcaaatgaacagatcagatcacaccggagatgttgttacttgtttcgtggaaggaagaagaagacagtcggaagactgcctcaaacttgaaataaagaagaggataatgtgctggttcggcaagggaacgctgcgccgaggaaaaatgatactcctccgtttcaaaattagtacaattttacaccgtttgtctaatttaattttttttataattagtattttatttattattattattattagataataaaacatgattagtattttatatgattaatttttttatatataaatttttaaataagacggacgacacgtgtaaccacggctaggatggagatagtacttattaacacatggttcccacagatacatttttttcaagtgctacattaacgccatgtggtataaaaactcagtcaaacaaaacacttaggctgtgtttagtttagtgcaaagtttggattttggttgaaattaaagataatgtgactgaaaagttatgtgtgtatgacaagttgatgtgatggaaaaggactgaagtttggatccaaattttggatctaaacacagccttagacgtgttgttagcaacatctaaatcaatccgggttgcaccagtttaaagagatggacttgaatgtggcatttcggttcaagttcaaaagtcagactctgggtaaaatcgagggacgtaaaataaactgcattatctcatcatgtaggttgttaagctctactgaattgattattttgttggtgaaacgaaaatgtgatgttggtcaaagaaagtagagaatctgatgcagatcgacggagcatacgttgcaatgatacaaacaaatatgaagttaacgatggtcgaggttaaaatgtacaatgaaagagtgtagattctaagtacgaactatcttcgatggctgtgaagctatgtatctgtggagctttatatcgaaaacaactccaatcggcaatagcactatagcagaaaaggtgatttcgatggctagaaaaggtaggtttctagtccaatgtggcatgtgctgttcttgctatggacttctccttgccgcaaatgacctcactttctatttcaggccctgcaaaaacagttaatcagacatgaatatttaaggaagacattaaaatttctctattttgctatattcttgcttctaaagttttgtatggactagaatggatcgaaaaaggtagattaagcccaattactttgttttgtcatttacttcaagacccttcactgtacatagaaaacacataataccagggaccaccactgtacataattatggaccagcaagttcgtcactttcaggataatgtaggacaaatataacacagtaggaaaaacagaacaagaaaaaccttgaacagaactaagaaaacagtgacaaatgtgaagattaacggcacagtttttttgaaaaccagagctaattagagctaaaatgtgacatacaggtaaagcaacaatcatagaacatcaaaacagaagattcagcatgatataatcactagacactttaacagacctgtagtaggctgtaccaagttttccaccttccagtcctaccaggcctcccgccttgagagttctcttactgaccctataataccttgcatcaacttcttcatattgaaaatcctcatcagaaaagtcatcacacaacacatcaaaaacactatcaaccagcactccagaactgtactcaaactcatcatcggagctaaaattggtaaaatcatctaccattgctgcaaaagcggtaaaatgtggttaattttcatgcaaccgataataatgtgtaataaaaacagtgaccacattagatagccataatctacagtgttttctgtttacaggcagacaggctccttcaattaatcataagaagtcaacataagaccacacaatcaaaaccaattagacaacaaaatactattacacctcccaaatgtaatttatcataggaatagagctacaacagcaagcaaccgtggtattaaacactcacaatgttacaacccattaattataaggtgtccaagtaaataagaaataaaaaattaaacagggtgttaataagaaatgtcttactaagccaacataaaattaaacaggctggcctcagaaggtaccttgagaacgctgcgatgcagctttagaaacaagtggccgtaagtgcgcaagcctataaacttcacggtcaaagtcctcatcagaattgttggagaccaaccttagcacagacgagtatctgcattgttcaaaaatctagagctgattacaactttaatgaaaccacattgttcaaatatatagagctgattaaacattaatgaaaactaccagacacctatgaggctacaaaagtgaacaaaacaaacaagataatggatttaacaaaacacgtcactacagtcagcaaaggaacacaaatcatccggtaagggaaattaggccaacatttcatcactccttaaatatgttctatgcaccaacaggttacatgataatgcactcatcacatgcaacaacagaaacactccctccattcaatccactcaacaaacaagaaacaggggaagctaacataaggtcaaccaagaattgctcagaaccaactacacattggaaaaatctaagcatcaataagcagaacaatcaactaggttcaataagggattcaaatagctatggcttgagaacagggcaagatcatatcaatctcttgaaaaaaaaaggagaaacagcacaacgaatcaactatacgtcacatccacctaacaatacaagattcccccaattgtgtggcaggggatcagatccgaatagacaatcacatgatcaatagctgcacaacgaattaacaagtatacgccaaatccacctaacaacaagatacaccaatcatagcaggggatcagatccgcataggtaatcacttgatcaatagcagcacaacgaattaacaagtgaacgtcaaaacaacctaacaagaagaatcaccaggggatcagatccgaatagacgaagaaatggcaaaaatataacatacgaagggcgtgccgctggcgcaacaggtgagggcgcctctggagaaggagccgcaggtgagggcgccttggaagaaggagccgccgttgcggtcgccttgggagcgggaccagccggtgcagtcgccttgggagcgggacccgccgctgcgggcgccttgcgagcgggaccagccggtgcggtcgccttgggagcgggacccgccgcagcgggcgccttgggagcgggagccgccggcgactgagacatcacgccgatcggggaggtggccgtggcctaggcggtggcggtggcggcgcaagtgctcggcgaaatcgtgattttggcggagaagaagagatcggagaggctgtatcgctcatttataccagcgtgtcgaggataatgtgctgcggctaaatgttcgtgtttcgcaaggaaatccggcaccagcacgttgaggctaatggtctgtgtccaattgttcgtgttttggaacatccagtaatttttatggttctgatcgggctagtgggccagaaatgtgagaggtagaaataatcgaatttcatcaaaaaaaaggccatccgaatcacagaagtgagaaaaccaggagtactttttagctaaaacacagaggggaaatgcgccgtgagggatgtgtcgaaacaatactgctgctactaaatggtacggaagaatcgtaagagtaaaaagaattgaagaaaacgttcgaaaaaactaataggctggaagacattaaaacacaaatggaattaaccaaaggataaaacatcgacaaagaaaaacaaacataaacaaaaaaaaggtaagacaatgatgaaaatattttaccggttgttagatcccagatctgaagaaacgacccgtcacgaacccacggatccgacgggaccggacggatccaacggctggcggaccggatcaaatcaaacagcttgacaagaataccggggcgccgccagtggctggattggtagactcgggccttcgccgcacaagccaacccagccaggagaacgattgctgctacggccggcggcgtgggacacggccaccgttgatgcaggccacagatagcatgtcgccaagacacaccatgggaggtggccgccgtcgtaaatcaaccggtcacacatgcgcctgcctcagtcgtcgcagtcagaggccaggctcaagctggcaccatggaacggctgtagagaccaacaccgtccctcgactgtacaggccggccaaagagactcctccggcgaggccaggtacgaggccatatgtcagagacctcgccaagggctaaagccggcaacttgccggccggctgcagagaccaaggccagacgtccctccactatagaggacggccacagagacatccctgccgagaccaaggccgtcctctgcagtcacagatacatcaccgccggcgaggcagggtgaggaggccataggtcggcagcaggcgccgaaaccaggccgccggcgaccggcgagagaagttcctgtatgagattgggtgggagacaaatgaatgagatggaaagaggcggccaaggggtggagaggaaaccccccctcttgttatatagcggtgagatcccacgcgggcggagaaacctaggttcacacgaaaagcctgccactacctttacgcgtcaacaggaccctacctgtcatcctgcgtcagagtaaaaaacgggtggccattcaaacctttccaattttgcgccgtcgaaagaggtgcgatgctaaccgcaccgcccggtgacgggacgcctccgcaaccaccagtcgacacgcaattaactaccccaccacataacgcctcccccacacagggtcaccgtgcagtggggccacgagcgctaaagataaacgtggtggggcccgcttgggagggtggtggggaaagcgaaaacgagagatctgggaactctacaccacccacccgacacgggaatcccacctgcgtttatcttttcagttttttattagtagatttttatttatgtagtagtacttctctctgacgctctggtcctagctgtcaattgagagcaagtttaattcggaccactagcttcaaattatctatagtcaatttaataactaatttatacaatagttacatattacactattgataattagtctcaccagtcctacacacattacgtcttgaagtccatgctacagctgactataaatctgtagcctgatatttttctctctcctcttttatctctttaaaatatgtttattgctggtttatagcttgctactcttgctatggtagatgctgtgaaacatagtacttctacagtaataaaaaaaaaggagccccccgagactggctcacacagccagctgcagatggaccaatcagctgtagtagtaaaaaaaatttaactcgccgcggtgaaacggacgggtcggttgggttgtcacttgtcgcgccttttgaacctttg

SEQ ID NO: 42586 - DNA, 13913 bp, Oryza sativa
gcccccccccccctccctcgaatttttttttgttttatttgtttgatatttttttcacgcttagggacacacaagaaccaaccatagaaaaattgaactcaaatgaacgtaatatgtgacctatagaatttttcctctcctctcctctctctccgaactagtgcaaaggggagatgtacaacttttttatttttattttatttttttgatattttttcacacttaggaactcacaggaaccaaccatgtaaaaaataaactcaaacggacgaaatatgtggcatgtgaaattttccaaagctctaccgaaaaacttctctcctcgaaaacacaatcttgcaagcggaatttggaggttttaatatcgccgaacccggcaaagctagggagaattggatgtaactttttctgtagatgtccgtgcatatattatttgcctgattccgagtccgtatgagaaagttacgcctattttaatagatgacatattttgtccgtttcggtagagttttggaaaattctacaagtcacatattttgtccgtttgagtttattttttatacggttggttcctatgttctcctaagtgtgaaaaaaatatcaaaaaaataaaataaaaataaaaaaattgcatctctatgtactgtttaacttatatatgtcatttcatgtggttatattttgaattagattaagtaatttcatatagtggtagagtgcattatgtttaacatgctgatcaaagggttttactaaagaaattatggtctaattttagtgaaggtgcaaagtagactaagtggtatgctagctattttcagacttagctaagtggtagttcgagtttaaattttttttgtggttggttgtatcgtgatcctgagtgtgaaaaaaatccgaaaaaataaaataaaaatgacaccgttgcaactccatacagaaaaacagaaatggaggcggcagcgcagccatgctggcgccctcctcccttgggcggcgccagcatggctggcgccctcctcctgccacatcggttcgcgtgcgccacggtggcagaaggacggcgcctctcgttggatgacggcgccagccactctagcaccccaaaaagaaccatttctgggataagttttttcaggagtctatttgcgaaataaatttttcaaaatgaccaaaatgtgaaaaatccagtcaccttccccactttgaaaaaagaggagtagtagcttgctgattggtgttttacatttaggtaaaaaaaataaaaatcgttgattatgccgatcttctactgctgcctaatttgggtacattgttttaagaaaaaaattaaggcgcctgcttggctgtgttttgacacgtcgttgttgcctagctagcctgtctcccatgtgtgtcgccgacgtgttggacccacccgcatttacggacccacatgggtaacgtgaggccgtgataaactgggcaccacaaaggcacaaaccgaccggaccaaacaaatgtgactcgcacggtcgcaccacaaaccgaccggaccacaaaatgtggcccgcacggtcgcaccacaaaccgacggattcgcctcctcctcccccgtccgagagttgtggttggattggaccgaaggaccaaacacgatcaagcacggtatacatttttttttgtgcgaatttattccctcacgacttttttagtgaatgaccaccctgtcatatatgtttccatgagacactgtacgctcgtggacaacgctgcgaccgatagaagttcttcagctcgatgcctcgatacctctctaacacgtgaatgctatattttcatagtatattggtagtgttatttattttcatacaccaaatgtttccatgcttaattgctgatattaaaagttgccaggttctgaaaatcacgtcacacccaattatcgatttccatatgtgctaactccatacgagtaaatcccaattactcgtatcgatttccttatgtgctccagctgtagtatatacttccaaagttccaaattgaggctaggctggacccaaatactagtataaggaaaaagaaagcagtatttatatttttccttatttttctattttttttcctttctagggagatccagccaattcttctggcaccgtttctcttagctgtagctgtaggattgtcttgacacgtccttgtttcctagcccgcgcccatttgttccaccgacgagtgggacccacccgccattagttggaacaatatgggtaaggcaccacacccacaaacgggacccacacgtaacccggtgaagtgtgttcacgctttttgacacttcaagatgatacttcttcggtctcaaaataaacaactcctacaccttcttactattagagcaagtttataatagtgcagtcaattatttgttttaaatcatttataatcaattttcatataatcgtttcatataaacatatactccctcctttcaaaagtctaaatcatattcgtagttagtcactatgtgctatattattttttttatcggaaccaaaaaattattttagtacttattggttacatgtttattggttttggattaataagttaattacacattagtcttggtgaaaaagaaacaggactaaacttttggaaggagggagtactacacaatcaaactacgtgtcatacacacatgcatgttagagtccgtgctgcagttggatacaaatctgtagcacattgatcttctctctcatctcttatctcctcgaaatgtgtttatggctggtttatagtctgctattgcacctgctcttacctacccccaatatgcaaattgagaaattttattactccactaccctcacttagccatcaaccaatataattttcacattaattaaggatgcagtggtctatccttaccggtaattgtgcacggcacaatgcacgtttcccacgttagctatcgtaatcacataaaaacacttaaattttgttgcattttcctgtataatatgtcacgcgaaatatacaaatatactaaaattttaagaactatatgtactatgggagaatttactatttgccactttaccaaaataccagtgctcaaatgattgcttaaattaataaatgaacaagatgtgtggcaagacttattggaaaggaaaaatcttaatagtaaatcaataactcatgtagagagaaaacaaggggattcccatttttatctggcctgatgaaggtaaatagttacttctaaatatgggttctattccgcttaatgtttctttcaggagagctttagttggtcagaatttggtcaattggcataatttgtgtggttcagttgtgcatattaatttaacagagaaggatgatatatttagatggaattttcataaaattggtcactattctgtaagatcattgtatttagccttgattaataatgggtatatagaaagaaatagatcatttggaagcttaagatgccccttaagattaagatttttatgtgtatctccttaaaggaattgtgttgataaaagataatttggctaagagaaattcaaatggtagtttgagatgttgtttttttatgaaagaaccttatgaaaggtgaaacctaaactgaaacataaatgagccacatcatccaataaatattagccattggattcatgaaaaacaaaagagggtgaatgaatcaagaccgttggattagatggatgataaaaaaaatattcaaataggttttcggaagctactagaagaggaaaaaaaggaaaaatgaaagagagccaggaaataagtaaaggaagataaaagattacatatatatttttacgatctgcacctatagcaaattattttttcaaatgagcccttcatcttttaggtaagattaattggtagggattgaaggtagggattgaactattaagagcatattcaaaatgtatactcgtatgataaatttagtttctataagttaattgttaatatgtttgataagaaaaatgctactgggacatacatattccttccaatgagaggtcattatctcccaaatatagatttaatgattttcacactgatttaaaacaaaacaaaattattccttataaacagacaaaatatatgtacgtaggctacataaagggtgaacaccaaagtcgaataaggggatgatagagggggtcatgtaacgatgaaaacaactataggatgagatgtaaagtttacaataaataggaagtcatttattatatcagcataatatcactcatcccacccatattcttttacgagcaacgagaagcccaagagagatggcttgccactctaatgtaccatgttacaggattttagagtccggcgaacgcgcgacatgatgtgctagttttttatgaaaaacggaacatttttccatcttttcctatattgtcatttttctagatttctttggagatcaattcaattctcatttgaattatacccaccacatagtatttctcatatgtttgagaattggctggtgggagttaataaaaaaattaagaaacttattcttgtatgggctttcaccgtatgttagactatttggcttagtaaaaatgatacagtttatgataaaacaccaacaaaatattatttgcaagtacttttcaaggcaacggggatgggctcaactacaaaggtatgataatgatatcaagctaataaatgatgcatgtcgtaaacccgagtcgataattatgcacctttttaccaactttggatggagattctcgaatagaattcataaattcagggttcttttatcttgtgtggttgggcccaactacaaaggcatgatgatgatatcaagctaataaatgatgaatgtcgtaaatttgagtcgacgattatgcaaatcgggattctcgaatagaattcagcaatttagggtctttttatcttgcgtttgtgttttctttacagtgtgtgctaagtttgtttatgtgtggactttataataattggttgtagctcgttagcaaaggtcgaaatgttactccattatcttcttataaaaggaaaaaaatacgaattaccccctaaactatcgtggtcgaccaaaatagccccttgaactcaaaaaccagacatcgctcaccttgaatttttaataccagacaacaccccctagtactattgcaagcggtttagggttcaaatagcacatgtggcagtccagtcatccttttttttaaaaaaaaaatcgctaggacccacttgtcagaatccccacccacctctttcttttccatccccttttgaagcgtgcgacggccggggagagggcgtgacgctaccggcactcttctccctcctcttctgaagcgcgcggcggcggggggagacggggtgacacagtagggtgcgtgcgatcggcggcggcatggaggcagaggtgagggcagcgcgtgccggtagcggcatggaagcggatgtgagggttgtgtggcaagcacacagaggacacggcgacagtcggagtgctgctaaatctatcgtctatctttcttccctttggtgcgcagtgagattggggagggcgcgttgcgacggggccagaggggtagcgccgtcagcgagggcgtcgggaaggagaggagattggagcggaggcggcggtgacagcgatggagcgggtggcggaggagcaaccgggcgcggggatgtaacaccctgaaaattcgacgacaaaaatctaaactctaaaaatacggattttcaaaaactttttaaattaattgcatcatgccgatcttattcgcctattttatttgaatttgatctcgaagtttattaatcgtgagtaaagattagttgtggataggaataaataaagtattatcgcgaccatatttggatcaattaaatttaaatatgatggaataagaattaaccctaattaaaaattcaaataaattatataaaaataaaatatgagtaatattaatctagggtgaattcattagttgagataacacaaatattgagtaaaatgcatatatccaaaaattaggaattgtggaatcaaatttatatgggaaatacactaaaatcgggataaataggaaaagccactattcattgccccctaggtgttcggtcgcgttccctagccctagcccctcctctgccgcgttgccctcgcgccccgcacgccgcgcgccgctccgcctcccctctgccgtcgccgtcgccatcaccgcgcgtgccgccgtcgcctcgccgcccgcccgtcgccatcgccgcctgccgccgcgctgacatcaccgagccgccccgagcccgcgccgacatcgccacccccgtgccgcgcgtgctgccgtcccgttgccgcgttgcctcgagccccgcgccgccgtcccttcgccgagtcgccgcccgtcaccgtcaagcccgcgccgcgccgtcctatcgttgctgtcacgccgtgccgtcgtgtcgccgcccatcgcatcccgccccgagccgcgcgccaccgctgtcgccgtcgccatcgacgtcccgtcgccgcgcgcgtcccatcgccgctgccgcgccgcgcgccgtctcgtcgcctcgcgccgcgagcccgccgcctcgcgccccgcgccgccgcgccgccgtcgtttcacccctccccctccttcccctctctttcttcccctctcccctataaagaccccggcccaatcccccccttctccaccccactccattccctcctcttctccctcttccccttctccacgcgccgccgtcgtcgcgccgccgcgccgccgttgtcgtgccgccgcgccgccaccttcgaagccgccgcgccgtcgccccggagccgccgcgccgtgcgtcgtcgccttgcgctgccgtcgccgtcgtcgccgccaccgccgccgccggtgagccgtcttccccccctcacctcgcgcccaccgccgtcgccgcccggggaagcaaagagccgagagagagagagatatagaaagaagccgggagggagcagagaaaaagaaaagagaggaaaggaggaaggagccgggaggagagaaagaaaagaaaagagaaaagagagaaaaagaaagagaggagagaaaaagagggaaaatagaaaagaagaaaaggagaaaatagaagggaaatttggggagaaattaggaggatttaggaaataaaaatggtcggggttaatcgtagattatttttggaaattcctcgagcgtaatagtatttcggtcgaaattccgagttaattataaaaatatgtttcttgatcagattagattaaaattagtagtaatttagatataattaataactaaacaattagatgaattcttatagattattatagattatttttggtaatctctaaaagtcatcggttcacggtagaaattcggatttaattactagggattttagccgtgtattatatttaatcatttagtcatagactaaattaaatcatataatatttctaggatttcgtccgatatttagctcgcgatagaaatctctaacctattatatggatataatgctcgggtagattaaattaaaaacttatgacaacaaaatatttatacccgcaaaatagtttaagtcgaaattgggtttgccgtagttcgcagatagtaaagtttataaaaaggaatcgactttcacattcgactttcatttggatttatttggatttttatttgaattctaaccgaattcaaatcaatttttgcacgtaactatagagcccgagggagttgcggatccaagcgaaggcaagacccgcaagactctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaataactgttttcgactggggcggacggaggatttgggtggtatctggaaaaggctagtaccgtccccggtcaattaaggaccgagccatgaagttaagcatgaaacaacccccgtacaaccgcacttctcgtatgggtatagacctagcggattagatagccgagcggaggcagtatccctgcatagatggttcacccctgagtgaggcaggtgcgctacgatgggacagccgttgaggtagggccgagaagcgtgccctacatcggtgtcgccattggtaggactgccatgagtgtgtgagagagagaacttaacttgaaccataatttaatatgcgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcgggaacgtggacgtcctcagaaaaccataacgactcaatggcgggaagctatccttgggatcacaatggatggtggacagaaccgtcattgtttaatatgaacactggtattaaaacttgatcagtctatgctaggtcttaggcttgtgaaaagaattacaaaacttgctttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccgatgatttaagactacgcctgcggggttatgatgtaataattcgtattagacactcgtgtatgtgcacttggtatttcagctatgaattcgtgtgtaccagactacttgatctagggaaattgtactgtttacacaattgattcctgttataaaaacgggggtccacaggggacgacggggatgggcgacaaacttgttaccgtagcctgccgcctccaatgtcctcggtgccgcccgtctcaccctcttcaccgcgcgcgcctcgccttccccgtggaggactcgtcgaccaccgcctgcctgagctgagaagagatagagagagagggggggggggaagagggaggcctcactgccgtctccagggaagggagcatcagcggcgccgactagtgacgtcgacaatgaaccactcgtctcctcttgtgcttgttgctccgagtcctcgtctttgcatggatacaggaaagaggagtcgggagagagagagaaagagggaggcgacgcgtgccgacggcgctcacccgtgaccccgagatacctcagcctttccgctaaccacgccgccctcacctccgtggtcactggcctctacagccaccccgccgcatcacccctctcccccacccccgccatggctaccttctcgtgtaagtctggcgtcatccgccgctcccccgaccacaggaggacaaggcatatggtgagctcgacatgccagccatagcccgcgcgcgtgccgctcgttcttagcggcgagcgagcaacgggcgagagagatagaggtgagaggggatagagaggagagcgactatgacaggtaggcccaacattttttaaaataaaaaaatactaactggattgccacgtagggccaaaaccactccgatgttgagttagggggtgttttttcctgtattgaaagtttagggtgagcgatatctgcttttcaagttaaaggggtaattcggttcactgcgatagttcaaccagtaattcatactttttccaaaagaaaaaaaaaacaaacaactttcaggcgtttcccttccttcctgacgagtttttggtgttcgtcttccctcccgcgcccgcgccttctcgctcgcgcgcccgcggggacgcggcggctagggcgatgcagctggtggacgacgccgacggggccctcgactcgtgggcccgcttctgcgacctctccgacgagctcttcggcggcgccggcgacctctcggcgggcccgcgcctggcccccgtcgtcgcggacctctgcgcccgcggcctcgccgagctgcttcgggaccaattcatccgctccctagaggtgacgcaacccccacgcttctctacccacactcacctgctgcgtgttgctcccgccgcgcggagtattggggggctttctgcattgcacggttttggggactcggatcgcgctgcgcgctgagtgtttgtgagaatgcctgccccgaatttgagacggtgtagcagtagcagagggggtatggacttgggctcaaagaccctttcgtgtgtgcttggccatagacagtcaaggttgaactaggccacactatggaaacatggggtagacgggtagtaggactagtttgctttcgctgaaacaattgtcaggacatcacttctttcatcccttcaggtttgtggtgaacccttttatttatctgtgacgtagttaaaaaggagggaagagatggccacaatgcacagggtggctgtttcctgtttgtcagacaggcagagccccctgcaatttaggggagagtatctatgtgctagagtgtctacaatacttgttttagttttatttgagcattgaaaattgacagaatgcctcaggttttcaggttggtttgaaattgtaatggcttaggatttgcacttaacttttttcactccttacattttagttgaattagctcttatgcaaacatataagaggatcctagtctaaaagatgccatattatctgttgcaagtctgctggctgtttaaaattctatacccttgctcgtatttatggaatgctatgcaaagctttttattcttactctttctctattcaacctgtccttattaatgcagggaatatttagaagcaacgcggttaagaagttctggcagcagtttcatccttattgcaattcctctgcagtggaaagaattaaattctgtgtgagttacagaatagttaattatttgttcatccatacgtttgtttcagggtagaaaatttatgttgcagaaatgacatcttgcctgcttcatattctgattgtctttcttgcatacccaggatgtgatatctttcatatgttgtatcaagaaatgaaatggcattctttgtattgaaagatgaaaccataaaaccatcccagccatgcaaatattttaaagatactttcaccagtttgtcaatactgctgtatcataatttgaaactagtgaataaagtgtatattagtaatcatcttacctaatttcggtcttttaacattttacaacagcataatttctctaaccatgaatttcaggttcaagaaaactggcctgaggatatcttaagtaaagcattggaagacatatgtttggaaaagaattaccaggaaaagtgtgttctggctctagttcattctttacaatcttatgaggataggtcaccacacagaaaatctaaagcactggattgtagttccagcttaatgcctaggtaccagttaatggtatcttcagtacttctgacaacactaccattgagttttcctggttagtatctttttcaccactgttttactgtatgaaaaggcttgagtttgacactgagccaattctgaaatgtttaccatgacttccatttctgaaccttgcggagtggtttgtgtttctctagattattctttagaatcatgaaggatagggtgcatggcaacacaaacaatgttatattttcagtttgttttctaggcatcagttttctaggcctcacaatgatctttagaccagttatgactaaactggagtgttgtgttatctcctatgcgttaattcttccaagactcatgtggccttttcataaagagggaaagatttattactagtattaaatcttatagagccgcagattgatgcaaattacccaactgcctttacttttttggcacttttggatgggatatttatggtttccaaactttgttctctgtatctttgctcctttggtcctgccatctgggggccatatgaataatcactcattgttaggacaataagttagaatatggatgaaactgcaaattggatcttgtattggcaatttggattgattttattagcctctgcagaaaaggtcataaccattggaaagcattcaacaatccaaaattttttctattcatgtagcatgcatacccatcttccacattatagttgggttgcggccgtccttttttttgttttttgtttaaggttactttacagggtttcttggattgatggaatcatggacagatctcctattctcctccctctgataaaatcagttacaatatcctcttttagctgccagagcacagcatgcttgttgcacacccactgacacagttagttcaggaatattgcacatgaaacattctacagttactaattaatccaaatagaagctattgtttttaacaaatacattttcctgaaattataatattggtgacttgtttttttttctacttgatctgtagagatattaaatgtatacttcaagaagaaactggaagagttaaatatcatgatggctggattggatgggagcgatccatttgataatcatgatctttttgaaaggaacagtacctctgcttggcattctgaaatggacattgatggtcaagaacctgggatttctgaaagtagaaatttggttaagaacattggaaaagttgttcgtgatctaagatatcttggttttacatcaatgactgaggactcatactcttctgcaataatctggcttttaaaggtccaggctcacttctttaccttaagtacctagtgtataccacatatattattttggcatggacaatcttgaatttctgcctgtatccttatctgaactctcaattctcatattgcagtctaaagttcatgaactagctggtgatgattatagaattcctgtacttgggtgtgtcaaaaagtggattcaggtaacctttcttatcctcattcagtcatttattcagaaacatctccctgtccgtcaaatttgttctgtgtttctagcttcatattatacccgcttaagtagttgggtcttgtaaggataaattattctctgcaggtttagccttttttccctcgcacatatttgaattgaaataagacttagtgttaatgtaatagagctgtcacatcagtgcatctatcatgagctagtgcgccttaagaatattaatttttgtctcattgttctttcaattacttaatacctcttttgaatcagttctgtaagtccattgtatttagtgtaacatgatatctactatgcccttaattccat

SEQ ID NO: 42587 - DNA, 23729 bp, Oryza sativa
aaggaggtctatatagcatgatataatttatttagttattgctttttttcgtcatctctttttgtgaccagtgaataatttgttgctcttgaaccaaacatctgcatttcttttcatgtgccacaccatgtcttttccatgttaaggtctaaccaaatatgttcacacttcacacggccatctcaaacagaagagtttgcttatgatatttcttttatgttgcattaatttagttttattctttatgatgtatgtgttcttaactggagcacagtttttaatctggaaatttttgggtattgatgaagctctcctgccattgaagacctaaaacagtgtttggagtacacgggtcaacattctaaacttgttgactcatttatctcatcattgagatatcgcttgctgacggctggtgcatcaaccaatgatatattacaccagtacgtgtccactatcaaggcattacgtacaattgatcccactggtgtcttcttggaagcagtaggtgaaccaattagagattacctgagaggtagaaaggacactatcaaatgcatagtaacaatgctcactgatggatctggaggaaacgcgaacggaactggaaatgctggggacaatcttctggaagaattgaatagagatgctgaaaaccaggaaaatgttgattatgatgaccatacgaacattgatgagaagcaagcatggctaaatgctgaaaggtatatttgctctctgtttcttgaactattaagaaataattgctcctttaataagtacatcaataaaactgctgtcattgtgattccaacttttacagctgggaacctgatcctgtggaagcagacccattaaagggcagcaggaatagaaggaaaattgatattcttggacttattgtcagtataattgggtcaaaggaccagctagtcaatgaatatcgtgtaatgctggcagaaaaactgctcaataaatctgattttgatattgattcagatatccgcacgctggaactgcttaaggttggactgttacttttgtgattgtcttcttagctatgccttttctatgtatttgattgaattgcatatgatgctattccttagttgttatctctattttttttaatgatgctgttgttttggcagattcattttggggagagcagcatgcagaagtgtgagattatgcttaatgacttgattgactcaaagagaaccaactcaaatattaaaacatctttatcaaagacatctcaaactggtactgcttaaactgcgagtgcttgtaccaaacagatcaaatgttacagcgtttgcatttaaactctcttcttttttgtcagtaggaactgtgcaagaggagacagaattgtctcatgaggttcttgacgcaactataatatcctccaatttctggccaccaattcaggtatggtacaaagcttttatcgaaaccatcatggtaactgttgagctaaattagtgtcatctgtcatgtcttcccttttcttattttctgctggggcgtggggagacctatgactaaaatagtcttcagttctcatactaatatttcatatggtaaggagatgttgattcacagctattgtaaattggaaatctctaatcatgttgaacttgttgctcaaccaagaatcatgcggtcaattactgatgttcgatctttactgtttatttcacttgaccttagtacgacaatctgtctagattcactaaacctctcaaaacaaatgtagacagaagacctcacagttcctgcttcagttgatcagttgctgtctgattatgcaaaaaggtttcatcagataaaaacaccacgcaagctactctggaagaaaaatcttggaactgtcaaggttggtatgaaactttaaactgaatgtgtagctacaaggaatcattcctttttaagaatttcttttattttcccagctggaactgcaattcgaggataggagtatgcagtttactgtagctcctgtccatgctgcaatcataatgcaatttcaagagaaaccaaggtaataaaactaccatgctgcacatggctcttatttactcttaattgaggtcatcaattttttttcagttggacttcaaagaccctagctacagcaatcggagtacctgtggactctcttaacagaaagataagtttctggacaagcaaggtgtggcaaatacataatactcgtacttagcatgctgcatttttgttagtaccttatgaattctttagtatccgaccaaatcactgtagcacattcatgcttggtgctcctaacaattatgatggaccatcaatcgtttttattgtgattttttcagtgtgaattctttagacttatgatcagatgggctagacagttaacacttcatatcatctatatttgagtttgcatgaaacatataagttgtggttaatataattggtaaacagaaatggatgtaggatatctttaaacatgatttaggctccatgacatctgtaaggcgttcctgaagagaacctctcaaatttagtatgattaaaccaacttatgatttaaacctaatttcatgctatatcgtagggcgtcctgacagaatcagttggtccagatgcggatgaccccacatttactgttgttgatagcacatctgattttaacaaaaacagcaccgtgaaccaactctctgaaaggtttcaaattactgaagaggaaggtgaaagttcgattgcgtctgttgaggaacaacttaggaaagagatgacagtttatgaggtttgtttcttgagatctcaagaatgtgttgaaaagaagatgccttcgttagttatgtcatttatcagttctccctacaccaaccaagtaatcattcatttgactccattcgctgtactgcagaaattcatcatcgggatgctaaccaattttggaagcatgacactggaccggatacacaacactctcaaggcaagataaatgggacactgtccattcatcctctctctatattaatcttttaacccattcgttaatttcatccaaaattgcttgtttcagatgttctgcatagccgagccatcatatgataaatcactgcagcaattgcagagttttctttctggtctagtgtcagacgaaaagctggagatgagggatggatcatacttgctaaggaagtaggagttacatggattagcctgttcatctgttagactagatatggaaggtaatcaactagtcacaccatcatcatctgatggttacactatgaccatccggttcctaaaatgtactccattttactcttcttgttgcaggaactgaagaatggaggccccatcctgcgccattcacctcactgcgtgcagtaatattctgcactcgctgttttgttccttgctgaggggatgacgaaagtagagaagcacaggaatcctaaagcttttgaatgttgttattgtgcgtatattgcactgttgacgcttgacgacgctctcaacgcgttcggttgttttccgacgtggataaatgcatatcttttcggtctgtaaatgacagaaagaaattcaaccagacttcttggcattaaatggcaggggcaatggccggaatgccttttggctactggcacccttcggtgtcagcttacttatcactcgtggccgtgggttcgtcaacacgtgcgtgcattattcaagtgtggccgtgcttacacttgacaagttgacatgttaaaaacagtcatctctgaaaaaaaattatgatgttcaatgatctaatgtgatgttgcagtgaaaactgaacatgaatttggcatgtccggcgaggagtttggatgagatggctattcttttctctattataaatgcagcttcaaaacatgtagtgagatgtatgtaatcaaatgttatgtttactcattttttgaaaggaggtgtgtttactcattcatataaaaaaaaagttacactggtgtacaaaacccatactacagtgacaatgctgctggagtacaagcatccataaatagaagttattagaccagacatttgaccatgtaaggcccctcaagttcataacccagtttacggtagtagtggcgagtccccactcctgatataacagcgattttctttgaacgatgctccttgcgagcaattctttctgcttcttccatcaaaagagtaccataaccctgtcgatgttgagtcaaaaaaaaatcagaaatgtaatttatatttctggacaatcaagttaggaagtatatctataggcatgtaccaattgcaagtcaaaacaggagaaataatcaccatttatagagcaacactacatttcctctaatgataagaaattggataatatgtgacaatataccataccagaatgccatactattgagaagtttagacactaagcttgatttaaaacagtgactacaatttatcaagcgtgccaggatatctaatttgcaagcatagcaaagtcgttggtgctaactgctactaatactgtcatggcaccgatccatttcccaaacatggtatgctaataatatcacatgtactatggtcacctggtgttgtagtttgtctgcatcacgaccatgtacagggactgcagttccatatacatgaagttcacggacaattgaacacctccctactagctcagggcatgtaacattgcggccacattttcgcaatcgcagcagaccaataaggatatcctgtataatttgtaagatggcaaaatgtgagtgctccaaaagattgagagaacataaggccaagcgttgaactctgcagaatagtatcgatctaataattttaaaaataacaaataaatacttcaatggactgctgaaagtctgaaacacataacagtaaaaattcccggaccaagaagataggtgttggtcatataatttcaaacaggcctgctcagacattctgcatattttcaagttccccaaaatcacatgaaatgctggcaaaatatatgtacctgctgtgtatcctcgtatgagagaaaggtctcccagccctcatttgcagcatagtcacgcctaacaagctctacttcgtcaggtctaattttgtgatggatatcctacataaagacaaacaacgaaaataataaggacaaagagctaagttaaattacaagcatgtgagagtgagaggagatgcagtgttccagacctgaattcccgcctcacgagttctaacatctcggcacttcaagcctaaatcttccattcgagccaaagcaagctcacgaagattacctttttcaacaccagaagtaacaagaggcatagggatatctctttgtacacggtaaactcgtgtccaaggtggtaccatggatagaattcttgcaacaatatccaccagaagttcaggtggatagtttcggtatctgaaacacaacaaacattggcagggcctaagttctcactaaaaagttctagagaacaaacacaacagtgaacacaagactagcaatctagaatatcaagtgctagataaaataagtacctgccagttttccagagctcataaaggccagttccacgaatcacaagagttggataaatctttagaccatcagctcggaatgctggattttcaaaaaattctcggaaactttccagatctctttcaactccaacattaggtaaatctggcatcatgtgggcgaccacctatcaaaaggtaatcaatggaggattaaaacagttcaaccatatgagatgatactttattttaacaaatgctgccagcaacaagttgactaaacgagatgattaatgatttaaggagactaccttaaaaccagcatctttagccaaacaaaagcaatcagcaacagcagctacagtgtgacctctgtttgtgtcacgtgcaacatcctcgtatgtgctctgaacaccaatttctaagcgggtacaaccataagatagcatctggcgcaaatgaggccccaagcaataatcaggtctcctgtaattttgaggaaagacaacaatagtttatagaactgaagttaataaagatgtttcatggggaaatcatacagaaccatcaaggaacctaagcatatgggtagtttagattgtcaaatgatcttacgtctcaattgtcatgccaatacatttgactgcaccatgttctgaataacaaacagcctcttcaacattagcagaagtgtgtcccgataaggcatcatgaagatttctaatgaaataatcccgataatcagctggtaatgacatgaaagttccacccatcaatatgaattcgacctgcataatgtattcaaattattttaaacttatgatagcattaatcaaatgtaactagaaagtgaatcgaattactcaaaccaagacacaacactctcaagggtaagggcaaaccttgtctacactatggcctagccttttgagctgatctatcctgcttctggcctgcacatatggattgtacctacaagtagacagatcagaaagttctgaaacccaaagggatgaagcagtcaaaataatggcgacaacttcatggctatatcgcccaacacaatctgttgctatagaactgccagaccaaaagatcactagtgggcattggtgtactttcttgtttcattagctagtgaactttgatcacagtaattaatgagttgtgcatcatttgtactcctctaatgcaagtcttcaatttcgacaaaataactaccccgtggcttgctgacaatcgactaattttcaataaataacagaactctgccttcacttgcagttcagcatacttcaaaacaacactagagaaagcatcgccgtgcagctcatctcacaggtggtatagtatttccaagtgacatcagtagccagtgaggtaaatcaccttgctcgaatggcgcgcatgctggtgggctcgtagccggtgtaggactgggtgctgtactcgaagtcggagtcggggcctccggggcagtacacgcagatgttccccgtggtggcgatgtgggggcaccggtgcggcttcgacatcacggcgaccacggcaatgcccgacgccgtgcgcacgggcttggcgcgcagccttgggagcagcgcggcgcggtcggcctccggcaccgccgcgatcatctccaccagcttcggcgcccgcgccagcccgtacctccggcacgcggccgacttgagcgcgttcaggtccacgtcctcccctcgccgcgagagctcccccatcgccgacacgatctccgcgatggcccgcacccgcgcctcctcctccgacagccccgcggggagcaccactccccctctccccggcgccggcttcctcctgcgcggctgctcgccgccgccgccaccgccggcggcggctacggcggtggccatcggtggaaagggttttgggtctctcggtgagagctcgggatgtagcgtggcgtggcggcgcgggtcggaactcggaaacggaatggggtttggagtttggactcgggtcggtgttgcgctttgcccttgtacacgtgccgtactagatctcggccccccgcacagccgtcggatcgtggtacggacgtctcagataagaccacgtcgctctgcaacgtcgtagtagcctggaaatactctcccgaattaaaaactttggaggacgaaactagccttctctccttctctctcgtgttctctcccaatctcttcttgcggcggaagcaaagcgagaagcgaggcgactcttctccggcggcggcggcggcggaagcggcggcgagatggacggcggcgtaggcgaggaagggaagcagcagccgcacctggtgctggcgcacaagctgttcctgctctcgcacccggacgtggacgacctcgccaaggtcgacctccgcgccgatgtcctcgccgcagtcaaatccgatggtagaaaacctcaaccccccccctccactcgaatcaatggccgtggcagcttccgcttgccgcgtgcttctgactctgtgtgtgtgtgtgtgtgtgtgtgtgtgtgtgtgtgtgtgtgtgtgtgtgtgtgtgtgtgtgtgtgggaatttggcgcttgagttgatttgatttgatttgatctgatcgatgtgcttggcgtcagatatggcgtctctgtacgagtcgctgggggccggcggcgtgctggagacggacgctgcgctgctcgcggagatgcgcggcaggatcgaggaggagatccggaagcttgacgagaagtgagtagatctcgcttgctcaccttttcctgttcgatttgaagtctaggttctagggtttcatagaaatcgtggagttgacgcatctaataccgtgactagatcgctactttcatactcgtatctctagtctgtaattgtccattgttcaatgttagtgcgcttaatttgctttagcacatctgaccatcaattggttagtcctgttttctgtaacagaattatcaattgagatttgtttttctgcattaagggcatgccgagttctgctcatctgaattagagtaatctaatctagccatccagattagaacaaaatgtttagtgatgataaatataaatttgatgatcgcatggacaaaataaatgctgttgaggaagcactttagtttatgccatcataaattttatcaacacttgctgaaaggctcacaatttgtgcttgttatggatagctttccgttcttcttctagcatacatgagttatcattttgcttgagagtactattctgaaatataatcaaagttgttcagttatattcttgttgttaaaaatcgtcctttatccctgaaggatcgctgatgctgaagagaatttgggtgagagtgaagtgcgtgaagcccatctagccaaatcgttgtatttcataagggttggagagaaggtaatgtatcatgtatcttcaacattgttctaggatatcatccacatcacgtagatatgctgtcttaataactgaaatttcaggagaaggcactagaacagcttaaagttactgaaggaaaaactgtagctgttgggcaaaagatggaccttgttttccacactttacagattgggtttttctatatggattttgatctcatctctaagtctattgacaaagccaaaaagtaagtccgaagtctctcatttttgttatttataatgttttgcttgtttttttgttttgcattatgatgtctaatacttcacaaatttgttggctggattgaagattgtttgaggagggtggtgattgggagaggaagaacagattgaaagtgtacgagggcttatactgcatggccactagaaacttcaagaaagctgcaagcttatttttggattcaatttcaacattcacaacctatgagttgttcccctatgatacattcatattctacacagttcttacaagtgttatctcattggatcgtgtatccctaaaggcaaaggtatattcgtctttgcctagtgaggtttgctttattagcttgaatgtccattgaacaaaaatatctttgcaggttgtagatgcacctgagatcctggctgtaattggcaaagtacctcacctctctgagtttctcaactccctctacaattgccagtacaagtcattttttgccgcattctgtgagtaacaaaatcacattattttgcgatgatttttgcattatactctattgagcagtaattctcctacagcttgctattgttgatatctttgaatttcttattcctgattcctatttgttttcagctggcttgacggagcagatcaagttagaccgttacctgcagcctcatttccgttactacatgcgtgaagtccgtactgttgtctattcacaattcctcgagtcctacaagagtgtgacgatggaagcaatggcttctgcatttggtgtgaccgttgatttcatagacctgtaagtgccatcctctatgttctgttgctgtgatcctgtcgtgtcatacgacggcaattgtgctgttcatggccattggttgctaaccttttcttccaatccagggaattgtcacgcttcattgctgctggaaagctccactgcaagatcgataaggttgcttgcgtcctggagacgaaccggcctgatgccagaaatgctttctaccaggcaaccatcaagcaaggggacttcctgctgaaccgcatccagaagctatcacgagtcattgacctgtaggtgttagtgttggagctggtgcttgccaaaactctgctcgagctcccccgcacgagtaacttatttgctttggtcccaggggactacgaacagtacttgacttcgcattcgaagtaggttacgaggaaagagagcttaacaaaatcagcgttaaatctgagaatttgagcttatgtaacctactatatggatcgatgaaagttcagacccgttgtttctagactctcttctgtgatgaattcatccatttatttcatatcggtgatcatttgtgtttccatctcaaatcttcaatctttctgcttggctcctttcgtaactttctttaacaagaacacaagctactgtgcttctaagctgaaccacaaacaggagaactgaggaaggccatagccaacagataaaacaaaaggtatcagaaaatatcatgcatttcatctcagaatatgatagctaacacataacacaacgattgctgccattacagtaagcaacacaactatgtatccgcaacagaaacttaacactgtttattcaactatatgataattctgattaatgtgactacacatagggcaaagctcgcagaaattcttctgtatgtgtacatttttcatcatgcagttctcaggaaaccaaagacatcctacccgcctagaacaagggggaaaccaactcaccaacaaaaaattttcaacactaaaatcacaaaccaagttccagagaatcgcacatggggttaaaggattgcaagactgtaattgctatggtattttctagccagctgcttgactgaatttgccattaggcgtgcccacagggttgttattgtcggatctggggacagccgcttcctctaagcgcttccacaaagcttctcgcttcgaattagattcttcctgcttgagttcatcgtcgttgaacttctgtgtgcactccccgaaaaatgcagaatcatgatctgagaagatcttgcgtacgttcagtgtcaggcttcgaactgcttggttccagtgaccccttgcattcctctcaagcgcaggaaagataatgggtaatatcaccttgtaattctgcttaattaagttctcaatgtggtcattgttccaaagaaacagcgcccgctctgccacctaggaacagacaaggaaaagaaaaggtaagccaggctatatgtttttctaaacacactaatttctcaatatgtttctcagatgtcaccaagtatctaggcatccatctacaggaaatgtttaataaactacaaaaatgcttcagcaaatcacatataactaggcagaaccactggaccaacatgatagacataaaataccattccaagacaacagatggtaccaaggcactgcattattttgctagatagatgagtagcagcttgcaagataaatgttatttacatagcaagatagcaaaaaaagaaaaaaaaagagaaagtaatcctgaatacaagtctaagacctgtttctggcatgatttgcaaccagcagttggcaaatatagataaccaaaactaactaatgacttcaataagacactatgtttcttgtaaaacagacattatactttcctaaagcaggataagaatatgttaaaaacatgcataattaatccaaatacaaaccaaaacaaaaagggcaacaaagagtcgcaccatcttttcatagacatacataattatttgggtggcatgtttcctctttaacctaacaccaccaagttctaattttggtgacttagtatcttggagtagcagtagttctatgttcagataaaattaacagcttgcactcaacaatcagcttccacagtacagaatgtctttctaatcttgtaaaattacagattggcatgcaaattttctttcctttttggaggagcatgtaagattctagaagcaacaagcacctaaatctgcaatcacagattattcaggggacgcacatgggtaggatagcaggatagagataaacaaaaatttcatgcccctataatgatagcaagggtacatatcaattgtaataaggatttcaagcaagattacaaaaatgagtgtagtaaaaatgaataaattggtggtatgtaccgtccagaagattggcatatatatacaaaaaaatgatatgctgatgtttagaatgccctagcattgtaaattttcaaactaacaagtaccaacagaatttcttaagaaaacaaatgctcaagaagtataaaacatcttggtgattttttaaatataattccagattagcatatgtcaaaagcagctccatggttcaccagaaaaggtagatgaacaccaaagcttgatcttttttaaactgatgaagcaaattatataatatcatctgtggaggagagcaatgtggatacacagtaatggaatcagaaacctaagcagcaaactgcatatatcttggactgtgaacaacaaagaggattgaagttgacatggatttgaattttgaaacttgattgttggcatgagagattttacctggaaatgtgagctattcatgctacaggcaatctgacggaagagtggaaccatgcatctttggaattctgcaggctgtgttgcctccagaacctcttctagttcacccaagaacatcacctcctttgaactgtttgtcacaggccaatattttagcaagcccctaataacagtgtcagcaagtttgcagtccttctcaacaaactgtgtgatgcagtatgataattgctgatggtacatagatacacattttggcttgtgaagtgggatcagtgcccggacaaggaacaatttgtgctcttctttaagtggaagagcaaaaccattaattatgctgcccaagatctccagcagctctgcaacaccattatgcttctctgtttcaaatataaacctgtagaaaatattgttgattgctttcctgatgaaggggcggtgcaccatgatttaccatatatgcgatggaggattgtcttcaaataatccctttccctggggtcttccgaatcaaaaagatctagtagcctaaggatgaaggaatgatctatgtatctcttagccagctttgcatctgtctcctgtgatgcgacaaacctcaagaaaacctcataaactatctgtaaatgtgaccatgctgggtccatgagaggctcctcctcctccagatcaactccttcgatggccttgttctctcgaggggtggggctggagctccggaacaagttaatcgacaccatcttggtaatctccgacatgacgacttcagagaacttgccatttgcagaagtgacatagtcaacaagttccataagcgtctgccgcttcgtctccttttccttcagattctttgtcggatccgcgaaatcgtacaccgcgcagcacaggttcaccttcttgacaaacaaattctgcttctccgaggccggcacgtccttgaacgccggcagcggctcgttggagtgatacaccacagtcccattcatcatcggattgggcgtcagcccagccggcaccacgtaatccccatttccactcctcttgttcccttgctccacgctcctggcgacgctgtacgagttagacggctcattgccgttcggcccagcggcgtcccggctatcgccggccttccctggcttcctcggcagccggccaaggatctgcttgatcatcttcttcccccccccccccccaccacagccaaccaaaaaccctagcaatacccaaatcagccgcagcaaccagcagggatctacaaacccacagctccctcccaactcacccaacagcacaaagatctccagacctgaaggaatccaccacccagcctcccccaacccaatcaacacgaggcccagatcatttgaaccacagcacggagaatcagacctggtccaggaacagccgctcactccaccgcccggggcctcatcggatcaggcgacggcggcgacgcccccatcgcccctccccaacacactcccaaaaacaaaaacaaaaacaaaaacaaaaaaagaaaaatccaaccctttccgctccccggacagccaaatctaggatccaagaaccggggcggcaggggcaaccggccggccgccgacgcgaatggcgagatcgggtgaggagcgcaagcagcaagagcgaagaggagaaccttttcttggcttgagggcgagcgagagcgagagagagagagagagagagagagagagagagagagagctctccactttttctcctcctctggatttgagaggcggccttgaggtcccccaaaagtagcaaaagcagtaaaaaaaagctttgcgcttgcgccgcagcggaggagaggagaggagaggagagtgtggacagtagtagcagtagcagtattctactgcaactatttctgggggtgagctgcaattaattgcacacgcaggcggctgtcccttcgccatcttgtgcatgttttggcctccccacacagaaccttcatgggtgttagtgctaggtaggggtagactgatgactgtgactcaaaagtgggagtaggagtacgagtactccttttttttacgtcatcttccagtattaaactgagtttatttttggtattgtttagttcacaccaaactttccctaaactagtaattttccatcatatcacatccaaaacttttctcctcacataaactcccaactttttttcctaaactatcaacttcccaaacttctctccaatttcagaaactaaacacagcctttgttacggtatagtactccatccgtacttaaaaaaaactcaacctatcccctactaggttgagtttttttaaggacggagggagtaaatcaacttttatgtttgaattttgtcttaaaataagccaacttctacattcttaaatacccttggttcgcaaatgaataaaatttatcatttaaacatcgcccatctacccatctatcaatatagttctcctatttgtctttctccttaattttatcttgggaagttagggtttggcattttgtgacacttcctctatcccataaaaaaccaatctagtattggacatggcacattactactactacgaatctgaacattcatagtaatattcattcgattatatatttgtttttttagggagtaaatgttttggagataaccaaatggagacaatgggaattggagtagtttatctatatagcggaagtcgttctccttttatcctcccctactttcgtctaaaattcacttccctctaaagactgatttatataaaaaagaattgactacggtataaaaccaattaacccattttgctcaaatgatgtgttccatctcatacttggatcgagctggtaggaataacaagctgtagtaggaaaaaaaaattgtgacaaacttttggattggataagccagcatggtgaagtggctaggagatgtggtgtcagtggtacttgatgctgatttaaaaggtgtccccagtagtgtcttgatgtactagtagtactactctccttgcttgtaccgggggggtgtttagtaggagagaggggtgggacttatgcttctatgagagggactaaagtttagtccctagtttccaaacacctctgaatcatccaaatgtacaccatacgttgctgaatactcaaatcattatttgtaatttctctacaactaattagtacatatttgtcattataaaatatcctgaacttatgtaagctacggtgctatgttacccaaaaggacatggtcaatcagtactagcaatactgacagtagtattatctttggatagtataatctaggtagcgaagggcacctaaatgacactgttagtgactactaatcaagtcctatattgcattactaatactataatcgtgtggatcatgccaggctaattagtggagtagtagcatgcacgccaataaatgcactgacctaagctgtctaccaaatcgttcagtcgactggcctgacacattccgtcggcgccaacgactcgtttagcagccatcaaagcgcaaaattatgggaaaattaggcgataattatagtattcgagaacgggaccgtccacagtctatcatgccagaaatacacacagtgccccataatttcagcaaattaattagtagttggtcaagttgtacttatcgtcttgctgttcgttgtagcgtaagagcatgtacaatagcaaggctataaaccagctataaacatattttaaagagataaaagaagagagagaagagcagcgggctacagatctattgtcagctgcaacacagactccaatacatattgtgtgtatgacatgtgcgattagatattaatagtatagtaagtaattattgtatgaattgattattatacggcttatagatgaattggagctagtagtgggctatactattaaacttgctctaagcatacagtttgaaaaagagtaaagtccatcaccggtccctaaacttgtaccgttgtgtcatcccggtccctaaactcgcaaattgaccgttcaggtccttaaacttgttcgactgtgttatcccggtcctaaacttgcagatcactcgtttagatcctccaacttgttcagttgtgtcaccccggtatttaaacttggatttaaatatcatctgggtcaaataggacggtttaaagacttcatatttaaaaataatttataactttttcatgtgaattctaacgaagacaaactttatatcaaacttgtagccctcgacgcgatctacaactttgtagttgaatttatttttattttaagtcattttttgtcccaaaatgtaactttaaaattaaaatttcaaaatctataaacatgcaacaatattttgggatcctaaacagttttaattcaaaaacttttcaactacaaagttgtaggtcgtgtcgagggctacaattttgatataaagtttgtcttcattagagttcacatgaaaaagttatgaattattttttgatataaagtttttagaccatcatatttagggactggggtgacacaactgaacaagttagaggacctaaacgagtgatctgcaagtttagggaccaggatgacacagtcgaacaagtttgaggacctgaacggtcgatttgcgagtttagggaccgggatgacacaacggtacaagtttaaagaccggtgatggactttactctttgaaaaatcactgcctcaaccaaaagatttttaaatagttacggaatcgaacttaattaatgggcaggaaaccatcgattttcaccttggagtttcatgtaattttgtcttagttgtgcctgtattactattgctaattgctcgttacaaatatctttttgcggtagagaatagagtcttggatgaagtgttttaggggttgtgattgtcattttctgagataataaggtcgacatatttttatgcaaatcgattgatgccgtctaatcgacctattccttccgttccaaaataaaattatttttcacttatcacacgtatactaataaaaataaaaaaactagactatcccattttatcaaatcctaatataattattccttagtgctcccaatacatttatctcgtgcttttaaaaactcgaatacaataattactaaaattaaacttattttgagacatacggaaggagaaatagactattctgtaagagatggagtaggttccaagcggccggttaccgcattaactaggtttgtcgacactgtacgatagcgaaaatcacttaatatttcgataagattaaaagaatttgataaaattaattcttttagtgaatatattaatttggtttttgttggtaatagatgtgttgctgcaattaccgttgatatcgattagtacgagagacggagagaccccacccctattcggtgttgattttttttccccaaatcataaattcacaacaaagtatcacgtgaatgataatacctacaattaggctagggagcacaaactggaggtagctcgtctggttgtgttatttgtagtggaacacgaattcaggtcctataaacatatgtaaatgataatacacataattgagctatattttctttcagggatagacaacgatataccgtttttgtttatagtgagatcgacacctatggtgtcttcattaatctcgatagtaatatcaagatatgtgacctggtcttcagaaatcatccgtggtgagttctttaacattgatagtgatttcaagagatgcctcctaagtttcttagaggtgctatatggtgagttcatcaatattgaatcttaagatatactagttcagtctctaaaaggtacgctcaagtgacttagtcaatctccacataatcaagtctacgttgacggcatcaatctcaaaatatcccgacctagttccatgggctaatgtttagccatcaccttttagcctcaaattagccctcaaggatccaaataggtgggctaattttaagctaatataaattagtccccctcaaaacattagcgccttcaaggggtgctaatggggctaattttgtgtggggaccataaaaagcatgtctctctctcctctctttttactctctctgccttttagccttaaattagcccatggatccaaacatgtcaccctaggctaatgtttagcctatcaattaatgactaaacattagctctcaaaattatccctgagctaatctttcaaatagggccctagtctcttagaggtactccgtgttactttgttaatataaataaagtatagcacttagtcttttaaaagtgttgatagaggcaagatgtgtatatacgagcgtctgccttttgaccatttttttttttaaaaaaagaagctatggagcgatcatcgggtcttgaactttgatagctgaaatgcacctgtgaacgatttttttttataatgaaaaactttatttccggtctttacacgatgtgcacacaacctataagctgaacggataaaaattaatggctggcattttacaagtgtacgactaaaattcatcaaaactgattttgtgagtagaattgtgacaaactcaacgacaaatgtacattcacttctcaatagcgggagcaaaataagtacacttgttaggtttattatgacgattgatgaaacatatatatctaagttttaatatatactccttccgtcccaaaaaacctcaaaggttgggtttttttttttttgacagagggagtagacttattagagtgtttatattcacagctaattatttttttaataatatatgaatactagatttaagctttagaccgagacaattacatcccaataagtttatggattcgccaaagtggaatggatgcaccctcatatttttactgttggtgtgaactaggttgattctttaatttactggtgtgaactaggtcgattccaagtgtttagcttagtataaataaaaacttgttttgttctacttatttcaaaaattagtgcaaatatagattttcttttgccaagtataaagtgaaacaaatctatacattttttttagaaaaaacacttcccagtgccaatatactaatactacggagtaaatctggtaaaatactaatactacggagtaattctggtaaaataatttttggtagatatgtgggtcccacttgccagtctcggcgtaggctatatatccggagtcggaccccctcccaacccggaaccctgaacccgccaacccgcttcttccccccgaccccttcgcatctctcgcaacaaaagaaacgaaaagaaagggtttttttcctctcccccatggaggcagagcacccgcaccagatcacatacaccaccaccaccaccacctccacctcatccctctgcccgcgccgcaggaagagaggagacgacgaggcggcgcaccacctcgtgttccccatggatctcgactcggccgcggcggcggctgcggcggcggcgcaccaccagcagcagcagcagcagaccacggttcgtccgtctctttccccgtctccccccttttcttgcgtttcttggatgaaattaatctgctgcttcatcgctggacatatgctctgcgagttcttgttctcgggtttgggggtgttggggggggggggatttcttgggaaggcttgtgtgcgaggatttgtgcctggggttcaggagaggaggaggaggcgcctctctggattctttgctttggtgggttagcgagggtttctgactttcttcgtggccgtggttggttggcgccgaatgcgtggtgcgagaattcttaggcggttcttgttgtgtgtgcgtggaaagagagattctttgcttgcgtgtgcagtgatcgggtgatttgggaggaatccatggttttctttgacctaggtgttaccgccatggattggatagaggatgttcccattataagctggaatcatgaggaatgaaccttcgtggggaaacactagtgcaatttagcttcccttttttctttgtcgtgagtagttccttgcaagtgtttctcagcgattgaaatgaaagattagcagttcagcccttgcgtagttagcattgttagcattttagataaatgctggctgtgtctgtgtggacatcaatggccaggagatgtttggttgccattatcagcttcatctacacaaagttatttcttttgttgcgatatcttgttcatccttcgtacggttggcagagaaacagtactgtatctcgggaaaggtttggagggatgctgtcaggagttctgcaaagtagcgtaatagcttaaaactacatggcattcacttgttcttggcagcacttgtacttggttctgtttttcctgttgagagatgttcgattattggcaatttcatctcatacccatgtgcatttgataacctcctaatagatatttgtggcttcatcataaacaaaacaataattatagcaattcttgcttcacatgaacctttttgcaaaaaattacattgaagtctaacagatgcattttctgtcaatagtcccaggacaagctgaaagcattggcttatgagtacggtcatgagttccgagtattttcaagtgtaacatttgagtcaatgactagcaacttgcccgcagcagatcagggtacaatatatctcttgcttttatgagttccgaggttttctttacaaaaatctctctatctttatggttgtgctctgatgctaaaacatggttcatgcagaggaagatgatgacttttatgagcttcagcctgctgactatttcaacttggtttcgaacagaataggaggttaattatattgacacttactattgtttgggaactttagcatctgtgtagtactgtccaaattgtactacttttcttttttattgtagcactatctaaaacaatgaaactgactgcagaacaatcgaaagttttgaagactcgtaaaatgcgtgaagcagaacttgctgcccaacgagcaaagataaaaaaggtaagatataattcacactgctcttctctgtatttagtgtttctttctgaatctaatttggtataatatctatttttccacaaccttcttaactgtaggcagtaatgagggtgcgattccctgatggatacatacttgaggccgattttcatccgtcagaaacagttcaaagtctgatggattttctgaagaaagtaatctctagaccagacctgccattctatctctgtaagtccacttgcttgggagttactgatgtattagcttcaacagtagggtttcacctcctctttgcccccttaattacccacctttgtttatcctatcaacaacgatctcggcttacagttagtgtaatttcatctgtttcagtttacagttagctttggttttcataaagactaatgagaatacttgtatctatgataagaactatttatctgtttcatttgcaatcaaatatgttggcaatcatgatatcggaaataactaacctcccttaagtagttccatcattatagttacatgcgagtaaaatttaagtgcatccttttgtgtaaagggttttacaatcaaccaccttttacagagtaatacaagttaataagcaaaattgggtacaacattcagaacacctatttgatgagttcatatgacaacatgacagtagctcaaacaggacaagttttctcatcgtgttctcgttgcccaaacttggattagacactatctgttgttatgtcaaaggaatatcgtcagtcaccaagttgattctgtctggtgatagctttgacaaatgtttgagttaaaatatgccacatgtaacctgtatgtgaaaacatagctttaggtttaacttctacagttttttgggtaagcatcatattcatctgtcattctttgagcacagatcatttgagtgacatctccatagattctctgcattcatatcatagagatgtaccagttataatttcgtaatactccatcatttgattccactacagatacagttccaccaaagaagcggataaaagacacttcactggatttctacacaattggttttgttcctggggctaatgtctacttctcttatgatctgccggaaggtatgtttgtcctaaataagtaataactagtaccaggttttgttcctggggaactcattagacattcccattcgtttttgttttttttattgaatcacatgcaggctcagagttaaatacagacagtgtaaaatcaggaccttatctccgtgaagaaattcggatgttggatggactaccaattgtccaagaacctgtgcaccaaccaattgattctactatgaactcttcttctgctcatcaatctgatgtgtctcaatcagattttgcaccgccagcaaacaagaaaccagctaaaccaaagtggttcaaaaggtagactttcttttagtgacatactgttatgaaagagtgaattcattgctaagctatgctactacggtgctacttcttttttggttcaaatttatctgttttctcacttctcttggggagcaaaactaaattattgccctggcaataatttatacatatctgaattctctgtttaattagaataagaacctacatggagacacctgtgaacttatcgcttgctttagggtgctagaaggtaaatcatggtgatcttgcagcaatgaatttgctatttctccagcagtaacaaaaacccctcttcaagtagcatcgttgcatgagcaacaagcctaatttatatatgttgtctgaaccacctgtcgcagcttctaacatatcatcacttcaagatgcattaccatgttcatcatgaaattttgttgatttttcattttcactcttgaccaattgtacatatcaatgtatttatgtttaaaaaagtcagtttcagtttcaacctgtgcatgcattttgc

SEQ ID NO: 42588 - DNA, 3806 bp, Oryza sativa
tgatattgtctctaagttgctttctcgcgtcaatttccccagcgactagtttgttgcagagcgtgcaagcgttttttagcagcggcctctagtggccgtgggccagcaaagatattgtgcgatgattacgacgaggggtcgtgtgtaattatgttcacttcaccgcttcaattatagtatcgcctttgcgaggggtcgtgtgtaattatgttcacttcatcgcttcaattatactatcacctttgcgttgtgcttagctgtgagtggatggatgcttttgacaagaacgtttctgtctggcgtcacgaaataatgcattaatcctgggattggaattcgacgtctaatcgctgaccctggataggtacaatagagataatgtgagtggtctcacgtttgctaattaggcctcgtttggaatgtgtggggtacaaattcatacagaaatcgagatgcttattctgaatttcctgtgttgtaatagtagtagtcttaatccaccttggagttacagcggtgaacggtggaaaaaacggatgaaatttaccaacaaaattcaaaatattcttttgaccttgatagggttaatggatcatcaaattgtgatgtgatgtggccatgtgggagttgaacatccaactaccaacaggcccagcaaactgcacgagctgtgtgtactaaatttccttggccaagtttcccctatttccgcttatttttattcatttttcatgttggagatcaagttatctcagacgtgacaacacttattttattcaatatgtcttcttgtgctgacatctcagagatcatcgcatcgagaccaagaaaaggaggtttgcaaagcaagtctgaagtctctgatctctgaagaccgtttagactgcaaaatgtgcgctgatttcgccgtgataatttcagaggttagttggtaggatagcagccggttagatacactgactcctccccgttttccaagtcgtagtctgacgcatgggacggctgcttggaccgaatttccagagacttcgatttcatcagcgaacaagcaacttcctgaaatctgaacctacaacgaaggagtacatcgtcagagaaagaactctgctgcgatgattcaggttcagttcaactcagtcttcaggaagacggaaaaaggaaaacaagaaggatgagagcgttgcaaattctgttcgtcagaagaacgtcttacacacagcgggtcatcactggaccagaagacgtcaattcgatggtcgtaattcaaacacaagttgacaaattgtcaataagattctgctctgctcaaccacatgcagatcagatcgatctttcggctcagttcgttcgacgtcacacgcaaagaagaaggcgaggagagaaaggtatctgtctcctctgcacacgtgacccacacttttgtgaatttgtgagcgttgagctcgtccgaaaatttttcagatggggcagatggcaactctccatccatattccatcacctgtcctagctgctaaactctgaagaacctctctcgttgctccagtacagtacatgatcacatcacatgggtttcaggataattgctctggtccgatggcgccacagatctgaatcagttatcacagttcagtcatccagtgtggtgctgctgctgctgctgctgctaccagctagtaggctgcacggcgatctgtgtgctggaacctggaaatggtgaggccaggacgcaccaggtgcgagacagcaattactaccactaaggcccctttgatttggaggaaaagtataagaattttagaggatttcaatcatataggaaaatttcctatgaagccctttgaaacaaaggactgaatcctatctaatcctttaaaattcctatggaatggacaatcctatagagattttggagaaaatttagcaagagcttcaacctcttgctaactttcctttgagtctccctctctcatccaattcctgtgtttttcctgtggttcaatcaaacggcaattcctgtgtttttcctgcgttttgcaatcctctgttttacacttacattcctatcaaaatcctacatttttcctattcctacgatttctcaatcctgcgattcaaatgggctctaaaattgaaggaattcagtaaccgatacagtagcatttacggagattatggtcacgtgaggacatttttacgttaaaaattcatgactaatgtaactcttaggttagggctccaacgtcaaaaattcatgacgaatgtaactcttaggttagggctccaacggcggcttttctgtcagtaacacacactttgaaaagaacttatcaatcaatatcaaatactcttcgtcgtttggactcgacaacaccgctggatccatcactgtacaggatcagcaagatcgagccaagaaatacatcaatagaaatgatgtgtcaaagatgatgcagtgacaactgtattttcatgtagtaaactgtaaacatggatcaaaaaccattcgatttagacgcactgtaccacaggttcagagtggttaatccatcccatcaaagcagattggcgagtagtaatcccggatcggtccatttcgtaatagcaacgagatgggaaagcaaccacttggatcggcatcgatcaatcgtgatatttttttcttcacgcatgatagcgaccttgtcagttcgtcgatgtgctgcgaacgtttaaatttgaataccgttttctctttcccacaacagttacaaaatccctttttagaaatgaatttcgcgattaccaacagagaaattggaataagtcgtcgcattggactttctgccccagatatgagaatcttttcagcaaatccacggctcaaacatttatgcgcgatttgctcctggattaaacaaatatatttaacgataataacacatggacatgtctcttgccacatccataccgcagagaaaaaacgatgggccagtttagtttgagatctaaattaggcttgccaatttttttggcaacctcaacaataattgtgtatgtttggattgaagccaaattttgatatgcctatataacataggccatttcaatagccaaattagtttaatttagcttcaatccaaacacatgttggccttcccaaaaattggcatgccaaattttggtaaggccaacatttgtcacaaaccaaactggcccgatatcaattcagcttctccattgcaaaaaagtttgattatcgcgcataaaaatacctataaatattatactcttaaaatacttcttttgtagaaatttacagagatcaaatttactgtctccttgagcatgtgttctagtgcattgcgaatatacacgtctgatgtgaaagagtgtatatgttagagagcacaccgaatatatagttgaaaaagatgctaagggaaagtgttaagtgattaattaatagattctcaaaaaagctagtacaactagcgagcatatgcagtaaaattctcccagattttaccgcgtcatttgcagataagcccctgtatctgcccagcaattacgttggagtttttcacggttggtggcacagagcacgctgggtggaaaggttggtaggtagtggacaggtgggttgcaagccgcccggctgtgagaaagccaggcaggaggaggcgcagcagcactagccgcggtataaaacatccaagcgctcctccatcgtcgccaccgctccggtttgcctcccgcgcgagccctcgtcgacgccgccggtcagtactttgtcctccaccttgatcgctgttgctaatctccggga

SEQ ID NO: 42589 - DNA, 1675 bp, Oryza sativa
tgttccgatagtcttaagattgattgcatttttctcaccttttcacaggtatattgctgaaggaagaagagcaccaacctatttatcatgtcaggaggatcttcaccaaggtcaagacgaagcagctttaattctttatcaagagatctcgaactcccttcagagcaaggttgtctctctgttattgtcctcggggcttctggagacctagccaagaagaaaactttcccggcactcttccatctttttgcacaggtaatttgactcctgagtcctgacaataactagctgtttcatgtacaatttccaaaatctacactacgaaaggaacaatctagtgcacagtcatttgaggcattccagagcaaaggttcagttactcatacttgatcacaagtaaaagctcgaacacttgtactattttttcttcccagatacagatagtggatataggacacaattgaaaagaatgctggaaaattgcagagcaagcttctttttatccagcaagctgtttttacgaaccactcataaaatcttagtctttacaagcatgcaaaatgtgtgcagtgctataattcccaggttatcgttgatattcatgtccttgtgttacagggatttatacaatcaggtgaagtgcatatatttgggtatgcgagatcaaacctttctgatgatgggttaagggaacgcattcgtgggtatggtttctaaaagctgggtttttgacatcttggcatattgctgctgtatttagatatttctacttcttttaaacatatctagccactgaatttgaatgttatagctaggatagttgtcaataaaaacatttaatactctaattatggtcaatacgtactaaaaacaagcagtacatgatctgagatacattgtgtgtaatgcggtggcagttatatgttcgacatcttcatgaaattgtatttgtttttcctgtcccctatgaagttcaatcatcaattttgcacatatttatgcctttgttgtatattgctacagatacctcaaaggagcctcagaagaacatctctcagactttttgcaacatgtgagttgttgtttgtaatgtaaccaccattttgtgatgcgcacacgtcattatgataaatttctttttcagataaaatatgtcagtggttcctatgacagcggagaaggatttgagaaattgaacaaggaaatttcagagtatgagaagtcaaacaaatcagaaagccctcgcaggctcttctatttggcattgcctccatctgtctacccttcagtctgcaaaatgatcagaacatattgcatgaatccatgtaaagtttctttactattccatacgttattctttttggaatttatacaagctatgcgctctagttgaacaaaagcaatgaagcataaagttagtggaaaattcaggtcttcttggaagcatttcttcatcaagattcattttctttgcataaatgttctgtttgcagctggatggactagagtcattgttgagaagccatttggaaaggacttggactctgcagaagaattaagtgcccaacttggggagctatttgacgaaaaccaactctacagaattgatcactacttgggaaaagagttggtccaaaacctggtaatggctataattttgtcgggctgcaggaat

SEQ ID NO: 42590 - DNA, 1811 bp, Oryza sativa
ttgataatatacaggtaagctggtcaatagttggtacttagcagtaggcaacttataggttatgattcaagaagtccaacttttataaactgcagttaatgcatcatgtagaagaaatattttgtagtcctcttgtcagttgattgctgaacttctttctgttttttggtggagaactgctgtgttctactggtataatttatcattgtctgaatggactaattgaatctaagaaactaaaaatataggtatatttcatttgtactattttaacagtatattgccaacaatatggcatgccatagtagctgcaatttataatcaatacaatcctgcagattgtattcagggaggactttgggactgacgggcgtggtggatattttgatcaatatgggtatgtagaaacattacatttcattagcacttttcttaattaagttttctattataaaatcgtaaccttacaagtcaaaagtgtacatatgagtatattatctagagctaagtgttgataaattttggaaatatttaaattctttgttaattcttactgattaagaaaagcatactctgcatttcagtgtggaaatgaacattttgctttattgagtttgcaagccaacatggaaattataattttcagtaacagaagtgttcagtactgaattcgaagagagtgcattcgctttgtatatgcctttcctgctatgagttaactaaaccatttaaggataatgtatactggatcatagtcctctctttttgcataattgtttattgcttaaacatgttttacacctcccatcgtgtatctcgttgttcctcaagggagtatctaacgttactcttgttgctgcagaatcattcgtgacatcatccagaaccatttgttacaggaaagtattctcaatatgtgtcaacattccatatgatatgatttgcatcattgtagtaacccccaccctgtcctaacaaagaaaacttttagtactttagtgactaggaaagaaaagcctcttcttacattaatttgtttaaaatttatattcacagatagtttcatgctgaattatatatggtcaagtagtacatgataaattccttgatgagaacaatgtctttagcctttaggagttaactgttccaacaacaatttaatgaactgttgcttcttctgcaggttttctgtttggttgcaatggaaaagcctgtctctcttaagcctgagcacattagagatgagaaagtcaaggtactttacctttctctattctctacatgtcaatactatattgcagcttgccaatactataatactaagagtattatgttttagtccgtttctttagtactaaataaaaccagttccctgttaatgccaggttctgcagtccgtgaaccctataaagcatgatgaggttgtccttggacaatacgaggggtacaaggatgaccctacagtgccagatgactcaaacaccccaacttttgcatctgtcgtgcttcgggtacacaatgaaagatgggagggtatgtctctcatcagtatatatacacattagggttctggagaaggacaacattgattttcgttttcccttcagattgtctttcagtggaccataattcttcattttaactctgtaatattcatatcctgcaggtgttcctttcattcttaaagctggtaaagcactaagctcaaggaaagcagaagtccgtgtgcagttcaaagatgttcctggtgacatctttaaatgtatgtgctataattacgtgcagttcatatcatggtgtactcaaccctt

SEQ ID NO: 42591 - DNA, 924 bp, Oryza sativa
gtatagattttttataatgtatggcaaagggtataaattttgtagaatgcatggcagagtataagattttggtacaattttggaggcaaatctaacaaaatagattttcataattggatcgaaatatttaaagtaaaaattattgtcaaagtttaaacatattgactgcacgtatttcaaaacagaactaaactgtgaccggaggcaacctagatcatctgggatgtaaatggacaaaacactttgtttttacgacttaattatgttgagatctccatccaagcatgttgtccccatgcttgacaatccaggtaaaaattcagaatttcatagaacaaaatttttgcataacccatgaaagcagcatgctatgctggctgctttccgaagtcggaattcaatcgaggtggaatgtgtacacgggcaaggggtaatcttcattttacacatgggttacaaatccataggaaaaaaggaggtccaactgagtgattgcaataatcatatagctagaggatggagagggatatttttttttttttggggcaatcgagtgaactgcgttgcaaacatgaatatacatctacagggcgttgcagcgacgaacagcagcactactaatgtcaatggaggatcacagattcacaggcaaaatttgaaggtcgaaatacccaaagctatctgtggttgaagccttaaaaaagtggattgaaaccacaagtttgagatgtgcaacagtatgcatgtccgcatgttatagctgcagaataagagggcaaattagcatcatagtgttaatgagatgagtagacaaactggtttaacattcaaggcttctctgttgttcttttttccaccccatgactgaaacccaacatatggaagtcgatactaattcaatttcaaacagcataccaagcaact

SEQ ID NO: 42592 - DNA, 2113 bp, Oryza sativa
ttaatttgaaaaacaagtccaatttactccctcgaactatttcacttaaccccctaaactatttttctgctcattttaacccctaaactgttagaaatgattcactttactggctaattacatttctcttctttgtttctctttatatgagtagtattttaagcttatattttgaagagccatagatgacaccattatcaaagttctaaaatagtttcaatattttttcatgactattttcttaaaattttaaacctatatgtttaaattagtctcaatgcttgcaacctatgtaaacagcgattaaaaatgccaataaattgttgagacttagttataatgcatatatcaatcccaccaaatttcattgcaaaatttgacctatatagagataaacaaaaaagataaatatcgtgagggagtaagacaacattttcaatagttcggtgagtaaaatgagccgagaaattgtttaggggattaagtgctccagcgaaaaagtttaggggggtaaaatagactttttcccttaatttcacatataaattctatattgtaacttaggaccatagcgtaaaaaccagatcggaccggcgatccaaccggaaaaaaagggaaccagtgttgcccatggtttggttctatgggaagaccggatatgcaattgacctactctgaagtctgaactgcctgaaatgcacggttttaccatgaatcgggattaaactgtcacctgttggaccaacagcacaagaaattttgggctgtacattccttattgggccaaatcaaggcccattaccatctcagatgtgctatttacacaaaaaaaacacaatagcgcacgcagacagggagttagaacaaaaacacgcatcactttattgactgacggttcagcacatgaaccggcagaccggccggtttcaccgccgtaccggtgaactgaaagctttgaccgggttgagctccggtccgagtttttgtactatgcttacgactcaaaataagttgatagtataaagatgtatggaggatttgccccatactttaagtacacttaagttgtagattctgatattgagaaacagttgccgcaatacttcaaattccacgatatcatcaacagagtaagtaggtgccagagggagaactttaaacattgcaaaaagtgcatatcagatgtggttgcatattgaatcgatagaaatttcatcgatgttcatgttccacaatgttttatactctgcagaaaatgatctgtctcgttgcatgctaattaccttctgtagaatgactatcctggttactatggatactgcctgtaactatagtatttcttaaggaaaataattaacactttatcattattgataaagttaatgaaatcaagagtaccttaagggacacccgccgagctaatactctcctcaaagcagataaaattccagcagtaagtgggaccaccatttctttcattccaataacttgtgttcccttctccagtgattcacttccaaagctatctatacaaagtgagggattttcaacatcatttacttgagttcataagaaatttggatggaagtcttaattgacaaaaaagatagaattttgcagcgtgttatttcagaatcagatctgcaaaataggatacatagtggtgaatgtgttcttgtagcccatccatttcctaagagatagtatgctaccagcatagcagcgagcccaccaatctacaaagccaggaaaaacagatgtgaaaaatcatctaatgaagaacttactggttgctgacttgctacttcattttttatatcagtataggagcaatgttttgagaaattcagaaaaaactcacagaaaaaattcaatagttgctacacatgatcatagacaagaattagtttatccagtaatataatcacacttgcacagatttctaacagttatctttcctgaaaagaaaccatgaagaatgtattcctctgaatattcacttcaagattcgtgcatgcatgcatgcagcctcatctgtgctttatgtcgatcagattacccatataaatgcactatacgttttcaaaaattgaagtgatatcttttaaccaca

SEQ ID NO: 42593 - DNA, 3475 bp, Oryza sativa
taaatgcagcttagatatgcatacaaaaaaaaattgggaagcactctgagaagtataattaagctcagagcgatacaaaatatttatgcatatgtactattgaactaagttctataatggaagtgctcagaaataaggtgatagaaaggcaacaggatagtgcctactgcctagcacctggcaacaggcagcctaccaggttccatttgattggaaacattagagcagattactctatggttactgcaaatagtatcaagattaaaggaaccaaatactgcttaaagggaaactaggtgctaggcagggttgatacctagaaaataggcacccatggtttagaacagcatttgagcatctaagtgtaaccgtctccacaagcaaaaaaaaaaaaaaacatacaaacccattccctcagttgttcaatcataaatccatgacacatgcataaagggttagatggagtgaatattttccaggataccaatcaaactaatgctgttaaatttctagttgatcaggcacccttgccttacagcatggtttgcattaattgtatgtagagggggtttgcaccagacaccattgctctcccgacatccgtacaccacacaacacaacgaacaccaattaggcctttaatatttcatggtgtttaaagaaacaaaatacagtgtacttacacaagtggtcctaagcactaagtcctttactccacagcacgaagtacaatgccagaattcctccattgataactgtcggaacaacctgaaataaaacatgcaacctaaatgataaaacaaaaacaagaatctatagtggtagataacataatctcaataaaataaaaaatgtataaatcaacctgtgtgttgggcagaggccggcctttccaaggcttctgcaaagccaggaagatgactgaagcaggtacaaggcaactgaagatgaagccgaccattgaatccccactactagacaggtagttatacagggagtacacagaccaaattctagcaaagtttcccaaaatatgaataacttgcaacggtgttgacctgcccaatagaaaacattatagtttggttaacaaaaacgtgctattatactgaatgatatcacatatcttaagggtgctaagccaaatgaacatctgatatgagaaaaataattagggaaattgggtgttttcagatctgaaatgggtagaaaaaacaattgaattgagaagctagcaatcttgaaatatttgaccactctcattcatcaatgaaatttgaggaatttcatcatatgtcaatcacacacaattggcccaatttcaatatataacatcaggtaactcattatgtaccctttataccatttccattataaaacagttttgtgtgcttcattgaacaaggtaaaatgacacaactcagctacctcaaaactgacatttatctcaatggcatgtgttttcttatgaaactaaaattgaatgcagcaaaagtgccttcattcttttaatggcctccaaaaattatttcaaacatttgtattcaggtaaatatcggttttgtggtaatatatgagtaaattggacatttcaaccagcctaatgaaagatggctaacagttttgtaatggcaatggtacaaaaggaagaaaaaacaagtttctcgatggtatatagaagaatggggtgttcatctatgtatatcattggcttctttctctcataaaatttggcaaattttaaaagggagtatgattcactgttaaaaaggaatacaaagtatggtaaagtaaaggaagaacaagcaagagaaaccagcagatactatttttttaatagcaatgacaatttaaataagtgatacaaaataaaatgttacaataaatgtcaaaatatcaagtacaatgtccatagcaattctaatataaatcaaaaatattgttgttgtaaaatttgtatatactataatctacagcgtcactattagttaagtcgagctgccttctaaaatagaacattaactagtttaaattcagctatatctggataaagtgttcgatatctcattgctacattgtcttgctactaccaacctttacaagaaatacgcatgagaaatataactaatatatacagtttaagaacaaatatgttgaccatttttttcctacatactggacaatgttggagaaatctacacttgaactacatgctagtcagtttaaacctactgatttactacaaatcacaggctcattgtgcgtctccctaattatgcgtatgaagtagaatttcagctatcccagatcttacagagaaactcattagtggagcgtgcagaatcgagttactggaagtacgagaaatgtgcatactggaaacaaaacgccaataaacctctgaaatcgctcgctccaatcaattaatttcctaccaggacaacaatgccaatggaacactgatcgcgttgcggctaagctatttcacccagcggaatgacaatgacgagcagcgagatctcgcgccgaggagcaggagcgacgggcaggaagcggttagatgaaaagctcacctcgccgtgggcaccgagcgggaggtggaggcaccgccgccgccttccggtgcggcagaggcggagggcctcggcgacatcatcttcgaaggccccgcctcgccgctgccccctggtccgactccccggatcagctagctgctggcccctggtccgactcgccggatcagaccacggcgccgacgcccgacgcgtggagcggcggtaattaagccttcccgctgtgatgctgctcgactgcgcgaggcggcggcggcggcggcggcgggcggaggggcggcgctgggcttctccgatctggatcgatttttcttttcttttcttccccgctgttttgaagctcacgaaaaggaggcgatgcagaagactaggggggtgtttagatggggctaaaattttcttagtccatgtcacatcgaatgtttggacgctaatttaaagtattaaacatagactaatataaaacctaattttataaatgagagctaatccgcgagacgatttttttaagcctaattaattcataattatcaaaagtttactgtagcatcacattgtcaaaattatggcgtaattagactcaaaagattcgtctcgcaaattagtccaatgttatgaaatgggttttgtaattagtgtatgtttaatactctaaattagtgtccaaacatccgatgtgacagggacttggaataagtccctggaaaccaaacagcccctagaagaagaagaagaagagggtagctaccccacgggattccgttgcaaaacggcagtcacgggataaaattaatacagatcccttttccgaccaagccttgtctcctgcacacgattcccccaaccagaagtcgtgcgccgctccgagctccttcccccgatgagaacccggctcggtatcg

SEQ ID NO: 42594 - DNA, 5525 bp, Oryza sativa
catatgattggatcctaaaatctttgtagtcgaaaaaccacaacactcccctttttgcaaaccaacccttaactcatttaaacaactagaggaactagatagagaattacttgtatgcacgcggtcctctcgacaatacattttatcatgaaaatgaggtatagtcaaattcgaacaaatatatactcgatgcacattatattctcctttactatcataattaccaataatatgaaaaatcacatcagaagggcatggcaattcaactctatcaaataatttcttctctaagcagttgagtggacaaagatcatcaaattgaatataaccccaagtatttaaagaagattgcaatttaggctcttcattctcgctagcaatgtgaataacatgtttaaactcaacacatagtggctctactatagaactaacatgttcattcactagttgttgcatggatataagtgaagcatcgcacaactcttctttatcacaagaaacatcaagcaaattgttttgtgacaaaggtatttcaacaatcggttccactatgggttgctctaacgtagcataagttgtggacatagttggcacatcataaatatgcataccttgagtagctgtagcaccattatcattactttttttctcatcttcagaaattataggtgcttggtcaattgaacattcttcccgcatgcatgtagctatagatagatctttttcctctccatctttcttctcttcctccttactaacttggttgttctcagatgcctacaaaatattagtatccaaaacaataggcacaacattacgttcattttgtaacaactcagacttagttgaaggcatcacaatattagtattattcctggtatctctgaaaatctcatcgattctattcttcgtcctttcaatactatctttgaaaatttctttgattccattcttcatcctttcaagattatcttcgaaaatttcagaaaaactcattggttccaatttcatttttcaaccgttatgtctaaatgtgtatgtattagcaacaaaattatgcaaaccattattatcatatacccatggttgaccaaacaacaaagaatatgcttgcatagggacaagatcaaaactggcagtatcatggtaattttcaatcgaaaagtttattctcacaattctatttaccttgaacttaccacaagagttgaaccatttgatgtaatatggatgatgatgcggttgtgtaggcaactcaagtttctcaaccaaatctgaactcaccaagttattgcaactctcattatcgattatagtacgatatgctctatccttaaccacaaactttgtttcaaataattcgtgatactgccattgctccgctttttccatttgagaacttagcactcgttgcaccaaagtactgtcatcacgtgcaccttgttggtatcgctgattttgagcgccactcatatctgtcattgccaacacaaaaacaacaacaaataatgaaggttatccctaataatctgctacgcggtgtagtggtgcccctcaacaactcagccaaatggagcaccttaccaagctcttacaagtgtcttaccagcaatgctaaggacggtacaaccggtggctggttcgtgacaccttaaaggacgtgatgtggcaattgcaaggatcaaagcggtgctgaccagaagtatatatgtgtagcttgggaggcacaatatatagtagcaaaggaatgcaattgtgctaatcagaaaatgcaaagttgaataatagttcaaagtactagtcaatgtgctggcctagcctagactcaactctagctcaagcaaccacccgaccacactaaggactagatacgaatcaatgcacaactctgcactctgaaaacatactcaaaagatgaatgatttttttctttcttggtgcggcttttttttaagcacatttctgccttttttttacttttttttaggtgcggcttttttcttttttttctttgcacctttctgtcttttctttatttctttattcttttttttttacttttttttcaacaaaaactgaccactgaccttgaacagggactcaaatgtaaatatgaatatatagggactcaaacgcaaagtgcaaaactaaaattggatcatctcaaaaatggattgctcatatcatgtaggttccatttttatacaaatatctcaaatccgctacttaacaattctataaaggaaaatacggatagtcacagatagatctgatctgatccggagtctctccttagacgcacagagtactcccctcacgcgcgcgcacaatgcaacataggagctctagaaatcgagtaactcccaaaccgttggataaaaatttctccaaaatacaaaaacggaaacccgacgacgagatgattcaatttttcaaggtcccggcaacaactgacgagatgaaaaactggacccaaaactgacgtacaactcacacacttgagtgatgtaccctagacctaagtgatgaacagatgcaatactcaaaactaaaaattaaatctaaaactaaaccagcactcgacacgacgatgcaacctagaattcaacaaagtaaaatctaatagaacaatgcaacggctcaaattgtctaggtaaagaataaatatttttgtgtggcaattttctggttatgggaagataaattacctaacgggcaaccacgctctgataccaactgatgagggatattaggtcccgatcttccgataggtattgataaacaacgatttgggcggagtcgcgacacaactcgatccggcttctgaacaaacacgctactgagccccgcaatcgcagcaccacgtctcctctggttatcaatcgtgccgaaacccggttgacctcgccgagaaggctaatccctgcatgcgaatcgaagaacacaagcaagaacaagatagattgcaaccaaattgcatatgaatgattaagcactcgaatttggggttccacaaaccgatctagcagcgaaactgttcttgacagaataatctaagcaaaacccaactctaaacgatgacggctactgaattaatatgattagggacgtcctagggtttccctagggcgcacacccccttgggctaagcccacgatacaattaaaaggcccaaaacccgagtcagattcggactggatgagatacgtggcttgttttgcagattcccggcagctcggtaggaattttgatgtgggaccaaaaccatctgaaggtagactccataagctttccaacaagtactcatgggtcccgaaattccttctagatcagcggctaggtccatttgaagttgatgctatcaggaggcccgaattcgaatccaaaatatgtagaactttatctcttgtcttctatggaccaaaagtgacgtggtgaggtagaagtagacttggagaggtcttggtttggtccctaatcaacttcttcaatcatccatttattagttacgctcggtctcttttctttcgcccaagcaactacctctgcaaatgaaaacacacgaaactcattgtgtagcaacgtttgttcaaatatataacaagtaaatcttatgtagaacatatgcacctttatttgattaatacataaggtagtcatggttatatccgagctagttatgtccttatcaagtgggttgtgactatagtggatttagagcacaaccctcctccattgagcccctcttcactcaggttcctaagatctcatcgtaatgtatcggatgaagactatgagctgattgagttgctgcacaacaacaatattcccactcgcaggatcatgtctgttttgtctgacctgtatggaaacattcgcaacataccgttcacgaagaaagatgttagtaacataaggacatcaatgaggaaccggactacatgcaatggtgacatggctgaaaccatcaagtacttccaagaattgcaagcagaagacccgatgtttttctatagcatggatgtcacgaccggaaataacccaacgggcgttccttacgtgcgtgcattattccttgtcccaggaggcaaggtacaccaagagttgatacagttcagagttcaacaagcggaagcgtaaatagttaatttattacatgggcggcgaaggcccagcacacacaaagacaaacgggaaacagctgaagactagggcgacgaccacaggcgcttgacggcaggcacgagctagacaccaaagccttcatcttctagggactcctcttctgggtttgggaaaaattgagcaagactgagtacacccaccgtactcacaaaacacacccacaagtgcagaataaatgcagggaagtacaagggggttataatataaagggttagggtttgcagaaaatagcattaaaagacacttagttgcttgaagctattttgtaaacacgattctagagctatacaatattattaatcaaggccgtggacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatctttgtcgcgtcccaaaacgactctaaaatacatcctcgaaattatgcaaagaataagtaaaatccatgtgaaagcctccaacaattaaaatgtgcaaatttaaaagtcaaataaggcttggaggatttttgtatatttcctaaaagcctaaaatgcgtaaataaattttagtggaattttcagagcacaaataataattgagaagaaataaacaaagttaaaaaggtttataaaaagaaaatccctaaaagtcttcttttccccccttcctctcttgggccggctcggcccaactctccctccctctctctctcctctccccgcggcccatcggctccctccccgcgcgcgcgccgctgacaggcgggcccgcccgccaccctcgctgacgggtggggcccacctgtcatccccttcctcccgccgctcccgccgctcgcccgtgccctagcgccgccgccgccgcgaatctcgccgcctcccgccgtccccgcgcgcaataaagaggggggaaatattccccacgattccctctctctttccccccgtttttccctctctctctccctcggattcgtccggattcactcccgcaaacctcgccggcgccatcaatggcggccggatcctccgcgccggtttccatctcctccggccgccttccctcactcccaaccctatttaagccacccccgtgctctcctccaccgtttacgccactcgccgcctctcctccccgtcggattcgtgcccgcgccgtcttcctctctctccgccgtcg

SEQ ID NO: 42595 - DNA, 3116 bp, Oryza sativa
tcctccgctccggtcgtcgtttccgccgtcctcgtcgacccggggtgagccgtggaccgctcctttcgcttcccccttccctcttctctctcgggcgccgctccgccgcgctgttggtcgccggcggcgaccatcggggcgcgggtgcgccgcctcccgtcggccgtgccggcgaggccgccttcgggcgcgccccgcggctgccaggtgggcccggccgtcagccgcccgcgcccgcgggtgcggctgacgcgtgggacccacggcgccggtcggcgtcagccgcgtgcacccggtccaccgtagaccgagaggctgacgcgtgggccccactcccgtggacccggtccgcgcgccctctctctcggctgacgcaataaacccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgctattgttattattattaccttgttcaccctagattaaacaaaacctcaactagtggacattctacttaagacaccactagtttaattttaggtagatgcttcgcaatttaattaggtaacattaggtggtttttcaactatagactttgggaattattcatatcacctggacactttggaatggtttggttattgtggaattggcttcacaccgccccctctattcaaaatccccaaaaaatggttttaggctgggcgcggggtgcatggttttgatggtagcacctcggccatataaggaccggtcttcgggcctctgttgcaaagcactaccgtacttccacatgtctaatgggtaaggcttagtttgtggctcaggctagtcataaacaaaagtacacggattggagatggatgaagtcgggggtcgatggacattctccagggcaaatgaaggctacacgagctgcggcccggtagtcgagatgtcatggcacagggccggtgtcctgctgctaggggctcagttctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtagaatctattcgaatagccgcgccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcgtaggccttgggttaaggcaggttcgtgtgggttcacggccttgataaataatcttgtatagttctagaaccgtgtttacaaaatagccctgagcaactaaatatctttaaatgctatttactgcaaccctaaccctttatattataattcccttgtactcccttgcatttattttgcatttgtgggtgtgtcttgttgagtacggtggttgtactcagtcttgctcaatttttcccaagcccagaagaggagctccttgaagatgaaggcttcggtgtctagctcgtgcctgccgtcaagtgcctgtggtcgtcgccctagtcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaatcttcctcacgtgtaaccacgtgtcgcataccaccacggtatatggacggaagacgtgacatagtttccaacccatcctagccatagacaagagtaccgacccaaccccacctacggccggaacctccgggacaggtaggcaggactgaggccctagcagcaggacaccggccctgtgccatgacatctcgactactgggccgcagcttgtgtagccttcatttgtcctagagatgtccatcgacccctgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaatccaattccacaataatccaacaattccctagtgtccaggtgataagagtattcccaaggtctagagttgtaaaaccacctaatgttgcctaattaaccagcgaagcatctaccatgcgtagagtgtccactagttggggttttgtttaatctagggtgaacaaggtaataataacaataacaataataataaggtcataacaaaggtaaataggcatggctaaataaaacagtgataacgcgggaatttaaataaagcggtaatgcaataatttaaatcaaaataattttataaactgggattcaatatgttcaaggatgatatgacttgccttgctcgctttcccaaacgtcggcttcaacctccgcgaagagcggatcttccgaagctgcagcgtctacacgaccaacggaaaagaaaaaggcttttactctaataaact

SEQ ID NO: 42596 - DNA, 3121 bp, Oryza sativa
atggggggaaagggggagggaatcacggggaataattccccccactttattgcgcgcggggacggcgggaggcggcgggattcgcggcggcggcggcgctagggcgcgggcgaggcggcgggagcggcgggatgaaggggatgacgggtgggccccacccgtcagcgagggtggcggacgggcccgcccgtcagcggcgcgcgcgcggggagaggccggatgggccgcggggagaggagagggaaggggaaggagatgggccgagccggcccaagagggagagggagggaaaggggactttttagagtttttcttttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttaattattctaggcaccatttagaggatatattttagggtcgttttgggacgtgacaatggagttgcagttctgatggttcagttggtagcttattttgggtggatggagcctccaaagaagcctacaaaaaatttggtgattgtatcgtcttcgacacaacatactgcaccaataggtataaccttccttttgctccaatcattggtgtaagcaaccatggccaaactgtgttgtttgggtgtgtattcttaaaagatgaaaaagttcagacttttgaatgggtgttcgaaaccttcttgagagtaatggatggaaaagtgccacaatgcatcatgactgatcaggacaaagcaatggagactgcaattgcaaaaatactaccaaataccgttcataggcgctgtatgtggcacttgcacaggaatgctagctcaaaccttggtgtgctattgaaccagaaagaggggtttgaatttgatttgaagtcatgtattgagacctcgttgaatgaacaagaatttgatgaaagttgggatgctatgatcaatagatatgagttgcaggggaacaaatacatgcagcacctatatgagaacaggaagaagtgggccacatgttttttcatggattgcttcttccccttcatgtgcagctctcaaagaagtgagagcatgaacaatttgttcaaagattttgttcacccggtggattcaatcagaaacttcatcgtccagtatgagaaacttgcccaatcttgtctcgacagggatgaccaacagcgctacctcactgtccaaacagaccccgatatgtggtccggctacccaatggaagaacaagctgcaaagttctatacgcgtgcaatgttcagcaaatttcagcataggttgtacttgagtacaacttatcaaacaattgctggcccggaacctggatcatattttgtgcagctgattttaaaggatgacagtaaaaaattcttagttcattatgacctcactgaaagcttcagttgcgcctgcaacaaaattcagagggacaagatgttgtgtgggcatgctttgaaagtgatgtgaatgtgtatgtgctaccaaaaaagtacctttgtgatcgatggacgctcagagggtctcaacatgcttcaaatgctcttgtgcaagccaacatcgatgaggcatcaagcaagaaaatgaagtatgtccggctctgcaagaaatcagcctccgttgcagctgaagcctgcaaaacaaaagagggatatgagcttgcagtcaagacaattaatggattggcagaaaaactagtagtgattaacacaacaaaaaactccctctgtgagcagcactgcagtgttggatggtacccctgtagcagcaacactgaaagatcctaagaagaaggttccgaggggcaggcccaaaaactcaactaggttaaaatcttctgtgtttgatgataccagtggtgggtcaacaagccgtaaaaaaaggaagaaatcaacaagcaaccaaacctgctgatatgaggtgaaaagatggtctcttattttttttcccactcttttgtttcagctcagcgttatgaggaggaaattcattgatgagtcattccttttgcaggggtgaagaagaaaaagatagcactaagggatgtgggagagaaaagatagcaacatttcattttttttacatttgctgaatgagacttcttcatgtaataattcctcttttttggctgattggtgaaccatgttgcttgaaactgaattgaaaagcttccgaacaattgtgatgtatggtcagaaaaatgttaaaatgtggttgcacttgctgagaaaaaatgtaactgatacctgaattttatctgatacatgtactgtgagctggtccatgaatgaggtggtttgaattttatctaatacttgtactgtgagctggtcgatgaatgatgcatgtaccgtgtgctatcagacctgccaggtaccaggcctgggaccaggtctggtacctagtaccaggagtacatacttggtacctggtacctggggttactgctaggtaccaggcctggtacctgggttgctgctaggcaccagacactggtaccagtatttgtgagggctgataccccctatactgggtgataccatgcctggtgcctaggtttagacctgataccttggttttatgctaggtactaggtctgatacctagtagggactgccaggtaccaggcctggtacctgggtttagacctgatacctggtacctggggttactgccaggtaccaggcctggtacttgggttgctactaggcaccagacactggtaccaatatttgtgagggctgataccccctatactgggaggtaccatgtctggtgcctaggtttagacctgatacctgggttttatgctaggtaccaagtctgatacctagtagggactgctaggtaccaggcctggtacatgggtttagacctgatacctaggaccaggtctgatacctagtaccaggtactctaggtaccatacttggtacctggtacctggggttactgccaggtaccatgcctggtacctgcgttgctgcaaggcaccagacactggtaccaatatttgtgagg

SEQ ID NO: 42597 - DNA, 7023 bp, Oryza sativa
  unsure (1)..(7023): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggctgagcttatcagcaccacgtgaaacgaggcatgccattagcgcatcgttaagtatggactattataaattacagaagtgaatttatttgatttttaataaaatatataaagtttttgcacgaaattagtggttcagaaaacgtggctcatggcaaactggccctaagacatgacaatgacaatcagtctcatttattcataatgggatgtctcataaacatcccaaattaattatttgcagttgtttgtgttaaatatgtgatccgaattttggaccaacaatatatttggattagttatctaataggactgcattataggattagtttcctattaggactttgagtctttacctattaggactcctagatttctcctatatatatatcccttgtaagccgtacagggagggtgcgacagctcaatgtatcccctgcgtttgtatctaactcctctatagtgatcattgccggtcggcgtctatagttttttccctcaagggtttttcacgtaaaatttatctccgttgtacatttattttcataacagttcggcccttcataatagaactgcgagctgaaaatatgtgagatcttgtaacagttgccctgcatgctgtgttgcagatcgttgctaagggaatggcctttaccattcccatcggaggtggctgctgtgtgtcgcgtggccgatgaatccaccgaaaagagatattgacaggtctatctcctagtgttggaagctgtgggagtatttcaaatggtaatgtactaagttccttgggtgaaaacaaataaaaggtagctgataatttccacattcaaggaaaataattaaaatgatccaactttaattagtatcaactgaatgtttgtagacttggagttctttggaacatctgttactgtagaacattgcataatgtaattcatcattcatttatcctttttgattttttcaggagttttcaattgttcatcatttatcttttctatactaatattttccttttgagtttcagtttaaaagttttttttcttccgaattctacttatttagaaattttctatctttgtttttccttttttcttcaattatagatttttcccttctgttgttttttcccataaaatggtttttctttgtcgagtttggtttcaaaaggcagggagagtggtgcaccgatgccgcaacgatgagcttatttggtttgtaaccatggaaaaatatttgcaatatgggtaagtttatgtcaatgccaacattttgacaatatttatgtggtattggtaagtattgttagcaaatcttaattgcatccatgccattgtaactttcacaattttgatatataccattactgtccggggattcctaacgctggcccatcgttaacatgtgattagcactaatgatgattttgaagtcaaaatttgaaatctttcaactcaaactttaaaaaatttcaactggaaatttaaatttgcaagataaattttgaaaactttcaactcagatttaaaaactttcaactcgagatttgaaacctttcaactcgagatttgaaaactttcaactctgatttgaaaactttcaactcgagtttttaaatttgaattataaaaaatattttttattaaaaatatcttataatagaaattttgataactttcactacatcctaaattaattatgttgaaaacataaaaaaaaagaaggatcgtatagatgcatgcatgcatgcatgtgtgggaccaaggtgcatgcatgtgtgtgtaatgcatctgcacgggtggagaccgaggtacatgcatgcatgtgcagttggtttgctgcatgcgtgagagataagaatctggcgcatctgcgcgagatagcaattgcgttactgtccttctatctgaaggtatgccatcataatttgatatatactactacttacccttcactctatttctttcttttttaccaagttaccctttcttcttcattcattccctcctccctcctgttcatcttctcagcaccaatggcagcagtacaagcatgggtgaaagcgctggcatagaaggcgcttaacgacactgtcggcaacgggaacatcaccatcttcgagccaaggaacgaggacatggagcgcgacctcgacctagagttccgccgccaccacgtcctccccgcctgcctccacggtggtcaatgagggtgggcaccgctcgtccacggacttggatgaccttgttcgagcgtgtagcccgcgccgccgctgctgccatcgacccgaggagatactctcgtggggatccatcagccgatcgagaacgacacctccggcggcggtggagaagcccctacggctaaagtgcctcactcagatttgggctatgaagttgccatcagcctcgacacgccgctcacgttcctcccggatgagagcagcagcgaagaggagacagtggcgacttggcggctgttgacggtcgttatcgatcagtttcaaccgtcaatattaccaaaatagaggagaactagtggtgcttgcaatgcatatgtttgttagaataataatattccactagtattaggtctactaaccttttgcagagaatgacaataaagtggaggagaatcgacatcaacacaaacgataaatcaatcggacgatgtcgagaaccagacttgtgtatgaatgggccaagaactcagaattgacacgacaaactgggccaaaattcacaagtctgcggagaagaacaacagaggaggccgccagccaaaccatgggctggttgggccggccctaggttcgaccgaacctggtggttcggccgaacccccctcatcgccgctggatgcagggtttcttctgaacggtgtggattagctcccaatgacggttggagggtatttctaactattccaaccgtcacaaccgtcattaggaggctatataaacccctcatcttctcacttcactcacacacctcaaggaagagctctctcattcctctcaagtttagtttagtagtatctagctggtggaatagaattagaataggaatcaggagtccggaagccttcggaagagttcgggtatggctctagtagcttttctttcctcttttgtaagctttgtacttttattagaatactcttctaaatacatttctggtattgaaatactttccaagtatacgagtaccaactttgcattatgttcatgttatactgaatatactactagcttatctgggagatgctttggtgcgcgtatagtgtttgcttatgcaattactctatatcatgacatgatattagagtagtatctggtagtttagacgtggtgtctagattacgggatatcattatttggggttatatattgcggatgagaggtgggccgctgatagtgacaggtcagtatgggtattcctccgcgcctatatataatcctaagttaattttctggggagggtattcctccgtatttagccccggttggatggtcatgacgggttgtcgtaaggaactcggcagtcaggggtggcttctcgaaataccaggagggcatcggaaagagggtattagctagtatatcagttaactagaatgtatgtatactatgtatattagaagtataggaatagattctctttttcttttctttccacctaacttagattatttattatgaggatgagtagtaatgcttgtgtgtcactctacccttggattatcttaacccctgcttagaatatgattatcacaagaaatatataaattattagttgagttctctctacatgatcttttcacgagataaaataaatacgatacccttggaatactctcgggtgaaatgctacaatggtatatccatgcgcttgcgaatgaactctgtaaccataatataccagaagtgtttctgcgccattgctgggaattatatttctagtaatgtcgttaagaaataccaacagcagcaccgtgagatcttcgtgctatctcctcttctgattcccaattcgattatgtttgattttatttactggctcgtattgatctctgttcgatcccaattcgaatatatccaattcgaccaggtccgtatctatccaagtgagcagagcacccctctatatatccatctctagctctccctttcttcattgaatggatgaagaacttgttcttgagtgtttgatttcgagttggatgagcgaagagaggatgaacataactacatgtgatagagagggagatcgatgaaggaagaagaaatgggcaatctgatctaaaaattttagaaaatacagtcacgagttaagtagtgccatctatcgaataacagcaaaattatagtgacatttctccaaatagacgaatagtaataaaatatttcaaaatcataaaagttataatggcatggttccaattaatcctaaacattaccagcctataatgagctagtagcccatataagtgcaatttgttggctgaagagtttggtggttgagttgatatctacaagctagctaggaaatcatgaaattttatcgttctaaccaattttaaatgcaaatttctaattacgttatgtccgttttcatatttataaaaagttcatatttctcaaaattattggttggttatgaatctacttttgactaagacgttttatacttcttttagatatttaggctgtgttcggctggctaagttcccaactggaacagtgcgcataaaaaacagagcgatccatttgcacgtggttaattaaatattagttatttttttaaaaaaatggatcaatatgcaattttcgtatagaactttttacaagaaacacaccgtttagcagttcgaaaagcgtgcacgcggaaaaggaaggagaggtgttgggaacctggatgcccgaacacggccttagtgtatcaagaatttgaaattcttaattaagacaaattcaccatctaaggacaagaaaattgttatagtatgtgtagcagtgttcttaattgtatacttgctctccctaaagttaactgtctttttgggatgtgtgcagtaccatgtttaaactttgacaattaatataatatcactttgaatattttgaattcaacttttttaaaattgtatgaatagatttctcttccaaaaatggtttcaaaatattataactttgctacacttttccatacctttttattttatactagtagtaattactatcagaaaaattcttttggtgacttgatcaaaaacatgctgcaaatggcataggtatgggaattgaacatattatattggtcacgctttgattcatacccctgatcgtacattacatcttaaaaatattcttcatgttacccaagccaaaatgaatcttatttatgcttctcgtctagctgaagataatcatgcttttcttgagattcaccctaaatattttttgttaaggattgggtcacgaagaacacaattcttaaagggtggcatcaaaggggcctctgatgacgctctctctcgtggcccgatcttctggtgaggggataactctcgctttgatcgagtgcgacgtttgtgacgtggctaccaattagaacatgtccagaatgccgtgcaatcgctaaaccacaaacgatgttgtaccaaccgtggcgcgcggttgatgatccctgcaatgcaaatgagagaacactgcaagaacaagataagatgcaatctaaatattgcgaataggtaattaagcacaaagaaatggttgcgattgaagtggtagatccaatcgacccgtcaaatcaacacaccgaatattgggggctctgaatctatagtcgccgactagtagagcgaggactagagacaaggtgaatagcacttagcaaaattcaactaaacaaaaccccattgtttttcaggatgtacaaagctatttatagagaaaaataaagctagggttaagtactaattcgtggaggtggagggagaaacttccgagatgggcctagtctattacaaggtccaaggcccaagttcggtttcagcaacaacactgttttgttttggtgattcttgttgactcgagatgaatttggacatcagaccagatgcatttgaaaggtagcgagataagctttccatgaagtccaagatcacccaaatcggagttggcatgaaggcactaggtccgtttgaagtcagtgttgtctccggaggccgaactggacttggacttggaattataattggaaagtgtgaagttatgtgcgtatccgatgaaatgatgtcctcatcatcctccccttcttgaattggagtcgtcctcaactcaatcccatcttcttgaccgtgttcactctgtcgtccaggggtcatccttggaggtatctcatcgtgaaaaacaccctcatattcctgcaaaaagttagtaatagcgggtagcaaagaatataaagtactaggagtagtaaccaatgtgggtatatgatctttgcaaaaaagagcatagtaacaagaatctggctcatctagagcgaaaatattatatttagaagctagcaaaacacccttcaacttaatttcattctttgaggcacttggttctattttactaggtgaagcaagattcttagtaataatctgattttcactgttagatttcttttcacattcaagtcttgcaaggtcatctttcaaagcagcggctgtcagggttacggataaggtataccctctacccttggatatacgtcatatatcgat

SEQ ID NO: 42598 - DNA, 6165 bp, Oryza sativa
tcaaaactctggtcacactcagctgtccatttaaatttctcatctttcttaagcaactgagtcatgggtctggcgatcctatagaaattttcaatgaaccgacggtaataacccgcaagtccaagaaaacttcgaatctgtgacacggtcttaggtggggtccacttggtaactgactccacattcgacagatcgactgccacgccctgagctgtaatgacgtgacccagaaatttgacttccgacaaccagaagtcacacttgctgaacttggcatataattggtgctccttcaacttctcgagtaccagacggagatgttgctcatgttcttcttcagattttgaatagatgagtatgtcatcaatgaataccacaacaaacttatccagaaattccatgaacaccttgttcatcaggttcatgaagaatgcaggtgcgttggtatgtccaaaagacataaccgtgcactcatacaacccataccgagtggtgaaggctgtcttgggaatatcctcttcccgaattctcaactggtgatagcctgatcgcaggtctatcgtagaaaacactttagctcctttcagctgatcaaacaaatcatcgatccgcggtaaaggatatttgttcttgattgtgaccttattgagtgcgcggtaatcgacacacattctcttcgtcttgtccttcttctccacaaaaatgatcggagcgccccaaggtgaagtacttgttcgaatgtatcctttctgcagctgctcatccacctgcttcttgacctctgctagctcgttggctgccattcggtacggtctcttgtaaattggagcggttcctggtgccaaatcaatccggaattcaatctctctcttgggtggcatggtagtgaggtcttcggggaacacttctggatacttgcagactacggggatatcttccaatttccgcgaactcttctcgtcggtggccacagggttttccacctcatgctaatttaaggagattccttgcttcggtgagtgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcaataatgatctaattataattgttaagagcttttcttgtttaaaaatccttaaattataaattgttgtttaaaaggaataattagaaatgatcttaaaagagaagatctaattttaatttgctaaatctcaatataaaattgggttagataaaattttgttaaatactttacttgattctatagttcctagatttttctgggatttatttgagccaaggaagtatttttaatcaatggaatatcatttcatgaataatttaaatagaaaaatgtttttaaatcctccttttggctttgggccgaaagccggcccaaaacctctctctttctctctccctccctggcccaagtcggcccacaaccgagccgccgctctcttctctctctctcccgctgacaggtgggccccacctgtcgggcccgtcttcctcctcgcgccgctgccggccgaaaccctagccgccgccgcttttcaatccggtcgatcctttccgtttctggtgaaattgtttgaggggaaataatctcctcgatctcctcttccttttctcttatagaaacttcggtcaataacgtttggaaatcgacggatttgagctcgattcggatcgacttttctccctccaaccctagctttccatcttgccgccggtcgccgtgggcctccatcgccgctcgctagcccctttataagcacccccgagctctcctctatccgccgccacctttgccttagcccgccgtcgcgtctagcgccgcctccgcgtagccctagccgtcgctgtagttgccgtcggttcagccacgccgcgccgccgttgcagccgccgtcgtcggtcgccgtcgccaccatcgggatcgcgaggtcgtcaccgtccccgtccacctcttcgccgccgcagaagaccgccggagcaccgccgtcaccgtcgacccgaagaccgtcgccgcttcttcctcgtcgccggcgccgtccgttgctcttccgccgtggttttggtcaccggtgagttcgccgtgttgtcctctacccgttggtgtcctccgtttgcgtcgttgcgccgtcgttcgctggcgagcgcgcgaggccgagccgtcgccggtgatgacgtcatcgctgacgtcaccgctgacgtcatcgtcgccttgtcccgtgaaccgcggtagatcaagttgatctcggccgcccgttttggatagaatcgatcacggccgttcgtttccttagaccgccccgtgcacctggaccgcctttgatgacgcaataattcccttttccttttcaaaaataattctttattgcgtcataattcaattaaaatccacacaagtgttttaatccgatttaatctttgaaaattcataactaattcattgtaactcagtttaatgtggttcaagttgcaaaagttgtataaaataaagatctacatattaaaattatccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgtgagtacgccggaagtattcaagaagattaattgaagaccgattattgcaaggcaagtcacacagatcctaaacacaatcctttgagcatgttgatcctgtatttaaattctctatttatttcaactgtgcatttattttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacactattgggattacttatgactcattattatttaatgatggcttaatgatagttcacgatggtcaatcgtgattggttaattaattacttgccaactaaaacttgataatggtggcttgtgagcacatggttttgagagtcgtgctcatgacaatttaggaccggttcgcgagctactgttgtgaaacattaaccgtgccaaccacaagccagcgtgggcaacggctttaccttttgtatagcatgattcattgcggagcaccagactgagaagtggcggagataagcccacaggggtcgctggggagtccatgccttgtttataagggggtgattatgatccaggaaaggtgcgctgtggtggattgtgttgtgcaaggggtattgtcacaactcctttccgaggtaccgtggtggtattgaggcacatggtgacatgttgtgggactgtgtcttgtgggtacagtggtacacctctggccaaagtaaaactattcgaatagccgtgcccgcggttatgggcgggttgagcaatatttttcatgattagtctcacacctctcacaataattatggatgttatacctggtaataatttgcttagctcctggtttagagttagatctgtacagccgggtatggttgttcaggatggttgggcctgtgcagcatgggtgtgttgttcagtgttgattaaaatttctgattaattactccactgttttatttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatctaggaggagaagacgtttggcttataccccagttgagctgcctgtgggagtggagccggagcttcgctagattttattttccgctgcagttttcttcatggtgaggactaagttcctcttaagtaagtatttatcgttttagttaatttgatgaatctgtatattaaattgtcagtttgtgtacctcggctgattcctggacgaggattttatgcacaaataagttcggaaattactagtgaattttcgggcgtgacagtgagactggtgacttgtacaccatggtttctcccttctcattggtcaaggtgactgtgcgattcacacaatcaatgacacccttaaacttggtcagccaatccattctaagaataacatctaggtccttggattcgagaagaatgaggttggctagaaatggtgatctttgaatttctattgttatagaggggctgaattgaaccgaagtggagctattccctggggtatgaacctgcattggtgtgctaagttcttctcttattaacccgtgtatcccaacaaacttccttgaaatgaacgaatgcgttgcaccagaatcaaaaagtactgttgcagggattgagttaacaggaaacgtacccagtacgacctctggtgctgcttgcgcctcctctgcggacgcgtggttgacacgagcctggacaaaccttggcccgggacgccttggcttcgggcatttgttagcaaagtggccatgctcgcctcagttgtagcaggaccctggctttgttccagtctccttcttggcttgggtggatggagctgactgtgctggtgccattggtgggcgcggagctgcattgcggttggggctgacctccctggtggttctggctgccactggcgccctggtggaaaccgcttgagttgaacgggcggtgctggcggacaatcatagtggtaggtccaccctgctgtccgggagtgaagcgcggtcgttggtggcttccttggttggactggaattgcgctgcctttctcttcctgtccattttgttgcgctgatcctcctgatggattgctttgtcaaccagcttctcaaagtcggcatagtctccagagattaactggttggttagctcgtcatccaggcctgctaggaacttctcctgcttctcggcgtcagtgcggacatcctccggtgcatatcgcgctagatgattgaactcatggagatactcagtcactgtcctgttgccctggtggagtgcccggaactccctcttcttctgtgccacaaccccgtctggcacctgcgccttcctgaagctgcgacagaactctgcccaagtgacttccgtgcctggcgggcgggtagccatgtgattgtcccaccaagctgacgcgggaccctggagctggtgtgtggcaaaggcgaccttctcctgatcattgcactgcaggagatttagcttcttctctatggcatggagccagtcattcgcctccatagggttggtggtgctagagaaggtgggtggcctgacgcgtagaaactccggcagtttggactgagggggagggggaccaaactgctgctgctgctgctcggcttgctgctgcatcctctggtgcatctgctgcatcatggctgccatcatcttgagtctgatgagccattacttgggccagagccggattctcggggagcggtagcggaccattgctggagtcgctgttgggatgcacaccgtcagtgcattcttcgccgttgctgccctcgcctgctgtacggctaccattcctggtgtagaccatctgaaggaagagcagacggaggggggggcaaagaagaaaaacagatgctccggaactaagctttattatataggaatgtaaactgcaattgttctgatttgacttaaaacacttaaaacgacaagcaaatccttattaagacagccatatcataggcacatgatatcgaccgtcgactgacccccaagcgaaaaacctaaacactcaaactaacagac

SEQ ID NO: 42599 - DNA, 3133 bp, Oryza sativa
cgcgggagctgacactggggcaggagctgggactggagctagagctgctcgagctgcgggaactgcgggcagaactggaggagctgcaggagctgcgggcggaggtgggttcctgggcgcaagctgaatgcgcacgggtgcagtcgttgacttgcggggcatgttgcggatccggactcctccgggaatggggaggcccttcaactgagcattctccttcttcaggcgtgcgatctcatccttcagagctatgatcctcatgagcttcccgtcatccgagtgcatcttgtccattcccctcatcacggcacacatatgacctaaggtggtgtcgttctcgccggctgtcggacagaaagtgctgatatcatcgccacttgctcgacgagggtggaaacggtacgctgtgttgcagaagatgtagttgtggcgctcacgtagtctagccatcatcaggtatgccgcctcctgacaggcgtgatctgcggtgcctccagatgcctcaaccaccatgttagcgaggcaggtacccacatagccatgaacctccagacgaacccggtgaggaaactcaccactgagcggcggaacagttgagtactctggcgcgttggggtagcccaccaccagtgtcatgcgagccaactctgccacaaaatcatccatgccttctccgcgatggttgggtgggtgatcggccatctagagaagacaaaggggtaggatcaatgcatgctcaaatccgacttaaatgaagcagtaaaagactccaattaaatacgcgaataagagcggaattttatgcatagatcatttttgcacgagggcgaataaataagatggacttacatactactaataataataagagcataaataccttgcaacccatattcctgagttaggacctaatgcattcctcccatcaaatcccgactgactgtcgaataaatctcaagtaattttactaaaaccctagactgacttgttttgacaaatctcacttaaacgagcgaccaagatttttcccttgaaccacaagaacaaatcccaatttttccaggaacaaatccaattgcaaagaacatatgcaatgaaaaggattcagagggctcttaggtttttccatttggcttgtcctacagtcaaggtcggctctgataccaacttgtcacgcccagaaattcccgaatagaattccaagcagaatgtgcattaaaatccccgtccaggaccatccggggtacacaaacgacaaagttgacatacagatccacgtcttacaaacattataaaagtcttacaaaaatgcagcggaaaacttaaaggataactggagctaagccttgacttggacttgcagcgggaacaccactccacaggcatcctcgacggcacgggcgaagcctactcctcggaaagaccaccatctgacgcatactcaaattctggggtttggggaaaatagagcaagactgagtactacccactgtactcagcaagtcataccggaataggggtatgatgcagggaattatcaagggatagctataatggttcatttgcataaagcgagcatttataaacagaagttgaaagcagtaaaacagctgtaataattaatcaatattaaccatccactgttcaacgctacaccacgttgcaacaggcccaaccatccacctgaactaatcagttccaacagactacactagggtgaagctaatcatggtgaatctggttgaccgcccataaccgcgggcacggctattcgaatagttttactctgatcagaggtgtacaactgtacccacaagacacagccccacaacacgttaccgtgcgccgacatgccaccacgacataccggaaagaggccgtgacaggatccttcgcataaccccctctaaccaagcacaccacacctcaggtttcacccccgtccccagtgggcaacgggcagtcccctctcgtgcctaggtgaatccggaagtgacagaggccgtcgcaggggacgccccactccatcacgcccacccttgcctggatgcgtcggctagaggaaagctacactacaagcccagccgttgcccacgctggcttgtggtaagtacaaggaattcttctagggtttcccgcgaaccggtccttaagtgccatgggcgcgaccatcaaaaccatgcacccacggcccaccatttattatattttaattaaccaacaccggagcggtgagcattaaccaacatcattcctagaatctgatatctctgcattaatgtagtcccccattgtgtgctagttgaactaagcaaagctaagcattccctagtccaatctctagtcatgttatatcccaagctaacaaaggaacatggtacaaaatagcatggctatgacagtaggtcaacatcccatagtattattgtaaaacaatgcaatatttgaagaaaaacaatagaacatttgcaatataggatcaacatgttcaagtgacaagcatgacttgccttgctctgcggttagagggacccggcgactatttcaaagtacaccggagcgtcggggaagcctgaatctaagcgacatacaaagcaaacaatacaaacaggctataagactactgaaacggagaacaaaaccatttttaatggattctacacatttttctttatttactgagacttgaatgggcttaaacggagctcggatgaattagatatgaattttagaagattaaatgtgcttttactataaacagaaaaatccttaattgatttattgcgcaataaataaatcccggggagagagagggggcggcgccgacatgcgggccccatatggcagtgactcgaggagggcggtccacggcggaccgggaaggagcggcgcaccacgtggtgcacacgtggcgccgacgcggcgcacacgcggcagccgaaccgacagccccgatctaccctacccaagggttgatcggacagcggcggggagctcgcggccggcgcgcgcgggcggctcaagctgacccggggccatggcgctgcagcgcggcaccggcggcgaccggcggacggcggcggcgattcggcagacggcggcggcgcgacgacggctaagcggcggtgctacc

SEQ ID NO: 42600 - DNA, 14583 bp, Oryza sativa
cggaaaaaggaaaagtgaggaggaggatgcggggatggattttataggggcggagaggtcgggaacggccgggagtggcccgattcgccggccgacgtggggaggtggaggtggagagagaggtgggatttgaatttcgaatcccggccgtctcgggtgcgggcacgggcgagagggatggggagtgggtgcgggagacgcggcgcatgcgcgggcgtggccgacgtggcccggaggaggcgggagcgtggatgcggcggcggttgcgggcgcggtggcggtggctggaggttgggggaggacccgacaggtaggccccacctgtcagtgaccccgggagagagagggaggccgccggctcagctgggcctcggcctgtcggccggcccagcgggagaaaggggtgggaagagagaatgggccggcgacctattccgaaaagaaaaaggagggaaaaagaaagaaaaaggaggaaaagaattttccagggaattaaatattgcatgtgctcaattttaattggttaaaattatttctagggctctgaaaattccactaaaaatcttgttagcaaatttcgacatgtagaactcaagaaaaattccacatgccaattccgattattaattgcattgatttattagggtttactcttgcttttacaccgatattttttctggtgaattataaattcaatttaggcttgggaaagaacttcagggtgtgacagcagggctcatcgtcgacaagcacaccacgcgatgtgtttgctatcggcgggaccagcacgtctgcgcgtgctgacgcggaagtggagaatcaagtggttacaccggcccagcacatcggggccatcaacgcaatactgagggaaaccccttatgatcccattctgaacgatgacctcacacggtggacagaatgactacgggaatcagtggccaatctcagtaatgcgttcgaggaggccactgccggagcaaaccagaacaaccgccagctagcggtgcaaatggtgaaccacctgagcagcggacatcacctcgacaagacacccctccacctcgcggcaccggcgatctttgtgaccatcttaatggccgccgagaagtacgacacgcgcgagacaatgaaaaccattcctgacatcgcgtctcatcacgacgtcgcgagaacgaggagcgaggaggacacccaagcgaaaaccgagaccgtgataaccgccacagccgccacgaacatgatgatcgcgaacagcggatgccaggcgatactggtcgaggacgccgccataacgatgatgacgatggagatcgtcgccgggacatcaacgggaggcgacgacaggattctcgagaacccggacgtcatcctcgtaatcgtacaccggaaccaagtgactcatcgtcatcgtcatcatcctcatcatcctcattgtcagacagaaatccacggaggacatacgatcatcgacaacccaccacccccagcggcagatgtaaagctttcaaccgtgctctacgtgatgtccggtggcctgagagattccgaccgggagcaatagagaagtatgattggagcaccgacctagaagaattccttcaggtctattccagagtactctacactgccggagcggacgacaacgcgttagcgaattatttgccagtggcgttgaaaggatctgcacgttcatggcttgttcacctccggccatactcgatttcttcatgggcagatctgtggcagcagttcgttgctaacttccaaggaacttacaagcgccatgcgatcgaagacgacctacacgcgttgacacagaatccgggcaaatcattgagggactacgttcgacgctttaatgagtgcagaaatactatccccgagatcaccaatgcttccgtgatctacgctttcaagactggtgtcagagatcgctataccacccaggagttggcgacaaggaggatcaggactgctcgaaaactattcgagattgtcgattgatgcgctcacgcggacgacgcactaagacgcaagaacaacaagccgaagacgggaggagagaagaaaccagccaaagacgcacctgaatcaagcaagaagaagagtcacaagagtgggaaaacgaaagctcaaacggaagtcctcgcggcagagtacgtggaccctcccaagcaccctgacccacaaggcaacgacacgaagaaaatatggtgccccatacacaagtcagacagacactctttggaagattgcttcgtcttcaaaaagtcgctcgcaaagcaactggcattggagaagggcaaacgagtacgtgtagtcgagaaggccgctgaggcagctactcaggacttggactcagcataacctgattccgatctccatgtctcgcaaatcttcggaggttccatggcgtactcctcaaagagagagtacaagaaaatggagcgtgaagtttgttcgacatggcagagggctgcgaccaagatgaagtggttagaacagaagatcgagttctcagatgaagaccaccccaagactgctgtcacgccaggacgatatccgattgtggtcgagcccactatttagaataccaaggtcgcacgggttcttatcgatgggggcagctccatcaaccttctcttcgcctgcaccttggacactatgggaatcccacgaagcgagttgacgcccattaatcaacccttccatgcaattactcctcaatcatcgtccaagccattgggcaagattatgttgcctgtgactttcggccaagcaaataacttccgaacagagcagatcacctttgatgttgctgaatttgatacagcatacaatgctatcatcggaagaactgctctcgcgaagttcatggccgcatctcactacacatatcaagtgctcttgatgcctgggccgaaggtgatgagtacacaactagctcggatataaccatgactaccttatatatgagtcaaccaaaggtgcatatgttctatattagatttacttgttatatatttgaacaaacgttgctacacattgtgtttcatgtgttttcgttcgcagaggtacttgcttgggggaaagaaaagagaccgagcgtaaggaatgcatggatgactgaagaagttgattggggaccaaaccaagaccttctccaagtatacttctacctcaccacgtcacttttggcctatagaagacaagagatcaagttgtacatgttttggattcagattcgggccttctgacagcatctatttcaaacggacctagccgctgatctagaaggagtttcggggcccatgagtacttgttggaaagcttatggagtctactttcagatggttttggtcccatgtcaaaattccaaccaagctgccggaaatctgcaaaacaagccacgtacctcatccagtccgaatctgatttgggttttgggccttgtaattgtcatgggcttagcccaatggggtgtgcgccttagggcaaccctaggacgtccctaatcacatttattcaatagccgtcatcgtttagagtcgggttttgcttagattattctgtcaagaacagtttcgccgctagattggtttgtggaaccccaaatctgagtgcttaatcattcatatgcaatttggttgcaatctatcttgttcttgcttgtgttcttcgattcgcatgcagggattagccttctcggtgaggtcaactgggtttcggcacggttgataaccagaggagacgtggtgctgcgattgcggggataagtagcgtgttcgtttagaagccggatcgagttgtgtcgtgactccacccaaatcgattgtttatcaatacctatcggaagatcgggacctaacatcccccatcagaagggaacaatcactgttcaagggaacgcaaagctggcagtgcaatgcgacaagcagagcctcgacatggtcgagcacacgcccagcccacccgccacagctgagccacccaggaaagtgagcaaaacgaacaagacgccgaaaccagacggcgcaatcaagatcgttccgctctccagtgccaaccccgacaaggccgtcaagatcggggcatcactgggcgagaaataggaactcgcgctcatcaccttcctccgtgacagtgcatatgtgttcacttggcagccgtccgacatgccgggggtccctagggaggtgattgagcacaaactcatggtgcgacccgatgccaagccagtaaaacaaaaactgcagagatttgcaccagatcgaaaacaggccatacgagaagagctcgacaagcttctcaaagctactccatccagagtggctagccaacctagtcatggtgcagaaggccaataggaagtggaggatgtgcgtcgacttcaccgacttcaacaaggcgtgtcccaaggatcacttccctcttcctcgaatagaccaactggtcgactcaacagctggttgtgagttgttaagttttcttgacgcttactccggttaccaccaaatcagcatggcgaaagaggatgaggagaagacagcatttatcacgccgttcggtgtattttgctacgttaagatgccgtttggactgataactgcaggaaacacttttcaacgcacggtccaaggggcacttaacgatcagcttgggaacaatgttgaggcctacgtcgatgacattgttgtcaagaccaagacaagcgactcattgattgacgatctacgggaaacattcgacaaccgccgatgatatcgcctcgtgctcaatccagaaaagtgcacgttcggagtaccatcgggcaagctgctcaggttcctcgtatttggcagaggaaccgaagaaaatcccgagaagatcaaggcaatcaagaacgtgaagtcgcccacaagactcaaggaagtacagaagctaactggatgcatggcggcactaagctggttcgtcgctaggatgggagaacgaggacaacctttcttcgctttgctgaagaaacaagacaaatttgtatggacacaagaagccgaagaggcattcatcgcactcaagcgctacctgtcaaacccccctgtacttgttactccccatcctaatgaagaattattcctttatattgccgccacgccatattccatgagtactgtcattgttgtcgagagagagaaggtgcaaagaccagtctactacgtcagcgaagctctccacgacgcgaagacaagatacccacagatccaaaaactgctctatgcagtaatcatgacgtcaagaaagctacgtcactacttccaagcccacagggtcacagttgtttcctccttccctcttggtgaagtcgtgagaaacaaagacgttgtcggcctcattgcgaaatgggtagtcgagctaagctagtttgatgtccactttgtgccacgaacagccatcaagtcccaggttctcgccgacttcgtagccgattggactatgcttgaaaacaggtcagacagtcaaaccgacaacgaaacatggacaatggcgttcgacggtgcactcaacagccaaggagcaggggcagggttcatcttgacatcaccttcgggagatcagttcaagcatgcaattcacctcaacttcagggcgaccaacaacactaccgaatactaaggactactcactgggataagagcagcagccgcacttggagtcaagcgactgatcgtaaaaggggattccgaactagtcgcaaaccaggtgcacaaagactacaagtggtctagccccgaggtagagttatccaagtacctcgcagaagtactcaggaagctggaaaaaagatttgatggaatcgaggtccgacacgtataccgcaaggacaacatcgaaccagatgatctagcacggcgtgcgtccagacgggagccactcaaacccggcacctctctggacgtcctgacaaagccatcggtgaaagaggcaaacgacgaagatagcacagttgcccccgacatcagctcgggggctacagaggcagagtgtgccattgccgacatcgagaccacagacggctagcggatcccactcattaaattcataagtagtgacaagttgcccgaggacgatgcagaagccgagaaaataacccgtcaagccaaaatctactgtatgatcggcaatgatctatacaagaaggcaccaaacggggtacttctcaaatgcgtctcgttcgacgatggcaaacatctcctcctcgacatacacgaagggatctgtgggtcacatgccgccgatcgcacattggtcggaaaagcttttcgacaagggtttttctggcctactgccctcaaagacatttgcgacatggtacagcggtgtgaagcttgtcaatttcatagtaaacacacaaagttaccagcgcaagcgttccaaactatccctctcacttggccgatctcatgctgggggctcgacatactcggaccattcccacgaggacaagggaagcgacctccacgggggaaatcaaggccgacagtgccatcaaattcattaaagagatattctacagatatggattgcctcaccgcatcataacggacaacggctcccagttcatcagtgccaacttccaggattactgcattaggctgggagtcaagatctgcttcgcttcggtttctcaccctcagagcaatggacaggtcaagagggcaaatggcatagtactacaaggaattaagacccgtgtctacgacagactgatgtcacatgacaagaagtgggttgaagaacttccctctgtactatgggccgtgcgtaccacaccgacaacgtccaacaaggagacacccttcttcctcatgtacggctcagaggctatgctccctactgagttacagcatcagagtacatgagtacataagtactccgacgaggatcaggaggaacagcgaaccgacgacgtgaatctactcgaggaacatcgagaaagagttgccgtcagagcagccagttaccaacaggcccttcgccgatatcacgagaagcgcatcagagcacgcacactttcgattagtgactacgtcctctgacgggttcaaagccaggcagggcgtaacaagctctcacccaaatgggaaggaccgtacacaatcacgcaagtcttgcggccgggtgcatttaagattgcagacggtgatggccgcgagttagcaaattcttaggaacattgatcaattacgtaaattctatgtataaatcaatagtatccatacttgtaagacatcttatagcttcaataagatttatttttaggtaaagattacaatcaaagtgttccttcccgacgatccctcaccacgataacacctagcattgaaacctaacctcatgtccctttacgccgtcttgacaaggcctccgaggaacctaagggaacttcggctggggacactcagagccgataaggccttgtcggatcatgaagggacaaaagaccatgtaagatcaggtcgtgtaagagttcttgccgcgcgtattaaccaagccgtgtaatcggaaattgggttttccaacttcactgctgggggctaggatcagtgcttgttcaaccaaggcaggtcaaaggttcaagagccttatcttcctagaaaaattctccgatgataaggctgggggctagggagagtgtatgactcaagtgactgatcgaagtcacgaagtgagaaaacactcatacacaacgcatctagagtaagaaaacttagttagatagatttcttttctatttcacaactacttcttacagttcgtaaatattccaaaatatattacatgtctccctgagatatttgtcacaggatataaagactaccaggaaggccaacgccagtccatggactggaagaccttctctgcaagcggcgcaatcgacttcgccagattatctatctctgcgggagtcctccgagaaggagaaaacccttcgtggaggaactcgaggtgcagctgcgggtggtgatactggatacaggccaacacgtgccctccagcatattggctcgatcgacgacactcctgcttaagggcctcatcgatacgcttgccgatgccttcaagctgagcacaggccccattcagccacgagatgtatccagccgctgactcctcggggtgcccgcgaggtactcggagttccctgcagactccggccatggccgtacaatagctcctgaggtacgagttgaaccacacctcgcgacctcggagtgcttctacggctcggtccttcttaacttctaccatagtcctctcgagttcagccacctcgaactttgtcctccaatattggatccgacgatctcggtcggccaacgcactctcgaggtctgctcaacagggaaatgactaagtcaagtcgtgcccctcttccgagaacacggcaaattaagtcgatccgaacaaaaagagcaaaggagatgaagaccaaagaacaaacctaaggaagtcgtcgccatgctcgcttccatggacaagttctgatctacgtagtcctgcagcacatatggctcgagcgcaagtgccgaaacgactaccggcgactcaggctgcccgcgctgctggacatcctcgacgtcgacatctctacgacgacaacaaagtactcaaaatcaacatgctaaagaaaacgaaggtgatgactgcatacacaaaagcagtttgaacctacgaaagttttacaagcgcaattgattaaggagtacaaggaggctgaaatcctactcttcaaaaagggggagacagactccccaagtcaccgtcttcttccatcacgcccttacgcgcgtagttagcagccccctgatctaagatcctctggaggtcgagttcagggtgcaccaaccttacgcacgtgaggtcgtggcacacctcggtgtagatcccgttggacgtctcctccccgatcctggccgcatgcttggaggggatctcctgtcacaccctaaaaatcctaaatatataaattgttgtttaattagaattattagaatttattttaaaagtctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaatgtttttaaaagtctcttttggctttgggccgaaagtcggcccaaaatcctctctctctctctccccggcccaagtcggcccagtccgcagccgccgcgcgcgcgcgttcggtcgctgacaggtgggtcccacctgtcggacccgtcgtctacctccggccgccgccgcccgaaccctagccgagccgtgccgccgtctccttccaaattcggccgcgtctttccttctccggtgaaatcaatagaggggaattgatcttcgggatctcctctaccttttctcttttggaatcaccgtcttattcgctttggaagttcgtggattcgaggtcgaatcggatcggtctctttcctccgaaccctaacctttccttcgcgtcgccggtcgccgtgggccttcgccgccgccctccaacccctataaaaggatcgccggtgtcgccgctacccgtcgccaccctcgccttcgtctctcgtcgtcggaagcgccctagcgccgtgtaacctcgtgccgccgtcgtcgccgccgctccagccgtgcttcgccgtcgctccagccgtcgccgtcgctcgggaaggtcgccatcgtggtcgccgtcgcgtcgccgtcctcgtccgccccttcgccgtcgctgtagaccgccggagcatcgccgtcgtcgtcaagccgaaggactccgccgccttttcctcgacgccgccgtcgtccgttcatcttccgccgttgtttggtcaccggtgagttcgccgcgccgcgctctacgtcctggtgccctccgtttgtgccgtagcgccgtcgttcaccggcgagcttgcgctcccgagccgccgccggagatgacgttgccgctgacgtcatcgggaccgtccgtcgtggcccggccgttgatcggttgatctcggtcgtccgttttggataggatcgatctcggccgtccgtttccgtgaaccgctgccgtgcgcccggtccaccgcaaaccctagccactgacgcaataattccctttttccttttcaaaaataattcattattgcgtcataattcaattaaaatccatataagtgttttaatccgatttaatctttaaaaattcataactaattcatattagctcggatttagttggttcaagtctctaaatttttctaaaattgagatctacatgttaaaaatatccacatgtactgttcatgcttgtttatatgctgttttggtgattttgcccttttctgtttagattccgatgtttccggagagtctgttttcacaggagaagaatttgaagagttccaaggccagcaaggcaagtcacacagatcccaaacaatcctttgagcatgttgatcccgcttaaagctactgtttctattcaactattacatttattttcgaatgtcattgggtggaattaacctattgtttgttatagccctttttgttcttgattcctttattccttgataccttgggttattttaacttgactagttgggctatatatattggttaagctagatgttagacgtgattgcttagccatgcttagaaacattagcacactattgggataacttatgattcactattatttaatgatggcttattgttagttcacgatggtcaatcgtgattggttagttaattaatgtgccaactaaaacttgataatggtgggttgtgagcacatggttttgagagtcgtgctcatgacaattaaggaccggttcacgtgtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgcgctgtggtggattgtgttgtgcaaggggtattgtcacagctcctttccgaggtaccgtggtggtattgaggcacatggtgacatgttgtggggctgtgtcttgtgggtacagtggtacacctctggccagagtaaaactattcgaatagccgtgcccgcgtttatgggcgggtctaacaatgtctttcgtgattagtctcacacctctcatcataataaaagatgctataactggtaataatttgattagctcctggtttggaatggtatattcctggtttggagatagatctgtacagccgggtatggttgttcagaatggtagggcctatacaatagggtatgttgtatagcgttggattaatattgtttaattattacttaaccgttttattaaattctgaaatgtttattaaatgctgtttatgcaaatgaaaccctactatgccatcctttggtatcctgtgcacttgcatatttgctgcgtggcttgctgagtatgtcatatactcaccttgcaatcattcatcagaggaagagttctacaatgatgctgatggtgtggaggattaggtgtagccctggtcaagctgcctgtggagtggagccgtctgcgccgtttatcttattttccgctgcttagatctttattgattgagaggaactatctacctctgtaatgacattttattcacttattaattagagtaataattgtactctattatcaatttgttattgtgtgcctcggctgattcctggacgagggttcacacacatgtaagcgtttggaattttggatagaaatttcgggcgtgacatctcctccatcgccgtggccagttccgcgagcgaagacatcagcgagaactcattgggattcaccgggatggtggtcgtaacaccgcactgcccggcgagctggtacaggccggtgtatgtaacccgcagcgagccacggatctccgataggttgttctcgagctctgacatgtggtgctcgagcccctgccgctgccgctcgttgccggccaccagctccctcatcttctggaggtcctcgcggacctccgccaggtcacgcgtcagcttgtcagcgcgttcgttcgccgacgacgccgccgccgccgccttcacctcctcaatctcgcgccctatgccgtgagcatctgcctggaggatgcgctccatctcgatttggaactccccccaggtgaggacgtcagcgggcgggccgcaagtaggcacaaggctgccggcagggccgctgggcgtcgcctcacggctcctgggcacgaccacgacatctgtcgaagccgctgcaggagacgcgctggagtttcctccagacccgtcttgcaccgctttcgcccgcgccgtcctatgaaggatttccgtgatttccatgaaggcaggctaccaaagttttgtgaattaaaagacctcaaattcatctagttacttctcaccaagtgtcaccagcctttgccggcgctgaggcgggggagacgcgtctaaggcctaagtaaaatgagcatggtgtaaggtcaagatcttctgactacgcgataaaggaccagaaaagctcaccaatggggtaggcgccttccgacgattcccaagcacagaggagaacttcctccctctcttcggaatgttgctgccactcattgtagcagcagcagcagcagcaatgtcagatgcctccttggcaatgccctctttcaatgaggccgctgcctggtggtccacgagcggcccgatgacgtcagtcagagggagagcctgcacgcatgaagtctcagtacgatccagaaaagcagaagtaaaggagttctcaaatacactcacgatgatcgtagcctcgcgatcagccttccccttctcacaaagagggatggggacgttgcttgccgtcgtagggccgctgatcatcacctaaccgacgcggtgctccacggttttgctgtttaaacctgtaagatcgaggagtagaactcgataagtatggaggaacatgcaaataaagagtgtaatccgaaatacgagaaaaataccccgaggagaaacccaggtcgcgtcctccggcccagaatagtcaaaggctaggtgggctcgggcctagagcggctgaatccacctaccgatgaagtcggcagcgacttcataccccgataaccctcgtactcggaggtcatcgatgacatcgatgaaagactgaagggaaggggttagggcaggtttggcggcccattcggaaatcttatctggttgctcctcaggaacaacaaagactagatccgaattttctatctgaagataaaaccacctcgtccgccatttgctacgagaagaggggcactgaaaggggatgtatcgcgacttcaggccatctcgaagccggaaaccaacacaccggacacctttttaggttccatccagcgcaactcatagtagaagcgaaagagatcaagaaagggctctaccccaatgtaggcctcacaaagatgggagaaaatactgagaaaggcgatggaattggggttcaggtggagcaaagaaagaccatagatattcaagacgagaagaagaaactcggagggcggaggaagaaaaccacaaagaatatagtcctcaaccgcaaccatgcggcccaggacaggttcgggttcaatacctcctggttctctctccatggtcccgcgacaagggagagcgccgtcctcctgcagcttcttcatggacgcgctggtggaagtggacttgtcgagatcactgttagggttacggataaggtataccctctacccttggatatacatcatgtatcgatatggtatatctacgcatatacggacattctctgtacacgttaaggaaattcatcacggagtccacagatggaaggattcctactcggatagaacagggtcgtcactgtatcgtgtagggtccgatgtctccgagttctacttggagatcaacacgtggcctgggagatctgcttaactccagtgcaggtccaaagctcaccttcggatatgttagcgtgccagttgattcgatcctgtaatcaacaagaaatagaaacaaagaaatcgtggttaaatctataaatgatagccgatcggctagatgccaacggcatatcatttatctttgagccgatgtcatctgtgtatcgatcgacaatcatgaataagtaaagaagaactaaatctactcgatcggctatagatattaacgatatatactccttatatcgatgtatacttaaatcaagtgattgggatagatcggtcatcatgccgagacagtatgaatcacttagaccgaaatatatatcaataacaggactatatatgtttatagcatagccgatcagatagatctagcatgtatcggctaatactctgatactactctatatgggctgcagga

SEQ ID NO: 42601 - DNA, 4264 bp, Oryza sativa
ataatatatcaaacaaaggtctaacatacttagatgcagtagtattttgatataagggcagatttaacatgtcaatagagcatatagaacaaatatagttaaatcagatacgatcggctgaaactctgatgctattctaatcggcaactagaaggcaggctagagattgatattctaagcacgacttaatagatcaaactcaactgatgcagcattaagtatgaaaagaagaacaatatctagacaatcaaaccgctagaagtctcatagaatggtagatatctcatataatctagatcaacatcaagatctaacctaatcggctgccttctgcatatagatgttagccgataataggttaggtggcgatattgctaaagattatgtaagatatatgataactcgacgaattatataaacaagattagagtatcataaagatggaagcactaatcctaagaacacaatccgtcataacgaattttacctcttgttgaagatcgaaattgatgcagctcaacccgaaagcaagaactcgtcgaaacaaaactaaagcaaaagggtggcgatgcgccaaaattgtattgaacgtgtgttgttaattacatagggctcggggtctatttatacccgagaattacaagatatgcccataccggacacgactattatctctaacaaactctaagataccataagtctttgcggcagacttttgcccacatttatctataaggaatttacataagatatcctaattaatagatacaattgccttcccaggactctatctatgcgtggcaatcatcttgaagtacattaacttgaacccgatatcgcgtacaagtcatattgtcgggatcggctacatcggcttacctagcccgactcagacccagccgatcttatcgtagccgatctggactccagccgattcctgctctgttttcaaactcgatctccgcttccgactttgcttcgatctaatcttctttcccaacgctgatgttaccaagtccgcaatatttggtaatgtttcggatttgctgtaaatcgactccgagcaagtttcgcactttaccgttttctgaccgttactgccgtgctttaaatactaaccgtcaccctcgagaaacctcacaccgtgacttctgttttctctttcttctccggcgactcctccggcgcaaaggcgatttctaggcgacttcctcctcgacgagatctccgcccgcaacaatgtcgtcttccgccagcccatctggtgcgccatcagccgaatatgctgaggtaagttctcatcggctaaatccccttctttagcagcagatcgatcttctcttatctcatattgctctcttcctctgaatctctttggatttgtagcacctctccaacctagttgcaattcccaacctgtcgcatgaaaaccactactttctcggcccagtcggcaatccagaccccgccgagttcactattggtgaaaccaataggatccccttcagattaaccaacccagatctaggtcactagaagaataccttcaagtcctggccgtctctagagaaagttccaccagaaaagagctggactacatggttcaaacgtgtatcagccggcaagagggtccactgggatgaaatcggaatcggccaagcacttgaccttactatagcaaagtcggccaaagatgaacccctgatgacagctgcttcttacttctggtcgaacaccattaaagcctttttgttcaatgaagggccgatgactccaactctcatagatatcagcatgatcacaggtctggatgtcaccttatcggccaaccctatgagtttgaacacaaagaaccaatatgacttcaagaccaaaagcataggaggttggtcaggctacgtaatggcatatatgggccagggctcggtcacccctcgggaacatgtgccttttttgttaatgtggctagaaaaatttcttttctgtggatcaagttgtggccccacaaccaactggcaatttctagctgaaactctagaaacaaagagacaattccccttgggcaaaattctcctcggctatctataccagatgttgaacaatgcatcggctaagatagccgtcggctcagtagttggagcaggtggaccctggtggctgctacaaacctggtcaaacctgctagttatgaaggttgtcaatcggccatccgtatcagaagctgagttcccaagactagagctgattgtaggagatgatggagaagagcgtactcatcggagatgcacatcatacggagaatatgcttctacaccaactgacactggggcaaaactatcggctgaactactcaaagattggttctgtagcttctatgaaggctttcaaaaaaatactcgagtttggtttctttatgaaaattctgcagaacttgaacacccattggacttcagattcgaagacatcaaccatgaagtataccaatcatccagggaaattttctcggctgcaatcagcccatgcatccttcctgttggcattcatcaaggaagaaacatccaagcttcttatgaattctatcatccaatgagctcaactagacaacttggaatgggccaactcccaattggcttattctttgccgacaaaatccaatgccgaggagaaatttcatcaaccctgatgatggatcggctgctcaaacttcaaggaccccctttgggcagtattaacaacatagaactgtcaacattcagaagcaaaaactttgacaggtggtggggcgaatggaagctgcatctattccaacaaccagcttcaatatatatgacagacctctttccagatgttgttcctcaagtaagtctttaactttgcttgatttcatttacatagttgtttggccgattaagctcaactaatcctccttttgatttgcagacaacagaatcctcccctcctcatcaaagcaacagtggcaaggacatccaatatgccccaggtttaattcctaacggaggtgggctatctcctccggttattggctatgatgcccccaagacctcagctcttcttcaagggctcatcagggaaccaaccgatgccggcaaaaagaggaaaaccagatcgtcggctgtaagcatcgcagctccaactaagaagaagaagaagacaaagaaaaccaagccagccgatgacctgcctaccctagatccatccattgaacaagctctggatgaagagataattgaagacgaagttgatcaggccgcagccgaagtaagcgatactaaaagaacaccatcggcttcgcctaagcaaacccctccaactccttttgctccggtccacttttcaagagtaagcaactttctttaattcctctcataattatttgtcttatagccgatcactcccaagttttataactgcaaaaaaagaagactgcggtgaagaagaaatcggctgcaacaacatctaaaccaactccaccagtaagatagttttaactttcattagttaattttcagctgattctgtctgacacttgtttcctttcagccttcccctcctcctgtacaacaatcgtcaagtgaccagaatgtcttagccgattgtggggtgtcatcacgtcgagaaagaagaacaaccagctgctcctgctatcccagtaagtttctttttgtctcaacaagcattcagatcggctatgactgtttctaactgcttctaaattgtcactgcaggtattagccgatcttttctcttttgacatcagagactatcttgatgaaggagaagaagataccacaagcaaagccttagcccctttatctgatgatgtgaagaaaactctaggaagtatcttgggtcggctagaagcatcatcgctagatagcttggtggttgattgtggctcaatcagggctcggctacatgagattcaggctctaatcccacatgagctagccgatatccttaccccagccgtttaccttgagcaacaccaattcaaattggagaaagccaagttaagactggcggaatggcgagagcgtaaggacattgaggccactatccaagccaaccgacaacttgtgtatgaagaaaaatccaagctcgatcaactatctgaaggcccaatcaagtctaatattgatcggctcgaggctcgcaagattgaactcttagcacaacttgaagaatgcaacgctgagctggacatggaacacaaaaaactagccgatctcccaaagtctattga

SEQ ID NO: 42602 - DNA, 2287 bp, Oryza sativa
aggctatatcggccatccagcgatactaatcttaataatctttgtgtaataggacttagaatttttgtaatcggctaagacattctgatactttattgtcttaacaatcctttgtgccaattaatatgacttcaaaatttgctcaaaaattttgcactgcattttgatatatatgtgcccccctagttttacaatgtcaagagcattgataaaattataaaacaactaagggcgatataacaatatcggtcattgtacatcggcaaaccacaaccgattacaccatgaaaaacaactaagggcgatataacaatatcggccattatacatcggcaagccacaaccgatgacactatgaaaaacaactaagggcgatagaacaatgtcggccatcggaaggcgatgtaaacacatcggctgtcatgcatcggcaatataagtcgatcatgcattaatccaaacacttgggtaatatttcttcaaatatttgccattgagcgctcgcccataatcttcaccatcaagcccttgcaacatatatgctcccttagacacaaccttatgaatttggaatggtccttcccaattcagcgaccacttgccgaatttactatcacgagtaccaatcggcaaaatcagcttccatacaagttctccttccgaaaaatctttaggtaccactttcttattataatgccgagcaacacattccttatccttaataaccttcgcaagggctcgcaatcgtgactgaaccaaatcctccctcttatcagccataaggttgtaatactcatcggctgttaaatcgttttgcaactccgttcattgagagccatttctaacctcccatggcaaaacagcctcatgcccataaacaagtttgtaaggaggaacttgaatcgaaccatgacaagccatcctataagatcacaatgcttcggccaaccgagtatgccattgccgaggataatcaaaaattttctgcttaatcaatttgatcaaacttttattagacgcctcggcttgcccattagcttgtgcataataaggagaagaattcaacaacttgatacccacgctatcggcaaactgaacaaactcatcggacacgaagattcatccttgatccgtagtaataatttgaggaagaccaaatcagtagattatatgctcctgaacaaattaaatagcatccccataatcaactttcttcaaaggaatcgcctctacccacttggtgaaataatcagttgccaccaatataaatttatgtcctttactcgatgatgggtttatcataccgatcatatcaattccccaacctctgaacggccacggcttaataataggattcatagccgacgccggtgcttgctgaatagctgcgaacttctgacaatcctgacaccccttataatatctgaaacaatcttccagcattgtcggccaaaagtaccctgcacgccgaagcaaccacttcatcttgtgagccgattgatgagtaccacagatcccttcgtgaacttcgccaattgcaaccttagcctgatcggcactcaaccacttaagtaatactccatcaatcatccgataataaagctcatcatccaacagtgtatactttagtgccttatatcttaatttcctagaagccgattgagatggattactcaaatactgatgcacatcgtacctccaatcatcggctgacatcgctgcaatttcaactttaacatctttgatcattggcttataccccgatgccccttgagctaaatcattagcttcaagattttgttctcgagatacatgctttaaagtaaccagccgaaactctttcattagttccaggcacttctcgttataaaccatcaatgtatcgttcttgcattcatattctcctgccaattggctgattactagcaaagaatcgcccatgatttcaatggtatcggcttcaacttccttgagtaattgcaaccccttgagcactgcttcatactcagcttgattattggtcgcatatggtttaatagtataagcaaactcgaaacatgccctcctaggggaaattataactaagccgatgccacaaccatgagtacataccgatccgtcaaagaataaagtccatggcactatctcaaccgagccgattgaatcatcacgatgctctacattaaaatcggctatagcttgtccctaatcgctttcggtgattcataccgaagatcaaactcagtcaaggaaaatatccactttccaactcttccctttaatattg

SEQ ID NO: 42603 - DNA, 15331 bp, Oryza sativa
ccatttttgctaataaatgtcagccttggccgatcgcctggacctatgtctatttctcccaactcatcggccgacatgaaaccttgaccttgcttgtcatcgagatcatctactgtatccttagcatagacatttgaaccctccacgacgccctcaaagtaatagcttgggttctccatcttcgattggctgtatatcagaatcggacacttttagaaaatctccatcccagacttttccagataaacaatcaaggccatccatctcccaaagggctaaatcagcactggcaacattaactgacctgtcggctagcacgatctctatcttgtcgccttgccattgaatcaagcattgatgcatagtcgaagggatgcaacaattggcgtgaatccaatcccttccaagcaacaagctgtacgaacccttcccatcgatgacaaaaaacgtggtaggaatagtcttgctaccgactgtcagctccacattgagaacacctctggtttccgatggattaccaccaaagtcgttgagcaccatatttgtcttgatgagatcctcggcgttcctacccagcttcctgaacgtagcataaggcattaaattcaccgcggcccctccatcgaccatcatcttagacatcggcttcccattgacgtagccgtttatatacaacggtttaagatgccgattctctgtcccctcgggtttctcgaatactacatgttctggtgacagaaccaacttagtcgatccctcttccacttcatcgacatcggcctgatcgatcccgaattcggctggcaatgtaaagaccatgttaattggtgccgctacaacactcttcccttttgccaacctcttcgcctcatcggctgcagcatcatcggctataggaacctgattcttgacacgccactcctgtcttggctttggtttcctcagccgatgattgatttcctcttcaacctcctgaaaacgctccctattcctcaatctctggacccttcttttctgattcttcgtgaaaataccagaaggacaccattgattcttcttgatcacttcatcctcttggccacgatcttgattcaccggacccaaccattgataaacaggaagtcttgcctgtcttagccgattacccctattatacaatcggctcgagctctcgatgatatcactgcatctagggtagttttcgatagatggcaacctcatcccttcattccagcagaatctgaagaactcacaaccccaatggggatcaaaaccatcgtcgtattcttcataatgcccctcctgctgcttatcatacttcctttgatacttgttgataatcttagccgaatttacttgaaaaccctttgcacgggccctatcggctgcttgactagctgtatgcaccatattaacaggaaaatgattaccatcgaccttcatcggctttttggaatcaacaaacctaatctttcccccttcaatggcaacctggatttgttgtctaaaaaccttgcaatcgttagtagaatgagacccagaattatgccatttgcaatatctcttcttgcctaattcctcagccgatgggattgtatgaccagcaggaagcagaatctgcttttctcggtgtagtaaatcaaagatcttgtcagccttggtgatatcaaaatcatacttctcctcctttccaggactttttacccattggcatggtatgactttttttgctcctcacccattcggctgcagctatttcagaatcatcttcctcgtcatccgacccatacatgtatggacaaacatgattaactttcttagagcttttcctgacttccgccgacctatgctcatgcaaggttaccttctgtatcagatgcgataagctatcaaagtcttcggacgagaatttctcccttattggaggaatcataccctggaaggccaaatcggctaattgagcatcagtcaaactcaagctaaagcatttgttcctcatctccctgatcctctgaatatactcatgcacgggttcatcatgccgctgcttgatcgctgtcaagtcggacaacttcatctcatgaaccccactgtagaaatagctgtgaaattgcttatccaaatcggcccaactattaatcaacccatatggcaaagaagaaaccaagtaaaagttgatccagatagagataaccggaataacctaactttcaaagcgtctacagccgatgcttcaccgcactgagcaaggaatcggctgatgtgctcataagtcgacacgccctcttgtcccgaaaacttagagaaatctggaactttaaaccgattggggagagggactctttcaaaccactcaggataaggctgccgatacaagtttccattctcttttagtttaagcccaaattgttctctcattacatcagcaatcacatcggcccacggtcgttgctgagctgctccttgtggctgttgttgcataggctcgaactgaccatattgagatgcgaactggggctgagccaatccccctaattaatatggggcttgcggggaaggaggctgatattgatagctcaagttactgtcacaccctaaaaatcctaaatatataaattgttgtttaattggaattattagaatttattttaaaagtctagaagagaagatctaatttttaattaataaattccaatataaaatggggccagataaaatttcattaaatactttgcttaattctataattcctagatttttctgggatttatttgagctaaggaagtatttttaataaataaaattgcatttcatgaataatttaaattgaaaaaggtttttaaaaaagtctcttttggctttgggccgaaagtcggcccaaaaccttctctctctctttctcggcccaagccggcccagtccgcaaccgagccgctgctcttctctctctctcccgctgacaggtgggccccacctgtcagggtcgtcgtcaacctcgcgccgccgccgccgccgcccgaaccctagctgagccgtgccgccgtttccttccaaattcggccgcccctttccttctctggtgaaatccattgaggggaaatgtttcccgagatctcctctaccttttcctttttggaaacatcgtctaaatcgctttggaaattcgtggattcgagttcgattcggatcggcctctttcctccgaatcctaacctttccttcgcgtcgccggtcgtcgtgggccttcgccgccgccctctaacccctataaaaggacccccggtgtctccgctacccgtcgccacctttgcttttgtctctcgccgtcggtagcgctctagccccgtgtagcctcgcgccgccgtcgtcaccgttgctccagccgtgctccgccgtcgctccagtcgtcgctgtcgctcggggaggtcaccatcgtggtcgccgttgcatcgccgtcctcgtccgcccctccgccgttgctgtcgaccgccggaacaccgccgccgtcgtcaagccgaaggtcgccgccgcttcttcgtcgacgccgtcgccgtccgttgatcttccgccgccgttttggtcaccggtgagttcgccgcgtcgccctctacgtgctggtgccctccgttcgcatcgtcgctccgtcattcgccggcgagtttgcaagcccgagccgccgccggtggtgacgtcaccgctgacgtcatcgtcgtcgtctctcgtggtccggccgtggaccggtcgatctcggccgttcgttttggataagatcgatctcggccgtccgtttccgtgtaccgctgccgtgcgcccggtccaccgcaaaccctagccgctgacgcaataattcccttttccttttcaaaaataattcattattgcgtcataattcaattaaaattcatataagtgttttaatccgatttaatctttaaaaattcgtaactaattcatcttagctcggatttagttggttcaagtctctaaatttttctaaaattaagatctacatgttaaaaatatccacatgtactgttcatgcttgtttatgtgctgttttggtgattttgctcctttctgtttagattccgacgtttccggagagtctgttttcgcaggagaagattttgaagagttccaaggccagcaaggcaagtcacacagatcccaaacaaccctttgagcatgttgatcccgtttaaagctactgtttctattcaactattgcatttattttcgaatgtcattgggtggaattaacctattgtttgttatagccctttttgttcttgattactttattccttgataccttgggttattataatttgactagttaggctatatatattggttcagctagatattagatgtgattgcttagccatgcttagaaacattagcacactattgggataacttatgactcactattatttaatgatggctcaatgatagttcacgatggtcaatcgtgattggttaattaattacttgccaactaaaacttgataatcgtgggttgtgagcacatggttttgagagtcgtgctcatgacaattaaggaccggttcacgagtttcggttgtgaaacattaaccgtgccaaccacaagccagcgtgggcaacggctttaccttttgtatagcttggttcattgcggagcaccagactgagaagtggcagagataagcccacgggggtcgctggggagtccatgccttgtttataagggggtgattatgatccaggaaaggtgcgctgtggtggattgtgttgtgcaaggggtattgtcacagctcctttccgaggtaccgtggtggtattgaggcacatggtgacatgttgtggggctgtgtcttgtgggtacagtggtacacctctggccagagtaaaactattcgaatagccatgcccgcggttatgggcgggtctaacaatgtctttcgtgattagtctcacacctctcatcatgataaaagatgtataactggtaataatttgtttagctcctggtttggaatggtatattcctggtttggagatagatctgtacagccgggtatggttgttcagaaaggttgggcctatacaacagggtatgttgtatagcgttggattaatattgtttaattattacttaactgttttattaaattctgaaatgtttattaaatgctgtttatgcaaatgaaaccctattatgccatcctttggtatcctgtgcacttgcatatttgctgcgtgacttgctgagtatgtcatatactcaccttgcaatcattcatcagaggaagagttctacaatgatgctgatggtgtggaggattaggtgtagccctggtcaagctgcctgtggagtggagccgtctgcgccgtttatcttattttccgctgcttagatctttattgattgagaggaactatctacctctgtaatgacattttattcacttattaattagagtaataattgtactctattatcaatttgttattgtgtgcctcggctgattcctagacgagggttcacacacatgtaagcgtttggaattttggatagaaattccgggcgtgacaagttggtatcagagccaggttgaccctaggttatgccaaatggttacccatagaagccctctaaaaatattggaaaagtagaagtgttctcctccccttctcttctaattaaaccaaactaatagcacatgcacttcataatctcttttaatggttctcattcaaaatttattccagtgttattagtaccgtacatctattactgtactaatggcttatttactagcaaaagttttacaatattgttttatttaatcttgctgtaattaaataaatttagcatgttttcgtttatttcttttgaaaccggttgttcaaaagtacaaaatttgtgacctcgtttccaactgtttcaacttatcttgcaagcttggtttactttatttacttaccttttactttgattttctaactttattcaaattaaaaacttgtgctattaattagatagatgtcttaactccctcctttcacttgtctttagatgccgcgctacaagcctgagtacttgtttggtgttgagggatttgtccaggagttgcgtacgatgtcctttgccataggatttgggactgcccttttttatgcccagattcctcatgatcgtcacgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcaatcgctacagtgatcggttggccgacactgagtatcactaccatcctcgtcaaccacagggaagtgaccgtggcagctaccttgagactgaaggaattgagaatgatgctaccacaaggcatttggttgagatgctgtgggctatgatgaaacccgtgcagagactgtgttagcagctcaagatcgtgaagaccggaatcgtggtaagatttgcaagctagaggacaaggtggatcgtttggagaaggaactagccatgttgaagggagaagcaccaccgcagaaggccagggttcgttttaccgcaaggaagagagctctatttgtccctcgctaccaattggcgccaaaggtccgtgtggtggagaaagaagttaccccagccctagcggatcctccggtcgtcaacgtaagtgatgatgaaggagaagaatccaagcgcacccattccaagatcgagtggggagccactcaagatgatgaagacgagccgaacgagccttcaatcaactccgatgctcggaagacctagaatgccttgtcaaaccgttgacttagatcgttgtgttagtttgcttgttttaagtttggttgtgtgtgtgggtcttgcgtgtgatttacatcagtggtgggatgtaagtgcatgcgtttgtttgctttcgagtgttaggtagttggtgagtttagtggtgtgagagtcttcagttttgtaataatgaaactcacttaagatcaataaaagtcaaattaatttgctgtcctaagtagttttccccggtttctcttcttgtgcttctgcccatgccagatggtgctcactcgcagcaacgggaatggccccaacaacaacaacaacaacaacaatggagagaatcccacacttgcccaagtcctggctcaacaggcacagcttatgaacatgatgatgcagcaactccagaaccagcagaaccagggaaataaccatgcacctccccagaacaagttagcagaatttcttcgtgtgaggccgcccactttctctagtaccactaatcctgttgaagctggtgattggctgcatgccatagaaaagaagttggatttgcttcagtgcaccgatcaggagaaggtctcatttgcatcacatcagttgcatggccctgcctctgaatggtgggatcacttccgccttaacaggacaactgctgaacctatcacttggcttgaattcaccgctgctttccggaagacgcatataccatcgggagtggtgtctctcaaaaagaaggaattcaggtcgctcactcaggggtctcgctctgttaccgagtatctgcacgagttcaatcgtctggctcgttatgctccggaagatgtgcgcactgatgaagagcgtcaggagaagttcttggaaggacttaatgatgagctttcttacccactcatgactggggaacagaagaaatgccggattgctcacttcaaggcacaacaggggaatagtcagaggccgcgtcttaccttaggaccctagaccatgccacagggaggttcttcgtctgttgttcgtccgcagcgtcagttcttcaacaacaatgctggcaacaacatccgcaatcaagctccacgccctattgcagcttcgacaccgcaacaacctgccaagagggagcaaggcagcaagcccggggtgtgcttcaattgtggagacccaggacattacgctgacaagtgtccgaagccccgacgtgtgaaggttgtccctgaccagagcaactctaccgtaccagcatcaaaggcccgtgtcaatcatgttgttgctgcagaagctcaagatgctccagatgtgattttgggtacgtttcttgttaacttagttcctgcaacagtgcttttcgattctggtgctacacattcattcttatctatgagttttgcgagaaatcatgggatggaagtagaagatcttagacgtcctttgatggttagtaccccaagtaatcaggcactctctttgcaacgtagcccctctgtcagaatagaaattcaaggagtaccatttctggccaatcttatcctgttagaatccaaagaccttgatgtcatcctagggatggactggttagccagacataaaggtgtgatagactgtgctaacagaaaagtaactctcaccagcaatgatggtcgagttgtaactgttcatgcattgtcttctgagtctttgagatcaaaactgaaccaaataactttggaagagattcctatagtccgggagtatcccgttgtgttcccagacgatttacctggtatgccgcctaaaagggatatagagttcagaatagatttggtaccaggaacaactccgatccataagagaccttatagaatggcagccaatgaattagcaaaagtcaagagacaagtagacgatttgcttcagaaaggatacatcagaccgagttcatctccgtggggagctccggttatttttgtagaaaagaaagatcatacccagaggatgtgtgtggactatcgtgcactaaatgatgtgactatcaagaataagtatccgctgcccagaattgatgatttgtttgatcagcttaaaggtgccaccgttttctccaagatagatcttcgatcagggtatcatcagttgagaatctgtcacgaccggaaataacccaacgggcgttccttacgtgcgtgcattattccttgtcccaggaggcaaggtacaccaagagttgatacagttcagagttcaacaagcggaagcgtaaatagttaatttactacatgggcggcgaaggcccagcacacacaaagacaaacgggaaacagcggaagactagggcgacgaccacaggcgcttgacggcaggcacgagctagacaccaaagccttcatcttctagggactcctcttctgggtttgggaaaaattgagcaagactgagtacaaccaccgtactcaacaagacacacccacaagtgcagaataaatgcagggaagtacaagggggttataatataaagggttagggtttgcagtaaacagcattaaaagacacttagttgctcgaagctattttgtaaacacaattctagagctatacaatattattaatcaaggccgtggacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggtgcggctattcgaatagattatactctgatcagaggtgtatatctttacccacaagacacatcttcctcacgtgtaaccacgtgccgcataccaccacggtatacggacggaagacgtgacatagtttccaacccatcctagccatagacaagagtaccgacccaaccccacctacggccggaacctccgggacaggtaggcaggattgagcccctagcagcaggacaccggccctgtgccatgacatctcgactactgggccgcagctcgtgtagccttcaattgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaatccaattccacaataatccaacaattccctagtgtccaggtgataagagtattcccaaggtctagagttgtaaaaccacctaatgttgcctaattaaccagcgaagcatctacctaaaatcatactagtggtaccatgagtagagtgtccactagttggggttttgtttaatctagggtgaacaaggtaataataacaataataataataataaggtcataacaaaggtaaataggcatggctaaataaaacagtgataacgcgggaatttaaataaagcggtaatgcaataatttaaatcaaaataattttataaactgggattcaatatgtttcaggatgatgtgacttgccttgctcgctttcccaagcgtcggcttcaacctccgcgaagagacttcccctcccctcggcttcaacaaaaatgggttcttgacttcttaaggaaaaattagagacttgaacggtccaattccgagttcaaatggccaagttatggtcatttgaagtttatatgctctttaaatgaatatttgcgaatttcttcatttaaattttaatttaaaaagggtttattgcatcagccgaggggagggggcgcgcggaccgggtccacgggagtggggcccacgcggcagcctcacggtccacggtggaccgggtgcacccggctcacaccggccggcgccgtgggccccacccgtcagccacacccgagggcgcgggcggctgacggccgagccccacgcggcagccactcggcgcgcccgagggcggccaagccggcgcagccggcgggaggcggcgcgcctgtgccccgatggtcgccgccggctaccaccagcgcgacggagcggcgcccgagagaggggagggaaagggggaaacgaagcggcggtccacggctcaccccgggtcgacggcgacgatggaaacggcgaccggagcggaggaaggcggtggcgcggctcgggtcgacggggtcgacggcgttccggcggtcggcgagcgaaacagaggggtggacgaggtcggtgaggatgcggcgaagccgaaggaggcggcgtcgaggtgggaggtggtccggggcgacaacggcggcggaccggagctcggcagcgacggcggagagagagagcgacggcgcgagctcgattccggcggggagagagggcggcgagtggcggaaacggtggtggggagctcggggagggtttatatagggttgggagtgagagagggtggccggaggagggggaaatgggcgcgggagacccggccgccattaatggcgccggcgaggttaggggaacggtttccaaacgaatccgagggagagagggagggaaaaatggggggaaagggggagggaatcacggggaataattccccccactttatttcgcgcggggacggcgggaggcggcgggattcgcggcggcggcggcggcgctagggcgcgggcgaggcggcgggagcggcgggaggaaggggatgacgggtgggccccacccgtcagcgagggtggcgggtgggcccgcccgtcagcggcgcgcgcgcggggagaggccggatgggccgcggggagaggagagggagggggaaggagatgggccgagccggcccaagagggagagggagggaaaggggactttttagagtttttcttttttataatatcattttaactttgtttatttcttaataattattatttgtgctctgaaaattccactaaaatttatttacgcattttaggcttttaactttgcacattttaattgttggaggctttcacatggattttaattattctaggcaccatttagaggatatattttagggtcgttttgggacgtgacagaatcaaagaggaagatatacctaagacagcttttaccactaggtatggattgttcgaatgtactgttatgtcttttggacttaccaatgcccccgctttcttcatgaacttgatgaataaggtgtttatggaatacctagacaacttcgtggtagtctttattgatgacattcttatctactcccgaaccaaagaagagcatgaagaacatcttcgccttgcactagagaagctacgagaacatcaattgtatgctaagtttagcaagtgtgaattttggttgtctgaagtgaagttccttggtcacgtcatctcagcaggaggagttgccgtcgatcctagtaatgtggaatccgtaaccaactggaaacaaccaaagacagtttcagagattcgccgtttcctaggcctcgcaggatattatcggaggtttatagagaatttttccaagattgctaagcccatgacacgactgcttcagaaagatgtgaagtacaagtggtcagaagaatgtgagcagagttttcaagagttgaagaatcgcttaatatcagctcctattttgattttacctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatcttgagttagctgcagtggttcatgcgttgaaaatttgacgtcattatcttttcggtactcgtacagaggtgtacaccgatcacaagagtttaaagtatatctttactcagccggacctgaacatgagacaacggagatggttggaattaattaaggattatgacatgggaattcattatcacccgggaaaggctaatgctgtagcagacgctcttagcaggaaaggctattgcaatgctacgaaaggacgacagttgccattggaattatgtaaggactttgaaagattaaatttgggaattgtcagtagaggtttcgttgcagccttagaagcgaagcccactctaattgatcaagttagagaagcccaaattaatgatcctgatattcaagaaaccaagaagaatatgagaagaggaaaagctatcggtttcttggaagatgagcagggaactgtatggttgggcgaaagaatctgcatccccaacaacaaagatttaaaagatgtaattctgaaagaagcccatgatactttatactccattcaccctggtagtaccaagatgtaccaggatctcaaggaaagattttggtgggcaagtatgaagcgtgaaatcacagaatacgtagcagtatgtgatgtttgtcagcgagttaaggcagaacatcagaaacccgccggtttgttgcagcctttgaagattcctgaatggaagtgggaagaaatcggtacggatttcatcactggtctacccagaaggtcatcaggccatgactctatttgggtgatagtcgacagacttaccaaagtggctcatttcatcccagtaaagacaacctattccggaagtcggttggcggaattgtatatggcaaggattgtgtgtttgcatggcgtccctaagaaaatagtgtctgatcgaggcagtcagtttacttcaaatttttggaagaagcttcaggaagagatgggttctaagctgaactttagtactgcttatcatccgcagacagacggacaaaccgaaagggtgaatcagattttggaagatatgttgagagcttgtgctttagacttcggtggaagttgggataagaatctaccttatgcagaattttcatacaacaacagttatcaagctagtcttcagatggctccttacgaagcactgtatggtcggaagtgccgcactccgcttttgcgggatcaaacgggagaacgtcaggttttcgggacggatatcctaagggaagcaaaagagaaggtaaagatcattcaagaaaggttgcgtgtggctcagtctcgccataagagttatgccgacaatcgtcgcagagatttgagttttgacgaaggagattatgtgtaccttcgtgtcacgcctcttcgagaagttcatcgttttcacaccaaaggaaaattggcaccgcgttttgtgggaccttataagattgtcagtagaagaggagaggttgcttatcagttggaattacctcaatttttggcaggagtccataatgtgttccatgtgtcgcaattgaaaaagtgtttaagcgtacctaccgaagaagctaatcttgaacagatagaagtccaagaggatcttacctatgttgagaaaccaatccgtatcttggaaatagatgagagaagaaccagaaatcgagttatccgtttttgcaaagtccaatggagtaatcactcggaagaagaatcaacttgggaacgagaagatgaattgaagtcagctcatccgcatctgttcgccagttcttccgaatctcgaggacgagattctgtttaagggggctaggtttgtcacaccctaaaagtcctaaatatataaattgttgtttaattggaattattagaatttattttaaaagtctagaagagaagatctaatttttaattaataaattccaatataaaatggggccagataaaatttcattaaatactttgcttaattctataattcctagatttttctgggatttatttgagctaaggaagtatttttaataaataaaattgcatttcatgaataatttaaattgaaaaaggtttttaaaaaagtctcttttggctttgggccgaaagtcggcccaaaaccttctctctctctttctcggcccaagccggcccagtccgcaaccgagccgccgctcttctctctctctctcccgctgacaggtgggccccacctgtcagggtcgtcgtcaacctcgcgccgccgccgccgccgcccgaaccctagccgagccgtgccgccgtttccttccaaattcggccgcccctttccttctccggtgaaatcaattgaggggaaatgtttcccgagatctcctctaccttttcccttttggaaacatcgtctaaatcgctttggaaattcgtggattcgagttcgattcggatcggcctctttcctccgaatcctaacctatccttcgcgtcgccggtcaccgtgggccttcaccgccgccctccaacccctataaaaggacccccggtgtctccgctacccgtcgccacctttgctttcgtctctcgccgtcggtagcgctctagccccgtgtagcctcgcgac

SEQ ID NO: 42604 - DNA, 1031 bp, Oryza sativa
ataagtgttttaatccgaattaatctttaaaaattcgtaactaattcatcttagctcggatttagttggttcaagtctctaaatttttctaaaattaagatctacatgttaaaaatatccacatgtactgttcatgcttgtttatgtgctgttttggtgattttgctcctttctgtttagattccgacgtttccggagagtctgttttcgcaggagaagattttgaagagttccaaggccagcaaggcaagtcacacagatcccaaacaaccctttgagcatgttgatcccgtttaaagctactgtttctattcaactattgcatttattttcgaatgtcattgggtggaattaacctattgtttgttatagccctttttgttcttgattactttattccttgataccttgggttattataatttgactagttgggctatatatattggttcagctagatattagatgtgattgcttagccatgcttagaaacattagcacactattgggataacttatgactcactattatttaatgatggcttaatgatagttcacgatggtcaatcgtgattggttaattaatgtcacgtcctgataaattcatcccgaaataaaaatcattttctaaaaggaataatagaattaattaaaattcgaaaagaaattggcaaacactaaaatacgtacaagaaaaattcaaatgtggcccggagaatttttgttaaattctctttggtctaaaaagagccctcaaattttagtggaattttcagagcacaaataataattattaagaaataaacaaagttaaaatgattttataaaaagaaaaatcctaaaaagtcctttttccccctccccctcttgggccggctcggcccatccctccccctctctctcttcttccccgcggcccattcggcctgctccccgcgcgcgcgccactgacgggcgggcccgcccgccaccctcgctgacgggtggggcccatccggcatcccctacctcccgctcgttcccgccgcctc

SEQ ID NO: 42605 - DNA, 9950 bp, Oryza sativa
ccccctaaacctcgccggcgcatcaatggcggtcgatcttccgcgcccgtttccccctcatccggccgccctctctcactcccaaccctatataaaccctccccgtgcctccctccaccgtttccgccactcgccgctctctctccccgctggaatcgagctcgcgccgtcgccctctctctccgtcgtcgccgccgagctccggtccgccgccgttgtcgccccggaccacctctcccctcggcaccgcctccttcggcttcgccgcatccccggcgacctcgtccacccctccgtttcgctcgccgaccgccggagcaccgtcgaccccgtccacccgagctgcgccgccgccttcctccgctccggtcgccgtttccgtcgtcgccgtcgacccggggtgagctgtggaccgccgattcgtttcccctttccctcccctctctcgggcgccgctccgccgcgccggtggtcgccggcggcgaccatcggggcgcgggtgcgccgcctcccgtcggctgtgccggcgtggccgccttcgggcgcgccccgcggctgccatgtggggcccagccgtcagccgcccgcgccctcgggtgcggctgacgcgtgggacccacggcgccggccggtgtgagcccgggtgcgcccggtccaccgtggactgtggggctgccgcgtgggccccacccccgtggacccggtccgcgcgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgcagacgctgcagcttcggaggatccgctcttcgtggaagttgaagccggcgtttgggaaagcgagcaaggcaagtcacatcatctttgaacatattgaatcccagtttataaaattatgatgatttaaattattgcattatcgctttatttaaattcccgcgttatcactgttttatctagccatgcctatctacctttgttatgaccttattattattgttattgttattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacatggctagtgtcctgctgctaggggctcaatcctgcctacctgtcctggaggttccggccgtaggtgggattgggtcggtactcttgtctatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccaagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaagttcgtgcgggttaacgaccttgattaataatactgtgtagctctaggatcgtctttttaaaatggctttgggcaactaagtgacttttaaatgctgttttctgcaaaacttaacccctatatcattaccccttgtaccccttgcattaatcgtgcatccgccggtgtggcttgctgagtactgtggttgtactcattcttgctctatctttctccccccttcagtaagagaagctttggagaagatgtcttaggtggagtcttggcttacaccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtacctcggcttttcctgggacggggattaatacactagcgttcgggaaaatgcaattttctcggtcgcgacaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcttggttcattgcggagcaccagactgagaagtggcggagataagcccacgggggtcgctggggagtccatgccttgtttataagggggtgattatgatccaggaaaggtgcgctgtggtggattgtgttgtgcaaggggtattgtcacaactcctttccgaggtatcgtggtggtattgaggcacatggtgacatgttgtgaggctgtgtcttgtgggtacagtggtacacctctagccagagtaaaactattcgaatagccgtgcccgcggttatgggcgggtctaacaatgtctttcgtgattagtctcacacctctcataatgataaaagatgctataactggtaataatttgtttagctcctggtttggaatggtatattcctggtttggagatagatctgtacagccgggtatggttgttcagaatggttgggcctatacaacagggtatgttgtatagcgttggattaatattgtttaattattacttaactgttttattaaattctgaaatgtttattaaatgctatttatgcaaatgaaaccctattatgccatcctttggtatcctgtgcacttgcatatttgctgcgtgacttgctgagtatgtcatatactcaccttgcaatcattcatcagaggaagagttctacaatgatgctgatggtgtggaggattaggtgtagccctggtcaagctgcctgtggagtggagccgtctgcgccgtttatcttattttccgctgcttagatctttattgattgagaggaactatctacctctgtaatgacattttattcgcttaataattagagtaataattgtactctattatcaatttgttattgtgtgcctcggctgattcctggacgagggttcacacacatgtaagcgtttggaattttggatagaaattccgggcgtgacagttacccccttggtaattatgaagattcggctggatgttgcgcaccaagtgttcaggaaccatctgaggcatcactgtgccgtccggctgtgcatggtgaaccaaatgttctaggatgacctaatttacaaactgctgtataggctgaccaccaggtactgtgaacccggccgatgcattcactgaccccgggtgctgaatcggctgaacgatctgctgtctcaacggagtctgttggatcggctgctgaggctgctgccttggtggcgtctactgaatcggctgcagaggctgctgccttggtggtgtttgccgagccggttgtacgacctgttgttggattggttgtacaaccgcctggattggtggtgtctgctgaatcggctgctgctgcactggatcaacaatcggtggaggtggcagaaacaaggcagcaacttgatcttgggttagccgattcgtagcctgcccgccatgctgtggttgttcccttgttaacaaccaagggttcaccggctgttttggcgtcatagctagtgtaccaggcaaaggagtcgacgctggcgctgtcggctgggttgtgggtgcaacagagggaactgcttgaacagatggctgaacatcggtgatcaaagatcgataatttgggaagacacctccttgcaagtaaactgggcctgcagcctgatgctcagctatcaaaccatcggctattgtcttcatcatgtttgacaatgtattgactaataccccggactgattgatcaaagcatgatgcacagcgtaatcaacccgatcttggaagttattgaaaaaatcttgcgctagttcactattctggttaagatttcctccttgcggctcctgactaccatcaccttgaacgccatgaactccttgagaattgtcgccttgatcgctcggggagtcgtcggtagcacctttagtactcggctgagctgagccacctggagcttgtttcacttctccatctttggaagaaccagtcccaggactatcagcaaccacttttattttatacttctgaacaagtgtccccttgcgggtctgcatgaatgagttcagaaactgatcccgtgcctgctgcagcgttgcttcaaactcctccttctgctcaggtgtgaatttctctggatcgatcggcatgacgttgtcatcaatgatgtcagtcaatcccagcttcaacgccttgcctttaacggagcctgggctagatggtggtggtggctgtttctcggccatgaggaagaactgacgtctgacttcttagaggtcccaccaggcgtgccaaaagcgtgttgacagaaaacacgtggcctgggagatctgcttaactctagtgcaggtccaaagctcgccttcggatatgttagcgtgccagttgatttgatcctgtaatcaacaagaaatagaagcaaagaaaccgtggttaaatctataaatgatagctgatcagctagatgccgatgacatatcatttatctttgagccgatgtcatctgtgtatcgatcggccgccatgaataagtaaagaagaactaaatctattcgatcggctgtagatattaacgatatatactccttatatcgatgtatacttaaatcaagtgattgggatagatcggtcatcatgccgagacagtatgaatcacttagaccgaaatatatatcaataacaggactatatatgtttatagcatagccgatcagatagatctagcatgtatcggctaatactccgatactactctatatcaggatattaaagcaagaataatatatcaaacaaaggtctaacatacttagatgcagtagtattttgatataaagggcagatttaacatgtcaatagagcatatagaacaaatatagttaaatcagatacgatcggctgaaactccgatgctattctaatcggcaactagaaggcaggctagagattgatattctaagcacgacttaatagatcaaactcaattgatgcagcattaagtatgaaaagaagaacaatatctagacaatcaaactgctagaagtctcatagaatggtagatatctcatataatctagatcaacatcaagatctaacctaatcggctgccttctgcatacaaatgttagccgataataggttaggtggcgatattgctaaagattatgtaagatatatgataactcgacgaattatataaacaagattagagtatcataaagatggaagcactaatcctaaaaacacaatcttgttgaagatcgaaagcgatgcagctcaacccgaaagcaagaactcgtcgaaacaaaactaaagcaaaagggtggtgatgcgccgaaattgtattgaacgtgtgttgttaattacatagggctcggggtctatttatacccgagaattacaagatatgcccataccggacacgactattatctctaacaaactctaagataccataagtctttgcggcagacttttgcccacatttatctataaggaatttacataagatatcctaattaatagatacaattgccttcccaggactctatccgtgcgcggcaatcatcttgaagtacattaacttgaacccgatatcgcgtacaagtcatattgtcggtatcggctacatcagcttacctagcccgactcagacccagccgatcttatcgtagccgatctggactccagccgattcctgctctgttttcaaactcgatctccgcttccgactttgctttgacctaatcttctttcccaacgctgatgttaccaaattggttgttaacaaccccccgggaggacttaaggcatcgaatcttaccgccaacacatccatcacagcctacgaagccagagcctacaggagccgagtcaccgggtgatctagtcgaaccaactcaactacgatctcgtcggtattatcgagttccactattccctttgtaatctgtgatttccgtcatataatcccatatcaactggattagggctattacctattaagaggcctgaaccggtataatccctgtcttttgtttgcttgatgtcgtactacgtaaatcctcataccagcgtaccccaataccctctatatccggtctacgggtattccccgtcgacagcggcaggagtcatacaatgcaaaacaattcttttaccatcgaatataaatatatatatatattggtcctaccattgaaaacaacttctctatcatattgccatggtcggcccaaaagaataggaacaagcttgcatatgcacaacatcacattcaatttgatcatgataggagcccatagaaaaaggtattttaaccaaacgggttaccttcatcttaccatatgtattaaaccattgaatatgatacggatgtggatgtggatgggtagtcaagccaagcttcttgaccatctattcacttgctaaattgttgcagctcccgctatcaataatcactttgacagtatggcctttcacaagaactttgctttggaacaaattgtgatgttggttttgctcttcacacttctctttagcactaagtgctagcttgacaattaggctaggatactgatctagcgactctggatgcaaatggacttcctcgatgttatcgttatcttgtcctcctgcatggtcaatggcagctaaagcatattcatcatcacaatcactagcagaagtatactcaccatcaccattcacaaatagagctcgccgatttggacagtcgcgggcaatgtatccaatgccatgtcacctatgacatgtaatatcacgggtacatccagtggaagctactgaagttgcactcttggctagagtccgaactgaagcatttttgcttgtttcttgaacatgggatggcgtggaggtaggtggatgaatggcagtagtagattgacgtggtgttgactgtcgtgtggaagtagcacctgtaaaagaactcctatgcttgttgcatccctgcacttctcttttagctttgcaagcaaaatggaataatctattcatggtattgtattctttatattcaataatatcccgaatctctctattaagacctccatagaacctagaaattctagcatcctcagtttcttgcaaatcacatcgtgacaaagcaatcatcatctcttgacaaagcaaccttgtcttaaaagttgcagttgatttaacatgtcatgagcatagtaagaaggaacaaatctagacctcattgtacgtttcatatcatcccatgctctaggtctaagtcctctaccacatatatcattccaccatagagatgcaaaggaggtaaattcactactggcagctttaactttcttattatcaggaaaatcatagcaagagaattttttgctcaacagctagctcccagtctagataaacagaagactcgaacttaccatcaaaagaaggcatagtaaattttaccttagataaaagatcatctttggccctaactcgacatcgtcttctatttccaacactcttgtcttcctcctcatcgtcagcaacaaattgctcttcgttttcatcgtcatatctttggtgtcgatgagcagtggcacctgcaccttattcacctgcagtctcaagtaaaccaatgcgtcgcacaatattttcatgtccaatattcatattctgaatgttttcagttaattatttatgtgattgattcatttgctcaatttgatccactactttcaccaggctttcacttaaggtttttaaatgtttatatgtgctttccttgtatgatttactattacacattaactcttcataccaattttccatgcccttcaatttatgcgctagattctccagtgttggttcgtcggaacttgtacctgacatcattagcaagcaaaagaaactcacaagaaagtgttagttcttaacaatctataatatgtggagcttttgaaggcactcaatactcaagcatataccaaattcttatgatgttctcaaagaatgcaaacacaggtcaatcactgtggctggttcgtggcacaatgacacgcttgatgagtggagcgattgcaaagccggacctgtaaaggttagtagtatgtggatcttggtagacttaactatatcaaaaggaatagcaaaaatcaaatagatttgcgaaattgaataatagtccaaagtactgctcaacgttgctagccttgcctagactcaatcctagctcaagcaaacaaatgattaacactcggactagaaacaactggttttatcacacaactctctccaagaaagccaaagaaaatgccacactgttttctttttctgatatttttctttttgttccttttttctaatttttttctttcttttctattttttggtgcggcctttttttttctgtttttgcacctcgctggctttttccttttttttatctctctttttctttatcaaacagtggctaacggacggaaaaaaactgggtaaaaaaaaattaccgataccaactaactcaacggaacctgctaggctgcatgcgcacaggaaattttcacggaaattaaagtggcccgcgatccgcatgcacaaggaatcagcaagtcgtggatggaaattacaccggtacacatgcatgcatgcgcaataaagtaggagatcaatctttgacttaaacaggaaactcggatactttttttttcttttctcaaaccaatctacaaactctaccgggatgaccgcaacaaaactaaccgatgagacaaccagatgcatacccaaaccaagatgaaactagggctaagaccagatcttgacacgacagtagaccaaaactcaataaagcaaaattgaatgaaaattgcaaggttcaaaactaatgtttggtgaaggaaaaagtgatgcagcaatttgtagataatgggtagggaaaataaatctataaaactaaaatcctcaccaggcaaccgatgctctgataccaactgatgacgctctctctcgtggcccgatgttctggtgaggggataactctcactttgatcgagtgcgacgtttgcgacgtggctaccaaccagaacaagtccaggacgccgtgcaatcgctacaccacaaaagatgtcgcgcgcggttgatgatccctacaatgcaacgagagaacactgcaagacaagataagatgcaatctaaatattgcgaataggtaattaagcacaaagaaatagttgcgattgaagtggtagatctaatcgacccggcaaatcaacacaccaactattggggcctctg

SEQ ID NO: 42606 - DNA, 702 bp, Oryza sativa
tattcaaggtcatctagtgtgtctagtcatcctttggaactagtcttttctgatgtttggggtcctgcccctgattttgttggtaataagaagtattacgttagctttattgatgactacagcaaatttacttcggtttattttcttaagcacaagtcagaagtatttcagaagtttcatgaatatcaagctcttgttgaacgactcactggtcaaaaaatcattgctatgcaaaccaactggggtggagaatatgaaaaactccatccattatttgaaaaaattggcatatcttatcatgtgtcttgtccccatacacatcaacaaaatggatcaacagagcgtaagcatcaccatgtaatagaagttgggcttgcactcctagccaatgcttatatgcctcttaagttttgggataaggcattcctcactgccgcttatctcataaataggacacctagcaaggtgatcaaccttgaaatgccactagagctcctatttcaccaaacacccaattatcaattccttcgaatttttggatgtgcatgttggcccaatctttgtccttataataatcacaaacttcagtttcgatccaagcaatgtgtcttcctcgggtatagcaacttgcacaaagggttcaaatgtcttgatattcctacaggccgtgtttatatatctcgtgatgtcatctttgatgaa

SEQ ID NO: 42607 - DNA, 9199 bp, Oryza sativa
  unsure (1)..(9199): unsure at all n locations
taatctcctatgaaaaatggagccaaaaacacaaaccgcacaacttagttaaattagttataacatgctttttgattttagtttgcaagccctagataaatttgtgcatcaaaacaattaatttataaatttatacgctaaattatacccacatagtaaattcgtatactgatgtactctatttaaatataaagcttgaaatttagtcctgctttactcgatagcagtcgtgttcaccactgttcatgcccttgtgactcgaatgtagctagccattagaatcttatctttttcaagatggcaactggcaacataagatcgagccaatagctagcccctcgctgtaataaggcagtagaattgcacctcgccgtaaggtgtaagctagcttgactgtatttggactcagagctatcaccgtttgttgtcctgcagcacctgtacctgttaccctctgtcatattctgcgattgtctcctatgacgcctgttagggctcctttaaatcgtaggaataaaaaaacagaggaatagaaaaaacataggactctgacaggaatacaattgtaaaacagaggattgcaaaacacaggaaaaatacaggaacgaccgtttgattggaccacaagaaaaacgcaggaattagatgagaaagatagactcagagaaaatgtttcaagaggttagacttcttgctaactttcctccaaaatgtgcataggattacccattccataggaattttaaaagattgaataggattcaatcatttgtttcaaatacctccataggatttttttttcataggattaaaatcctccaaaattcctacattttccctacaaatcaaaggggcccttaagattggggttcatttcattagcatgtgtgccttaaatcaatccattatcgaccaattttccccaatcagttcaagggcaaaagagtctaaatctaatttgcataataaagtaaaattcatatggacctaattaagtgacatcaacatcagtaaactttgcataataaaagctaaggaaaaccatatccatttcaaacgaaactaaaaagaatgttctagagtgttgtttgttcagttttgaacttttttttccatttgaaatgatcttcgagcacggtttaagaggcaatctaaataaatatatagttgtgtaattgtattgttaactagcatattgcctgtgcattgcaacgaggttttaattgattattaacctactattatcattgttttttaatacatcatcacttaaattttaaatacatttttttgatgggaaaattttattttattttttaaatatatttgtaactaatatgtggaccctatgatatcacaatatattttttcttcacacaaaagaaatagagatgatgggcagggatgaaaactgagcggattctttctatccgctctggaggaaaaacgaatatggatatctttcggagcaaataattcctcaaatagttcagatacgaatacgggtacatatattttctcccggatacaaatacaaatatggtatcggggttttcgacggatgcagataataatacgaatatccggcgaatagtttcggatatccgctgaagccatgagaccccatttctttacagctctatgaccttcaatatagctttttagattttaatagtagcgcacctcttaacactagtccacactattaatattatttaaacttttaaatattttgttaaattatactatattttatataaattgagctaattatatatgatgatgtttgtttctattagaagttgaggtggttttcgtgttccgagaaaaaaatatttccgtactcatgtccgatcatatttgatcctaattcgtattcgagataattcgtatttgtttcggtatctgagctattcatatttgttttccatctggcaaaaaaaaaaagaaaatgaaaatgaaaacaaacatggtatgagcattatccgtccgcatccactccgttttcatccttagtggtgagggtagttgatatctgggttctttggccccatatgtcttttattcaccattactattcctttttaaatgagtatagacatttctaaacaatgcaaatgtgcaggttaacaactagctatagacattccttggcaatatattaataatgaacacgcttttaaaacatttacttttagaattcggtataaattggagtagagaatagaggagaaaattgccccaaatattttgcgcttgtatagtatttttgttctggcttgttcttttgttttctgcttaaaggggcatgcgcttgagatcttaaggtgtgaaccaacatgttccacatcaaatagatttattttaaaaatgaacaactctgagattttcatttactaccattgatctgacatactattccctcaagttcttcatttcttatcattttggacatgatacccatattaattagggtgtatattatttattctacccatattaaataccttgaagtggtatatttagagatctgagagtgttatgtttaattggcttaggctttatttgttcgagatttttggtaggaactaaacaacagcacacaaaatatgaaatgccattatgatatgattaattaagtattaactatgataagtttttaaaatagatttatttgtttttttaaaaagttgtgtataaaaagtttttaaaaaacatatcgtttagcaattagaaaaatatgctcatcgaatatgagggaataactaagcccaaaaaactcagaagagcattactattggaatgaaaggcccagttccgatttaatgagaattttacaacttcgctgctaataggtttttttttttcactgcatggcgcatagttggaaataataacaccattaactacaaagggcaatctcgacctataccggccaccactaaaactcttcaacgacagtcgacgagaattctcatccaccgcaacaaagaaagcttattcaaccactaaattaagctgctattttttttttgtcttgtgtttatacttttcttttattcttaagtccaaagtcaaagtcataatcacttacagagcgtgcagaaaaaaaaagaggaaaataaggtggcctatcatgacttttgttgggaaaaattgacaggtgaaagagctgtgataaagaagcaagccgctgcagattgaattgctgggtaggatatttctaggctggggccataagacagttctgcaatcttcagctcgtgctgggtgctcttgcatctcggatttgctatcagcaaccaacaccatgtcctccagtacgttagtgctcctgcagctcctataccttattagccttatcctaccagccttctctgccaacgatgacaaccaattcgcctactctggcttctctggtgctaacctgaccatggatggtgcaactatcacatcaggtggcctcctagagctcaccaatggcacagtccagcagaagggccatgcattctacccggtcccgttgcgctttgtccgatcacccaatggatcagtgctctccttctcggcatccttcgtattcgccatcctatctgtctacactgatctaagtgctcatggcatggccttcgtcattgtgccaagcatgaacttctcagctgcgttgcctggccaattcctgggcctcgccaacatccagagcaacggcaatagcagcaaccatttcttcgctgtcgagctcgacaccatccaaaacaaggagtttggcgacatcaatgcaaaccatgccggcgtcaacatgaacggtctccgatcagagcagtcctactacgccggctactacgatgacaaggatggtaacttccataacttgagcctgattagccgtgaggccatgcaggtgtgggtggactacgatagcaacaacacgcagatcactgtggccatggctcccatcaaggttgcgagacccatgaagccattgttcacagccagctacaacctcacatctgtgattacagatgttgcgtatgttggtttctcctctgcaactggcacaatcaacgtgcggcattgtgtactcggctggagctttgcgataaatagtcctgcttcagccattaacttaggtaagctaccaaagctgccacgcatgggcccaaagccacgatcgaaggtattggagattgttctaccagtagcaacggcaagttttgtccttactgtgggcattattggtcttgtactcatacgaaggcatatgaggtatacagaactgcgcgaagattgggaggttgagtttggaccgcaccggttctcttataaggatctgtatcatgcaactgaaggattcaagaatgagaatctgctgggtgtaggaggatttgggagagtatataagggtacccttccagtgtcaaaattggagattgcagtaaagagggtgtgtcatgaatcaaggcaaggaatgaaggaatttgttgccgagattgttagtattggtcgtctccaacaccataatctcgtgcaattacttggctattgtagaagaagaggtgagctgttcttagtgtatgactacatgccaaatggaagtgttgacaaatacatacatagtatagagggaaaaaccattctaacttgggcccaaaggtggcatatcatcaaaggcattgcatcttgcttggtctatctccacgaagagtgggaaaaagctgttatccatcgggacataaaagctagtaatgttcttcttgatggcgatatgaacggacgacttggtgactttggccttgcaagattgtatgatcatgatgatgacccacaaaccacgcatgtggttggaacaataggatacctagctccagaactaggacacactagcaaggcgacccctcttactgatgtatttgcttttggcatgtttgttctcgaggttgcctgtgggcagagacccatcaatcaaagttcacttgatagccaaacgatgttagttgactgggtgcttgagcaatggaacaaaggatcactagtcagtacagtggatagcaggcttgaaggaaattataatgttagagaggcagttttagctataaatcttggacttttatgctctcacccttttgctaatgcaaggccttctatgcggcaggtcattcattaccttgatggtagcattccattaccagagatgtcaccaacagatttgagctatcatatgatgacaataatgcaaaatgaagggtttgacgagtacatcatgacaagttcatcgatggtaagcaatggcactgcatctgccatttcaaacggaagatgacatgaattatggtcatcagatatgaatgcactgttcttttcttactccttttgtaaaaactgctttccttgtatacagaaggatctttttgctaggtgagaattgtatgtgattgtaagtttttacaatatttgtgtaaaaacatgtaaacagtttgtttataatgaatttaactatttttatacataatagaagagttgctccaaacagcctctgtatgaatttaactcatagtagccaatataagctcttgtggttgcttaactgaagctcaagccatccgtgcatggagctgagatgtgaaagagaggtgattgtaaatcatctttagcaaaatgtctctgcataatacatatatagtttttctattgaatataaacatttatgcactattaattatagggtataggtaaacatttccattattgtttggacatcaccactataggtagattgtatatgcactagtccaatcacgtgatagaactgtcatggggcaaacgtgtcaagtatcgagagtgcccgtgctcacctcacacttgtacacttgtatcacgtgctctggacgtacttggactggctgtggaagttcaagcacgcaaaactagtagcatgtgcagtcgtaacttacaccactagactaccaaagggtgtgcacataggaatgacaataacgtcgccaaggctggtaggttcatataatgatgcatttagaacacaccattttggaattagctacctacaccaggcaggtatggggtaatgtccaccataagctgaagatttcgcatgctcctcctctggtgacctattattctggtggtttgattctcgtcgccttcttccaacaaagtccagttgcgctggctagctttgatgctgttcttattctgatttcgtggctggtgtggaaagagtgaaatgctcaggcattccagcagcacgtctgcaggtttgcgtcgcaagtggctcaagcgatctgggaggaatgggaatggtgcaactggcctgggaggatactgcagcagggctcctttctttgtgtagctagattgggtgcagtagtgcaggctttaccccttgttcttatgtaagtcaatcacaacaaccgtatttgttgtttaaacttcgtacatcctctacatttttttccctcactcttaatacaatctggcattccactggccggaccgacgaaaacaaaacattttggaatctgtacatttatttatacacacacatatataaaagcctaaagtaggtattaattaattataacttgtgaccgtacataatcgtaggtactatatatgattgtaatattttacagaacctcctcacatatataaaatatcatgtttggcccatatttacttaaatttcatgttagaaaagtgtccatgaaattcagttggtttcttggctaagatcattggttcaactcatattactttgaacaatatagctagtgattcagtatatgccaaattagttcagtacgccaaattcatattattccctccgtttagatcatatacccttcgtttatatcaataatctgaggatttaccctcctatgcaaatgacatatataggggggggggttactgacatgtgggtccggagggtaaatcattaattgcaatctaaagaggatatgtacaattaggcccctttgaatcgtagggtagaaaaaatagaggaatagaaaaaacacagagaattgcaaaacacaggaaaaatataggaatggtcgtttgattggagcgcaggaaaaaacgcaggaatcggatgagagagatagactcaaaggaaattttccaagaggttggagctcttgctaaatttcctccaaaatccacatgcaatgtgtgattccataggaatttcataggatctggaaagcttcaatcctttgaatcaaagggccaaataggaaaatttcctataggatttgaatcctatgaaattcctatataaatcctttgattcaaagggtccttacattttactttctacttctccagatatttgctgtccagtccttaaaagtttggtccctacatggaacagagttcctacaaaatatcaacttgaagctaagtcattgaagttacctcacgttaaggcaatatatctgaggtcaacatcgaagaaatcctgtcctactaactgaaaggaactcccgtgtattttttcccttttcgttgtcgtccatatacttattctgcaatattgacgtatcgaatacttttgatcaccgatgacatttcaacgccgtaagaaatatgttcaccttgggtgtgtttagttcacgccaaaattggaagtttgattgaaattggaacgatgtgacggaaaagttgaaagtttgtgtatgtagaaaagttttgatgtgatagaaaagttggaagtttgaagaaaaagttgggaactaaaccaggccccttttccatggaagaacacaactgagctgtccaaatcaagaaatcaatttccacaaagacaaaacctgtcacatggaattgaaggtgccaggtgaagtttcaaagttaggcagcaccttgtaagtcgcatggaatctgatggtccttttgtggtattccattctcgcaattaatttctatggaataatttgttatgtgatgtcaacatcttctacactagcacagattcttacatctgtaacgggtccaataaaaccgttatagattatgtcatctgtaacgggtgacattggcaactgttatagatgaccagaacattcttgagctgttactgaagccgccttatctataatggctcctaatcaagagccgttacagatgtaagctcctttatctgtaatggcttcctcattgccccggccgcacaacccttccccctcccgctcttccgtgccaccacagtccacatcatcattacattcctgcaacgcgacgtcgatgtgctgccgtgcagtggccatcggtagagcagggatggccggagtagcaggaggctagcagagatgaaaccagattggatgttttttgttctttctattataaatctccacatatgtaacagcttacgagtttagtttatattttttttaagctgaattttcacatatgtaacggctccacgttttgagccgttacagataactttcatctataacggctctctagcccttacatatgagtcttcacgtctgtaactgttggtctgtaatggttagtccaaccattatagatgtgatttttgagcccttacagatgtagtgttctgtactagtgtataattgtaccttaaaccactgtaatagtttgaataggtcaatgttttattaaatttgatttctctaaatagaaatttgattgtagatttttttagaagagatgcaatacattctaataattaagagtgttttttaagagttaccaccctttttagtacaaatttgtgcactaaggtggtgaccataaaaaacgtagtaattagatagtgtaaaccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42608 - DNA, 6541 bp, Oryza sativa
gggaccatagtgttggcgcgtagagactcctgtgatgaatcctcaattacaacaacatcatgatagactggtgtgccaagtgctgcaaagaaaaaaacaaaaactctctaaatatatatggcagtgatctgcatgaaaataaataaataaatatatagataaaaacaaagatacttacaggtatcatccgtcacagaatccatcatggaagctcctgggtattgctcttcgcttggaattggttgttgtccttgttttgaatcaccgctgctgtcgtcagtgtcattgttctcatcagcaccaccttgggaacccgcactgtgacttccacccgcaccatcttcaccatactcatcatcaacactgtcctccactttttcatcacctttgtcttcatcgtcttcatcttgtttgccatcgtcttcctctgtttgagccccctcatccatagcacctttatgagcagccggtgggtgaactttgccatccatattgttatccctcacattctgaacatcaaattgagatacctcatgagcagcaacagccccaattgcaatgacttctgcaaaatcagttgcatctacattgccactgtgccgcccaatttcctcagccttgtaattgcttctagtttcagctctgtatgcttgtcaggaccatggttaaagttgggagtgccaagtacagcggcatcaccttcagaagtacttgccatgcctttcacccttgccaacttctttaattttgtgctaaactcagaaagtatgtcgttgtctgatttgtccaatataaattcaagctgttccatgcatgtggagatgatttcagtgcgcctaattttgagtttctctttcatcttcattaacaactcgctgattacaggtggctgtgaaaaacacagtattttttttaaaaaaatatctacatgaaaaatcagctataataaaaagtgatgagtgcctggcaataacccaggtaccaaagtctgatacctggcaaaatacaggtaccatgtctggtgcctggcaaaataacaaggtattgctatagttgcctatcataatgtattgttgggtttacctcatcacatgcattatttggatttgcatcacaccctgttgattttgggtcttgaccaacttggccatcttgcatattcatttgttcttcgtcaccagcagcagcaggagctccctgggggtctggcgtatgttgtcctatgttcatatgttcttcgtcaacaccagcagcgatatgtccctggggatcaggtgtgtgttgtccttcatcaacgcaagtagcatcatcatgtactccttcctccacatcctgtctatatccaatggagagcatgtgctgtggagattcgtgcagtggagattctccatcgcgataaacagtggattctatatcttttatctaaaaaaaatgatatataaattgctagtctacctacatgatacaaaaaaaaggaggtatcattgagagccttatacctggatagaatcatagtcagcatgcttggatctgctggtagcaatagtttttacttcatctatatgggcagtggttatatgcgctatgcgcggtgtgccttgtggaacattgatacctgcaacaaaatccaggaagataacctgcagaaaaaaaatggattcaagcatttaaaaaaatgacaggaacatgatacccaaaaaaaatcagaaggggaaaactaacattaagtatatgaacacaacctcggacatttagatttatgcttgtgtttattctgaaatcatggatggcctcgaaaagataatcagcaacatggttgcaacaattcaggttcttgatgttcttcacatcactaatagctgttagatattccctatgaactgtcaagttgctacctgggacaagatagacacccaaagcaaccatcatgaaggacacaataaattcatcctcattatgttccagtaacatccgagaaatggctttatttaaagattggcctctgccaccttctatgaacttctccttcaacctatggtcagtatcttctgtcaacttcaaacgcatatgtccttcaggaattccaatcaccttcttaatgagtggtcttatggggattgataatccatcgaactccaaggtaccaagctcagtattgacatggttcaaaagccacaatgtcatgtccttggggaaactgcaaccctgtatcaacaatagttcctcaaaattgatgttgtgcacatagcggatctaatctggtgacagttgagctgctatcgtgctcatgttgcttgggttgcacctcaatttaatgatctgcacctaaaaatattgtaccaaaacataagaaaaatttcatttaatctctttttaaaaaaacttaaagggaactagtataaaacaatgaaaagatgaacatgaaaaagaaacttaaacagaattatggcaaaatgaagcacgatacctcttttccattttccgctctcttccttttcttgtttccactggtcgatgcacatgacttcttcggcagtgatgaacatgtcttcttcaacagtccaatatcagattgcttgaacttattcaaccttggtgagcaccgcacaccctttccctcaacatggacaaaatctgaattatttgaagatgtagccattacggctctacaaaaaaaagggaaaacatagcagttagtccgcttttcaaacattgttgataccttgtgaaaaaatcaggggacgaaactactaccgtacatcatttacgctaataatgcagtaaaattgcagcccctataaaacacatgtattgcttgatacctagtaacatccctcaggaatcacgcgaacaaaccacgggacaggaaaaatctaaaactctagcattagattgcagccctacaaaaacaaaaaaaatgtattactcgatacctagtaaaaatgaagtaatgccccatgggaatcaccctagaaaaaaaatttctgagaaatataaacatgcatcatccacacatacaaacgcgcggccactaaaaactattgataaaaatcaccttcattagaaaagtaaccaacctattgattttcactgaccctcaggaaatcaacacgaatcccatacacttcctgccaccccctacctacaaaccctagaacagaaaatgcaaaaaaaaaattgacgcctaattagggagtgatttggaagttataaattgagaatatcctgataagacattgtacttttgcgcgaggtaatcttcaatcagagaaactgggagtgagaaaggagagaaaaacgcatataccgatggtgggagagcgccggcgcggggtatcgctgcgtgcacgatatcaccgctggtgcagcaacgccgatgtggggacgcgcggagaagttggccggagcgcaagggcgccagcgaaggggagcggaggaagacggcgcgcggcgagcgccgagcggagcgagagaggaatgcagtgtggagagggtggggaaaagggaaaggggatcagatggggtgagagggtaacggtttgggcacattaatttctcccgtgacaacggaaccgccacgggacaccgttcagtagtttttctgctagaagaagggtgcgtttgcaaatgttacagctggtaggcgtgtatttgaaaaggcggcattttagatgtgtggttgggttgtgtatccttgacgacaatctttaccctccaggcacaatccaacggctgacaaggaacatatctagattttcgcggtattgatgctttcaccgtaccaaacaaaaaagtagtacgggagaaatttaactatttttcactattacatttggcatttatccaaatgccccttataagtttgcacatattttttttctctcttaagagatgccttcttaactatttatcacttttgctcacgttgcatgcttcactagtcagcctctcctctctccttcctctctctctctctctccagtccggcgtgctccgccgctgctccacctacttcactgccgctccgcgctcctctatcgtgcaaggagctcgtccgccgctcgttgctctgccttctccactgttgccctcctcctcctccaccgccgccgttgccactctgcctcctccaccgcagcaaggagtccgtccgccgctgcttcatctcttccatcgccattctgcctcctccgccgctccgcctcgtctaccgctgcgaggagtccgttcgccgctgttccgcctcctccaccaccgctctatctcctccaccatcgtgaggagcctttccgctgccgcgtcggttgtaggccagctcggagatagaagctcttctctggttgttttccatgacaaccgccgtgacaacattgttcatttccccagctgcacaagttcttgctgtcatcgcatgctagaccgaaggaagagaggaagaggagaggagaggctgactagtgggtcccacattggtttctaccctgcattgctacgttggcatgccacgtgggcaaaagtggcaaatagttaagaaggcatctcttaaagcggcgaaaaaatatacaaacctaagaggggcatttgaataattaccgaacctaatagtggcaaatagttaaatttcccagctttcattgttgagtattcagtcactctaaacgatttatattaatcgtggtagttatttgtgttcttaattttattagattgtaagtagtcttcttcctacattttttttattgaagtgatctctgtaactaagttgctacgattggtaatagttaagtgcaaggacagatccagttcatcggtatcattggtgtcatcatatgccaatctcacttaatacatagttttatcttcattggcttagcaatttatcaatagatttctctagaggtcatcgaggtcatatgaccacgatgaatacactgtatctctgcccctgattatgtctaacatcctaccaaaacattatcatacaatggtgaaagtggaacacaatatgcataatcacattgcttttaatttgttctcagccatttaagaagaggaagtttcgtccatccgttcttcccacacccaccataaatctgtaaccccctctctcctaggaaaactaaaaaaacacacattaactccgtgcatgacaaattatcaaaactaactttctaaaaggaaaacaagtaaaaagcaatcaaaaaccctagcaaaacaagttacacatgttccacttttgtaccactcttggcccctagtgtaggcagccctttgacaagtcacgtgccacctcatcaccatcttctttttatgacttaacccttcttcttataactacatatgcatgaatgcatgataagcaaccaacatgatctattttgtggttatgtaggaatacaatataacaatatatgaatatatattaactagagtagtgactttagatgtgaagcattacaaaagcaatggcattcttcaagaatgacttaacccttcttctttttctcgcttaagaacgataagctctttcctcctgcttaaggtgtttgtaatataatttgttttacctttttaatataatttatttactttgggggcttcccctagaatgctttccctcaaaaaaaaaaagcaatggcaacaacagttgatcattctttcttccttaatattacaaatttccttgttacagtgttaaaacagatgatacaattttagattaacaaaaaggaaattctcctcaatgtttttaagtaagtataattatgccacttatgaagttcgtggttatcatttcgtctccataggaaaggtttctaaaatttaatctttcatgatatatttggttcagttaatgtagtggagtgaatgcaaaataattaaagaactcaaataatttacttcatttataaatatcttctatgggttcccatacagcaaatatcaattaaatgtgctgctccatatcagtacattcatttatacataaaagatatagtaatgaaaatcttatagtatgatattattctacataagatgtttcattctatttaagcatgtcgatgcttggcagaggaacaaaactaatatttcgtcctacttttgaaatggagaaaggtagtataaaaattgcgatgctttatgtttatcttgttagtgtgataataggcggttgtttcacctatattaatgaggtaaaatgatattgacttaatttgttaagctcaatgcgttaaattctatgataataatggaaattgagtgaaacatggcgtacaagcatgtctagtttatattggtgtgtagaaaatatagattggatgaacattagcgacggtttcgtgttaattaattagcgcaacaatgcgcgagagtacatatatatgcgtatagaaacagatcacccgggatcctaaatacaaggaataacaacttatctctaatctaccgggaatccataaccatatgcataagataagattacaattagttgtagtttctaacactccccctcaatctaaacttcggatgttgagattgt

SEQ ID NO: 42609 - DNA, 1861 bp, Oryza sativa
ttcctagctactctttctctcaaaaaatgataatcaacttcaatatgtttaataccaggcataaaccccagggttagcagacatatattgggctccaatattatcacaccaaacctttgcagctttaggtgcattaacacctaattcttgtagtagagtctatatccacatgatttcagctgtcacatttgctaacgccttgtattctgcttctgtactagaccgtgacacagttgcttgctttcttgaactccatgacacgagattacagcctaaaaatatagcaaaacctcccgttgatcttctgtcatctatacagcctgcccaatctgcatcagtgaatccactaaaaaacaaggatggagatttactaatcctcaatccataattaacagggcaacttatcatgtgcactcagcacatcccgtgcactcatgcactcctgcaatctggtccttccgatctcaatccgatgactaggatctgggtaaggtaattttacaaaaaaaccgctcgcctcctaccctgtattcttgctgaaatccccctaacccctggttgtccatctttatcctcctgactccgtcagaggctcagagcatgacgctgcgacaaatccaaaaattccctctgaaccaaacttttgtttccctcgattccttctgattaaagcaaaacggtgattttggaggtgcttaatgttgttcgtgtgagttgatccctcaacaggaccttatctcccattccatgtagcagagaggaattaaagatttaggttttggagaaaacaaataggaccaggaataattttaggaatgtaagagtggatatctagtgcttgattccttatttctatagcctaattcatcattttgtatcagtcttcttgctggtgggtgccgccatcgtcctcgtcgagcagcttcatgtcaccgtctttgtgggagagacgaagagatttgggggtggctaaggcgaaagaacagaaaatccaagccagggagatttttgtaaaggtacaaggtaagaggtgggcggtttttttgtaaaattaccctactggatcctagccatcagattgagatcggaaggacctgattgcaggagtacaggagtgcacggcatgtgctgagtgcacctgatacgttgccaattaacagtatgcttaatataccttaaaattcttttaaccaaagtctagtgagtcacagtaggagtatgtaaatactgacataccttattgacaggataagctatatctggtctagttaatgtcaagtattgcaaagctcctactatacttctgtattgagttgcatcattttgaccaagtggtgttccttcatgagctgataatttttttgaggttagcaaaggagtgcttacaggtttacaatcttgcatccaactcggcgcagaatgtcattggcatacttttcctgagttaaaattattccactgttcacttttgctcacttctattccaagaaagtaatgtaaatcacccaagtcctttaaagaaaaagctttggtaagatcctgcagaaaagcagaagttgcactagccatagaactagcaacaattatatcatcaacatagattagcacaaacatggtgacatttcccttattatagagaaacagtgaagtatctgccttggatgatttaaaacctagctcatgaaattttgtactcaaccttgaataccaagcccttggtgcctgtttcagaccatataatgctttatcaagtttgcacacataatttggtaccttttcactttcgtacccaggtggttgtctcatataaacctcctcttcaagaactccatgcaagagggcattctgtacatctagctat

SEQ ID NO: 42610 - DNA, 794 bp, Oryza sativa
cactaagcaatttgcactgaaacaaaagaacaatggtatatcattaaatttctggggaggcaactaccacttaaagaaatataatatttagattaggaacaaccaaatgttatacaactgacacagtatagtttgtgagaatttacatatcacatatgaatatataaaggatgagacctcaaaactcaccaaatcctaaaatcactgaacaaagcagaaagcccaaaagggagaaatccattttgtacagtatctccaaaacaatgatgcaacctgttgaaaccattagatgtcttggagaagagaagaccagatgcaatctgcccgagagaataataaaacaatcaacaaattagagacattatatcatgaacaaaatgggagttcgctaaacaagttgttatgtctttgtgtttagtaagaacgtcagatattaagagatattaagttttatgtggaacacatgaagaatttaagagatattaattaagttaaattcataatctgctcagattctgatcagttagattagtgataaacaaaataattaagcctggtcaattacattaacagaagacaactgatggaaggatttgagcaatttttacatttcccttttaatagaagttgagattacccatctgtaagaaaaatcttacttttcctcggcaacattgtcaacatagaatataagcaccattccaaacaaaacagtactcaagtacgcccagcttggaaactgcagtttaactatgctgtcagatgccgagccctgtgatcaacacaacatttat

SEQ ID NO: 42611 - DNA, 8383 bp, Oryza sativa
catagactcaaggtcagcaacaatttccttgaaagcggagagatggtccatcacagacccatcatcttgcaatttgtgcaaaaataacttttgcttcaggtgcatcttactggtcagatccttagtcatgcatatctgttccagcttcaaccacagcccagcggctgtctcctccttaagcacctcctgcaaaatattgttagatagatgaagatgaatatatgatatagccttacgatccattttcttctcatcgttgtaccaatcctgagtcctcttgttaaatctagaaagcgcatcatcgaggtcttgctgtgcaagaacggctcgcatcttcacttgccaaagtgagaatcttgtgtctcggtccaggagcggtagatcatactttaaactcgccatgggaattaatcctgaatttgctagaaagaattaggctaaatctagcaaaaacgtgaacctctggtgcactttccgtgtgcacgaagcgtagatcagggaatctcctggtacacaagcttaggtggccgtagcaattcaacgtgaataaaaatcacgtgaacaggagaagagctggctgccctaattttctttctcctcgggacgtgtgctgctggatggatggattggacgctgctgctcctccttttcctcctgtcgcgtgcgccgtttgacgtggctgctgctgcggtgctgccttttcttctcgcgcaggcgtgggacaaggccgactcggagtcgacaggtagggggccaaacagattgattcgaccgaacgatgaacacgacgacgcgttccgtcgattagatcgatttcttcgattaggaaaaatcgcccgtggccgggactgcagtggatcgatctccaatactctgataccacttgatatgaaaatagatgcacaacagagaaacgaacttttacgtggaaaactcttgcgaaaaaaaaccacgggcgtcaaccggcaataatcactatagaggagttgattacaaacgtaggggaatcacaatgggaacgtcacccctttccatatggtttacaagagtatatataggagataatagaaggacacctaataggatagacatgaagtcctactaggaaactatataatccgaatatattgtgggcccaaaattcggatcacatatttaacattatttaaatcctccccccggggctctttcttctttctatgctcctcttattctttttctttcccatatttggcttttcctctttctaaaactttgtaccacctcatttctattaatgagatggctataaggtagagccagctctaccttcttacgtcaaaaaaatgaattgttctcgacagaatcgttgggacttgcaaggtaaaaaaaaattcctcagctctgtaaatgctattgctgaactaaagttcagaaaactatagtgccgaaagatctcccaacacctcagatggcctactgcaacaaaatttagtgcaatgcaacacaatgtaacattacgtggcccagcccatcatggcccatctcagcccatactgtatgcgctgcaaactaatgttagttcaggcaattactctgaaatttctaatagacgaacctgattttttcatgtcaggtgtcgtgattgttcagattcagcaacttacatttccaaagaagaaaaaggaaattcatacatttttttacttggtttttgaaagtggcctggattttcatgatttggttaaaatttagcctttgtcgtatggatttggatcctctatccaaacacatgccttccaagataaacgaatccctcattatacaaaaaaaaaagcacaaaatgctcaacaagaagcttcaaattcgtgtaaatacatgtcatgtctcgctaccaaacaatatctcaactttttgccgcagtaccaaacaataagagtgggggcatgtttagattgatgtaattttcaaccataccattttttagcatagttactaaaaatgtggctatgtttagtttttttttgctaaattttgataaatacataagaaattatgccaaaatttggtaatgtttattttggctataatctacataggccctggatcttggcaaattggataactgcacataattgagcagaaaaggacacggcaacaatttcggtttcagattggcacattttcttggaaataaaaaaaatccaaggaaaatagccccagaaggaggcaacaagaaaatgattccacaagatgtaaccgaagcatgggcagtcctgcaaggatggaatgaaatacgctgaatgaaaatacaaatatgttttgcaatggctataaagtggattaatttagaatatgatgatataaccaaatcatgcaaagatactgtgcagtcgagttcacacaaattaaattactgtataatctatgcatggcgtttccggccgttatccctaaaaatgagcatgccagagatcaattagcaactggcacaataacaattttctcattcaaatattcaattactatatctcaagcaatatgttaaacaaaattgatgctccacacatctggccataattttttttttggaaaaagtacacccaaggtccctcaacttatcatcgagatacaaaatcatcccccaatcgcaaaatcagataccggacgtccctcaactaacaaaaccattcgctttaggtccttcggtggatttgaccccagttttgtccaacgtgacagctgagttagtgtgggacccacgtgggccccatatgtcagactatccacgtcagcctcccctctctctcccctcttctctcctttcctcctctctatcactcttctcctctctgctcctctctgggacttgggcaggccggccgatgggtcacgccacgcacgacggcgtcgagcccgggggcggaccagggcgaggcgacaagctcgacctcggcgacggccatacagtcgaccctggccaggaagatccccggcacggcatcatcgagcaccgtggcgtcgaactccactctgcgcgcgatggcgcgggagtagagcagtcccagctccacccttagctcccgtggttccgccgccagccacagccgcagcgccgcctccgcgagcaccatccacggcggggctatggggctcgtgctcctctctctagtgtgatagtgtcccatggactcgaaccgacggcggaggagaagccggaggcgaggcgggggaggagttccggcgacgccaccgagcgcacgcgatgagggaggaggcaggatagccgtcgtgcgccactcctccgccagcagctgcagcgcttcattgagctgcagcgcagcgcttcatcctcctcgctagcagctgcagcgcggctcctccccccgccgcccccggcagcgtcgccgcctcgcgctgctgatttcgctgagaagagagagatgaggaaaagaaaggagagggaaaaagagggaggaggccgaggtggccaagctgacatgtggggcccacgtgggtcccacgctgactcagccgccacgtcggacaaaaccggggtcaaaaccaccgaaagatctaaagagaacgtttttgttagttgagggacgcccggtatatggttttgtggttaggggacgattttgtaactcaatgacaagttgagggaccttcggtgtactttttccttttttttcccagtaagcagacttagggcccatttagaagcccagtatttggcccaaaactggtgtaaactacaggccaatgattccaacgcacgcttggatgggccgtgtaacatacacccatttctggcccaatccaacgaaggttcggtccagtccagcctctaactccgccgccgcatgcccaatccccgccggccgccgctgccttctcccttcccccaccgccaccgtcgccttctcccttctccctcaaagcctcagtaccagcagccgcggcgcggagagtggaggccctcatgcagaggagcgcccgggcgacggagacgacccatggcgtggcgacgtcggaagggacggcctataggcggtggagactggagaccgcgaataatgccgtcgccgacggggggagcttcaggcgaggatgcgtggccttcgtcggctgctgctgctctcttcctcgctctggtttgtcattgtgttggttggtggtttggggatatcaggatggggaaggagaataatgggtttgttgttcttctattgtgctatttgaatgttctcttgtcaaatttcatggtgattcgatctgcatttgttattggttgtcaaacattttatttcgggatggatgttattgctcatagttcatttgaagttgggaaccacagatggcttatggcaagaggtgttgagaaacaaatattttaaaaaataacaaaacactcttacagaaatacacagagtgagtgattcatactgtacttctgatcaggtctgatggagataaaaaagaactgtttctaaatttttgtgagaaaaaaaagtggaaaatggagaaaatacacgtttgggaagactgctgggtagggggcaagtttatagcagaaagctttcctgagctgtataatgtaataactctaaaaagacgtgtaacaattgcaaaagtaaaacaaaaaggctgagaagaagttagattcagaagatgcctgtatggagaaaagaaggtaaagtggagaagaatttgcaatgagattgataggctgtccctaacaaaagaaaatgacaagctgagttggagattaacaaagaatagtgtgttcacagttaagtctttttacagggctttgaaaatgcacaacatgcaattcccctataagaaaatgtggagaatcaaaataccaccaaaagtgaaagtctttgtatggctgaagttgtaaacccagatgctgttcctggtgatgcctaaattctatttttgcttaactagatcctagcttgttctgaactgattggctgagggatggcatctggtggtggcgctccgaatggcgaccctgtagcccgtattttgttttcgcttagctgaacaattgtaatgctgcgtttctctaacagaaacaggagaagaatgcatctctttctaaaaaaaataagttcatagttcagtaattaactttgtgcaaatcatcgagctaggtgttcagtattttaggagtcatcctcctttccacctctcacgctcgcgcgcatcacctgttagcggttgcactttaaattttttttttaaaaaaaacagaaaactgcggttgctgagcgctccgccaaacaagaaagaaagaaaaattggtaaaaaaaaaataaaattatagagatgaatatagatatacactatgcctatattttatcctcaaaatttacttttttatgggacatagtacaatgtaatttgaagacatttttgccatctgctaataatagcttaaagcgaactgaggtctgaacgactgaagctggcacccgatccacgttgttgattgcttctcccacttgtgccatttgcagtggatacatcccatctctcttctccatgacagtatccccttcttcctcgacaaggccgctgtgacaaaccaatgttgtttgcttctttcactgctatttttgtccttcccttgagtatacgaggggacatcccctcgaaggattagaatccactcccgttactatgaggttaatctttcactgctatttttggccttccctttggtcatggagatttacagtagttttccttttacacatgagaaaagaacactcctaaacaagcctttaatgtttagcgtacaagtcagcgaagcttaaagtgacctaaggtccgaagccgcctcaatttgaataagggatttagtggactccccccaagtcccgagtagaaggaaatgtataatggaaagtttcgtgcgtattccctctatttaataaaaaaaataaaattatagagatgaatataaatatatactatgtctatatttattctcaaattttagttttttatgaaacaaagagaacaatataatttggagatatttttgccatctggcttaaaacgacctgaggtctgaagtctgaacgattgaagccgacacccgatcgacgttattgattgcttcacccatttgtgccatttgcagtggatacatcccttctctcttctccatgattgactgtatccccttcttccttgacaaggccacagcgacaaaccaacgttgtttgcttcttttctctacagacaggtgcaactgtgcgaggctctctcctttcgtgacttgagctgatcaagtgcaagctggctacggcggcgcgcggggctgcaggctgctgagctcgtccgtcgagctccgccttaatttgcgacgggtccgagctgctccaaccttgctctccacgaaccggccaagcccaattcgccgttgagttccggtcgacggagcaccacatcggtgagcatcctagctcctttcttgcggaagtcgtcgcagtgcatgtgcttcttctcagactcagctatcgtcagtacttcgtggttgcgcttgcgccgaccgaccggcttctctcccgcgcactgcagttttctatctctatcgccgcccagttcttggaagcttactgcactgtactgtacttgcttactccttcattccaatcaaacacaatcattccaggcagcaactgttaatactagctagttgcattcagtcgaacacattccttcagtttccatttcccacaaaaagcagctgctgctcacactccttgcttattgtgcttccccgtgttatgttcgtgtgttcttagctctaggagatccttccgatggcagagctgatggccaccatggtggtcgggccactgctgtccatggtgaaggacaaggcctccagctacctcctggagcagtacaaggtcatggagggcatggaggagcagcatgagattctcaaacgcaagctgccggccatcctcgacgtcatcgccgatgccgaggagcaggcggcaaaacacagggaaggggtgaaagcatggcttgaggcgctccggaaggtggcctatcaggccaatgatgtcttcgacgagttcaagtacgaggccctccgccgcaaagccaagggccactacaagaagctcggcagcatggatgtaataaagctcattcctactcacaaccgttttgcgttccgtcgcaggatgggcgacaagctcatcaagattgtgaatgaaatggaagtcttaattgcagagatgaatgcctttaggtttgaattccgaccagagccaccaatatcctccatgaaatggagaaagacggattgtaagatctccaatctttcgatgaacattgccatcagatcaagatctgaagacaaacagaagattatcaatacattgcttgctcaagtcagcaatagggatctcaccgttcttcccattgtaggtatgggtgggatgggcaagaccaccttagtgcagctcatttacaatgaccctgaaatccagaagcattttcagttgctgctctgggtgtgcgtctctgacaagtttgatgtggatttgctggctaaaggcatagttgaagcagctcgcaaagagaagaatgagaatgtaatggctaaaaactcaccgcaggatgcactcaaagaagttctgagcgggcagaggtacctcctcgtattggatgacgtctggaaccgtgaggccagtaagtgggaattgctgaagtcctaccttcagcatggtggcagcggtagctcagtgttgacaacaactcgtgatcaagcagttgctcaagtgatggctccagctcaaaaagcttatgatctcaagagactgaatgaaagcttcatagaggaaattatcaagacaagtgctttcagttcagaacaagaaaggcctcctgagctactcaaaatggttggtgacattgccaagagatgttctggttctcctttagccgcaacagcattgggctctacactgcgcacgaagaccaccgagaaagaatgggagtctgtattaagtagaagcatgatttgcgatgaggaaaatggaattttaccaatactcaagctcagttacaattgtttgccatcatatatgcggcagtgctttgctttctgtgcaatttttcccaaggattatgagattgacgtggaaatgctaatccagttatggatggccaatggttttatcccagagcaacaaggagaatgccctgaaatcattggtaaaagaattttcagtgagttggtgtcaaggtcattttttgaggatgtgaaggggatcccatttgagttccatcatataaaggactctaagattacatgtaagatccatgaccttatgcatgatgtggcacaatcttccatgggaaa

SEQ ID NO: 42612 - DNA, 10630 bp, Oryza sativa
cttacatgttttgtcgctggtacttgctatggctgcagtgatttgggagagctgcggcagttggaccttggtggtcaactagagctatcacaactagagaatgtgacaaaagcagatgcgaaagcagcaaatctcaggaagaagaaaaaactgaccaaattgagcttagattggtcaccaaatcattccaaggaggcacagaataatcataaagaggtgctggaaggcctcacgcctaacgaggggctcaaggttctgaggatacattgctgtgggagcagtacatgtccaacatggatgaataaactgtggtacatggtggagcttcagttaattggttgcaaaaatctcgagatgcttcctccactgtggcagttaccagctctagaagttcttttccttgaaggactggatggtttaaattgtttgttcaacagtgacgaacacactccctttacattttgtaaactgaaggagcttaccttgtctgatatgagaaattttatgacatggtgggacataaacgaggtacaaggagaagaactggtttttcctgaggttgagaagttgttcatcgaatattgccataggctaactgcgttacccaaagcgtcaaatgcgatttcgaaatcttctggaagagttagcactgtgtgtcgttctgcatttccagcattgaaggaaatgaaattatgtgatttgagtgtctttcagagatgggaggcagtcaatgaaactccaagggaggaggtaacatttcctcagcttgacaaattaacaatcaggtgctgcccagagttgactactctacctgaagcaccaaagctaagtgacttaaacatatataaaggcagccaacaattatccctagtggcagctagcagatatattacttcaatgtccagtctcaatctggatctctcaattgatgacacagaaacagcattggtggccaaacaaaattcgagtgaattagtgtatgagaaggagaaatggaatgataattctcccctggaacttatggacttggacgggtgcaaccttttattctctcatccaagtgcactggctctgtgggcatgttttgtacagctcctagatctgacaatttggtgtgtcgatgtacttgactactggccagaaaaggtattccagggcctggtttccttgaggaagttacagattcgtgaatgcaggaatctgacaggacacacacaagcttatgagcaatctacaccagtacgaagtgaactcttgccatgtttggagtccctagagataagctactgcatatcttttgtagagatgcccaacttatctgcgtctctcaagctattagaaattatgaactgctttggcctgaagtccatcatattcagtcagcagcatgataggaggttggtgagtgcagaaagtgttacacggccggataggtcatcattaatagcagggtccagcagtgggaccaacgatcacatccttccatgcctagaatctctagcaataaagcgctgtgatcgtttggaggttctccatcttcctccgtccatcaagaaattggaaattttgaaatgtgaaaatcttcagtccctttcaggaaaactggatgccgttcgagcattaataatcagatcatgcgagagcttgaaatcactagaatcttgcttaggagagctcccgtcgctggaacaactcgatctttttgattgcaagagcctagtatccttgcccgaggggcctcaagcatactcatctcttagatttcttacaattgattcttgttctggtatagagttgcttccactgagcctgcagcaacgtctggattacctcgaggagaaaaaactagatgcccgctatgaaggtaatctccagtttcttcgtttcttttaatactatagaataaccagaagcttaatttggtgtaccctaaaaggcaaatgtagtacgattcactggtaaaaagtttacgagtgtggcaaccatatgattatatgtacatagagtacaatgcacattgataactcactcgtgcagctgtcacctccctttaaacttttgaaacgcatacaaaggaatttagttacgtctcctccgcgctttgctatgggagatgtggatgaataaatgttatgtattatagaaatgatagatgtatatatttaaataatgtgaaaatgttgtggagatgatgatttgacgttgcttgcatgttgagaaacgcccaggggtcttccggctagctacacgaggtggtgggctaatattcacgttttttttacattgcttgcatattgagttataaaaacgcaacaaaattataaataacatgtcatgtttgcatgagatttaatataactagataataattgttaataggtgataatgttacacgtttgtatgttgaactttaggagttagtggatacatatcaactatatagaaaatatagatatgctattttggtacctgcaagggaatttagatgatctattactgtgattatgctagtttggatcatgcaattaacctatatcctttagttgttgtattagtcgtggttgaagtctcgtgaaaaaaaaatagtcgtgattgaagtcccttggtggttttttccatggtccttcgaaccaatactcatgattctttccctttaagcgtctgatatggacaacagcttaaatttgcagaactaacacaatacttgccttgacatttttctggaaattcacagccccattgaatatagttgagtatatgtagtttccttcaattgtcttgttattatgccttcgtaaatcttgactgctatagcctactactactatatattatccaatactataattttctaatctttttgtttgccagaatcaaaggcgcatcaatatgcaattggtaggctgctgtgcttgaagtagcagattcagaaccagatgagagttgtcatcatggtttgtagagtaagctttctttgatgattaatttcaaatgatgaaatgctagctactatccttatgctgactctctatgacttccttgattgtaggatcgtgaccataactacaagtgatggttatcgtgtctcgtcgtagaatgtattacctacccagctaccctttctcaagataaagtccagtaaagtcgatcgtctggtggtgtgagctgctacaaggatgaagccgacccaaggccttgactttaaccagaaagctagtcccagactgcatccagaagaacagcaaataggggccccagctctgtttttttccatcctttttcttttcttgtgaactgtgatgtgtaatgtgtttgatttcgtttgtgctccaccataagagaaaggggcaattgcaaatttatcactgctttgaatcgttattgtaagactgctactagaaaattacaaaaaataccactgaaactatcattcaagtggcatccttgtaaaattaaaaaaatcggtggcaaatttacaaatgcatctaagataaactaagagaaacgctgctagcacttccatttcatgatgtactgtcacgtcgtgatcttttttggctttccgttcttttcgtctgtttacgaaaattcacatttggtttgttcgtctaattagcttaatgaaaatttcgttaaatcaaaagagtttaatgtaatctctactgcttaaaaaaattgtagtggtgatgatgaagccaacgtagacacgcgatccaacataaaaacgtagacacgtgaccgtagatcagaaaatcggatatgctatggataaaaaaccggcgccctcgcaacccaaaacaaccatcgcgcgactcctccgatccgcccccatcgctgcgcccccttcctcggcatccaaactcgcgacgcccccctccgcccgcgcccgcaatatcgcgctcctccccctggccctcacgcatcattcctcccgcacccccttccttcaccgccgccaccgctccccacttgccctgccaccaccgtgttcgtccaaccgccgcctcgaacagcagccctatcccgctgtcaccgccctcgacgcctccatccatcgacgccgccccaacctccggatttgtcgccccctcgcccccgtcgtacaagcgcccgcgccacctccggcatccatcgcgacccaggccgccggtgccccatcccccctcccccgtcactcctccaccgcgcaaccaccgctccaggttgtcgtcgtcgcgcgaacccggccggatcggcggtacctcacatcccttgcgctgcctcccttcactcctttctctccactgttgcggctggatcgccgggaccatcgtcacaaggtgacatagcatagatctcagctctccaaaacaaatccaacggctgggattcgtccacgtcatcacaagttaaaatttagatctacgctatgtcatcttgtgacatggctactctatgtcactcaatctgaatccataaagcagccagttagcgtgcgacgactaaatctcctcatcttcacaggcatatctgagtggccgctgccgtcgcaggtcccattcgtttggcttatttcctaataagccaaaacggctttgtcggtgacatgggatcgggggtatcatgactagaggcttgggcagccgcggtcacccacgtggcctgaccccctcgggggggtcgggcccgagggtgacgtggccacccctccctctgtctccccgaggggtcgggccgctcctgtttcggccccgagggctggggcgccccgaccccctgtggtattggcgccacgtatgtgggttaggtgggcacagcggcgctcatctaaccgcatttattgcgggatggacaagcgcgccacgccgcatttaatgcggcgcggcgcacgcatatccggtccgtggccggtcgcagtgtgtgaccggtcgcagaccggtcagatcgcgggttaggtggcagcaggcggcctgtctcacgcctcgccccgtcccgtcggaatgatgagagcctcttggcactcgtccctagctggagccggcgtggtaactcctggagttagcacgtcagtcccggctcgattcatgccaggcttcatcgcaaccattgcaaggaagtcactgtatgaagaagagcagatgtgcggcatgctaaactgacgcgtggtggagaagaatgaccggtcagtgactggactgacgccggtcacgtcatcggcagacaaccgtgctcccacgttgcatctgcttccggtggagtggaggtaggtatgacccatcccatcggagggtcattcggacggcggccattgcaaatctccgcccattaatgaagaaatgacagggtgatcccctgtgtccgacgagtgacggcgctgggcatcactcaaggacaagcggtgatttagcttccaggcggaggcgcgagtcaagatttggtcaagatagggtgggtccccacccaaaagaagagtaggtagaagtggtacatgtggtatccccttgaaatataaaaggaggaccttgcccacctaagaggaggatgaaaaaaaaaacaggggagaagagcaaagggaggatccagaaacagaggggaaggaggggagaactgagagaacatctgagcttagaactgagagaacatctgagcttgtagaggagagacaaaggaagagggtttctagagcttgaactctcttcctctccagctctttgtaactccttcactcacagatccaccagaacacaggagtagggtattacgcttctcagcggcccgaacctgtctacatcgcccgtgtcttgtgcattacctctctcgcgaacattccacagatcgagggtgaagaatctcactcagcgcccccggccgaaccggcaaaggggggcctgcgcggtctcccggtgaggagcccacacgctccgtcaggcttattaggaaataaaactgaatttgtaggtaaaacttttttaaatgtgttcttggtgacttaaaagccaatgttgaaaaagaattacgttaaaaatatctcaaaattaagcttgaaaattcaaattttgccttttttcttttcctaattcaacctccgtcgctgccgcctgtcctcccccagccccagcgtgtccttgctctggcggcaacgacagtgcgcccgatggccgacgctgctgcaacatgtatctgacgcaccggactttgtcgccgcaagcgtagttgtttggtttccatggacttattcaaagtccctgtcacgtcgaatgtttcgacactaatttagagtattaaacatacactaattacaaaacccatttcataacattggactaattcgcgagataaatgttttgagtctaattacgccataattataataatgtgatgctacagtaaacttttgataattatagattaattaggcttaaaaaattcgtctcgcaaattagctctcatttatgaaattagtttttttattagtctatgtttaatactctaaattagcgtccaaacatccgatatgacatgggcttaaaaaaattttagccccatctaaacatacatgttctgcaacggaggttgtgttggagcttttcgtatgagtatcgattttgtgtatgtctgacaaatcaacctgaagccatttaggcaaatcaacttcatgcttctcttttttttttttctttgcggggaacttcctgcttctcaatttattcttgtatgtatctttcatgctcaaaagtcgttcagccaaatcaaccatcgtcgtcactagcaatgactcgtggagtgctgccgtcgtcgccgaagacaattattggagcgctgccgccgcagctgcagatgattcctggagcgccgccatcgctgccgataactcctggaatgccgccgtcgtcgccgctgacaacaactcctggagcaccgttgtggccgcagaagactggtggagcgcaccgcaattcctgaagcgtcgtcggctcgccgccactgccgcagattttcctctgcaaagccttatccaaaacacggatcaaatcgacgaagctcctttccaatgtgcaaatacaattttacccctccaccttgttcccctttgacaggtactccctctattcctctattccaaattcacctacatatttcacaagtacaccaagacaaaaaaaaactaataactctctcattctatatttactctagcaacaaactcgatgcacgcaccatccccactattttctagccaatagcaaatcaagatattgcatgtaaaaaccgcgaatattagggaatgacctaatatcaaataattagaaagggtgaggcttcaaaccaaggtcgtctagccaccaccttgtggagctagccggaagacccctgagtgtttctcaagatattgcatgtgggttataaatacttgtgtgtgcatggatgcatgcatcaatgtccatttactccaatgcacaaataacgaatagacttaatgaatgagcacaaatatgtagatatatttggaatggagggagtaccacgtaggaagtaaatggtacctgaaggtaccaattgatgtcagccatccgatcatacctatccaacggtccacatttggtaccgggcttcactgctggacggtaaaaaaaactcttacttaatactccatccgtttctaaatatttgacatcattgactttttatcacatgtttgaccgttcgtcttattcaaaaatttttgtgaaatatgtaaaactatatgtatacatatacggtagcgctattccgagcgctagagcgcggaatattgttccgagcgccgcacatcgtgcctagagtccgtaaaaactggtgttcggttgcccacgttcgatctgtgtagattagttatatttgaattcggggtaaatcaattacagatccgtaaaatcggtggttggttgaaaataatcgctgtaattggtttatctttgtttccaatcgaggtagttacgatatggtgtgcaatacaaactgagaccaaatcttgtagtaatcgaattactgtcgatgtaaatgaaaattgatggtgcatgtgcctgtagtaattggattaacgacaaccatacttggtgaaatcttgtagtaatcgagttactgtcgacataaatgaaaattgatggtgcatgtgcttgtagtagttggattatgaacaacattggttgatactgtcgatgtaaatgaaaattgatggtgcattaacttgtagtaattgcattattgctagtcttggttaacgatttcttatagtaagtgcatcaagaaaaaaaggaaaaataaataaagagggagttactggggcctaattagtttaccccaaataatacgtgaataaattttttatttatacaatgaatcactccatcctaaaacacgggacaaaaaataaagattttacatgcacatcatagtaaaagcataagaataaaaattttacacacaaacacaacaatacacgccatcgccagttcctcgtgacggctgaatggagtttctgtcctactagagagagcaagaagacaatgcggcggagatgcaggctggagccgaggtagaaccaagtttggccgctgcgacctcggtaggagccggatccgtcgacggagccaaagatggaggtcgtcgttgctattgtcatcgcctcactgtcataaactgggcaacgatagaggtgatgaaacaaatcacagtttcttaccgatgttaccaaatcgattgaccatcacaaacaggatctccgccatgtaagggagaatagagaagcacgccaagatgagtgctcaacccaatcgaagtcagactgcatagaatcaagaaggataaagaatttaattaatcatagattgtatacaattctcgcaagaaatcaagaatctcattaggaattgctgagagaactcaccatccccacgacatccaccttgttcgccatgggccagacgtctcttcagcatcgatctgaagtagatgctgcggcagcgaggcctgaagcagtgccttcgcctcaagcgccgccgcccaccactcgccggccaccgccatcaactgccacggtgtcgtcgtcctcctccatggtgcgtcgcctatctgtgggctgggatggtggatcgattgagatccggaaaaaaaaatgaagtgggggcgagagtggttggttgggtacgggaaaaataaaatatatactagaagtagagaagttgtttttatcggagtaaattatttactccgataatggtgggagcacgatgcgggacatggggtgggatcgaaaggaaagttgtttttattatcgaagtaaatcgtttactcagataatggtatgagtgggatgacagggcgtggggtgggattgtaaccagataagtttttatcgaagtaaatcgcttactccgataacggtgggagcgagatgatggaacgtggggtgaggtgggcctggctgatacacgtttggcgcttggaatataagagcgcacagcgctcccaacagtagttctaatacatataagtatatttaacaatgaatcaaataataggaaaataattaatagttacttaaattttttaaataagatgaacggttaaacacattaaaaaaattttaacggcgttaaatatttagaaacggaggaagttccatgcatcgtaagttagagctttaccgtctcatcaccacggccagttgatctgaacttggaccttccaggtgtagtgggagcagatccacggtttccttccaatgaacttatgaacgggtgacttctctatgccggtttttctcacggcattgtcgtagttggtatgatccctatatctatgattaggtgactcagcatatggttttcgaacagtggtttcgtgctgacgaagatcgtcttctcggtttgagcgtctgtcatccttgggttttctcactgctggagaggccttagagcgtgtttccgcatctccatgattgtttggattaacagacctccttgagatttacccttgcgggcattttcgaaatactgtgtgtagaggtgttcaccacggtcttcatcctcccagcttccaaatttaggaactcctttatgctggtaaagtttaataggaagaataaagaaacacctatactcccaaaaaaagcgctaatgagaaaaaaacaatgttctagagcagatagcatatgctgattgctgaatctactacggttgtgtttagttcacactgaagtttagaagtttggttgaaattggaacgatgtgactgaaaagttgtgtgtatgaaaaatttgatgcgatggaaagttgaaagtttggaaaaaaaaactttaaaactaaacagggccgtatgagcttgttcccttgtcagttgtcatctttcgtatgtaacaggaaatataattctagcctaaataggtatgattatctaaactctcagatattgtctattgtaatcattgtatgcatgacatcagcttatgtcaaagctgtagctttgttggatcaaccagaattggaataagttcgctttgtgacccttaaaagtaatcgaaatctaattcatgattctaaaccacgaaaccaggtatctcgacccccaaactcttaaaaccggtgcaatttaactctctcggcggttttga

SEQ ID NO: 42613 - DNA, 2322 bp, Oryza sativa
tgcgtaagtgccacgtcaacgccacgtgtatcaaagactcggtcaatatcgccacgtaggtgccacattagcgaaaccgcccttcaaaaccaccgaggaagtcaaattgcactagttttaagagtttgggggtcgagatatccggttttatagtttagggtcacggattaaatttcgatcactttttaagggtcacaaagtgaacttattccaccagaatttactcgatcctgctgaaagacttagggcccacttagaagcccagtatttggcccaaaactggtgtaaactacaggcccataatattttctccatgctctgggctcaaacgcacgctttgatgggtcgtgtaacatacacccatttatggcccaatccaacgaaggttcggtccagtccagcctctaactccgccgccgcatgcccaatccccgccggccgccgctgccatctcccttccccaccgccaccgtcgccttctccgttctccctcaaagcctcagtagcagcagctgcggcgcggagagcggagggcctcatgcagaggagcgcccgggggacggagacgacccatggcggggcgacgtcggcagggacggcctgtaggcggtggagactggagaccgcgaataatgccgtcgccgacggggggagcttcaggcgaggatgcgtggccttcgtcggctgctgctctcttcctcgctctggtttgtcattgtgttggttggtggtttggggatatcaggatggggaaggagaataatgggtttgttgttcttttgtgctatttgaatgttctcttgtcaaatttcatggtgattcgatctgcatttgttattggttgtcaaacattttatttcgggatggatgttattgctcgtagttcagtggaagttggaaaccacagatggcttatggcaagaggtgttgagaaacaaatatttaaaaaaataacaaaacactcttacagaaatacacagagtgagtgattcatactgtacttctgatcaggtctgatggagataaaaaaaaaaaactgtttctaaatttttgtgagaaaaaaaagtggaaattggagaaaatacacgtttgggaagactggtgggtaggggcaagtttctagcagaaagctttcctgagctgtataatataactctaaaaaaacataacaattgcaaaagtaaaacaaaaaggcttagaagaagttagattcagaagatgcctgtatggagaaaagaaggtaaagtggagaagaatttgctgataggctgtccctaacaaaagaaaaggacaagctgagttggagattaacaaagaatggtgtgttcacagttaagtctttttacagggctttgaaaatgcacaacatgcaattcccctataagaaaatgtggagaatcaaaataccacctagagtgaaagtctttgtattgctgaagttgtaaacccagatgctgtgcctggggatgcctaaattctgtttttgcttaactagatcctaggttgttctgaactgattggctgagggatggcatctggtggtggtgctccggatggcgaccctgtagcctgtcttttgttttcagttcgttgaacaattgtaatgctgtgtttcgtggtggtatattttttccttttttcctggttacgaccctccagggttgtaatcttgtaattttttctgctctatcaatagaacttcgcactgtctcgtgcgagtcattcaaaaaaaaatgttgtgtttctctaatgggaacaggagaagaatgcatctctttctaaaaaaaaatggttcatagttcagtaattaactctgtgcaaatcattgagctgggtgttcagtattttaggaatcatcctactttccacctctcccgctagcgtgcatcgcctgttggaataaaaatagcgagagaaaacgaaaaagtcataagagaaccaaaattagcggttacactttaaataaaaaaaacagaaaactgcggttgctgatcgctctgcaaaaaaaaaaaaaagagaaaaaactcttaagaaaaactaaaaacaagtagttgattaaaaaattgctttataatgatatgggcaattgcaatgcacgggtatatgactggttttaccaaaacagctcagttaatatgggggttaatctctcactactattttccttttacacatatgagaaaaaaaacactcccaaacaagtccttaatgtgtactagcgtacacattggagaaaaatgcactcccaaacaaatccttagggcctgtttggaaaagctcctactcctaaagttagctccaggagttaggtctggagtggag

SEQ ID NO: 42614 - DNA, 6775 bp, Oryza sativa
  unsure (1)..(6775): unsure at all n locations
caactccagttcattttgtaagagagctccacccagctccactcccagttttggtgaagctgaaactgtttggctgagctccagctccaggaggggtggagttggagctggagctgtgccaaacaggcccttactctaaagtgacctaaggtctgaagccgcttcagtttgaatagtggactcctgagtcccgagtagaaggaaatggataatgaaaagctttcttcgtattccctctatacttaaaaaacaaaataaaattatagagatgaatatagatatatactatgtctatattcatcctcaaaatttggtttttcatgggacaaagagtgcaatgtattttggagacatttttgccatctgctagtaataatagcttaaagcgacctgatgtctgaacgactgaacccgacattgttgattgcttatcccacttgtgccatttgtagtggatacatcctctctctctctctctccatgattgtatccccttcttcctcgataaggccacagcgatctgaaattgctacttctgatgctatggtcatagttcattggaagttggaaaccatagatggcttatggcaagaggtattgagaaacaaatatttaaaaatcaaaacactcttacggaaaacatagagtgggtgattcatacttttggtcaggtctgatggagattaaaaatatctgtttctaaatttttgtgagaaaaaaaagtggaaaatggagatttgggaagactggtgggtaggagcaagtttctaggagaaagctttcctgagctgtataatataactctaaaaaaacatgtaacaattgcaaagctaaaacaaaaaggcttagaagttagatttcaaagagggtaaagtggagaagaatttgcaatgagattaataggctgcccttaacaaaagaaaatgacaagctgagttggagattaacaaagaatggtgtgttcacagttaagtttttttatagggctttgaaaatgcacaacatgcaattcccctataagaaaatgtggagaatcaaataccacctagagtgaaagtctttgtatggctgaagttgtaaacccagatgttgtgcctggggatgcctaaattctgtgcttgcttaacttaatcctagcttgttctgaactgattggctgagggatggcatctggtggtggcgccccggatggcgacctgtagcccgtcttttgttttcgcttcgctgaacaattgtaatgctgcatttctctaacagaaacaggagatgcatctcttcctaaaaaaaaaggttcatagttcagtaattaattttgtgcaaatcatcgagctgggtgttcagtattttaggagtcatcctcctcaaaatttgtttttttaatggtacacagagtacaatgtattttggagatatttttgccatctgctagtaatagcttaaagcgacctgatgtctgaacgactgtacccgacgttgttgattgcttatcccacttgtgctatttgcagtggatacttctccatgattttatcgacaaggccacagagacaaaccaacgttgtttgcttcttttctccaccgacaggtgcaactgtgcgaggctctctctcctttcgagactggagctgatcaagtgcaaggctacgggctacagcggcgagtgacgcgcttgcggctgcaggctgctgagctcgtccgtcaagcgccgccttaatttgagacgggtccgagcagctccaaccttgctctccacgaaccggccaagcccaattcgccgttgagttccggtcgacggaggaacacaagaacgacagggcaccacaccggtgagcatcccagcttcttctcagctatcgtcagtacttcgtggttgcgcttgcgccgaccgaccggcttctctcccgcgcactccagttttctatctctatcgtcgcccagttctcggaagcttactgcactgtactgtacttgcttacttcttcattccaatcaaacactttcattccaggcagcaactcttaatactagctagttgcattcagttaaacacattccttcagtttccatttcccacaaaaagcagctgctgctcacactccttgcttattgtgcttccctgtgttctgttcgtgtgttcttagctctaggagatccttccgatggcagagctgatggccaccatggtggtcgggccactgctgtccatggtgaaggacaggcctccagctacctcctggagcagtacaaggtcatggagggcatggaggagcagcatgagattctcaaacgcaagctgcccgccatcctcgacgtcatcgccgacgccgaggagcaggcggcaaaacacagggaaggggcgaaagcatggcttgaggagctccggaaggtggcctaccaggccaatgatgtcttcgacgagttcaagtacgaggcactccgccgcaaagccaaggccaaggggcactacaagaagctcggcagcattgttgttataaagctcattcctactcacaaccgtattctgtttcgttataggatgggcaacaagctcaggatgatcctgaatgccattgaagtcctaattgcagagatgaatgcctttaggtttaagttccgaccagagccaccaatgtcctccatcaaatggagaaagacggattctaaaatctccaacctttctatggacattgccaacaagtcaagaaagaaagacaaagaggagattgtcaatcgattgcttgctcaagccagcaatggggatctcactgttattcccattgtaggaatgggggggatgggcaagaccaccttagcgcagctcgtttacaatgaccctgaaattcagaagcattttcagttgctgctctggttgtgtgtctctgacaacttcgatgtggattcgctggcaaaaagaatagttgaagcagctcccaaagaaatgaataagaagaatgataatggaggggccaaaaagttaccacaggatgaacttaaaccagttgtgagtgggcagaggtacctcctcattttggatgatgtctggaaccgtgatgccagtaagtgggaagcactcaagtacaaccttaagcatggtggcagcggtagctcagttttgacaacaactcgtgatcaagcagttgctcaactaatggctccagctcaagaagtttatgatctcaagaacctgaatgaaagcttcattgaggaaattatcaagagaagtgctttcaattcagaacaagaaaggcctcctcctgagctactcgaaatggttggtgatattgccaagaaatgttctggttcccctttagctgcaacagcattgggctctacactgcgtacgaagaccaccaagaaagaatgggacgctatattgagcagaagcacaatttgcgatgaggaaaatggaattttaccaatactcaaactcagttacaattgcttgccatcatatatgcggcaatgtttttccttctgtgctatttttcccaaggatcatgagatcgacgtggaaatgctgatccagttatggatggccaatggttttatcccggagaaacaaggagagtgccctgaaatcattggtaaaagaattttcagtgagttggtgtcaaggtcattttttcaggatgtgaaggggatcccatttgagttccatgatataaagtgctctaagattacttgtaagatccatgaccttatgcatgatgttgcacaatcttccatgggaaaagaatgcgctactatagctacagaacttagtaaaagtgatgattttccttattccgctcgccacttgtttttctcaggtgtcattttcctaaagaaagtatatccaggtatccaaacattgatatgttcctcgcaagaagaattgatacgttcctcgcgagaaatatcaaaatacagttcattgcgagctttaaagatggggggagattcattcctgaaaccaaaatatcttcatcacctgaggtatcttgatttgtcatacagtaaaattgaagcacttcctgaagacataagcatcctatatcatctgcaaacattgaacctttccatttgtgactgtctttgtcaactcccaaacggaatgaagtacatgaccgccctccgtcacttgtacactcacggatgttggaggttaaaaagcatgcctccggacctcggacacctcacttgcctacagacgcttacatgttttgtagccggttcttgctctggctgcagtgatttgggagagctgcggcagttggaccttggtggtcgactagagctaagaaaactggaaaatgtgacaaaagctgatgcaaaagcagcaaatctcggaaagaaggaaaaactgaccgaattgagcttaagatggactggtcagaagtacaaggaggcacagagtaataatcataaagaggtgctggaaggtctcacgcctcacgaggggctcaaggttctgagtatacttcactgtgggagcagtacatgtccaacatggatgaataaactgcgggacatggtgaagcttgtgttagatggttgcaaaaatctcgagaagcttcctccactgtggcagctgccagctctagaagttctttgccttgaaggactggatggtttaaattgcttgttcaactgtgacatatacacctcctttacattttgcagactgaaggacgtaccttggccagtatgagaaanttttgagacatggntgggacacaaatgaggtaaaaggagaagagctgatatttcctgaggttgaaaagctgataatccaaagttgtcctaggctaactgccttaccaaaagcgtcaaatgtgatttcagaattgtctggcggagttagcaccgtgtgtcattctgcatttccagcattgaaggaaatggaattatatggtttggatatctttcagaaatgggaggcagtcgatggaactccaagggaggaggtaacatttcctcagctttacaaattagatattagacggtgcccagagttgactactctacctgaagcaccaaagctgagagacttaaacatatatgaagtcaatcagcaaatatccctacaggcagccagcagatatattacttcattgtccagtctccacctgcatttgtcaactgatgacacagaaacagcaccggtggccaagcaacaagattcgagtgaattggtgattgaggatgagaaatggaatcataaatctcccctggaacttatggacttaactggctgcaaccttttattctcttacccaagtgcgttggctctgtggacatgttttgttcagctcctagatctgaatatttgggaagtcgatgcgcttgtcgactggccagaagaggtgttccagggcttggtttccttgaggaagttacatattcttcaatgcaagaatctgacaggactcacacaagctcgtgggcaatctacactagcaccaagtgaactcctgccacgtttggagtccctgcagatacgccgttgttattcttttgtagaggtccccaacctaccgacgtctctcaagctattacaaattacggactgccatgacctgaggtccatcatattcaatcagcagcaggatacgacgatgttggtgagtgcagaaagcttcgcacagccggacaagtcatcgttaatatcagggtccaccagcgagaccaacgatcgcgtccttccacgcctagaatctctagtaatagagtattgcaatcgtttgaaggttctccatcttcctccgtccatcaagaaattggatattgtacgctgtgaaaaacttcagtcactctcaggaaagctggatgccgttcgagcattaaatatcagctattgcgggagcttgaaatcactggaatcttgcttaggagagctcccgtcgctgcaacacctcagacttgttaattgcccaggcctggtatccttgccgaaggggcctcaagcatactcatctcttacatctcttgaaattcgttattgttctggtataaatttgcttccaccgagcctgcagcaacgtctggatgacatcgagaataaagaactagatgcctgctatgaaggtaatcttcagtttcttaaccgtgtacgatttagtggtaaaagtttcgagcgtggtgtctagaacccctagtcaaccattaatatgattatttgtacatagagtacaatgcgcattcataactcacttcttcagctgtgtcatctaaaccctttaaactttgagttgcatttgggtatctaatcgcatacaaaggaatttagtaatatctccagtagctattccttatatatgatgatctcttcctgtgattatgcttgctagtttggactatgtaattaatttttgccgggtcgactatgtaattaattgacttcatttagtcgccaagtgtggcatcatgcaattattatggcaaagctgtattagtcatgatcgaagccacttggtgaacttattcccttctactttgaaccaatactcattgatcatttccctttaagcgtttgatatggacaacactttaaattcgcagagctaactaacgcagcgcttgtctttacatttctttcttttctatatggtatataagggtagaatggtaatttcattcataccgctgcatgcgaggatgacttgacatactcatgtggcatttttgtgggtccaaggactatattaacccaaataattaatttgaaggacttgtttggacgatttgaaacatcgatgactaaattgagcccgaagagaaacttcaggagtcgcat

SEQ ID NO: 42615 - DNA, 1391 bp, Oryza sativa
tgcaaactaatgttagttcaggcaattactctgaattttctgatagacgaacctgattttttcatgtcaggtgccgtgcttgttcagattcagcaatttacatttccaaagaagaaaaaggaaattcatacattttttttacttttttgaaagtggcctggattttcatgatttggttaaaatttagcctttgtcgtaaggatttggatcctctatccagacacatgccttccaagataaacgaatccctcattatacaaaaaaaagcacaaaatgctcaacaagaagcttcaaattcgtgtaaatacatgtcatgtctcgctaccaaacaatatctcaacaatgacaacagattggaggtattcatctcacaatgatacatttcaacacaaatttatgtaggcctcgctgacaggacttggctggatggctgtcagttcagttcttgaaccaactgaagcatgagcagccctgcaaggaagcgataaactgaattaaaatagggatttgttacacaatacctgtaaagtggattacattaaaatattaccaaatcatactgtaagcaatcatgcagaacaagattccttgcaaacaacactaaccaaacttctagtaaaaccattatttttgctgtagtaccaactttttgcaaccactatatactccagtaaaaaccagaagtattgttgcaatgactttgccgataaattatagaatgcagctactcgaagcagtagattttagacaatttttactgcataataactacgcatggtgccatgatccctaaaaataaatagaggtataccaagctcaagtattgacaaactcaagtggcaattggcatatgaacaattttctcgttcaaatatatctgaagcaatgtgtaaaacaaaatagttttgctccacacatctgaccatattttttttgagtaagtagacttactgtggattcatatttgcgttgttgatagcgtttgatataatctgcctcgctggtcatgacgggagcgttgccggtaccagactgtttctcctccctcaccttctcaaatatgtcagtgaaaccttcacctgtagaaggatctttctcatcccattctccaaactttggcacggctgatcctctatcaggctgcaaacgcaattaattacttcatctaaaggtatttttatagtcaatgaatcaaagggcagtttacttaataccatgcatcataagttagagctttaccgtctcatcaccacggccagttgatctgaacttggaccttccaggtgtagtgggagcagatccacggtttccttccaatgaacccctacggtcacgtgaaggagacgaaactccacccttgtttgcagctcttgcctggtgacggggatgaa

SEQ ID NO: 42616 - DNA, 3739 bp, Oryza sativa
tggagatttacccttgcgggcattttcgaaatactgtgtgtagaggtgttcaccacggtcttcatcctcccagcttccaaatttaggaactcctttatgctggtaaagtttaacaaagaactatcatattattgaaatgcgctaagaaaaataaagaagcacatatactccgaaaaaagagctgatgaaaaaaaaaagtctagagcagacagcatgctgattgctgaatctactacatgagcttgttgccttgtcagttgtcatcatgttttctttcatatgtaacaggaattataattctagcctaaataggcatgattatctaaactctcagatattatctattgtaatcatgtatgcatgacatcagctttgtccgatcaaccagaatttactcagatcctgctatctatactgcttgaaagaacttgaatgtaactacttgtgcatcttttctgcaggaacactactaaggatgcattaaaaggacaggtctcaaacgagcaagtaaacaagctgtatcaattatcacattcacgaagctgagatcttttctctgcacgagattcctgcattaatatattactcagcaaatcagccctgcaagcatgccatgtcgacattcttgtaacattgaatccgcagcataaattgcatccttgaatgcagaaaggctggatcttggcagattggataactacataattgagcagaaaaggacatggcaacaatttcggtttcagattggcacattttcttgggaaattaaaaagatcccaaggaaaatagccccagaaggaggcaacaagaaaatgattccacaagatgcaacctgtctcctcaccagtaaacaaaaatactgcaatttaaggaacccctaacattgggcaccgagaagaaagaaatgacaaagcaagcatttctgcaaatcagaggcaaccccgagaaatcccacatggcaggagaagcgcccaagacgattcgagcaaacccaaccgatccaagcacgatgcaacccaggaaacacaaacaggccagtcaatcgagcaagaacttacggccatttcggcagggaagctccaagaacagcagcaaaggtgggtccttcacgcctcaggacgctgctccttgctctaatcctctccctcctggattccgaccaagaaaattgttgcgttcaattcaacaaggtcagtaaaagaagaagaacaagtgacccccaatacgagagcagcagcagtagcagcaggaagagactaggaagagcaggaggaattgaaaggaagaagaaaaggtaggaggaggaagaagatgaggaggagtcacgtttgaccattatggcgtcggattcttgctgcttcctcgcttgcttccccttcctttccggctgctgatgatgctgaatgcggtgggtgatgtggtggtggtggtcactgccccggccccttcctgcacgggcctgtacctatcgccttaactccagtttcaccatcatcgtggtggttaaccacacgccaattatccattaccaccacacacacacgctttgccctgcaatgctaaactgtaaacagtaactcagctttaagaattaagcagcttagcttaactgctcctgttgctgacgctgtcaatgctagtgtggcttgaaggctgaagtgctgaactgcactgcacagcggcaggtcatcgaacattctttccttggttgactcaggagtaaaatctccttcgtaataagggcatatgcatatctccttcaaagattttttttataaatatttgcagctacgtatagtagtataaaagcaagtttaatagtatagacaactactggctcctaatcatctatagttaatttaatagctaatttatacaatagttatccataaatatatactacacaattcatatttggtcccacatgtcatacacacatacatatttagtctgtgttacagctggctacaaatctgtaaaccgctgatcttctctatcttcttttatcttctcgaaatgtgtttatagctggtttacagtttgctattatctaagctctaatggtaggatgattatcatactgttgcagcaacgacttcttcctttggtgttgctgttgcgtggaattctcatggtatcatcgtctttcgccctagcacggagctttggtttgccctgaccggtctaacttggagtctactgtggtccaaactccagaccgtgatgattatgaaaagctcttatcataatttctcttttggaaaaggacttttctttttctttatgaggcatgcattattcctgtatatttttatttcagtagtatctaaaaaataagacaggcatcatttggatttcttcgggttccgaataaattcatgtaaattctctacatttcaaccggagaatgattcggtttagatgggatttaatgctagaaaggaccatatttgtgagcctaaaaggtagaaaaacaacatttactcgagctaacatgggggcaactttatctgatatctatcctagtcattgagagctaaaagtatgaaaaatataattatctctgaacaacctctttttttctctcttttcctagtcattgtctacagcctttttccaaactaatgttgtataagaaaaatactatacgtacgactaaacttgtgtgactttggaacgaccttaacgccgtgagctcgtgacgttaatctccgtataaccaagccatgttgtcaccatactcagtcacgtattgagttgttttaccgtttgatcgtacgctggtcggacatacaagtcatacgtatagcattgttcgttgtataatttgattacagactacagtcatatgagatgatagaacactgggtgtactgtaccttatttcaggattgcactgtatccctttgtcatcctccctcttctctttaggctcttctgtactttcaatttttcgtcacatcaaatctttcatacacataatttttcaatcacatggttttaatttcaaacaaactttcagaattaagtgtgaactaaacacacagtcttgtttgtttcgagtacaattactgtacatcgacagacctgcatcttcatccgatctacgtgtcgcagaacacaaactgacgacaacgatgggattttttttttttaaaaaaaaagttcaaattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcaaggaggagttgaggtccaaagcgatcaaggatgccgggtgacaagattggacacaaggttgcacacggtggacgaacaccgtgtgaggaggtctttgcaacaggcttcacaaggtcaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctagctgtgcatgtgcgctgtgattggttggcagggaggccaagccaatccagccgttccacgtggcccaagatggtgaatggctcgg

SEQ ID NO: 42617 - DNA, 3233 bp, Oryza sativa
tctctctttctcacctctcttctagtttcgggaattccttttctcttcctcctctagtttcgggaattccttctctcttctttttctctcttcttttctagatccggcttctaatagccgcgattctagtaaggattttgagaaatccggcttgatgagtattttcgggggcaagatttgaattgctatattcaccccccctctatagctgttcttggtctttcaattggtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatctccttacactgtgcccgatgatgctgacatcacgcctgcaaatatggctcaggttgattttaattatcgtgcaagaaatgcaatcattggtggaatttcttctggtgaatttaatcgtgttcaacaccacaagtccgctcatgacatgtggactgctctgtgcaatttccatgagggaaacaatgatattcaattggttcgtcagaatcaatttcataaagaatatcaaagatttgagatgcacccaggagagtccattgattcttatttcaaacgttttggagaaattatttcgaagttgagatctgttggaaaagaattttctgataatgataatgctcgccatcttttgaattgtcttgattatggtgtttgggaaatgaaagttacttccatcacagagagtgcacctctgagtgaccttaccatggacaagctttactcaaagctaaaaacccatgagatggatgttttccatcggaaaggcctcaaacactcgatggctttggtagctgatccctctggtagtacttcttctaatgactcagcttttgtgtatggtggcttctctcttgccgctttacactcagtcactgaggagcaattagagaagatccctgaagatgatcttgctctttttgctagaaaattctcaagagcttacaaaaatgtgagagatagaaaaagaggaaaaaccaatgaaccatttgtgtgttttgagtgtggagagcctaaccacaaaagagtgaattgtcccaagttgaagaagaagagtgacaagacgaccaagaagcccgagggacaagggcgaaaggggaagaaggatttgatgaagaaggcgatccacaaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcgcttgaggataaggatgactcatcggagcatcctgaggtatgtcttgatgatatcccttccttggatggttctctttgtgatgattcttgctcagataatgactctgttgatgatgaactaagcaaagaaagaatggcacacttgatgattgaaattagtgataagtataggtcttctaagtataaaattgagaaactaaaatctgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttctagtgctagtgctgcttgctctacttgctatgaaatgaaagttgatatgggtttgcttgagatggaattgaaagaactaaaagaaaaatttgttcatgataggattggtaggtgtgaaaattgtcccattctcactagtgacaatgatgaattaagacaacaagttgccatgcttaagaccaagaatgatttgttagaatcttttgctactaaggaacctattcattcttcatgtgctaattgtgctatcctggaaactgaactaaaagatgctaaaactgtcattgattctatcaaatctattgattcttgttcttcatgcatttctctgaaagttgatcttgagtctgctaagaaagagaattcatacctacaacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacactagttctagtacacccaaaacctcagaaccaaagatggtacctatgactagcaagtctaagcctgtagagttacctagacccaaaaatccaaaacaagttgagacaagcaaaccagagacaaaccaagcctgtagagaaaaccaagtatgagtgcacctattgtgggaaagctggtcatttggtaggtttctgctttagaaaggctagaaaagagcgacaagaacgtcttaggactagaagagctactagagtcctgagaggttcgagtgtgcgtgtcattgtcgttcaagtggtgtatctcgctttcctcgccgagatgtgcaccctcgacgtgacctagcagggttggggcaaaacagacatggtcatcttgcatataattctgctcataacactaaagatgcttgtacttctcgcatggttcagtactggattcctaagtcatttttcactaaccccagtactgaatcatcgagatctgctgtgtctttcttgtaggattttggagtagggagaagtaattcttggcttgtggactccggttgctcacgccacatgaccggtgaagccaagtggtttacttctctcactcgtgcatccggtgatgagaccatcacttttggggatgcgagcagtggacgcgtgatggctaaaggaacaatcaaggtcaatgacaaattcatgctgaaagatgtggcactagtaagtaagcttaagtacaatttgctctctgtttcacaactctgtgatgaaaatctggaagttcgtttcaaaaaggacaggtctcgagttcttgatgcttctgaatctcctgtttttgacatttctcgagttggtcgagttttctttgctaacttcgactcttctgctcctggtccttctcgttgtctcattgcctcag

SEQ ID NO: 42618 - DNA, 934 bp, Oryza sativa
ccctacgtcttgcattaatatattttgtgatagtcaaagtgcaatatgccttacaaagtatcagatgttccatgagagaacaaagcatattgatgtgagaaatcactttattcgaggtgtgattgctgaaggtgatgtcaaggtatgcaagataagtactcatgataacccagctgatatgatgacaaagccagttcctactactaagtttgagctttgctcaagtttggttggtgttacagtatagtcttagagactatttggcgcgcggtgattttacctacatgaggtatctttggtgattgatgtttttatgctacaagaggaaattcgtctcaaggtggagattgttaaatatgtgatccgaattttgggcccacaatatattcggattagtttcctagtaggacttcatgtctatcctattatgtgtccttctattatcccctatatatactcttgtaagccatacgggaaggggtgacgttcccattgtgattcccctacgtttgtaatcaactcctcaatagtgatcattgccggtcggcgcccgtggttttttcccgcaagggttttccacgtaaaaattcgtgtctccgttgtgcatctattttcataacacacaattatatttacagatttaaggttctaactgcagcagctgacagataattacacacatgtttcaacttgagtagcgacagtttatttttcagcagcttgtaccagtctttccattttttccacaatgggaaattcattccaataagtaggaacatcaattgatcaattccattgatcaacaatgggagagataacgttgctgcaaaatgttgttgatcaatcacaagtatcctctgcagtcatgtcatgtaggaaaaacatcattgaaatggaagtgctagctgtgattctcttatgatggagcatgaac

SEQ ID NO: 42619 - DNA, 6492 bp, Oryza sativa
cattaatagaaatgaggtggtacaaagttttagaaagaggaaaagccaaatatgggaaagaaaaagaataagaggagcatagaaagaagaaagagccccggggggaggatttaaataatgttaaatatgtgatccgaattttgggcccacaatatattcggattatatagtttcctagtaggacttcatgtctatcctattaggtgtccttctattatctcctatatatactcttgtaaaccatatggaaaggggtgacgttcccattgtgattcccctacgtttgtaatcaactcctctatagtgattattgccggttgacgcccgtggttttttttcgcaagagttttccacgtaaaaattcgtgtctccgttgtgcatctattttcataacacacaattatatttacagatttaaggttctaactgcagcagctgacagataattacacacatgtttcaacttgagtagcgacagtttatttttcagcagcttgtaccagtctttccattttttccacaatgggaaattcattccaataagtaggaacatcaattgatcaattccattgatcaacaatgggagagataacgttgctgcaaaatgttgttgatcaatcacaagtatcctctgcagtcatgtcatgtaggaaaaacatcattgaaatggaagtgctagctgtgattctcttatgatggagcatgaacgagatcaaagacatcgcagttcacacgaaaataaaaaggattttaaaaaagtgaagcagtttaagctccagcatgttattctttagcttacaacctgggactagctttctgcttaaagtcaaggccttggatcatcggcttcatccttcttgtagcagctcacaccaaccggacgatcgactttactggagtttatcttgagaaagggtaggtaggtaatacattctaccatgagacacaaatcacacaattaataacccatcagttgcagatttggtaacgatcctgcaaggaagtcacaccacagagagagtcagcataaggatagtggttagcatttcattcgaaatcaatcatgtataatgatgttacaaaccatgatgactcatctggtcctgaatctgttactttaagcacagcagcctagcgactgcagattgatgggcctttggttctagcaaacaaaagataatagtaataaaaaatgttatgtattggttggataatatgtagaccacagcattccatagtcaagtttggcataagatgattagaaggaactacgtatactcaaactacatgcaatggagctatgagtttccagagaaatgttaatacaattcaagtaccgcgacagttagttctacaaatttaagctgctgtccatatcagacgcattaatatatatttttttatttattttagataatattataatttattatttattcgtagtaaagcacgtgcattcagcttgcataatagtaatggctacagtagatataactaaattcttttgtacccccaaatgcaattcaaaaatttgaagtgtttaggtcacaccactgcacaagtgagttatcgatgtgcattgtactctgtacatataatcgtattaatggttgactagagattctatacaccacactgcaaacttttagcaataaatcgcggtacatgcttaagccgagagttgccttttagggcacccaccaaattaaattgagctcctggctatctattatattatcaaaacagctatgaaaggaggcaccacgtttgctgtggatgctcgaaattcccatattaatcggagaaaaagaaaagaagagtcaatctaaaaataactgaaattcggaattaaaaatatgcaatattgatagatgagtccatataggaacccaatacgtgattaattaaaatttggaataataataaaataaattccaaaattagaaaaacaaaaaaagaagagttcgagtacgtaggtgacggagcgtggggctcctcaccgggagaccgcgcaggcccccctttgccggttcggccggggactcagggtgaaattctaagctctctgtatgtggaaggttcgcgaccgtcgaaagagcataagacacgggcgatgtatacaggttcgggccgctgagaagcgtaataccctactcctgtgttttgggggatctgtgtatgaaggagctacaaagtatgagccagcccctcccttgttctgggttccgaatctggaaaagtccagtcctcctctaagtgggcaaggtcctccttttatatcttaaggggataccacatgcaccatctccctctcttctgtggggacttactctaccttttcataaatggacggagatttgtatagttgccgtccgaatgaccttctgataggacggcccatacctacctccacttccgccggaagcaggtgcgacgtgggattatggctgtctgctgacgacatgaccagtgtcagactggtcacaaatcgctcattcttgtccaccacgtgtcagtttagcaatctacatgttggcccttcttcacacaacatcttgcctgtaatggttaggatgaagcctggcatatatctaaccaggactaacgtgccatctctgggaggtaacacgctagctccagctggggacaagcgcctagaagccctcgtcctgacgggatggggcgaggcgtgcgtcagatcgcctgtcgccacctaacccgcgatctgaccggtctgtgactggtcacaaaccggataaacgagtgcactgcactgcgttacatgcggcgtgacacgctcagccaaaccacaataaatgtggttaggtgagccccgctgtgctcacctaacccatacacgcggagcaaaaatccacgaggggtcggggcgcctcggccctcggggccgaggcgggtgcggcccgaccccctcggggggactaagaggagggcgaacacatcaccctcgggcccgacgtcccccgagggtgccaggccacgtgggcgattgtgtctgcctcaaacctctagtcatgatactcctgatcccatgtcaccgacagtaggaatacaatttataaataactaaaattcagaattaaaaataaaaattattgaaagaagagtgcatacaagaatccaatacgagataaattaaaaattggaataaaaaaataaaaaaatcgaaattagaaaaaaataagagttcaagtaggaatacaatttaaaattaacttaaattcggaattaaatataaaaaatattgaaataagagtacatgtaagaacccaatagtagattaattaaaattcagaataaaaaataaaataaaatccgaaattaggcaaattaaaaagatttgaaacaactgaaattgaaaataaaaaataaaaatatcaaaagaacataataataaataaaataaattctgaaattagaaagagaaaaaaagatttcaactaggaatacaatttataaataactaaaattggtgataaaaaaataagactattgaaagaaaagaccatctaaaacacatgacgagattaattaagtaacaggcctatggaggagcagagttgtggcggttgatgagacatctaaaaactattaataaaacagtaaatagaatcctaatgacgattaaaagaaaggatgatgggcagatcgtgaagcaatcggtcaaggcggttgtcggggacttctagaaagtaaaaacataaaccccaatgataatcatatttgatttttaaaatctcaattataataaaaatgagaggcagcgggtgggtcgtataggagtacaatggcagagtcgtcgatggttgttgcgtcttttagaaagtaaaaaatgaattccaacgatagttatgttcaatttttagaatcccaatgacaataaagattatgcggcggacgggtcgtagaggagtattttgacagcgtttgacatgatttctaaaaattataaaaaacatgaaacccaacaagacaataaactctaaaaactataaggtacaatttttaaaggttcgggcttctaaaaagtaaagaaaataaaccccaataataatcatgttagattttaaaatctcaatgataataaagaagggcggcagtgggcgagccgtagaggagtatagtgacaaagtcgctgacgttttggcggaacttctagaaagtaaaaaaaaacctaaataataattatattcgacttttaaaatagcaatgacaataaagagaagatgcaatggatggttgtagaggagtataatggcagctctgacgagacttctagaaattataaaaaaagcccaacaggacaaataaactctaaaaactataattttttaatccaatttttaaaggtttcaatgagaatgaatagaaacaatggtagatcgaaaaagctaataaaaaataatatgataaaagtaaggggtagcaactgatgtgacttttaaaaactacaaaattagaaacccgaggatgataatgtttggtctttcaaaatcttaagacggtgagataacttttaataaattttaagtaaaatcatattaaaaaaatatatgattttatacgggtgctagtcgcgcaattgcgcggaccacccagctagttcttattattaaaagaaatgaagaaagtggagattaccttcgtagcaggcatctagctctttctcctcgatgtcatccagacgttgctgcaggctcggtggaagcacctttataccagaacaataactaactgtaagagatgtaagagatgagtatgcttgaggccccttcggcaaggataccaggctctcgcaatcaaaaagggtgagttgttgcagcgacgggagctctcctaagcaagattccagtgatttcaagctctggcacgattctatatttaattcttgaacggcatccagctttcctgagagggactgaagttcttcgcagcaagaaatatccaatttcttgatggacggaggaagatggagaacctccaaacgatcacagttccatattactagagattctaggcgtggaagggtgcgattgttggtctcgctggtggagcctgatattaatgatgacttatccggctgtgcaaagctttctgcattcaccaacatcgtcctatcctgctgctgattgaatatgatggactccaggccacggcaccccctaatgtctaatagcttgagagacgcaggtaggttggggacttctacaaaagaaccacaacagcttatctgtagggactctaaacgtggcaggagttcacttggtgctggtgtagattgcccacgagcttgtgtgtgtcctgtcagattcttgcattgataaatactgtacctaacttcctcaaggaaaccaagccctggaacaccttttctggccagtagagaagcgcatcgactttccgaatattcagatctatgagctgaacaaaacatgtccagagagccagcgcacttgggtgagagaataaaaggttgcacccatttaagttcataagttcaaggggagatttatgattccatttctcatcctcaatcaccaattcactcgaatcttgttgcttggccaccgatgttgtttctgtgccatcagttgacaaatgcagatggagactggacaatgaagtagtatatctgctagctgcctgtagggatatttgttgattgccttcatgtatgtttaagacacttagttttggtgcttcaggtagagtagtcagctctgggcactcgttgattgttaatttgtcaagctgaggaaatgctacctcctcctttagagttccatcgactgcctcccatttctgaaagatatccaaatcatctaattccatttccttcaatgctggaaatgcagaacgacacacggtgctaactccgctagacgattctgaaatcacatttgacgcttttggtaaggcagttagcctagggcaactttcgataaacagcttttcaacctcaggaaatatcagctcttctccttttacctcatttgtgtcccaccatggctccttgaaatgttaaacacagcggtgatcactctgatccccaagaaagactcccctacactgctgaaagactataggcctataagcctcatacatagcttcgccaagttagcagcaaaggtcatggcacagaggctagccccaagaatgaatgaacttgtgccctacacacagaatgcattcataagaggtcgatctattcatgaaaacttcatctttgttaaagggctcgttcagcaataccacaggcaacacaaggaaatgattctactcaaactcgacatctccaaagcctttgacacagtgtcttggtgttttctattggatatgctgaagtggagaggtttcggtgccaagtggagattatggttggtatctctgttcctcacggctgaaaccagcatccttatcaacgggaatgaatcaaacccttttaagccggctaggggattgcggcagggagac

SEQ ID NO: 42620 - DNA, 1874 bp, Oryza sativa
  unsure (1)..(1874): unsure at all n locations
aatatatgctgatgatgcagtattatttttcaaaccaagtcaacaagaagccaaggtagtcaaggcaattctacagatttttggtgcagccagtggattaatgaccaactacaataaaagtgcaatcactccaattcaatgcagtcaggaacaacttcaggtggtggctaatgagttgcaatgcaatattcaattattccctatcatctacctgggattaccactgtccacaagaaagccaacaaaagctgaggtgcaaccaattctcgacaagcttgcaaacaaagtggcaggttggaagcccaagttgttgtcccctgatggccggctctgcttgattaaatccgttctcatggccctcccagttcacttcatgtctgtattgcaacttccaaagtgggcaatcaaggacatcgagcggaaatgtcggggatttctttggaagggacagcaggaggtgagtggtggacattgccttgtagcctggaaagatgtctgtacaccagtggaaaatggcggcttgggcattcgaaacctggagctcttcggcaaagcgctgcgcctgaaatggccagccaatcgcttacatcagaaggataggccctggacccttgttgacttcagactgagcgcagatgacgagaaaatcttccaatctgcatctgaattctgtgtgggcaatggtagagacactaaattttggtcggacaattggctaggtggaggaagcattgcctggagatggcccacccttgcgacttttattggtagaactaagctcacagtagaacagggactcctgggacatcgatgggtgagagatttgcaaggatctctctcggatatagcaatgatgcagtattttcagctttgggacgaaatccaacaaatcaatctcagtcaggaggaggacacaattcgctggaagctcactccggatggttctttctcagtgtcctcagcttatgatctctttttcatggctcgtgagatttctccttgcggacagctaatttggcagacaaaagctccgtcgaaggtcagattttttctttggctagcaacaaagggcaaatgcttgacggcggacaacttggcgaagagaggatggccccatgaagatcactgtgtactctgccaacgcgaataggaggattgcctacacttgttcgtcacctgtgatttctccaggcgagtatggcagctgctgcgagcatgggtcaatgtggatttccctctgccaggacaagcgggagaggggctgataggctggtggatggtggcacgatgccattttcgaagcagctacaggagcaactttgacagcgttttcgccttgacctgttggctgatttggaaggagcgcaatgccagaatttttcagcacaagcagcagaccgtggagcagttactggaagacatcaaagaagaagtttggatgtggaagtctggaggctattttcagattatgtaatagagacatcatactttctttgtagccttcgggcttttgtgtatggctttgattgggggggacctgtccccagcctaatctcgacatcctattgtcgatataaagcccatttgtaatttgttccccttttccttaatgaaatttggtcgaccgaacctttcggccgacccggcaaaaaaaaaagacaaggttagctccttcagtttgcaaaatgcgaagggtgtgtgtgtgtcactgttgaacaagcaatttaaactatccagtccttcaaggcaaagaacttgtagagctggcagctgccacagtggaggaagcttctcgagatttttgcaaccatctaacannnnnnnnnnnnnnnnnnnnnnnnnnnnnnnnnnnnnnnnnnnnnnnnnnnnnnnnn

SEQ ID NO: 42621 - DNA, 9811 bp, Oryza sativa
ttagtggcaactgaattcctgaagcagttcatatgacacattcttggcgatctttggaaaacataaaaccctagcattgttagctatgctgtcttggcctttggcgagcaaatctggaaggatctttccaccactttgttttccttttgtaaatgcgttgacaaggatatgtgaattcttgatccaactagacctcattggcagctaaaatctgcccaggcaagagagatgaggggaaacaaagtcatggtcagtaggttgagatagattttttggccttttggttcaagaatcctgtactgtgccggccaagttttattggaatgtggaatgtcaaaattggggctgattctgattctgatatgtcaaaattggaatgtgaaaatcagagacgcttgttgtctctgattctgatttcagttccatggcaggctgccttagctgcgtaaatatatttcactgttcaatctattagcctcaacagttgccgtgaattcctggtgaagcaatctatttgtgcatacatacatgaatttgaccaagctaactgtcaacatctatgcatgaatgaacatctcgacgatgtgtcgatgtccacgaacgtcgttaacctggagaacaagatgtccatgcagagacagaggaaaaaaaggtcaaaccaccccttggccagcttatctccagctccggcttcaaaaaaaggtgtccgcttcacacgcaacggatcgaatgtgcttaacttttatgtgtgattcattagcagaaaatctgaaattttcagtgaaggaaccaggggaagaaagggctaaggttttccctatacgaagatttgtttagctgctgatgaattgatttcttcaccatatggccacattagcttcactgtgcatacatacacgcatgataaggagaagagagccattgttgttgactgagaaggagatacgcatgcattcatgtgggtggaaaaattgaggttaaatgggggtcggagttttgttctccgaccccttttgcaccttttgaaaatggcgttactccttcaagctcgctgtcgccgctgcggttcgtcaagagtgcgagctaacaatggcggcaattcaggcttgcaacatctgaaaagaaggcttgcacaataaaccagaatacatactgagtttattcagacaaattaaacaatccatcgaatcccgatttcagcaagctagcagagcattaattcatttcagtaggaaaacttatcttccgtttcagatcaacagctctgcatggtggtatgcagcatctgaaaagaaagcttttgcatagtaaaccactgaatagcaacatctgaaaagaaagcttttgcacagtaaaccagaatatattctaagttattcacacaaataaaacgatccatcctagcccggttttagcaaagctaacagagcattcatttcagtaggaaactttcctccttttcagattttcagatcaaggcctgaatagaggcatggccgcagcccacaagttcaattcagttttcagatcaacaaccctgcatggcgacatgaactgataccagattcataaccatttcaccatatatcatccctggcttttatactcctcaaaactacaaatgcacacactagtacatcaacccaacaccacaagttagagcaaggattccaagcatcacattcaccaataccttcgctctgcactgacatttggtaagtctacgagtcttggtaacgagcactttgagttgcatgccccaggttaactgtttcagcctttgtagtgaagctgagattgtagaatctggttgtcttccagcaacctgtcgtactccaggagaagctcctccgactgcttctgtagggcgttcacatgggcctccgcttccaacaccttcctctcgtgatcttcagactccgatttcagcttcttcatactctcgtttagcttagcaatctcctggtggagcttcttgatttcactggaagatttctcctccttttcacggaataaccggttctccatttgaagtttctcgacctcctctcttgatgtgttggctgctttcctcagtgtaatcagttttcggaggtagtggtgcaaccggtcaatgacaaatgcaaggaatagagtaaatcctgcagtgagagaccagctgttagaatctatcatgcctgccatatttaacaatgaacacatatcctgaattcctgattacacctagagataagtgctatacttttggttgaagataataatactaaacttgcataaagctttctgtaagagtatcccatcagttgcaaatgtactgattaaattgttcagaaaaacaacctggcataacataatgcatggaggccaacttttatcagttcaggtctgaaactcctaaccttctacaaggaaagagaccagattggacagacagcttcaaaggtcagacaacatgctatgtattttatttcagccaaactgccttaattactttatttgtgactagatgatttattggttaatagcacttagggtaggaactctagttgtgagtacagtgtgtgtacatgagtccttgtatgaacaggctgacaaagtgacagtccacctttattagttgcctgggtatagtactctgtagatccaacaaatcctccaatgcataaatccatatcaattccaaatgggtacatcatactgaccctaaggcataaacatgaaacgtgtaataggtttgtcatctcttattattctacattgacagtttgcatattagtatcatgattcctaacttgtactagtaaataaaattactaacctaagaatgatactatgtaccaaaatgaccaaataaaagcaaaaggtactacagttactgaaaatgtgattttctttcttaagctgttgcttgatataacctccatgtgacttctgaaatatgcttgcagtacaatactcactcaacttactagttcgtacaatgtgatcacatactgacatagtgacacttgccattctagttcttgaatacttccttcgcgtttgccacaatgtggtttatcagattaatagagcaaaaaagcatggaaacagaagtgatgagactgatattctaaatggccaccaaacagtagactatagttaaagaacaaatgatttctcactccatgctaccataatttttttatcacctagatggagcatgaaagcagcaaaaacctgatgcaagcctaaagcaataggagtccttattgtatccaacccagtccactacagtaacatggtactactgtttctttaccagttgaccacacaagggacctggcataaatgcaaagtgcaatttgctcattaagaattgaacatacacaacattcttcaatgataggatcataacttcctgcttctagtttaaaatgtataatgtaaactctctagcttctgtaaaccttagaagttaaaacaatatttggtttgcacaattatcgacctcctccatcattaagagcacttgctacacttcatccaagtagtagtaactagtaagttgagtagtaaagaatcaagaatgatgaaatggcgagctcaccgatgagggaggcctcgaggaggtgagtccgccatagcacctggtccatggggctgacggtgccgagcttgaggcccctgttctggatcttgaggatgctggcgacgctggacatgaggatcaccgagagcgtgcaggccagcgtcttcaccgtcgccgggcccttccccgtcttcgcctgctccacgccgcgcatcgccacctcccgcagcggccccaccttcaccatcagcagcagcgccaccgccgcctccgccaacaccaccaagaacagcagctgaatcatcctcccaaaaccaacccttcctctcctctcctctcctccaatctttttcttctactgttccgccctgagaaagctgggggttttaccaaaacgaagaccagctttgctcaatttcttcagcatcaaatcgaggaaccggtgcaggaatcgaggttgctttgcaataactccacaccccaaatgctgaagcactcctggtaaaacctcggttctgacggggaggagtggggaagaaatcgcaaatttaatgggaaaatttggagattgacaagaacctgccacctttcttggcctgcaaaagggtagctcatcagcaatcaagagaccaaacccaaaagggggaagcaaatggaaaatttcgagaggagtgaagaaacgaagaaagaaacccaccttgccttctcttgccaagaaccaacccaatagctcaatctcaaaccaatcaagagtctgtagccgtgtgggcagattatggtacgatgctaaagaagaactaattaactagtaaaggcgccgaggcattagagtagagtagagagagatggcggcggcgaaaggcgacgagcaggaaggcggcgtgcaagcagctcactcagctggaagagagagagagagagagagagagagagaggagtgtgaaagttcatggcccctgctgcctgctccgtgctctttttgtgattgataatggcgcttaacgctgctaatcctaaagttgcagggacatgcttaactttcaagagattttaaaaagctgctacgagcaatgcattagcaaactttactgaaaacaacctttctttcttccatttagataagtatatgtgtttgtgttaaagtaggtggttttttaacaacagctcacacctttgtagaatgtaaatttcatgctaggttcctctggcaaaacggcggtgggatacgaaactatgaacccataaaaacacttcgaaaatcgaaagaaatttgtgtatacaaagaaattcgtgcaagtctttctgcactagtagaagtagaactgtacaagtactgccctggctattcttttttattctttcatctgctgtatttttggacgattctgtaacgtgccagtacggggacttgcaccgtgctctgccaatttgaccaagtgtgattcctgcattgtcggcagatttctggtttacaccctgcatttctctcctctctgtaaaacgacggcttatctcatcgtcgtcatttgtgaaagaccaagaacagctatagagggggggtgaatatagcaattcaaatcttgcccccgaaaatactcatcaagccggatttctcaaaatccttactagaatcgcggctattagaagccggatctagaaaagaagagagaaaaagaagagagaaggaattcccgaaactagaggaggaagagaaaaggaattcccgaaactagaagagaggtgagaaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacacggaaactctctcaccgagcatctcaaaatgattaccaaaaggagcaacctccacccttgcatccatctctctatttatagcctaagacccctaagacattgtctcaaatacccctagggcgaaaccctaacttagaacagatctggtccatccattgttccttctactcaaaggaaaagctccagatgattgccacctcatcgacccgaaccctcacatggtcttcttgctgatgaatccgcgtgctctccgtcttgacgaatccaaacttgccacgttgcccagccgcgtcgtgcgcgttccgtctccttttcctcagcgcgcgctcgccagcgcccaaccagcccgaagccgccacgcgtcccgctgagccgctcccgcgcgcgcttgcaaaatcgcgtgtgggtcccgcgctcctgcacccgcctccgatcgagtcacgcgaaacggaggttgccgcgtacggttttcccgcgcgcgtccttgcgcatgcaagctgcctgcacctcctgagcccatgcgccatgggccgccgtcttgggccgtcgctgcttggacgatgcaggcctgccgagccgagccattcaccatcttgggccacgtggaacggctggattggcttggcctccctgccaaccaatcacagcgcacatgcacagctagctagcttgacttttccaccgagccatgctagtagcaaccagtacagtgcaagctcctccttgcacaagtacagtacgtgtacatgcatgtatgctacctacagcaagtactgtagcagcaatgcacttgcacagtcccttctgatttcttcgcgaatccgatgcttgcacacttgaccttgtgaagcctgttgcaaagacctcctcacacggtgttcgtccaccgtgtgcaaccttgtgtccaatcttgtcacccggcatccttgatcgctttggacctcaactcctccttgagtctagtcccgatccgccgttgaccaagatcgaccccgatcacctgcacacacatgaaccaaacaaccgttgtcttggcacagatgtcgcaacctgaccaacgttagtccacacacacacttcttgcacatccggtacttgtcaatttcccatcacaaaagaactataaccacacatggtttcacaatctcccccttgatgggaacattgacaatctcaagcaaaattttgaaaatttgatttttgattcacaaagcaaaccattttgcaaaagcgaactttggtcattttgaaatcgcgaaaaatcaagaccaagtgacaagaagaaaaagggatgcaaatgcaaatgcaagaatgctccccctatgtgccaaactccccctttcaccaagatttaaagcaagttttaattttcaataagtgcaaatttctctccccctttgtcaatgatgccatcaagatcaaaagagacaaaaatgcaagataaaaatgagatgaaacttgcaaattttaggttttgagagctttgagagttatctaaaggcatcaaaaggtagacatggatcacacagatacaagcatgtgctcaagcctagctaagcatgtgcataagaagtatgaaacaagtcatgaatatcaagttagtatcgccagcaagcaaaaagctttcaagtgaattagtgatttagtgtgcaaagctatttctagaagaagcttaaaagaaagcaaaccagctcataatcatgcaagatttacataatcaaagcaatgaacccatgctaatgtgctaatgcccagttcataaagagtatcaacatgataacaaagcatagaacatgagcttttaatcttttctcatgacttttatttttatgatttttttttaatttctttaaagacaatagcacaatcacgacggtccacctgatcttatcagtcagcaagtgatggttgtgccaaacactgccgtctgacctcaatcaagttttccagctagagttcccattacaggctgtctcagtgctatcttcggcactactcatgcgtaaacgcactcagtagcccggacaaaaacagagataaaacttgtaaagcatgattgatacaaagtatagacgcataagcatgagcattcataagcatgtactgacagttattgcgaaaagaatgtaaacatggcatgagtatgagatggatacttcaatttaaacaaacttctagagcaagcattgcacattgattgagttcaaatgaatagttaatttaagcaggtttcaacacgcttgaacagcataacatgatcacacaagctacttaagcaaatgaaagctagacaagagatcaaactagcataagagtgatacatccatagcatagtgatgaccaagagataacaagcaaagctcaattgaagagtgtataatacaatgcataaagtaaacatgatgcaatatgttacaaatgcatgcaaaagaaaaacaactccccctcaaatcaagccataggggtggatcacccctaactcactccgcaagaactcaaaacgagagcgatcaagtggttttgtaaaaatgtctgccaattgtttttcagattcaacaaattctagcacaatggtacctttctcaacattgtctcggagaaagtggtaccgtatctcaatgtgcttggtcctggagtgttgaactggattttttgcaatattgattgcacttgtattatcacaaagcagaggaacaccagagaaagacagaccataatctttcagagttgaaatcatccaaagaacttgactacatgcactagcagcagctacgtactcagcctcagctgttgattgagcaacagaagactgcttacgagaggaccaagagaccaaagaagtgccaagaaaatgacaagtgccagaagtacttttgcgatcaatcttacacccagcaaaatcagcatctgaaaaagctcgaactgaaagggcagaagagcaggagtaccaaataccgtactcaagtgtagacttgatgtagcggaagatgcgcttgactgcttggcgatgtgatgttcttggagaagcctgaaacctcgcgcacaggcacacggagaagtggatgtccggccttgacgcagtcaggtagaggagggagccgatcatgcttctgtactcgcgctggtcaacttcttcaccgtcctcatcaggaccaagcgatgaagtagttgccatgggagtggcgattggcttgcagtcggccatgtcgaacttcttcaggagctctttggagtacttggtctgatgtacaaagattccttccttggtttgcttgatttgaagtccaaggaagaaagtcagctctcccatcatgctcatttcaaattccctgctcatcacatcagaaaactgggcaacaagtgcatgagaggagccaccaaatatgatgtcatcaacatatatctggacaagaagaaaatcaataccactatgaagagtaaaaagagttttatcaacagcccccatttcaaaaccattttgaagcaaaaaggttttcaatctttcataccaggctctgggagcttgttttaaaccataaagagctttttcaagtttgaacacatgatttggaaattttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaagtttcttcaaagtccaagccctcaacttgggtgaaaccctgtgcaaccagtctggctttgtttcgaacaattgaaccatcttcacctagtttgtttttgaaaacccattttgttccaatcacattaaaacccaagggaggttctaccaaagaccaaactttgtttctttcaaaattttctaactcttcatgcatggcattaacccaattctcatcagataaagcatgacaaacatttttgggctcaaaagaggcaacaaaagctgaattgacaagttcataagaccgatttctagttaccctttcacccaggcctccgatcatcgagtcaggcggatgtcggttctggatgtgtcggggagctgtcggtcctgatgtgccaccatcaatctcctcagctgctgaagatgatgtagttggtgcatctcctgaaggtgatgtagtcgaaggagaaccggtttcttgcactggtggtgtactgtctagaggtggaggaatagaatca

SEQ ID NO: 42622 - DNA, 8569 bp, Oryza sativa
aaaatcatattaatcaatttttaaaaaagattagttaatatttaattaatcatacagtaatacatgcttcgttttgcgtgccgggtcccacagatactactgtgccttaaagactcacatcacaacacaataataaactaataatccatataatattgtactacctccgtcccaaaatataggtatttttggctatgaatacaactaaaaagcctatattttgggacggagtgagtaacttttatgtggtagatacctactccctctattccaaaaaaaaagacaatctgaatatagatgggacattacctagaacaacgaatctggacatgtttatagccagattcattgtcctatataatgtcccatcaatgcaaaggttggcttttttttgttgggacggagggagtaccaattctaataacttgaaagatgactttgcaagagaattttaagtacgtgctgaaattgcgagggaactttaggaaatcaagacgaagtaaaattctgtacaaaaagtttgccatttaggattcttcaacaaaaaaaaagtcctttgaaatttaaactgaaactatcagtgagctctcttgtatgcacacttgcacagaaattatgcagaaaacaaaatcagccttggcattataaaggcatattgttgctaagcaaccagcataatctgttagtctaaacaaccataaaagtaatatttagcttagaacataaaaaaatacttccatttctaatacattgtcagttaaactattgttttagttttgttgggggagaaaatatacaaatgacgctaaggacatgtacaatggatgccaataatggtctcttagcgttgctaattaggaaaacttattgacatggaagaaagagaaagagaagagataaaaaatcattattatgcataacacggtgaacaacgactattaatcactataatatagaaatatggttgcttgaggataaaaaaaggaaatatttttaccatagggaatattttttgagttagtgattagagtttttgtcgtctcaacaattgtaaagacatgatctctaaataatcttgtattatttaagagaccatactcgtctctatcatcgaacatgccctagtgcccctagctcacacaacgagattcacgtattctttttcatcctactaataataggcttgtgtattgtaacatttcagaaaatagattgacaacttattagcatatgtaggttactgtagcacttatagctaattatggactaattatgcttaaaagatttgtctcgccattttcatgcaaactatgcaattagttttttcaattatctatatttaatactccatgtatatgtccaaaaattcgatgtgatgtttttaggaaaaaaaaatttgaaaactaattgccctagtaggttcactggcattctcattatggacagaacggtgcatatatagctcggccggcattctcattctcattcaaatcctcctcaacacaggttttctcaccattctttttctttttaataatctgtgctaagtctctcattgttccttaatattaccttatcacaactactcgccaaaatacaagacgaaatcaagatatatatagagcatgcgtggggaaaaaacattgcgagaatatccgcttaggtttctttagtatgctttttttgtgttttcctttaccttgtttctttcaccttccttgttgacattgtaaatactttcttttctgcttaatattaatataacaccagcttagccttctgtttaaaacaaacgaacaccacgacaggatcaatgataaagtgctgccgttctgtgcttattagggcctagggcaccacccttagccactttgagcaagtggcattagtgccggtgccagttctcatgatgcttcgtatagaggtgcttgattagctagggaagaagcatcgtgcggaagataatttatttattatctctcttaaatataaccattattataatgataaagtatggtcaagtacatgaacacgtttgtcctctggctgaatataagttttattccctataccccaaaatattgtaatttttggttggatgagatatatcctaataatataaatctggataagagacatgttcagactcgtagtactatgatgtcctatctaaccaaaagttgatatattttggaacggatggagtacggtattttagtaaatttagacatttaacaatggagtgattttacaaatttttaagaaggtatcaaaaatatcatatcataccttccgtattagtagaaggtactaaaattgacattaaatttaggtatcttttaaaaactgtaaaattcctcttaactatgttccagcaaactttgccgaggtgcgtccagcctgcagccggctacgacagtacgaccttctcatttctcaatgactgcctagcttctccgacctcccgctcggacctccaacggctgagattaacctgggcagacacttgcctacagcgccaacgcgcaaacagcaaccactagcaaaccgtgtacattaccgaccaagcctctctccatccatttacgctcgatcgaacggcccaaatcggcgcattactagcacggcgccacggccacgcgcagcgcgtgtacgatgccacattgccacctcgccgctagctcgctctcgcggtctcgccctcccccgcgcggccgcgcctatataaatagagagctctcgcctcgtatgatcgtatcaaactcaaccatccttgctttggctgcgtagcgtgtagcgcgcgcgaacgaacgaacacaccaagctttgctctgcttttcctctgtccaaaacagccggccatggtggtgcttgccaagggcgagctcgagcagatagccctgccggcggcgcacccgccgccagccgacgtgcgcgcgatcgacctgtccgccacgggtcccgcccgcgcggcggaggcgcgcgcgctggtggcggcgtgcgaggagcaggggttcttccgggtgacgggccacggcgtgccgccggggctggtgcgcgccgcggaggccgccgcggcgcggttcttcgcgctgccgcagcccgacaaggaggccgccgcaggggcgccgctcgggtacgccagcaagcggatcggcagcgccggcgacctcggctggatcgagtacctgctactttgcctcgcccccgccgccgccgccgcggcattgccgtgcgccgcgacgtcgcccacgcctccttgccccttacggtaaataccgatctttccaaacgcagcagcagcagcgccctactgctactatctcgcggtgttctagattatatcttttaagatttgatgaagtataattataaacgttttattatcgataaatacatcgtttatcataaaaaattaattagtcataaatatgagtatgccactgtaataaatctaaacggtgaatcgtattttggcacgccaccacgtgcggggtgcgtcggattttgaccgttccgggaaggaagcgagcgaaggcaccaggcggctggacaaagcggtgacatctacgtctgcgttgcgcgttgcaccggcgggttactgttgcttccgtgccgctgcctgcgcagacagatacatgcaccgttgctgcacgcatgtcacgtctctcctccgttcctttgggcattattaagtccagtcatcgttgaatcatcattttcttcgcatcactttattttcctttaacaaactttaataattggtccattggaacgttcgtgtcaaacagtagatggagggtccgatcctagtgagctgagctcggacaagtggagtacttgtttcgacagtacggacacatgatgtgtgcaacacagggtttattggggtgtagtgtagggactgatctgaagtcgttatacgcgcgcgcgagcagcaaaacggaatcatgctattattagttccattccattttgctgtgtagtagtataagcaagcgatagttttgtccaggaatctttctgatgttcgcatgcaccagcattggataccttaggacttgctgttcttcttttccccgtgtatttccatttggcacgtggaacattttacttgagttgaagttcacaggaacgtcagcaacattctaaaaagctcattaagtgtggtgtgtggtggagccatgtcacccatgtgcgcatgacttcactcattaccagtggtctaagagggtgtttgggagagacttatgcttttgtgaaagggacttcctattttccaaacacccctaaattatattaccaaaaaatacacacgtacgcatatacttaatttatcattggtttttatctttttaagtcttagagtgtaatagtgtagtgttgtgtgattgagaaaagattcgggattcaaattcatgacgtgggtatcgttctccattaattaattcgagtcacgcatatgttttcagactttcagcattactctttccgttccatataaagtaaatctagaaccgaatataatacattttaatactataaatctagacatatttatatttagattcgtcgtggatgtatcacctccaatcttaagttaattcttctagaggggcttttgatacattcataaataagcgttcatttattgtagtgttgcccatctggtaaattaatagtgagaaaatcgtgtggataagatcgcccatcgtggccgcgtgtcgcttcacaatatctcggggccgacgtacggagaccggcgccggcggctccgtctgacgctgccgttttgattcacgtgcgcgcacggtcgcatcgccgtacgtggcgcagctcgccacatcggtcgcatgcatggtggtgatcgaccaacaccaccgccggatcatgcatgatgcatctcccctgacctgcggatctgcccgtctctatccacaaaccttttacatcatcacgatccaagccgccgatcgaattcgttgcgcgattttggcttgatctctttgttggtttcttcttcagttgcgttctgcgtgaaccgcgatcggtggtttagtctggtttgtttattttgctcgcggtgcagggagcttctacgcgagtacagcgcggcggtgcggcgggtggcgtgcggcgtgctggagctgatggcggaggggctcggcgtcgggccggcggacgcgctggcgcggctggtggcgcgcgaggacagcgactccatcctcagggtgaaccactacccgccgcgccccgatcagctgggcggcggcggcgggccgaacctgacggggttcggcgagcacaccgacccgcagatcatctccgtgctccgctccaacggcgcccccgggctggagatctccctccgtgacggcgcctgggcgtccgtgccgcacgacggcgacggcgactcctttttcgtcaacgtcggcgacaccctccaggtacgtagtacacgtactatacttccgttgcttgcgtgcacacacaaaattaaaggtcaaaaagtttggtcacttctgctgtttcgcgtacgtgcccctgtcgatgtcgaatcgaccgttccatcgatctccaatccagtcgagcaaatcagggtgatcagtgcacgatcgactgcacggtgtactatgcgtcaagcaagcgccatcaacgcacggttacttgtatggttaactagcacaatcatctgcatgccatgcatatatagggcccagcctgcacgtgaaaacacgtacacttgcatgctagtacgtacgtgcctactactactactaatgggtccatgaacggtgatgagatcgatcggtcactgcaatttgccaactctcaagaaaaggccatgcaaattgttgcacatcacatcgattaattattgacttaattatttacatttctctgtatccctgaggttaaatttctttgtgctgctcgtgtgtttgcgctttgcaacccacccaggtgctaacgaacgggaggttcaggagcgtgaagcacagggtggtggtgaacagcgagaagtcgagggtgtccatggtcttcttcggcggcccgccgcccggcgagaggctggcgccgctgccggcgttattaggggacggcggccggagccggtacagggagttcacctggaaggagtacaagggcagcggctgcaagggccggctcgccgacgacaggctctgcagatttgagaactagtagtagcagtcatctgacttctatgtacgtttgtgtatattaattcgcaagtagtgattatcactgtggtttgcctctagcaatagccttgtacgtaaatttcagtatgtgttaatctgtttatatataagcttccagcaaaagttgcatgcatgtaagtgctctgtggacagtttagttttattacaattaaatgagctctcttaagatgatggttgctagtacactggagcccagaaataacttttaaggtgaggctttacgttgttgtggtttggattgtaatccaaactgttcttaaattttagagtttaattttaaaaataattataggtaattttgtttatttatcttattaggaaccatggaaatagagctggccaatggaagtgacagagagaaaacccttaaaaccaaattctaaatattcaatgtttcaaacatacaatcgaaagcacaacctaatactcccccatccacaattataaggtattttggtcatttatattttctccaccaatatataaattaaagcctgtacatagataaaaaaaatgtttaggatatgaagatgtgatcatctgtttcttggaaaggggtggttgctacttgccccctgtttccaatcttcaatctttgatgcagaaattaatttctttgcttttagaatgaagggaataagacgagtctcttagagcagatacaatagcagactataaaacagctataacacatatcgatgagataaaagaagagagagataagcagcgggctatagatttgtagccagctatatcacggactccaaaacacagtgtgtatatgatatgtgggaccagatattaatagtatagtatatatttataaataataattgtaattaattattaagttgactataaatgatttgaagctaatactcttatactgcaacctgcggcagcatagagcctaattaaggaatctctgtttagggttcaaaaatgcgaaaataaatcctctagtatcttgcatgattggagccggccggtctgcatttagaaaccacacaataaaccggttaacttcaaactaaatgtgagttttcggtaaactttatgtaaatttcacaggttttttatgaaaccatccttaggaattgatattcggtgaccagtcgcactttctataggagtactagtattttccgatgtttcatgtactacatactccctccgtcccaaaaaaaaaatacaaaccctgattttcgtgcccaacgtttgaccgtccgtcttatttgaaaaaattataaaaaaaattaaaaagacaagtcacgcataaaatattaatcatgttttatcatttaacaacaataaaaatacgtattataaaaaaatttcatataagacggacagttaaagttggacacggaaatcaaggtttgtttttttttggaaggagggagtagtcgcctgtgctgtttgaactgacagaaacaaccagcagcccatcacgagctgagcaggagctaggtgcaaatgtaccgtactaacttaacagtactgattaccgaacaactgatgcctgctcagccgctcagcaagagaattcatcgcattcatgttctgggtcaaacaactgaaatcaggtcactctgcattactagcacgtacactacctgtaggttgtggcccttcttcttctatcatcagcatttgcaacactgatgacaggacaaaaggccatagtatcaaggcaaacaagggaaggaatccgtacagttgtctactgcgttccacccgccatgacagtaatatgaagtacgaacccgactgccctctgcacaaccccgacatagaaatagtgaaacacatcacaatggcttgcaagttgcaagtaaatagagggtaccatttggccatatataaattatactagtaagaagctcggacgtcgtaacagatttatagaaatatatagaaaattctactccctccgtttcacaatgtaagtcattctagcatttcccacattcatattgatgtacggaggaagtagcttaaaatgatatgtatttcataaaaagtttttcttttcccatttgcatgcaaatatgcaaatagccaatttgtatgcacaaaaagaagcataagtagatatttgagttgcatacatggacctcttcccttttcgttcggatcgctcttccatggtgatcatggttcaccgtgaatacatgacgatcaactgatattttctcaggaagatagagtgttctaccatttcattactgtaagccacaaattggttaattaaccgcttttacacatcattagtaatgtccgtgtgttgcaattagacagaatctgatgaacttggttcaaat

SEQ ID NO: 42623 - DNA, 3088 bp, Oryza sativa
tgaaaagttcagaggacgagaggaggggctgaagagatcttgacattcacatcccccagcgcatgtgtcaagacctgaacttaggtactttacatgtagtactaccgtacttgttgcgttacatcacggtgcattgactatatatttgacatgcgcaactcaacatttctcgactttataagtgcagggaaggtgctgatccaggatttcaaggtttctaggcccttgtttaatccaaactttttcttcaaactttcaacttttccatcacatcaaaacttttctacacacataaacttttaacttttccatcacaacgttccaatttcaatcaaactttcaattttggcgtgaactaaacacaccaaaattgagttcaacaatatatctttttaaccgattcaacaatttagtattactttctgtctccctccatttcaaaatgaacacaactaaattccttttagtgtttcctaatacaaggcgtgcatacaagcatgcaataaatagcacattttactcctctaaatttttttaatcctctattcacaagatctctaatctaattggttgcttgcattgtatttattagggtaatataaacattattattattattattattattattattattattattattattattattattattattattattattattcctccctccatccacaagtttctatttgtagtctttatgcattcaatacttaaataaagagataaattaaatgtttgattagaacctaacgagtcatctaaatactcattagttatatgcatgtattcactacttgattttgtaacattcaagatgatttaatttctcttttatcttggtgacaaaaataataggtgtaaattttgtgaatggagggagtattatttattggtctttgcattagtgatagttgcgtcttatattttgaaatggatggagtactattgctaaatgggaatagaaatcaaggtccataattgcataaactctaatgcaagttgttccaaacatagacaacgtcacacaatagcttagacaaattttaaaatcattaataatattactgctcgattattaattgtgctttggaagccaggtcacatcagcaccctcaacatgtgaaaaaactcagcgctagcagtcctatcttttttttttacttcttgttttagacatcaacataatcttcaattacatctctcatcattgtgttctctaattgtatgtttcaaaaaaaatatattacaaaataaccatatgaagtgtcttcatgacaaatctattaatgtcctttttcacatattaaattctaatattttcaatctactaatgatttaagaaatcgaggtgctatggaacttgatattactgaatttaatcgagtggtacttcacttcattgaactttagcaaagccggagcgacatagttttgccacgcccaatgtaatattacaccgctttactatatttacgagtacaaggaacatacatgtaattaaacaggatataattgtcaataaaactcaatctcagctcaactacaattgtgaaaaaaaaggaatgcgctggtgttcagcttgtggacactgtagccccccggcacagctccggcagcagcttcatacaaagtcttgcctgtctgacacgagggaacggaattgtgctcccacgcaactgcatgttttgctctccttagcaagcaaacaacaactagtagtagtaacagctaattaaaggccataatcaacacacatgacctagttgacgaacaaagagaatctagtcatgcaagtagtagattaaagccgactactgtcactttactttctagctaaggatttttgcagcagtcctattgtttctaattaaggagacaccgagtcctaaaagcaatggctcacatcctttgcccagagaggaataaaattccagaagaatatcaccaccattgatttataatatgatgaagggaatgagtatgatgattaataaggtttgctcattagcgagaccagcacgactactgatttggctcgcttgcaacagcaacagaaacaaaggaagcaaaagaaggcccaactttggcccacatgctgcagggaacaagtctatcttaccttcctcatctcttgcctatgattgaatcgtctctctcaatcacaaaaccgggtataacgcgtcctccatcttctaaaccaccaccacctcctcgagcacctgcctccccgagtgccgccgcctcctctatccaattctaagaacaagtgaaagtgagctctcttggtgagagataggggaggggaataagaaagggggaggtggaaggagaggggattggctgctcctctatggcctagctcagtcaccgccgccactacctcgcttgtcgctcagatttaatttggggcagcgtggcacgattggcgacgggcaactgggcgtggagctcggtggcagtgcaaccttgttgagcccctatctccaaggacgtgagcggagccaaagcgtccatggtccttgcaccagtagtggagtctcgagcatccaccattacatgatagatttgtccctatttatatgtttttctttgtgaaaacatttttcagaaagatgaatagtcaaagaaataaaatatcaattacatcatacattaaaaaacaaaggcaatatgctgtattcttatggccaaaatgttgtattgatgggatcaaagtgtaatggggcgctcgaagtgcttgttaagcttaagcactattttttcgcttagataagcactagaccatcaaggagcatttacatgtaagtctgtgtttacaaattaaatttttgcatctcggtgttgcaatttctcacattcactgatggttagccttttcgtccaatttctagagacgcatcgaaaaccagataagcatgctctatgcactctagtgtaagacattctagcatttttcacattcatattggtaacatcaatatgaatgtgaaaaatgctaaaatgacttacattgtgaaacggaggaagtacttagaaacacaagaacaaggacatcaagatgtaagaaatggag

SEQ ID NO: 42624 - DNA, 5790 bp, Oryza sativa
  unsure (1)..(5790): unsure at all n locations
cttattagccattacttcagtagaatcactacagatattaaacctacaactaataatgcactagtagcagtcgaaaatcaattagacggtcaacaggagcgcccatctggaagatcactttgaagtacaatagggacaaggtaaattctgatatgccaacttcagattcatgactagtgactacacaacttgttctctttctccctacaaatgatatgcatgtctgcaaggagactgcatctggctttttcagccagtggaacacataagctttgaaagatccagatgaaactgaatgagtgaagtgcatcactggcatttttccacttagggatgtttgtatccaagcaacagtaaaagccaatatgctatagccgaataagggattattcatggtttaggataagtatatttgagattagctcaacaagccagaatggcaaattacctgaacaaattgggagggaagcaacagacaatccagcaagtgctaaagcagcgacgccaccagccaagccatcaagatgatcaaccaatgtaactccagtgcccatggaaagagaacatattgcagccaaaacgagatagatttttcctatgaatgcaaggccaagaggaggaggaagaggaacaaggaatttccttcatgaacaaattcgaattagtaaagctgacaagtgaaaaaagtcaaaaacatcctaaagtattagtcaaaatggcaaagctatagaactatgacaacggtagtgacatgtatctttttgttacagaatgctggttatggagtttaagaccacatcaatgttggttatggaatttaaggccacatcaatgctggttatggaatttaaggccacatgactagcttggtgcactaaataggaaatgaaaatcagaagtggttagcaaagcacccttgcctctaaattaacatgtgaacacgatcactagtgactagctactagcatgagttgaaaatagatgttaaatcagtacatttggaagtaatgtaaggcacgaagtatctgtgcagtgttcctgtgagtacagggaggcagaaataatgttgtgcaccttattaactgaattgtacattgtactgcatcatgataatactttgatataggccattaagaaaggttactcctcatcaaaaaaaaaaaggcaatttaccacattgcctaaccgataaagcattaattcaaactgcagttagtttttcagtatatataagttgaagtaatgcttacgtgttatatggtgttgaaatatttgtagaacttaaccagatagataagtaaatcccagcaacaatctgcaaaagaactgtaagttgctttcaacataataagggaagagcatctcccgtcaaaaaaataagggaagagcatcctatcatctctcttgaaaaagcaccattcacctgaacaaataatctcatccaatgcggtattttacgattgcagtccatgacaagatttgaaatatcatcaagaaatccaaccattgcaaatatgagggttataatagctgctccattcactccagttgaggaaccaacctgtcttcttgcaacaaaaatgccaataggtacaaagaacaatcctcccattgctggtgttggctttctatagaatggagacataagcttccctctcctccggaaatgatgaatcttcatgttatcagcaactggtgcaaaaagaaatccagctaatgctgatagaactgatgatattaaaaaaggacgtgtcaagtaaaaagagtccagaggtagtctaacaatccgccaagaacaccagtcgacaaacaaaagtaatattgctaagaaagcaatcagtccaacattattcatcagcccttgttgagttctgggaattgatgtaaagagcttcagtcagaacctagcaaaaacacttgtaaaaagcgtgtgtttcttactactagtttgataacttttaagtgccatttaccaggaataacataaacagataatcctggaagatcataatgcatgctacaaatctacacgctgaatctctagtttttaagtattatcagaagatattattatcttgcctgctgtccctatgccctttctcaatcgtggcaaacctatgggcagcaactgtcatcgcaccctctacaccctcaaagcggctcttgctctttagaggtaactcaacatcactcgttggatttaacacgacctcctcatcgctccagtcgctctcacttgaatatacaacaacctctaaagggtcatccccatcagcgtgcaccagcgagaaatcacccagatcctacataaaaaccaacgctaatagtaaattaagctactccataagaatcaatgtatcaagaaactccataagaatcaatgttatctaaagaaaaataaaacagtacctcatcaaatgcagaggcaactggaaggacatcgcgcctgcttgtgggtctcgtggagatatttctgaattggaagtcctgaaaggataattaaatgacaatgcgattgccttagcttaaccatttcacacgcattggtttgtcaaacgaatcattctcgcgcaaactcaattagttatatacaaacatccatcataaagtcaccactcagaaatccaaggtgatactgtggatgatttctccaacaggcaacatcctaaccgtctcgacgagatcaaatagcatcgaaacgaatcacacaagcagcatcccaactcgccaacacatggataatcagacggggaaaaactagaagagaacactcatttcgtgccaatagtacacgtgctaaagcctcgatgaacatcagcgaggcggctattcccccgatgcggaaccctagcaggaggagaaggaacgaaggcgcccgcgagatctgggaactcacccggagagcggaggatcggcaggcgacggaagagggaagcacccgcggctgcggctgcggcggcggccggagagatcgccgcgaccgcaagcgcgggcgatggggagcggcacgcgcggccgcggcggcggaggaggagggagcggacggaggcgacgccatgggcgaggcggctcgtcggagaggagggggacaggagcgcacgacacggtcggagatcgcggcggctttttctagaccgcgacggcgacggcgacggcgttgcgccgatgcgttggtggggtgggtcggtgggtgtgggtggggtgctcgtggactcggtgcacgtagacaagcgagctagaccgactccggtgctcatggtgggtccatgactccggtgctcatggtgggtccacgggttgtgatttgtgacaggtattagacaggtggttactggttgacggtttattccttcacgtgtccaagtggacattttttttctcctgtgggcttggaatgggccaaaagagcagcatgttgggttccacggccagaacagtctaagcggctcgaacattgtctttgcgttgtttctgtcaataaaattttcagcttaattaacacaaggttgccaagttcgctttatggattagtatgataatataaaggattttagatggatgtgaccagattcattgtaatagaatgtattatatccacccaaaatcttttatattatgggacggagagagtatactataatttctacgagctgacacgtcatgactggaatgaatttctcctttactgatgtctggtgacgaaatccgtattgtgagtgggaagttactgcatctgtctaaaatattgtaatctagtagtagaatagaatttaacttattctaacaacgaatctagttagatggatcaaatctcatcccaaggttgtacttagtaacattttgaaatgactagtatctatgcaaatttaaaaaagaagccaatgttgatggacatggccctgtttaaatcccatcttaaaactttacaccctatcacatcaagcatttgaacactattaaatataggctaaaaaataactaattatacagattgcgactaacttgcgagacaaatcttttaatcctagttgctccatgatttgttattgtggtgctacattaaacatttgctgatgatagattaattaggcttaataaatttgtcttgtggtttactaacgtattttgcaattagattttttgttagtgcccgaacaccccatgcgataccctatataatatcctatgcgatacgccaaaactttacacccctacatttaaacaccccctaagtaagtgagaaagcacaaatcaatcacctctcctctcccaaccctctttctatgagctccatctttgttgaccaatgtggcaccggccatgcagcagtagcactatgtttaaatccctatttgcttcatgcacaacatgttgnnnnnnnnnnnnnnnnnnnnnnnnnnnaatcctgtcattgttaattggagtttgagagtgattgtttagtcttaattagattatctaatgttattagatcttgttgcaatgtacggaattttttttagtcatgaatatttcaatttggccagaattcagaatttagacatgactggtcaacagcatggatgaaacaatttcgcattagtgacctaatcgatcggagcacagaatcaagcttatcccttcctgaaagtagaactcaattcatttccagatgcttttctagaactcgggatcacaagctagccgagctgaaggcgacacacgaaacaaagtgatcaagtagatgcatgtgaagaaattacaagaaagcattggacacgaggtcgaccagatctctgagttaggcttcctgcaagccataagctcccaggaagtccgtgataaaggcagggaaaactgaagccaaagcaatctgtgtacatttcttcacgtcctcctgacaacaagatgtttctttttcactaattgtcacatccagttccatgatctctctggaccctgcaaagtcagaaacaagatgacacgtgaaatgatccaaattagccgtgagttcttcgtttgcagccaaaattaacaaacaaacctaagagcctggtgaatgtttagatagcttggggatcaatagatagttaatactgatgacaagctttcgctattctcaaaaaattaaccaaaaaaaatctcttttactgtcttgtacatgtttagatggctcgaggatcatacataatgatactgatggcaagctttcgctgttctcgaaaatggccagagagacatttaatagacttatcaactgatcagaagatgtacagtacagcttcactggcaaaatgcagtcattgaactaagagttgcaacttgcaatgacatttaaactcttcgtgctgtaatgtcgacatcttctcaaaatagtacaaaattataaaggaaaactggttaaataagcacttctgcaaacgagaatcaatgagataattcaatacccttggccatcccatatttacgaaaggtccaactggaatgaaccttcagatgccaggaggttttccagttaaattcacacgtaattttgcacctcaaaaagcatgctctatgcgactatgcagacagcaaagattatgaattatggatattaggagagaactgggatagttcggggtatacaaggagtccctggaaacaacatgcacgaactaatgaaaacagagtgatatttctgctcttcttgctataatatagaatcagctgaagctgggtccgtttcaggggggaaaaacagttcattttctataaaaaaaagttcaaaattttcttaatctccgattgctacaatgtagaactctgcaa

SEQ ID NO: 42625 - DNA, 11734 bp, Oryza sativa
acaatgccttatcaagcttgcaaagatagtgaggcaccttagattcctcatatccaggaggttgtcgcatatacacatcctcctcaagatatccatgtaaaaaggcattctggacatccaactgttgcaggctccagccctgtgaaacagctaaagacaaaacaagtctaatagttgttgccttaactacaggactgaaggtatcctcatagtcaatcccatatctctgtttaaaccccttagctaccaacctagccttatatctatctattataccatctgccttcctttttatcttataaacccacttacagtcaataacatttgttcccttctgtggtggaactagatgccaagttttattatgaacaagagcagcaaattctttatccatagctatcttccaatttttatcatgcagtgcttcttgtaaactagatggttcttcagtatcagttaagcaagcatatcttaccgtcccatctgtatatttcttgggtttgtgaattccatggtgcgctcgtgtgattggacctggaattggctgtgcttctggcgttgcctcggactcgactgcagagatggttggagtaggcgatccggtagctggcgtcggtgtcgggcccgcatcttgcagagacatggttggcccgaacgcatctgagtcgacgtggctcggcgtggttggtggagatgacgccgccgagccatgagccgccgcatccgcctcgggatccacctgacgcgacaccgagtcagctgaatcagcattaggatcgtcatcagcggtataatgttcgccggaactagccagatcgcagttctgcataaaatcatggttaattgatgtggattcgctatcattagctgcgctgttttctccgtttgctccagaattttgtcctgcactctcaccactggaatcagtaggattaggattattaattagaggttgatcatgtactactgcacccccgtgatcaagcataattgaaggaaggagattgggagtaagaagctggatttcagactgaagacgagcaccagcattggaatgcaactgagcaaaggggaaaacttgtacatcaaacacaacatcacgagagatatatacccgaccggcagcaatgtccaagcacttaaaccctttgtgcatcgtgctataccctaggaaagcacactgtttagatcggaaggcaagtttgcgtgtgttgtagggtctaagattcggccaacaggcacagccgaaggtacgaagcaggaagtagtcgggaggaagattgaataggcgctggagaggagtctcataagacagaactctggtaggggttcgatttatgaggtatgcagcggtggtaaacgcctcatcccagaatttgagtggcattgacgcatgagctagcaaggaaaggccaacttcgacgatatggtgatggttgcgctcaactgatccgttctgctggtaagcataggggcaggcgacatgatgttcaatgccaacattgttaaagaaactattgaggcgctgaaattcccctcccccaatctgtttgcatggttttaatcttcctatttaggagttgttcaacaaggttttggaaggcctaaaatttctcaaaaactttagatttgtgtttcagcaagtaaacccaagtgaacttgctaaagtcatcgataaaactaacataataacatttattgccaactgaactaggggcagggccccatacatctgagaaaataagctgcaaaggttctaaagaaatactaacagacttaggatagggtaattgatgacttttgctttgctggcaagcatcacaaatagactcacgactagaatccctagtgacatggagattatttgtgctaacaactcgatcgacaattgaaaaagaaggatgccctagacggctatgccaccgagacaaagacggcttgatggcgccatgggcctgcttatcagttggcaaggggtagaggccgctttcacacctgcctcgaagaagtggcctcctcgtgacctgatcctttaccaaaaagaaacaggggtgaagttcaacaaaggctctattatctctagcaaaacaatgggcagacacaagacttttataagcttcaaggacatgaagaatgttcttgagccagagatcacgagtgggagtgcaaatagcagtatgaccaacataatcaatgtccatacctgagccgctggcagcgtggacctggtcgttgccatggtacttgtcctttatcgccagcttctccatctcgctggtaatgtgatcagtggcggcactgtcaatataccagtttgtgtcgatgctataggagttgttggttgcagcagtgctcgcaaccttctcttctcctgtgaaagagggatcaaacctcttccaacacttggccaccacgtgaccaattttgccgcaaagctggcaagtgggcttgggtttgccgtcaccacggccgcgcctgaaaccgccgccgcgtccgccgttgttgccgccttgtcccctgccaccgcaccaccggcgggccctcctcgcgacacggtgttggcagaaggggaggagttgttctgaagcagatccaggcgtgtctcaaagccaacgagcaaagcatatagctcgctgactgagattgaatctgcacgcccagcaacggaggagacaaccgagttgtagtcgaagtcgaggccgacgaggatgtaggagacgagatcctcctcgtccagtggattcctgcagaagacatctcatctgctaaagctttcatcttacccacatattcagcgacagttttgttccctttcttggtggtggagagcgccatgcgggtgttgatgacgcgagctcgagactgcgacgcaaagaggctttcaatgcctcccagacttctgtggccttgccgagcgtggccacctgggtgaggacgtcgcgagagagcgacgacagcaagtaactcaggacttgttgttcctgcgcaacccattgcgcaagagcaggatttgccaccttctcagtggtcttcccatcgtccttggtgatgacgatggtggcttcaggcgccttgttgctcccgtcaaggaagcccgccatctgagcgccgcgcaacgtcgctaggacctgcgccttccagagcacgaagttgctcttcgtcagcttctcagagactgattgcccatggagagcaaatggaatggagctggacgaagatgccattgatttcggagagattggatgcgatggagggtggaggctctgataccatgtgcggtgaaacgatgcccttcctctaggctcgcttacgtgttatataggcacgggaaaaacccccggcgtggtgtttacatctcaacagaatacatccttatctcaagtgtttagttacaacaaactcctaagaagattcggttctatctatcctaatagaaccaatattatctaacatgccaaactactggggccggggttaccgtgccccagcggtaagcatggttaccgcatggtaaccgtggcaaaccgtaaaaagtttatcaaaattttaaattattttttaaatttatttaaatttaaggagctaggttaccgcggttttccttataccatactctctccgttaaaaaaaaactaaccgtggaggggtgctcctaggttggcttttttttggatggaggaagtactcccgcggtaagcgcggtaaccggtggtttgaggaaccctgatcatcataactagtcaaagaagcctattcgagcagaaatgatcgatatactccgacaatcctactcacactcgacactgtcactgtgcaagagacatggatttaacaccgggcaacgcttgagcttgagagacggctagtatgagctagctgagaagaccgatggtgtcatgtccgtcgtgcaacacgtaacagtgacgatagcaactggatgatcctctccatcgatcgctagtcacctatctatagctaggccagccatgggctagctgctgagaaacaaagtaaagtagggtcccgtgtctcccagtcgagttgatcgatcgatcggccattcctcgcaaatgtgtgtatacgatgccattcaagttcgcaaggcgcatcatgtctctgatccactgattatgcttacgcgatcgatcgctaattcgctagccaagccaccagggcgcgcacgcaccggccagccaccctcgcgggcgcggcatctccttggcgtcggcgtgcgtgcatgcaattacacgcaaggaagttaacgtacagaaaaaacacatcggtcgatcggtacgagccgggcgcatgtggtgaggccggcccggcgctcgtacgttcgctcgtcgggcgagactaccgtgagtgcgtgcgtgacagatcagcgcggccccgccctagctatagctagcccttttcacgcacggtacggctgagtcgacgttggatcgatcgatggtcccgggcgcgggccggcctaccggccggcacggcacggcagcggtgtccggtgtgtgggcgtgttagtacgtacggtactccgcctagctcgtgcatgcgcgcgcggcgctctctggttgctctgctttttgacgtacgggcgtgtgttttgcagtacacgagttgactacggcccgtgacgatgcgtcgatcgggtttggatgtccaagagaccattctgctcagtgcaaatgtcaggctcccaatgtgtcctctgccatcaatcaatcccaaatacaatcgatctttcgtgcccacctctcagcctctatttctagtaaaggtgagtttagctcacgctaaaattgaaagtatgattgaaattaaaacgatgtgacggaaaagttggaagtttatgtgtgtagaaaagttttgatgtgatgaaaagttgaaagtttgaagaaaaagtttggaactaaactcggcctaagatatcataacatccatcctaaccgcgaaaataaagagaagatgtgattatcatatagtgctcctttcgctgattggatttgacagcatcatgcttgttctacagcaaaggagggatttctatttgagcgagcaatgtgatgtttttttactttggaagaaggtcagccacacggaaaatcgttggtacagttgatctagaaatgtctgaatttggagggcgctaatgatgatgcacgaatgcacggtaatgttggagatttggatgcacaattctacagctaatcctgctgagttctcccttctagatttgtgcagatcaaacatattacagcccttgacctttccagtagaagcagcctttttagtccaggctgggctctggacggaccatagacaagtctaactttaatttcgggccaaaattgactaacgaagccccgctcaacaagcttaggtcttcgttgaaggaattagttttagatctttcatcttatcgtcaaatttaaatcttgttcttaaatcataatagcagatatagagtaccccggactattaaagtcagatcaatttacgtacataagttgttttgatggtggttttattccacgtggcattttagttatgaaaaataaattttaaagtggtggagcccatgtatcggtgacacatccctcctctcttctccctctctacttctctcactctccttgccatttcttgattccactatcgacaaccagccgagcggggtgagtgacgacaaagggtcctcgcgacatcggcgacggcccgaacggagctacccggcagcacgtggttagggtgggaaccattggggtacctgtggtcacgcatggtgaagaagtactagtctcgttagccgatcatcgtctgggcaatgatggggaaaggggccgggtagccagcggtgcatacgtagagatagggcaccaccaacttctcatccgtcgggtgggagtggaacctcggcaacagattcaacacctctcctagcgacagaacaatgtctcgacgatgagtatgggggttgggatgttggaggtgcacgtatagaggaagtgcgccgctagctcctcatctgttgagtggaagcggaacctcggcgacaggttcagctccgcccctgcgtcacgcccctgctgcgccacgctctcggctcccaacagaagtagccgaccagttgacaaatctaggcatcaagcagtggagaccaggcggagaggtcgggctaaggaggtagcagaggcagtccggctggatgaccacaggtggagctactccttgcaaggctccgcccgaatgtcgtagtgtttgactttgcaacaccattgggcattggttgccaacgttgccaggctgttcggtgtcaacgcggtgccatgttctctatctttgccactttcgaggacctcgcgtcagcgcctgtggatgggaaagctggagaggacggtgacttagggtgtgtttggttcacggtcaagttaggatgggatatggtgatccatattttgctggatatggtgatccaattttctgtttggtggagtggatatggcgatccagttttttgtttggttgtagggataaaggtgaatttggtgatccaattttctgtttggttggatggaggaggttggatttgtaggtgtggtcacctctcacttgagatagtgaatatacccccatcaaattaatgcataatgcattttataaattctctagcaattttacaccgctacctttccatattataaatacacatagaaaaaaaaagaaaaaagaaaaagaaaaaaagaaaaaagcattagatctggggctcctcctcctcactgccgccgccgccgcctcctcccgccggcggccgctgctcgcctcctcccgtcggccgtctcctcccgccggctgcaggcgccaccgcctcccgccgacgcggctctcagcgcccgcaccgtcgtcgttgccgttgtcgggtccgcatcgtcatcgtcaccggcaggcgtctccgagctcgcgcctcctcccgccggcggccgcctcctcccgctggccacctcctcccgccagccgccgcctcccgtcgacgcggctattgcctcccgcatcgtcgtcgtcgtcgggttcgcatcgtcgtcgtcgccagttcgcatcgtcgtctccgccaacgtctccgagctcgtcgctatcgtccctcttcccgttgccgcgccagcgccggccactgcgcccgtataacgcgccggcccactcgcccgggcgaccgcctccctccctcgctcgcccgggcgctcaggcggctggatccgggcaaatcggccggatccccccatccagcatctgggggaatattcctccccgagccgccccatcccacccctgcccagcaaccaaacacctacaaaaaaaataggcggccatgtcctatccacccatatccctccatccaaacacacccttagagaacctggcagcggttcttcctcctgtccgatggttctggcgagttcaaagtcaccttcacacccgaagtagggggcttgcttttgtcaatgttgtcgagctgttccctactctgtaggagcttctatggaagaacgacttgacgtctccatccatccgtgtggtttctcaccttatcgatgctcggtgcggccgagagatcgttgccgtcgacacctagtgtacattcagcagcgtgcatgactatggtgggatgcggtacaccgctgacagacctgctatcaccattggctagctctgtcccgaccaccgctagcatcgcgtggcccctccgccgttgcttgccccactacaggctgctgtcggagtgaaatcaagaaaaagcagatgaaggatacagagaaacaaagatgagggagaagagaggagagggacatgtcactgacatgtggggtccactacttcttaatttattttttctaactgaaatgccacataggtggccatttaggatgaaacaaccatcaaaaccactaatggacataaattgatatggttttaatagttcatggtactgcatatatggtattgcggtttaaggatacgatttaacatcaaaatgagagaactaaagtgaatttattacttagttaaatgggcagaaaacatggcatatctgtgtgtgggctaatattttatagtttaattatacgcggatggattgaaatgttattaagtcctttataatgtggtgaaaaagtgagtagcaatataaaacaaaaaaaatagtgagtagtctgtgcgacaaaatgtcaaagccaagtcggagagataccttcaaaatgtcaaaaccaagcccctgtgccacaacgccggagggatacaggttatattaccatgtgcgtgatgaatttgcagttaggtttgtctatcacgtgcataccgtggtggtgaaagtttgtcatggaatcacaatctatcgagtgaatgcatgctaccaaaaaagtaaatgggaaaataaaagaaaaagtaaagcaatatgccaccgctcaataatgagctttgttttgatttgtcatcgagagcatatgcacgctttttgggtttctccacgagactgggactccatcgtaaacaacatatttacaaacagaaaataatttataaataaaacttttataaacatattatttgtgttttaaaagcaaaggctaaaaaataactacgatgaaaaaatcttaaaaatcaactctaaatttaaactaaatttaaggtttaaaattcaaattttagcttataagtataaacataagccactgcacgatattcatagtgagtcacatgtagcatgaaagttttttgtatttttagagtgatgtcaatattcttcctcatctagcatataataagtactatctccattttttttaaaaaaaaataaagtgagatacaattagtaagaaagtaggtataactaaatgagggaatgcttgattgaatgggaaatgaaggtaggtgaaaaaattgataataaataatcatgtttgaacgagaagagaatgttgatgcagaaactgttatattttaagacaaattcagaaggctaaaagttattatattttaaaactgatggaataagagaaaggttatagtccattgagtgatattccagtcatatcctcttggtgtactactccgtcccaaaaaagacaaactctagccatgaacttggacatatacgtagctaggattgtttttttgtgaggggtagaacgtagaggcagttcatgccgatttgtacgagggatgagattaactattcccttttcttcatctactccctctgtcctataatataagggactttgggtagatgtgatacatcttagttcaatgaatctggacaaatcatgtatcatatccatctaaaatctcttatattatgggacggtgggagtagatgttaggggtgagaactgagaagtgatggtgctgagcaagaaatgatgatggttccaaaattcgagcctgagacaaacttagaaaatctcagcacctatctcagtctcaatgagggcagctagcaatattatgtggtgattttgatatatatatcagatgatgaaagatgactctattgacgaaagtgtatgacggtgttacaccaagagcttctatcccaatctgattttctctctcgtacatcatgtcaacacaagaggatttttaattaatttttaatcattttctgttgtttaaaagtagataggtgcatgcttggatcgcaaaacagttctttgtttcgccttgcacctgaagatcatttgacagaaacccaacataaccatggaagttctactaacttttggtgaacaaaaccaaaacagagcagcagctggctcagaacctgctcatccaatgctccttttgggtgtttagcgagttgatgccggtggtccccacgcaccactgtaaccaagtgcaattcccccatcagttcatgggcccccatacattaaactcggtccaaaaagttccaaagtccaaactcctaaccggggcccacgtccgagggtgctttgctttcgcgggcgtgacagcacggctcgaagtcactttccccactcacagaatcacaacttcccacccccaccacgccatatctccagccttcaatgaaccaattcaccgaagcgacgctctccgtacctccactgacatgcgggccatgcctcgtgtagggcccatatctcagtgggtgatatgactgggttcctgcgtggaaagcgtctcgctcgcccgagcggatacgattgcgcggctgcgccccccgctaacgacaagcggcaatctctttggccgcggcaccccgtcaccgacgggtggtcccggctccggaacggcgtgaggagaatgggcggagatcagaagtacggccacgtcagaacaagcagagaaaggcccccaggtcactgcgtggtggatcccaccgtggcgccaccctattgggccctactcttcagcgtgacgtggatggggcgcgtaatatgtgtttcggcggtagtagtaggttctagattatttaaggcccctcggctgctatctctatctatctacacgacgcgagagaaaaaaaaaatctggctcccgagaagaaaacaaaagggtaaaaagagcagagcaaaagctctcttcagttctccacgcccaagggcagaagagagggagggagagaagggggggagacgaaggaagcacgaaaccctaatcccgaggcagcgcgcctctccgatcaactccggcgtgagtcctctaaccgctctccatccccgatcgctcgctcgctcgcgccgctcggtgcttcaatccggctagggcttgcggccgtcgcaatgtggggggtttttccgtgcgatttttggtcaaattgcgggtggtgtttggtggtttttgtggactctggtgggtgggattagtgtttcgaactcgaagtgtacggggttgggattatactagggctttggtttaggcggaggttttggtggataatttctgaaaattttcagtggtttgggtagtttttgctggtaaatggcggctggttgttgcgattgctggtgggttttgatcacgatgaaatgtggcatgttaccatatggcgtttttggttggttggatttttattttgtgtattattgaaggggtcggttttaatggagaaatttcacgtttagcagtttagtcttatgtgaagtgactaatcgtcggttttgctttacccgtagtttgttgtctcccacaaaaaaattgcttcgatgttgtggggttttggtactatgacgtttgggttttagtggcagttatcacaaccattctgtgcgtatccttctacgtcagggtgggttttattgcgaaatgatggcgacttctcttaatttattagattaatttgttttatttgtaaaacatccactattaccggataagagagcattagattatataaattccgttcgaggtgtagttttgctgcatgcacctcgtggacttgcggatttgcatgtagaaccctgattaagagattgattagctttgtgcattgtttgttatatcattctcaccattatgtggtaatcaagaaatttgattaccattggatgggacatgttagtaattgcaacactcatggtcaaattgtcttcaccaacacatttataacatgctgtatatcaagatgcatggtaattttgtagctttgattatctttgctttggttgtctcgagttaagatactgcagccagtagggttttacctcccttcatagtt

SEQ ID NO: 42626 - DNA, 13348 bp, Oryza sativa
  unsure (1)..(13348): unsure at all n locations
ctggaagtggatcgaattctgtgtgctaacttaagagcaggagagaaaagcctaaaaaaatccagagtagtaatctcttttgcagatacgattaaacttgcgtgcaagaaacgatatctctcctgggattagttacattgttgtccaatttatgattcgtcgaaagaccattccagttagaactatagccacaggactgtgtttgaacagtaaaaactgctacctccggtaaagttgtgaattgcttgcggatctctaattcaccggtgacaattggttggtgatgtgtgtcaccgtttcagggagaattaaagttgacgaaaccgttcggcgggaggaggccggcgtgcagcctggagcttaatttctacttactccgtcccaagacaccaatctagattgacatttcaactagtaatatccagattcgttgttctagataacgtcaaattcttatctggattgatatttttagaacggttggagtacttctccgtccaaaactaaatttacttttcacatatctcacatactaaaaaaatatttctatatggttaaatcgtaataacctttttttattaaaatacttttatagtaattattattagaaataattttattttgagataaatagaataggtaaaaaagaatggtggggtcgccaagatatcggtatagatcggatcaagctcctctacctttaagtgtaggtgtctatgtaatcgacatgtgggtctgatgaagcatgtatccacctgtgagtgataaaggcacggcaccaataaaagcagaggatctcaatttgtataaatctatttgtcgtttgtcaattgtcaatttgtcattgacgaatttgctccgctacagggaccgtctgctcgctgctcgtcgtgaaatttgctcacatattttagctccacgtaagcattaaattcttcatttctcgtgtcactcagtcactatgctataaaatataaaataaaatactcaaatactatcaacaacatgcacaagatccgaccttccgtcccgtgaatccgtgatgaagaatcgaggatagtactatagtatgtgcatcatcttaaaaaaaatatatgagaggatacgtgtttgtggtttagcctgtcatgtaggggcctcaggtatctagttgtattgattatattattattacttcctcgtggttaaatgaaccgaataaatcaaagcggtatctgaattgatagcacgttgtactttagcctgctcgctctttggccgtttacgtacaccgcccatggttctatcaactctttagagccgggtatggatgcatgcccgtggatttaacaatcatgaagcaggagtaccatttacggagtagcatgttggtgtacaaacctatatatcaacataaatgaaggtacatcctgttttacaacttaaaacttggattaaggtcttaaaaaataaccttacacttcagtttttcattttgtttttttctcccttcccctgacataagccggtctggctgattgcgatgtgtaactacagctctcttcttctaatatattaacgtgtaatccttttgcgcgttcgcgaaaaaaataaccttacaatttaaatatggaactattcatcataaaacttttcaaaccgtttactttagacctaaactttcgaacctagaactatttatcactctttttaaagataacagaatatttcgtgaaccgatgaaaatatcgggcctcaacaaatggataataccaagactcttctctatcgaagacattgtagctctttgttttttttctttcgattacatggcagacacatacgcacatacataactacacacgccatactatactcatacacgaatatgtcttctaacacatgctctctaagccaagccattgtagttcaattctacacagatggataactacatttattcattagttatctactaaactttaatttgctagaataatagacaccgaggtatagatagaaatcaactttacgcatctacatagagatatagatagataatccctccttttttacatcgttgacttttcgatatatacttgacaatttgttatatttaaaaattatgtgtgataaacttgaagtcacgcttaaagtacttgtaataatcataacaaaataaataataataatatacttttgtttagaggaatggttaaacttatgtctgaaatatcaaattaccaaacatatataaataaacggaggaagtacatcaaatttattgaagtgttctggagtacgtgttaggccacctatggtatcggtcgatggagccgcctccacgtcgtaccatacgcacgcagcgcgcgggcgcgcgctcgcatcggtgctccccggcggccatacgccgcacacgtagacgcgcatacaaagctgcaaacctgcaacgcgcgtagtggcgcccggcgccgttcgatccacacatatctcgctctcgctcgcgcgcgcgggagcgtgaccgtgtcgcgtcgcgatcgcagcaccgcgcccgcgcccgcgcgcacgacggcgaggcagacgcgcgcgcgacgggagcgtgagcgcgggtacggtgtggctacgctttctagctagtctcgatcagtcgatcgatcgatcgcgatcgatctcccccaccgggccggtcgacggtcaggtacgtcaaggcgcgcggccgggcccggccggagctagctagctagccgaggtagacagaaccctccggtcatccggtgtgtgcgtggtccagggcgggaacgcgaaccttctccatcgccgcgggtccgacacccgcgtgggggcggcggtcgctgtcgttcgccgtgcgccggctgggtctgacctagctttggccggggccgcccctcgcccgccgatcgcgacgtacggcgtcccgtcggccgtcgacactgacccgcgcgcgctgatcgataatatcgatggatgtattggagggtagccttccggcagcgcgcggcgatcgatcgtttacgcagttcgggacggccttcgatcacgggcgtagtacgtaccatatatatccaggggtttaccgagccgtacacggtacactcgacatgaactagcttgcttgtccgtgagtcgcgatcgatcgatcgggcgagacaagtgacaagacgatcgatgtcgtagctggctagatatgcgcctccattagcggcccgggcatgcatgaatgtatcaatagcattggccccgttcgatatgaccatgtcacgatcgatcgacggtacagggcactgtaaccggcgagggctgattcgctgaaaagagagcgagcagtcgctgtgcccggtcgtcggccgccagttgtacaattcgatacttgatagccggtccccgtgaacgggtgaaccgcgggccgaccggcgcccgtccgatctatctaacttcggtcgatctatcgatctcagtacgccatccatcagatccatccgcctcgatttacggctgtgaccgtggggcgttgccatccatctgttgtgcaagacaatctggtagggtcgccctgcgtctcctctaatcattcgtccataattatgcacgtacgagtgcattttagtagagacgcatgcacttgttagtccagggtgtacgtgaattcaaatttcaatcccatggttctccgatgttgaattcaccaagtttctacttggttgtccaatattttaagacccatttgaaacacaggaccaagaaaatgattgagaaaacacataaatagaaaaaaaatgtacgaatagaataccatgcttattgaattcctatgggactttgaaacacaggaaagtctccaagctctcgtttgattagcacataggaaaaacgcagtaattgtaaacacatgaagagaaaaacataaggtgagacctcatgcttattttccttcaaaattgctctagcaagatctattccataggaactttaaggccctctttgaatcaaaggaaaaaccataggaattatagaggattttatcctatgaaaaataatcctatagagtcatttgaaacaaaggattgtttcctatcaattcctttgaaattcctatggaatgaaccttactagagcaatttggaggaaaataagcatgaggtctcacctcatgttttcctattcatgtgtctaaggttcctgcgttttttctgtgtgctaatcaaatgacagtttgaagactttcctgtattacaaaatcccataggaatccaataaatgtggcattcaactcctatattttttctattcctctgttttctcaatcctgcgattaaaaaatgccctaaaggaattgatatgtgatagtcctttgtttcgactctataggataaaatcatctataatttctatggtttttcctatgtttcaatggggtcttagcattttgaaattcactaagtacgttttcttttttgtgcagacttgttaaactcggtatctattaacttattaaaggaatagaaaaaggagcctccacgttcgctctcatggactagaaattctcatattaactagagaaaaagaaaaacagagtacatatagaaatacaatttagaaatagctgaaattcggaactaaaaaataaggaatattgaaagatgagactagagtccatatagaaatacattttataaataactgaaattcagaattaaaaaataaaaaaatattagaagaagagtatagagtccatatagaaatacaattagaaaataatagaaattcagaattaaaataaggaatattagaagtagagtatagagtccatatagaatttaaaactaactaaaattcggaataaacataataaaattaaaagtagagtttagagttcgtataaaaatacaatttacaaataactaaaattataaattaaaaaaagagagtctaaattcaatataggaatacaatttagaagtaactaaaattcgaaattaaaagttaaagaatattaaaagataagtttagagtccacatagaaatacaattagaaataataaaaaattaagaattaaaaataaataatattggaagaaaagcctagagtttatatagaaatacaatttacagataacgaaaatttggaattaaaaaaagaaatattgaaagacgagtctagagtccatataggaatataatttacaaacaaataacgaaaattcggaattaaaaataaataaatattgaaagacgagtctagagtccatataggaatataatttataaataactaaaatttaatattaaaaataattaataactaacacgtatataaaatacagtataaatattacacaatatattatacattagtagtttcgtaaagttagtacaaaatttagaattatgtatcattttaatatatttgaaaattatattaagaaaacatatatactattatatgagagaaaatataatgacactagccgtgtaatctgcgcgggccaccatgctaatttatttgaaaaaaacacactatcatggatatatagagcaactgagtaagcaagatatttatctatgtttgtatttaaaaatgtgacgccacaaataatgacaaaattattttgttatattcctgccttctctgcattatccgcgctagctgctctcctctagctcgctatcttatattctatgcccctgcatctcgatcggcgcatggcgtggcgcggtggcggaatatacgcacgcaccgctccggtcagtggccacggagcgtcgccccgtccagtggagatcaccacggaaagcgaacgccgatgacgacgacgcccgcgcgcgcatcaacatcacggcggtttcagtgcgccgtacccgtccatgcatgcagcgcgctgtagctagccacgacgtgacgcgctggtttagcgacacgtatactcgctctccaggacagctaatatgctctgctagctcacacgtttgtatctccgtcctgtcgatcgttggggatcacgtaagatcgaaacagtggcgacagcattgagcagtggcgtgaccgagtgaggtttgatgaaacctctccgcagctaccacatcagcggcatactagtactacttttgacgatgaaacctctttttgaaactgcgtcctcttttatggggaaaaaaagaagggaacaagggtatcatatagattgaataccgtatattgcagaattgcaagcaccaacgtaatttctagttcggtccatagcttcgataaacgagcgaacaccatctgaccatccgtgtatttcaggcacttctcgcacaaaaataaagtttcccacagttggcgcaatttaaccggagtctgagttaagccatgagttttccaatttttcacagaacacaccagcacggtaaaccttttcttagaaaaaaggttagggcgggcaaacgtccttcctatttttcacagaacgctccagcgactgggtttccccgcgcttacgccctcgttcagatgggtttccattccggcccatagacatgtcagccacaagcccataaccaaaacgagcctacaaagctaccaacaaatgctgcccacatgagccacgcccgcatggacgcatgtgggtaggccactctccgctgctttgcactctgtcgatctgtctttcggaaggcctgaattttgtgggcttggtgattacttgggcctaaatcatagcgattatttttggaaaagtccactttaggttcctcagataggggccgagcttcgaatcacattcttcaaccgcaatatcacccctcgacttctaaaaccatggcaaatttgagtccctctgctttgggcggttttggcttgtggtggtggcgtccacgtggtatgttgaccttattttgaggttgatgaatgctatcaaaacccgatccctatttgagagagagagagagagagggaaaaaaaagaaaagaaaagtgaacttattccttgttctttcgagacctgagatgtttagccacattggtggggaaactcttttaatctcatttcttatatgttactcatatagttataaaaaaaataacaagatagattaatttgatatatgtcactacacaaacatgtaaatttaaattttagttttgcaagtgaaaaaaatatgattgtgaaattaatttttttatgacatcaaatttaaacctggaagtttgggtgatatatcacatttacttttataaagaaacctttgatatgtgagatagtatatgtttgtttttcaattattttcataactatttacatgacacgacagacggaggggatatccctatccctccaaagagaatccatttcccactttggtgagatactgttcaatagataatgatatttgcagttgcacgctacagttttgaatattcttcgcatcaatgtaccaaatcattaggcatgtgatcagatcttcgcgcccgccctctccacgtctgcgttggcagcgaccgcggccgccgccttcgcatcgtccacgtgggcggcatcagcgtagacctcctcgtcgacgtcgtcgccggagcacgcgccgtgcgcgacgtcgtaggtggcgtgcagcccgacgagcacgtagtagagcagcatgatggcggtgcagacgccgaagcggatgaacgcctgcgcgccgagcgagcccatgaggaagaggttggtggcgatggacagcgacggcagccacggcacgagcggcacgccccacaccttgggcgcgcgcgccgccggcaccagaagctggatgccgagcgtgcccgccgcccacgccggcaccagcacggtgtacccaacccaccgctccggcgccgcgccccagtacgccgcgatgcccgccgacgagccgatgaccaccgatagcaacgccaccagccgcctcgcgtgcgtcctgctcgtcacgccccgcacgtagtacctgcgcgcgttacaggaagccattgttggttacagaaaactacgtgccgaacttgaacatgtgcaccgccgccgtaaggtgggagaacgtgcgtaccggcggacgaggagggcggtggccatcatcatgaagatgaagagcgtgctgacggagaggaggctggagagcacgtcgaggctggagaagaggccgatgcaggcgccggcggcggcgatgagcacggtggcgtgcaccggcgtgccggtcctggggtgcaccagcgcgaacaccggcgggatgatgtggctgcgcgcgatgtgcgtggtgtaccgagcctgaccgagcgccccgaccagcagcaccgtcgtcatccccttgagcgcgccgagcgccaccacgtactgcgcccaccgcatcccgacgttgctgaacgccaccgagtacgccgcgctccggtcgatcgccgtgtacggctgcatcatgctcagcaccagcgccatcacgcagtagatggccgtgatcaccgacatggagccgagaagcccgagagggatgtctctcgatgggttcttggtctcctccgccatggtcgcgatgttgtcgaacccgccgtaggcgaagtagacgatcgccgccgcgcggaacacgcccggcacgccgtgcggcatgaacggggtcaggttgctggtcttcgcgtggaggaagccggccacgatgacgaaggctatcacgaggacgtgcacggcggaggcgacccagttgacgcgggaggtgcccttggcgctcagaatggccagggtcgccgtgaccgcgatcaccaccaccgcgatggggtccagctcgttgtacccctcggcgagcgacgtctgtatgcgcagcgcgctcgccggcttgttgatgagcgacgcgaggtacgacgtccaggagcgcgccaccgcggccgtgccgatgatgctctcgaggatgaggttcgcggcggcgatgaaggccgccacgtcgccgagctcgacgcggaggtaggcgaaggagccgccggccacggggatctcgacggcgaactccgtgtagcagaacacggacagcatggcggagaggccggaggccacgtaggagagcacgatggccgggccggcgtggtcgtgcgcctcctggccggtgagcacgaagatcccggcaccgatgacggagccgaacccgaaccacgtgaggtcccaccacgtgaggcagcggcgcatctcgttctcgctgcggcggcgcagcgcgccgagctcgtcggcgtcggtggagcggccggcgaagcggtcgcggaaccgcgcgggcgtcgcggccagcgccgcgcggtacgcgccccagctcgcgaaggacggctccgggaagaaatcttccttctgccaccgccagtagctcctcgcctccgccgccggcttaccctcgtacggcttctccggcgtatcgacggccgccatatcttcgtgtggaggggatcgaccacagctttggtggtgaactggacaactggtggagtgtggtgagctgcaggcagctgcagccttggagatatccgagtgtggatttgtcactttgtgagacgatctcttttgtagtactccctccgtcccataatataagggattttaagtttttacttatatcgtttgaccacttgtcctatttaaatttttttaaaattattatttattttatttgtgacttactttattatctacagtatcttaagcacaatttttcgttttttatatttgcaaaaaaattttgaataagacgaatggtaaaatgttataagtaaaaaagccaaaatcccttatattatgggacatggagggagtagctttgttatctgatttttctttcttctttttcctttttctttttgtttgtgtgtgtgaagcggatgccgagcatttccggcaaaccggcgcctcggtgttacttatgattataagaattcgtttacatgacgtgtaacactttcagttcactaaaattcttcatctgctttaagtagcatggactacttatagatggacggagctcctctgatgcaaagttaaaggaacgtgggtcgctgataggtagggctcacctttaaaggcccacacgttagtgacgacgttcctctaatgtaaaactggagctttatcccttctagataggataaatgaagtcgtagcagtagtgccatgagcgggatgtactttcctaattttttttcccaaaaacgtcacaccaaatctttggacatatgtataggcattaaatataggtaaaatgaaaaactaattgtacagtttgtatgaaaatcgcgagacaaatcttttaagcctaattagtctatgattagctataaatgctacagtaacccacacgtgctaatggcggattaattaggcttaataaattcatctcgcggtttccaggcgagttatgaaattaaatttttcattcgtgtccgaaaaccccttccgacatccggtcaaacgtccaatgtgacacccaaaattttttttttcacgaactaaacaaggcatgcgtttctgtcatggccctaaaatccaaagtctgaagccccttgatttgtataaaaaaatacaaaaaatttgaaaaatttcaatcctgtggaagaaattgtttagtaagtctttgaaacaaggggattgaatccaatcaatttctttaaaaaaaaactacgaaataggcaatcctacatatattttataagtcatcagcacaatctaaaagtccatccctaaaattctacttttggataagtagttagattttcaggtgtcaaaaatttcctccatctaaggactaagtaaacattaactcctaaaaatgaaaattgagtaaacattaactcctaaaaatgaaaatggatctaacactacaccaacataattgtctcatctctccactgccttgccgtcgccgaagcaggccgctcggcatgcatctctccactgccttgccgtcgccgaagcaggccactcggcatgcatctctccactgccttgccgtcgcccaagcaggccgcccggcatgccgagcggctacgtggaaggcggcggcatggcagttccttgacagggaccttgctccctatgcgacggagggggaggagggcatcgggtctaggttcctgcctctagatctggcggtgtaggagatggtagggatgtgggcggctgaggcgtagcggtggtggttaggcccgcgcctggccgagcgggttggtgacagcagcggaggtggttgggacagtggcaggtagcggtgtggcatcggcggcagcatcccttcgagcggcgacgagtgtggcaaaggacggtgacggcctaagatccaacggaggtggttccgtatgcagcaacggccctaggtgcagcggcggcctgggagtttggacagaagagggtggcggcccatgacagcaatgacctgagtgctagtgcaaggatctcagcgaggaagaggcagatctcgtcgtcggcagccctaggtgcagcagaggcatgggagttcgggcgaaagaggactgcggtagaggcagcagtaggctaggagttcggaaggtgaaggaggatcccgacgacgacagtagccctatgggcggcagagtcctaagagtccagcgaagtggaatctgatcatgtcaactcgcgtctggtcggctagttttgactagatgacgaattgacgttggatgaaggcgggccaaccagcggcgcgtgacgccagtttacctgaagcggatgaagatgtcaccaatagaggttcgcagtgacggcacactaggggcagtgaggactagacgacttctactcgatgaatttagccgtttcaggagaggattccgagaagtagggatgtgtcgaggtcgtagtttttttttttgggggggtattatgttccactctttattgagatgtgagtctaggtaatcttgtatctttttggctgatatctttcgtagatatagaggtcagattaacgaaaatccattattaaaaaagaactgcactaacataatcggaggtcaactcctctcgtcgagcgtggcacgactgtgctacctccactgcgccaggtgcccacgtactcgcggagagcgagaaacaagacatgggattagggattctaatttttggacatctctataaagaaaatgttggagccattttttaaagaaaaacaaagtttttagtaccgggttttattttgggattctattggacatgctctaagcaagagctccaaactttgactatctctagttctgattccgttcttatgtttatccagctatctactcgaacaatcatttccttattatttttatattttacacttatatttctatcgtaattacgtgtttttattttatattttaatctgacgttttatcatttcaaacaagttggtcgtgcactggtgcctgtggtttgatggctgcggaaatttagcaactactccctccgtcccattttaaatgtagtcatggttttctgcgtccaactttgaccgtccgtcttatttgatatttttttaaaaaaaatttaaaacataaaccacgagtaaagtacttttcatgttttatcatctcataacaataaaaatactaattataaaaaaaattcaaatgagacagatgattaaagttggacgcgaaaatttatggtcacacttaaaacggggcggagagagtattattttggttggtgtctactagagtagcttctgtgcacggtacacccatgcacacatccatttccaattgcatcagcagtgtggtcaaaaaagaaaaatgcaatcagcaattcagcactacagggcacagacagctccacaagcgtgcaaacaaaacaagcatttgcggtagcctcgtccgatcgatgcggcgcgatagcgcacagggggatcgatggatggggacatgtggccgccaggcgaacaccgagccaggcaattggagattgaagatccgtgattgggtgcgatcnccggcctctgcatttgtggattccggaggcacattcgagtgtggggctggggcaacacgcggggcatgcgcaaaacggcgcaaggctccaaggctccggttcgccatcatcccagccgagcaggtcgcttcctctcgctctccctctccctgtccagtggatcaatggatcatgccgtgccgttgcgctcgcgtgttcctttggttggcctggctcgtgctgtgcggcgtgcgtgatttaggattggacctttttttttgttggggggtgtacagactacaggtagtgctcctgtataatccaaagtgattagttaggcggtgccaattcattttgttcagatcactctcttcatcgctcgcctactcataacaagtttaatagtctagacagctaccggcaataaaaaag

SEQ ID NO: 42627 - DNA, 1336 bp, Oryza sativa
ggctgatttcaatttcttagggcattagcaatgcgctattgaaatatgccaaacctcaccagccacatagaccaagaacaatataagctaaatatctcacaatgcatgccacttacaatgggtcccactaatatcaacttaacttttcatctcctctctttttctttccccaacaaccccaccaacagagaagccaagacgctcctctttttttttcccaccacatgagcggagctacattggcgtcgagctgcacgatggatgacagtggcggtgccgagcggcggatctctccgtcacaactccggaccaccacgagcccctctccgtcgcctccctctccctctcttgaagacggctgggtgtcgaagccgcggatgacggcagcgcgggaggctcctctccctcttaatcgtctcactcttctgctccggatcaacctcgagctgctctccctcgaccacctctcggtagcagcggcatggagccacggacgacggtggcgccgagcgacggatctcgggaggctcctctccctctccgtcacctccctcgccggctccagatcaacctcgagctgctctttctctcccccttcttggtagcggcagcgcactgagcgtcatggcagtgacgcggagccacgaatgacggcagcgacgcttctcccctctctcccccttcttcacctcttttcttgtgggcccaaacatgcgattccgacaacgagatatgtctagtggagatgaatctttgagttggctggataaggaagaacgacagctaggtgcactgtgaatggtcttattatacctactcccagtgactaagcacatactgacatacacgcagtcaaaacactgagggaatcttggaccggggctcgtctttttttcatgctctttaacatgatcttgattctgaaggggattggcccggtgataggccgcaaatcgccgtcggtggtagactgcggtggcagggagttcagacttcagacgacgacttcagacgacttgcgagtgcgtggctggcacgagtcctggtcgacgcttgacgtcaagaaatctcgcttgtggaattgtggtgctctcgacataggccctcaccctgttgatgcgcgtcggcttgtccgctaagaaaatccatccgtttcatattacaaatcgctttagtttttttaataaaactagcatggtgccccgcgcagattgtgtggctagcatcattatattttctctcatataatagcatatatgttttctcattatattattcaaatatattaaaatgacattataattttaaattttgcaataactttacgaaactacaa

SEQ ID NO: 42628 - DNA, 5957 bp, Oryza sativa
ccctctatatggactctatactctacttttaatattccttatttttaattcctaatttctattattccctaattgtatttttatatatggactctatactctacttctaatattccttatttttaattctgaatttcagttatttcctaattgtatttctatatggactctagtctcctcttctaatattccgtattttttaattccgaatttcaactatttttaaattgtatttctatgtgtactatagtatcctcttctaatattccttattttttaattctgaatttcagctatttctaaattgtatttttatacggactcaaaactctacttttaattttattatgtttattccgaattttagttagttttaaattcatatatggactctatactctacttataatattccttattttttaatttcgaatttatattttttcttaattgtatttctatatgtactctatactctacttctaatatttcttatttttaattccaaatttctattatttcctaattgtattttatatggactctatactctacttctaatattccttatttttaattccgaatttcagttattttctagttgtatttctatatggattctagtctcctcttctaatattccttattttttaattctgaatttcaactatttctaaattgtatttctatatgtagtcaactcttctaatattccttattttttaattccgaatttcaactatttctaaattgtatttctatatgtactctagtcttctcttctaatattccttattttttaattccgaatttcagctatttctaaattgtatttctatacggactctgctttttttctttttctccgattaatgtgagaatttctaggccatgagagcaaacgtggaggctcctttttctattcctttaataataatataatagatgtttcaaagtttaactacatttataaaaaaatataacaatatttttaacacaaaacaaatctactattgaaatatattcaatgttatatttaataaaataatttttgtatggtagatattgctattttttttataaatttggacaaatctaaaaaaattaaaacaactcgtaacataaaacaaatatggagttctaagaaaaaccggttgcaccataccttgacctcgaggctcaagagggtaccgacaaaaccggttccttccatccataggtgtagccccacaactacattgcaaatagcagtagttcatatattacacagtcaaatatattggggctttttttttctaaaacagacgtattaggatttgggagccacatttttcctgtgcttaccaaaattcagcaggaagggatgcattcgtgcatgtgtttgtttagatggatgggaaagtaggattcctagcccatccacatgatgggccaatttttttaaaacaaaaatcttaaacccatacttgctgcatacatgaaataataataattaaaaaatctatttccctctttttttctctctcccctcttgtgcacggtggctactgccaccattttccacttctatccccatctccagtgcttttccttggccacaaccaacataaagaaacgcaccacattctcttccatttccttcgccgccgaaatcgccgtcgtcggagtcaaaagggccaaagtgtttgtccttaatttttctcctatttccaaagtcattcggccaccaaagctcgtcgacaacacacacccaccgccccacggcaaccgccctgctcggccttgctttgccactgaccaggccacatgacacaatccacatcccgaccacctcaccccaaaccgccgctacaaggagctccactggactttcgtggtggtcaacggcagtcgcaccatgcatctggaagctcttcggagagctgccatcttacatggcaccactatttcagctgctcgctgtcaccaacttcaccatcgactctctagccgcctccttcattaccacaggttgtcatcgctacacgctccgcctgcgccaccgctgacgtgacgtggcgtgggttggggaacaccttgtagcgatgtcacgggcaaggtacaccggcggaggcacggtggccgagggcaccaagcttgaacgtattgagaagcaccctcctggcggcagtctcatcagttttgggcaaaatcgtggcggcagtgtctgatccccccactgtcaccgcaatgccggtgatgaggaagatggagaagagaagaggaagagggagaatgagagtgtgttgcatttttatttctttcccatgtatctaatatgtgggtctcaataatatgagtgtcaacgtgacaaatcagagcacagaacgtgaggaacccatttgggtaagtacgacacaaggacaaagtttgaaaacttgaaaaataatttttagaggtttggggacttgaatgatagaaccgaaaatgtttaaggatcgcccttatagataacatagagaatatagtggcgatggcggtctcagccagatctggacgcgggcagcagttggtgacgatagccacggtgtggtgacggtgccggcggcggcagttggcaacggcgacggcggtcgtggatgtggtggctgccgtgtcaactggcggcggcggcggcggaagacatggcgtcgagcagctagatgctcggtgttggaggacgacagcgcagcggcagtttgcggaggcggtggttggtgtcggtgacagcggcgacggcggctgcgactctggaggcggtggcgacgtcggcggcggggaaggagtcgggtgcgaggtggctgggtgttcggcagcagcggctgcggtggtggtgaccgtgtttgcggtcaccggaggcatggcggcctcggttgactagccgagggcgtgggagacggctgcatctggtcggcgcggcatcgttcggtggaggggtcggagaccggcttggcgtagagaagcgcagccgatggcagcggaggcgcgggcggcagagatggaggccggcttggcgcgagaggcgcggcagatggaggaaggccggattggcgtgagaggcgcgtccggtggaggaggccggcttggcgcagagaggcgcggccggcggtggaggaggcgatctaggtgagaggaggagctgccggtgggtgtggcgcggtcttcggcgcacgaaggctggccggcgggtgacgccggtgcaggggtaccacatgtcggcaaagcttgtgtggtggtggagcaatcggtgcatcagccgtggttttgatctcgtctgtgcccctttgtgtcacgccccgaactagccccgagcggaactaacccgtgacgctccaaattaacctattaatcgataccagtcccaggaaacagtgctggtatcacaggaagacagaatatcacagcaacagaggtctctttattatagagtaggagtacagtcatgttgggctgcggacagatcccgagctcacaactgcattacaaaaagggaagcggaagccaagacttggaccaaatatcacagacgcgacttgggaactaggccgaaaccctaaaactcatcgtagccgacctgctcctggaaaaactcctcgtcagcaggatccgcttcatcttcttcagcaacttgggggggggattatttatatagagcaagggtgagtacaggagtactcagcaagccatgggaaataagtgtttaatgtaggcttcaacgggatggcggttgtttttgcaataggttttatttaaactcttttcttcaacaactaagtgagtgcttctcaaacgacacggatgagacagtgcgtctcgtccggtcggagtatgtgcaaggtatcagtcttctgaattgatcaaggttggcgtccggccaacagctttcaaacggccacccgggcctggctgatcccatcagccgcagattttccaaacatcgaacccaaaccacatcagcaaatttcacaaagcagtagtcaaacaaaactacgctaggaatcacctcacatctgcctatgaccgtgggcacggctgttcgaacagtttaataacctctgcagagagggtacactttacccacacgacgttactaacccgggtcacccagcccgtgcagaacagccacgtctggcgactttgaggctttcacgacaaggcatttccaaagccgacacatgttcaccatatgccaacgagaggggtcccagaccaacaccagattaggtcccagaccatactgtgccaggaaacccgggggttctccccgacaccaccgcgttgaatccacatgtctcttggcatcatggctcccccgattagctaattactcagccaggggcgtcccattacacccatgtggtcgcacttgtcttatgttcggatgaaattccaaggaaacggtccttagtgcaagagcgggaaaccatacacccggtacgttccccggtccgcgattttggaaattcatttagttcgcaagcaccgacccaggtgtcgggttttccaagtcttttgtaaaacccaagttttacccaagatgtttctcagattttaagtttgaaggcgaccgtcgatactcgtacagagtgcacgattaccgaggcgcaactaggtggttacaagggaacatgatataacaattaacaatggaaggatcagatgcaacaagttaggtaggcccaccggtctgcctagcaaacggtgcaaacagattaagtgcaatcctatcaatgcataatattttgcaagcaatataattaagttcaaatataggctcaatatgttcaaaggtggcttgccttgctcgagatcttgagcttgatcctcgaattcctcgcactgcgggtcttcgggctccgaaactacacgcaaaacaggaaaactcaacaaacggcgaaaataaagtcctattattgacctctaggcgtgccattagatagatctcgagatttgaggagttttggaagttgaacggagtcaaacggacttacggttggaaagatattgaatttctaagattattggatttttgatctaaaggaaaaggatttatttaaatcctttttgaaaaagaaaagaaagaaaagaaggagggagggaaattagactttcctcgggcggctagggcgcggcccgagagaaaggggcggctcggccgaacttaacgggccggccggcccgagaaggcggcctaaaacatgcgcgcgggtggggaggagagagagccggtgggccgggtccatcccgcatggtctcgggtaggacccgcttgtcagcggctcggctcaccgtgagcgaggtgcacgcagggcgtgctagggtttggggaggggaggcgcggcgcgtgcgcgcggttcgcggaggacgcggtgcggcgggcccacgcacagcctcacggctcgtggtggaccgcgtgcgcgagtggggcggagggaagccgcggaccggggtcagcttgacccggtcgcggccgaggtggcgcggacgtggcgcctacgtggctgccacgcgggccggtgggaggtagatgacgacgtcggctggaacggacggcggacggcggtggcgagcggcggagcgaaccacggcgatacaggcgaaagcgagcacaccgggaggttgcacaggacgaggggagacgagccaacggctcggattcgccgggggatgctcgacggtggcggattgcggcggcggcaaccggcggcgagggaagggggaaacggcaacggcgcgatgggagaccgattcgggcgtgctagagcatctacgcgactccgggaatccgttgctagcgtcggattgggcggagctacgccgagcgaggccagcgacgagcgggcgctacggagcacgggcggcgacggcggcgagcacacagcgagcggcagcaacggtcggggcggcgccagcttgctacggggaggctactcgagcta

SEQ ID NO: 42629 - DNA, 13296 bp, Oryza sativa
acggcaatggcgcgggcgaaaaacggggaagattgggaggggaaaaaggaagggagggtgcctgggtttatagggcagcaatgtcggtttggaaactgaccttgggcggtcaagggagcgagccagcgctcggcggtcgcggcccaaacggcgacagggggggagaggatgacgccggcgggaggctaaagggaaaaagggggaaagaaagggtgcttgcccccttgccactttggggaaaaggaggagggagagagggcgatgcagcagagggggggagctctgcctccgtcccttggaagcacgcgcgaggagaggcggggccgagtcgatgacgacggcgatgacggcgggggcggtttggaacggagcggcgacacgggcggcaggcgcggacaggcgcggcagaggctaacggcggcagcgaccaggcggtcggccaccacggcgtgcgcgcgcgcgggcggcgcggcgatttgggcggcgtcggcgggaatgacagcgagagcggagagggagggctcggcgtggctcacgggcagagcggggagagagagagagggagagagagagatggggagggagggagagatgggccgagaggaattcggcccatcgaacctgagggaggcaaaatagacttttgcggagggatttgatttgggacggatcgagattcgggattgaacttgacgatagattggggatttgagatccggaatggcacggagactgactacgagcgaggaaacaattttcgcaattaaggtttttaagagatagttttcccgctaggcgccacgacggaacgggcgctacactttattggcctagtggcggtcggtcacgcctagcggcggctgatccggtgctagccttctcctagacgtgtgggttggcgatgtcggcgtgtgggtggtggtatattttttcctttttctggttacgactctccagagttgtaatcttgtaattttttcctgctctatcaatagaacttcgcaccgtcttgtgcgagtcgttaaaaaaaataaagaatatagaaagtactactagtgtagcgctgggactgcaagcacccgcaatggtaaagcaaggtgttttctataaaatatgtacatctcagcaatagactagattaatagtaaaccacctcaatagtatgtctatatgggtatctatagctctctaattcattgcctcgtttttctctatagactatctccgggttagtagatagttttgttctctctctttatttaatctcttccatgtaggaaaatatactgacatggatctcttatagagagagcctatagataaccattgtgggtgcccttactgtcaggttattgggagattcaaagactataaatcgctcttaaatagcatgttcaagcattacgccttcaaagagaatgccaacaagattagattaagctcgaaaaataaaatacttaatccatatttttatcgtacaatatactgatctatcatcaaatacaacaaaaaaaggactacaactctacaagttggaagtacttgtcaccaacttcttcagagttcagagttcagaggccgcatcagttatgcgcctatgcggcgaagcaggcgaaccctggtgcaacgatcgtgccgccgccggccacggcgtcgcagccaccacggtaggaggccacgctggagtcgaggacgtcgctgcacgacaacgcgtcgtcaagtagcggtggcaccggctggtcgggatgccagtacagcgccctgaggaacgcgtcgctcttgcggagctccctccaccggcgcctcatggcgcgcgaggtgcggcagtgggcggccctgctgatgtccttccaccggtcgccgccgccgccgcggaggcggaggtgggcgagctcggcgtcgtcgtcggcggtgaaggggcggtggtagacgtcgcgggcgaggtggtcccgccacctgtcgcggcactgcttgggcgagcggcgccgctccctcggctgcatctcctcggcgacgcggcgccagtggcggaagccgtaccccctggcgaggcgctccaggcacgcgtcctcttcgggcgtccacgccggcgagagcctaatgcggaggatgatcctcatcgcgctcgacggggtcgccgccacctccgttgtagaagagaaatcagacgaagaagtttccatgcctaggtgaactgacgcaaagcgcgtaggcgcgctcacaaatcacacaatctcttctgatctgacaggggtgtgtacgcacgctggcgcagccgctaattatgtagatggcatgcgtgcgttctccgattcgaagtcgatcttacttcgcttccatttcgaggaagaaatttaactcggactagtccatcataatactaccccgccgtccgccaatgcaaactcgatccgattagcataaggagtgtatggcagattggcaatcgcgtatggattgtttcgctttgttcgtcgagctccacgcgcatcttccgcgcgccgcggagaagcccgacgccacacagtagttctccggcgtcgggccgtctcacccgtgacgctccgccgccattagttgcgcacttgcgcttcctcgagctaatccgctagtaccactgaaaatttcgagaggaccgatagatccgaaatttcgaaaaactacgtaaatttcgggaaacattgaacacaaggacgggacaaaaaaagcggctcacagctgacattgcgtcacctcggagtggtatttgaagctttgagctgatacggcgggctgaggccgagcgcggtctaagtgagagggtagggccgatagggccgataggttgaggcgtgcatgatatatcggagaattcgattccgtctgccgagtggcttaaggtttgttcgggattgaaaataattaattacaaacctcaatagatgtgaaaatattttccttcaaatcccccgtcaattctcttgtgagagtgacgaacaagatagctcctctccacaacggctactttataaaatgggaatgctaggggacgggataccgtcccccaacaggatagctcctctccacaacgcgattcttatccatacactcactcgccgccgtcgccgtcccttgccgccaccgccgccgccgccgccgcgcccatcccccaccgccgccgtcgctgtcccccgtcaccgccgccgcgcacatcccccaccaccgccgcgcctgtcctccgttaccgccgccgtcgccacgcccgtcctctgccgccgccgtcgccgtcctcgtctacaagggatggctacagggggcgaccgcgcgtgtcggggtgctcctcccacaacgagatgcccagctatatctagtaagaatcacctgatacctggtaggtatcatccgatacctcgcaagtatcacgtgatacatggtagaaatcgtctgataccttgcgagtatcacgtgatacgtggtagaaatcgtctgatacacggcaggtatcgcatgatacctcgtgagtatcacgcgatacgtggttgaaatcatatgataccttgcgagtatcacgcgatacgtggtagaaaatcgtatgatacctgataagtatcacatgatacttgtagttatcacctgaaacgtgtgtagaatcgtctgatacctgatatgtatcacacctgatacctactcgggatcatcctgttgtgtagaatcgtctgatacctgataggtatcacacctgatacctactcgggatcatcccgtttgaaaacaggattccgttatatagcagtccccttataaaatcatctcagtcaatctatatatgtagcaccagtgcaccacctgatccaactgatcttgtcctaacctagtttccatgtgtatcttttacattagtaaagacaaatggggttccgtaggaattaatgttcaactttgatcaaccttacttagtcacatgctttattttttttttaaaaaaaagaaggtttaaaataggggcgatctaatctaaaaggagtgattttacagtttgggagatatcatattttctagtgtaaaatatgatacctctcggtatcttgggtactagaagctacggaaattcgcaataaattttttggtacctctttctccatcttcaatataattcagtgcttgcctaattcctatcatgacttcggctgtgtttttcacaccaaaaatgaaagtttgattgaaattggaacgatgtgacggaaaagttagaagtttgtgtgtgtaggaaagttttgatgtgatggaaaaattaaaaaattgaagaaaaaatttgcaactaaacacggccttcctgaaggatcgagctcaaacgaattgatgtgagactggaataatcgatttgaatgaggaagagtattccttttcctttgacatgaggaggtatcatagatactagcagtctagcactacaaaatgtggcatgattccagcagtgaatagatactagcagtctagcactctactagtagtagacggtagtacaaccggaataacgctttgcttgtagagggagcaactcatatgttctaatacacattcttatttggctatatcaccatgagcccatgagtgtaaccaagcttagagcctatgttaaattgctaatcaacttgagtaaaaaagaagagcgcgttaggaaccggatgccttgcttgcgatagcaaaagacgtcaagcaccatgcatgcagaagcatggtagcacaagctctgaagctcccaataaaaagcaaaattgagatatgagaatgattgcaacctggcttcaccagacaccaagctgaccgatcagaccagcggatggcaatggcatcctcgttgatccgcgcattggattgcacggctacgcccggaacacgtggtgctccagctccggtcgccccgcgtcgccgcgtcgctcgtgttcgactggcgccgcggtgccagtggaggcctctcaccgcgcgtgcacaggcggcggcgacgcagccggacccggaacaccaggcgcccgcgaatggggggccgtcggcgtttcccacgaccgcgctgaaggtgggcgccggcgtggcgctggcgctggctctgggtggcgcgtcgtggagggcgcgcggcgggagcgccggcccggtcctcatgcaacccgccgcggtgtgctccctcaacgtcgtcacggacagcgcgtcacgcgccaccgcggaacggagcgccgccgccgcggccaccatgaggacgagcgtggacgcgctctccgactcgctgttccggcgcgaggacgcgcccagggaccgcgccacactgatggacctcgtctttgagcaagtcaccaaggaggtcttcctgatccatcatcccgatccatttcttgattcttcatttctcatctcaatcttagctagatcaagaaaatgtgcttctaccaactgcgtgtctcttgtcatgcgcagcaaatcggcgacaggggaaagctgacgagcttgctgcagaaggagtggtcggcgtcgcgcgattccgagaggaagcttgacctgggcttgctgctcactgacgtactgatcaaccaggtacatttctatgatccagtattaactcagtttaagcaaagtaatccggattcactcttaaaactttcttgtctcaactctaacttccaagctctgtaagtgatctgaatcacctagttagtagtgatactatgtttaatcctgtagagagaatggcagagggcaaaagaagtttgtcagcaattgactggccgataccaacgtgactcgaggccttacctgcacttggtaatgatctaaccaacttattagtcaagttttgttttggttatctgcaaagcttgtgcctaatgatgcttttcttcaggctgtcatcaacatgatgatggcagtggagaccatgctttctcctgaaacagccaatagtgacgacattgagaagatgtcaaagaatgccatggacgcgtggaaggaattcaagaccaagtatgagcatgccaaggggtcaactgattccagcacctgactgaccagtattatgcttgctttcagacaaatctttctgttgagtgctgacaactcttgtgatgaatctgtcttacccacttagttgcttgtgaagtttgccccaatctttgtgacgtaaatgttctcgattctcattatgcatacctattttacaacctacaattatttaccaacatttctagttgtgtttatcccttttgtatatttacaccaatgcaatcttcagaagaaaaaaaaaatgaaacaacgaactgacaaaatttccaaagactttattcagtagtctccccccacatcttcagaaggtatctctcgcagctgctccctgcgatgtctcccgaggatgccatcctggtgatgccctgcttccctcctgccccgccattgccacgctttaggttgtgccggtactcgacggcgatttgctcgaacacctcgacgtcgaacatgttcatgatcaccttggggctcatctggtcccggacataggcgaaggcgagctggtcgcgcgggttgaacgcctccagctcgttgaaaaggaggcaggagaagagatcactggcgaggccgtgcctcctgatgatgatcgccgtgtccggcacatctgcagcacaacaaaatctcgtgatcccgtatccctgatctttgcttggatggcgttacattgttcgtgagttgtgacacactatcatatcatgtgtcagcaatgttgacatgctggctaatcgcattttgttcatgttattggcattgttcagatgtcagtttcagtagcttcgtacgatagctgtttgtttgtttgatcaagcaagaaaccaaaaactgaaggcgagaaagcaaattctttctgtgctatattgcaatacctgacggatatggaagcttgataggggaccatggctgcaggccgttccggcagtacgtctccatctgctccctgatggaatccacgtcgccccacttgcgccaccgcgccgtcgcgatcgcctcctccatggtgtggaggttgaacgggtgcttggagaccgccatgtccgcacccttcccggcgacgaacgagtgcaccagcagcagcgggtcgacggtgagctgcatcttggcgtccacccagacgctgaacctcgcgttcgggaacagcctgtgcaggaggtacttcacgatcacgcaattcatggccgggttctcgtaggggagccggtggtcgccgccggcgccggcgacaagcctcgccacgcgccacgcaccgatcgtgccggcctcgccgcgctcgccggctaggatgttgtggctcgcgaggactctgtgggtggcatcgtcgatgaacatgaagaagcacaccgtccggagcgtctcggagccgagccccttgggctgccggatcttgtcgtggtcgttgaagatcgccgacgccaccaccacgccattgcacttctccatggccaatctgtctaaaaccaacaacgtcttcacaaagatgataacatcgaagtgtgtagcagtgtttcttgattattgcaccacaaaaggcttgagttgcatatacgcaaaagaacacataaaaacatctggcttgcaactcaagggattataatgagttttcagctcaatgatagtcatgctcacgtgccacaagaattttctcctctatgaaaaatgcgaattggccaaagaaatcaccagattctctgacggggaattccttgaagaacccacatggaatttcaactgcgctatcagtgtggttgaagaaggatctccgctcaacggtggacaaatttcccgcgaacgagttcctcctcccattctggtaccgcaatgctggttttgcataaggagacgccgagaggttgcggcagaatttgttgatctcttctaagaccgtcttatagtctgttccaagagtaaaatatagcacttgtgaatttcttatggcattcaaattccagaaattcaaaaaactgatcagaaaacactgaacgaaaacaagaaaaacagagctgagaaacaggatcgtccgcatttgttgcgtttgcatgcgaccatggatcatgaaaagagaagcagagacatccgttacgtccttcccggacggagagggatcgacctgagaagacggcggggtcggagcagagcgcgcgcgtggcggggatcgcgtgcttgtgctcgccgtactcgcgcgggtactcgaacagcgccgccgacgccgccgacgaaggagcggaggaacggaaggggaggaagacgaggcagcgcgaggcggcggaggccgggtcggagaaggagacgtagagcgcgagcgggagcgtggtgaggaggtagagcagggagaggcagagcagcttcgactgcatcaccggcgggctccgcacccgcacccgcatccgcacccaccccatttcgccgtctccacgtccaccgcggccgcggctgcttccccgcacgtcgcggttgtgtttttgaccgagcttgatcgatccgtctctccccagtgggcgcgcgggcgcgcggcgtcgcactcgcgtggcggtttcggactttcggttaggacaatgtgggcgattgggcttgtggctcagtggctcatctcacctcgctctggatcgagcagggtacgaagtacacagactgagtgtggctgtgtggggccacatgtcagtgtcagttgcccggcccgatcgacgacttttcggttgtaggtaaaactggttcaggttcagttgagttgacaatcatctatgaggataaagaatcgattagagggcaaaaaactctgaatattcatcactgctttatcgatcggcaacgcgtgtatcgtgtaaggtctttttcattcccgaaactacgggtggactctcgactgtatgtgatcgcgtttgtaattggaaatttaccatgtggccacactatcgacctggttgacctgctactgcctcgaatatcggttgcatacttgcatttttgaatcatggctgaagcaactaatgaactgcatttcctgcttaattaatcagatactccggtatgcacttggaagtgtcacagaaaattagtttattttctgcaagaataggaaaaagaaaaatctttcttcgaaacagagctgaaaaggtatatatattgatgttccccgttaaatcatgcgttaaaatagttgactaaacagaacttttattgttgttaatctcgatacgcacgagtcacaactcaactacatactttacagtgcaaaaaaacagttcactcgagcagtttagggctttaagatgccattattcttccgaccaggagcttgaagattacactagctgtgcgatcgagtctactactccggtgaacatttgaagatttggaattgccgcgcgctcatcgcgttacatgtcggatgcatccttcgcgtcgaagagcatccatatctcgttgaccctgccgctgaactcgaacggcgagttgtactgcgccaccgtgtacgacgacgtcgggtcggccctgcgcccgtcggacacggcggcggcccacctggtcccctgcaggctggcgtcgagcagcgcggcctgctcgccgacgtcggagtcggccacgaagccgccgaagcggcgcacagcggcgtacctggccccggcccacctctgcacgtgcagcccctccgccggcggcgggtccggctggttcttcgccggcacgtagaagctgaccacgaaggaggagacgcagaacggcccgtcgctcggcgccacctgcgtcagcaccggcgccgtcatctcgatcgtctcgttgtacgcgttcttcccctggatgtagttgaacaacctggcccatcaaagcccagggttatctcaagcccaaacatttttgtggcccatgtaaagcccaatagaaaaaagaaagcttcactggtactactagcctgtgatgaagcttttccatggcgagaagagggagtgtgatgagtactgacgacttactggaggaagccggtgcgggtggcggcgacgaaggagatgtcctcgatgggggcggtggaagcccacatggcgtcgctgtaccgccggatctcgaacccgttggcgctgtccaccacctcgtacgacgggcactcgatgcgctcgcacgacggcggcacggccgcggaggcgacagcggcggcggcgaggagtagtagcattaggccgctccggcgagccatggtggcgggtgcggggatgcgtgcggcggagttggggaggtgggattgcagtggggctcgggtgcgtgcggttggggatcgatcgatcgatcgggttggataaatacggccgcgctttgcgtttgctcggcgcaggtgcctccacgtcgccaatgttcgttcgtacgttggagacgcacggggaagagggaagcaggcgcaagaagcgtcgttttggtggtttctgagattttccttgccaaaattagtgacagtcgcgtcggcgcgtgtgctgtattcacctcgttttatattcttgtgtctgaaactctgagggttgttttggtctgatgtcaaaacttgtcctaccaaccagtagtcaatttaaatagtactttgtagatgttttgatgccaatatttactatagctaatacaatttatatagttcaactctaccaaaacattggtagtggtgctaccaatggtttggtagtgcatcaaaccaaatcagccctaaatgccgattcatatttgctcttctccattgtcaagtctgaactgagaccttcacctcatccgactttgttgttgagttggttgctcaactttgactgattgagtaatgagcagttacttcaagtaaaagatagagacaaaatttttcttgcatgagtaaatttcagaaaactattgattcaacgtaaaattattataaaattatatatttaaagttaagtatcgcaaaactatatatttaatattgaaattattataaaactacatattttagagtttaaatctctagtgatattgttccggttaaagctataaacgttataatttgatagatttactacttaatctttaatttttatgatattccatgttaatttgtagtaagaaatttcacggtaatattatatctttttaccacaccttcaatctttagtttgaacgaagtgtaatgttgtgaaatttaattttcttgaattcattgtttcttgaaggaaaaaaaatagtgcttacgaggaattaattcctcgcaaccgtgtcacccaacttgccgaaaggatcaattctacaacgaagccctgccatcctaatcgtggtttcgaccccaaaacatagtagtatcttttttccgtcaaaaaaatttgtagttattgctttcattcaaatgtactcgtcagtttcattttataagtcgtttgactttttttaatagtcaagtttaattaagtttatagaaaaatatattagtattttcaacgcaaaacaaatatattatcaatgataatatatttaatgttagatgttgctaaattgttttataaacctaatcaaacttataatatgaaacgggtaatatggaatttcatccgcaacatttactgggtaaaatagcacgtgcagtatcatacacttcaatgtggttggggcttgcttcatttactgggattcgattttccgtacaaattaagtactccttctgtcccaaaataagtgcagttttagcactattcatatccaacgacagcactgttcatatccaacgtttgaccgttcgtcttatttgaaaaaagattatgattattatttttattgttattagatgataaaacatgataatactttatgtgtgactaatttttttaatattttttataaattttttaaataaaacggatggtcaaaacgctgagcatgcatatctatgtctacacttattttgggacggagttagtaagataggagtagtagtagtagtagtacggtctatgcatggtgatggtcatggtagcatggtacacgaacaatcatcaaattaagtaagatcacaggacatcattaatcatgttccctacagtacaaatttatgccaaactcttcgcggctaaaagggtcacagtccgttcaatccgtctatttagccataaatttctcaccagcaacatgtttaaatacgacagctactcttgtctgcgaatacaactgtagatggagtaggaattataattacggccaagagaagattttcaagtctaaaatcatgaacatcgttcaggtagtcatctacttctcgtgatgctactgtaaggttcacaagattaatccccgcttgataaaacagacaaaaaaataggataggtgacacacgagtataacgctctcggtgaaaaaccggagcagagtagtagtagtaatacagcagccgtgattttatttagaagactaagtatatcaattaagagggtagttaaccttaaaccccgcaagaaacccgcgtcaccctcacttggccttgccgttgacggcggtctccttgccgttggccgctgctgcggcggcggggaccttgcccttgccatcgtcctccttggcgaaggcgtcgacggggtaggtcctcccgaggccggtgggggtcttgaaggtgatcttggaggcgtcgtccttgtcgatgaacatgtcggagagggagacccagatgaggagctccttggtcttggccccggtgacgcgcttcatccggcggtcctcgacgaaggcggtgacctcggcggcgaacgagacctgcctgctgatctgcttgaaggtgtgggtgatggccttcttctggcgcagccacacgaaccccgtggcgcggttgtagccgacctcctccatctccgccagcggcagcaggcccagcggcatgtggatctccgcgaggagctccaccgccttctccgcgcacagcgccgccccgtggtacacctccgccccctccctgtgcgcctctatcgcctgcgaccccatcgaacacgaactccaactcttggattcgacactcacaattcacaaatgcacaatgcggtggtgggatactgggaatctttgggttgcgttgtttgtggggaaaggtggggcgctggatttataggggaggagatcggattggtggactccgtgagcctccgagtaggagaggaggcggggacggttggggtgggggaattaaggcgcggggggtttatttattactactcctacgtgacatctctctcgcaactcgcgcgagtcagaggaggccttgatgcagattggggttgggggggggggggt

SEQ ID NO: 42630 - DNA, 7757 bp, Oryza sativa
ggggtgttacgcaggcgccgcgctgtgcgcgagccgttgcgtagcgcgcgagtcgcgacaccgcacgacgccacgcgatggtttgggcggtggtgtgtgcaggtgggggttgggcggggcacgggaggcgtcggacgcgcgcgatggtggattgattcattgattgggtccggcctttcgccgggtggttggacggtttgctctacttgtggatttcgtgttcacgtgtcgtgcaggcttgcggggtgtgtcgcgcgcgcggtagccgtttcgaataggaacggaaaacctccttcaacactacctggatttagactgtttctcgtgaaatcgtcacagaaattcgttactatattcttgcgtctcgaatcgaatggggactcaaagagtcggcatgcattggacacgcctgtgctgactgttgtagaaaccaaccgtaagatattttgagtttagatgacgccatagcggtcatgacccacattttaaatgcaacaattaatcatgcgaacccaaccacagcgctcgccgttttctgtcgtcaaatcgtggactgtgcgattgattaggccatatttggtcactggtacaactagttgtcaatatcttgccacgaaaaagacgagcagttgacagaaaacataaacataatctcgagttctttgcctccgaaaacaagagtttcacccggcagctgctgcagcacagctcagtccagctgctaatttaacgtacaactgtgctatggcaagcaggacacgctggatggaagcaatggaaagcgttagaatcttcagattgaagggtgatatacagctgcaccattcaatggcgtacatgtacaaggtgcaaggtgagcgtatcggagttaatgttctgacctctgaaatgtgtagctgatgttgcatgtggcatcgtcaattcgtcatgcgtctttgacgttgcaagctggttctcgggtacgtacaaccacctgatttaacgtgcaaatacggcaacaacataaaaccagtacagttcttcacactacttcctctgtcagaaaaaaatacaatctaaatatatcataattcatcgtacataatatctcattctatcgcaggttaatttatttttaacagacggaatacaaaataaaccaaagtataccttacaatcacacgcattctagcttctaagcagtatactcattgctcggctcgagtatggataagaagttgatttgaaaaagaaaggtactgataagaacaagtgctttaaaaggtgccacataagtttatacttgaggtggagaagagaatagaagccacccctcgtagaagggacaatctccacacaaaactccaataaaaataaaagaaaataaagagtcgattgaacaaacaaataaaataaaaatattaaggctagtgtgctatagttaatatagattagcttatatggataaaattaaatgtgacaattgtaccttctactatacaacttgcccaagaaagaatagtgaactagttgagctatgcaattgtacgtgtccgtatgagcatggtttaattatatgcacccataagcgagtgcatgctaatagagaccgttgatgtaatagtctcgacaacgccatagttccctatccataacatctttcaatgttgtatggtgaaactgaggatgctttgctctcattttacagctcataccttctagaagaaggatggaattagcatcagttgctgtcgatgtgtagcaagttgatgtattgtttgtctagctcggttttttctcttgctgtattcgatgaaattgtcatactcaatgctaaaaaagttgatgtactggagaatttcatttctctcctttgtattctaatcttaatttttaaataaaatataaaagtcttaagaaaaaaaaacttgtgagcctcttaaaatagttggtcctttgaagaggtttggactgcatggctttactaaagagggaactggggagggaaagaaaatgaattctaagggatcagatcagtaatgttacgcttgatcctacaaagttctaagcccaattgaaaattgagcatattgtatagttttgttacagaaaggccaccacagaaaccctcttgaaactgcgtttcaatagggaagttaatctggtttctatcaaaatcccggaaaatccctagtgaaattgacattgagaatatctttaagaacagctcagcaccctttacactaattctaaagtcgcctctcactgtctcacataagggcacccacaatggttatctataagctctctacaagagatccatgtcagcatattttcctacttggaagagattaaatgaagagagagagcaaagctatctactaacatgaagatagtctatagagaaaaacgaggcaatggattagagagctatagatacccatgtagacataccattgaagtggtttactattaatctagtctattgttgaggtgtacatgttttatagatagcaccttactttactattgcgggtgctctaaatctaagctccctgaaccttcttccatggctccaaactgtgtggttgaagattgtagcatacttgaattaatgaagttaaaggttgtcgcattaatgaagtgtaagatgcctgtaacacccaacgaccatctgctttacattcgcaactccgatccagtggctggatgctgcgcaccaacaaagtcgctgcaatccctggacccatatgcttcatgtcaccatggggatgactagagcaagttctatagaaagggtagttatccaattttgtacatgtaacataagaggttatatgtacaatatatatatatatatatatatatatatatatatatatatatatatatatatatatatatatatatatatcacatctgcactatcttttgctgaaattaaagtcaacagtgagcttttctagtacttcctccgttttatattataaggcattctagcattgtgtgtatatatatatatgtgaatgaatctagacatatatataacctgaaacgaaggtagtattaacgtatagaagccatggagccatgctcgtgccctcatgggagatgcaagctttggtgaaagagaacgtgagaatggtgacagaccaggaggcgtggagaagcagaggtatatcaatgcaggacgtggagggggtagtgacattgtggataacaagtggcaacatataagcaagataaaatcttgtaccggaaaaaaaagagtaagttcactatagatctcttaatttattgctgagtctgaaattcatcgctcaacaaaaaatacaaggtataatccatccctcaactcacaatattgtgttaattttagtctctcgacatatagtggctggttttagctgacgtggcgtgtgagacccatgtgggccccattagtcaatggctaactcctctctctcctttccttgtctctctcttccccgtctctctagggcacgcgatgaagtcatggtggcgcgtagcctgcatcgcgcggtggttgacgggaaaggaatagcacggcggctggcggaggtggcagcggaggcagctagctaaggcgatgacagaggagatggtggcacgcggtgctagcctgcggaggaggcgacatacgcgatggcggaggagattgtagtgcacggtggctggtggagtcgtcctctccttgcgaccatgatcggtaaagtcgtccttgtccttgcggccggggagtcgtcctcgtcctcacgatggcttcttgaatgccctcgactaccactacatccattcccttttcctcaaccttgagagatcctcgggatgccgtcgtctccttgtttgggactccgtgcatcggccgccgtgcgccaccatctccttcatcatcacctccgccggccgccgcatgccacatggcaccatgtccttgccgcgtgccctagagagatgtggcagagagggagagcgataagagagagagaggagtgagccgttgactccattagccaaaatcggtcatcatactgctaaaggactaaaattaacacggtattgtgagttgaaggatgggctatacctggtatttcggttgatgacgaatgttaaactcgacaacaaattaagggatctaaagtaaacttatttcctaaaaaaaagggcttttacgtaaaaatcgagtggatgacaacacaaagtcatctatacaatactacgagtattgatgctcaaattgatgctgaatgagagatcataaagctacttgtatcagtacaaattacgagttacactcaatgattaggttcgttgagttgaaacctactcatagaagagtattaagtactaaacttcacggctaattattttctcataggcctggtatagttctaaaaaattttgcccaaaaacatcacaacgaatcttgaatctttagactatatatgaagcattaaatatagataagaaaactaattacacagtttatataaaatcgcgagatgaaacttttgagcctaattagtctataattagccacatatactaatgacagattaattagacttaataaattcgtctcgtggtttacagacgatttatgaatttagttttttcattcgtgttcaaaaaccccttccgatatccggtcaaacatctgatatgacattcaaaaaaatttctttttacgatctaaacacacccatagtaaaaatgattgtagcaatttcacctatccctacgcgcctgtaatcagtacaattacgggtgcgtttagtttacgtcaaaattagaagtttggttgaaattggaatgatgtgacggaaaagttgaaagtttgtgtgtgtaggaaagttttgatgtgatgaaaaagttggaagtttgaagaaaacatttagaactaactcggcgtacatgagtatcttcgagaaaaagtaaatgtttacaaaccggagagatataaatgagtataggagaggataaattgtggccgtcagatctagcaccaagtggagatactacacggagtactctgtctccctctcgtcttcctcctcctctccttccgccggggcgcaccacgcacgacggcataccccctccccctccgatctcccgccgaaacctcccccgcgcgtcgtggagcagaccagatcccgactgcgccgcggtttgcgctagccgcagcagctcacccgtagattccccccccccccccccccccgcgcgccggccgcggcgcttgttcgccttccggcgatgccgacgccgaacggtacacctcggtggcagcgctactccgccgttctcgccgcaaggtgcaccgcattctccaccccccgcgtgattgaattttagtagttcgttccagcgtatttggccccatgtcaggctttatataaaacttcaaatggttactttgggatgaactgtatttctctcggacttacgatgtcaaattgatatagttttgatacgttcaagatgaactgttgttgtgatttcctagtgtagatgttaactaacctaaattcacccaatcctgaaaatccaaacaaattgttttgcatctgattttgattcaagtgttataactgggatttccgacccctttggagacaaaaaagtgacttctgtcaattgtgatatataatggttagcttttctagaatgcgcgctcatgtccagtactccagtctgcatgtctgtttcatcatttatttcaaaaaaaacttggagaaacactataaagtacctgtaaacgatattagtatctttcgttgcactatagctacattacaaactccacagatcatagagggctgccctctgccatgatccaacattttgaaagcggaatagagactacattgctccaaaattctacatttacattctaaagtaaaattagatgtaactacaggactgcaactcgaaacatccctaggtggcatgttcttgattatcatgccaagtcgcctcatgcctgattagtgatcactattatcttaatctggtaccttctgaaaggtatactacatacctatctgcagttctttgcatcgttgctgatttcaagcatccttattcaaatttccataaaaaacagatgatcaccatctcgaattactgtaatatcatcaatttcagcaaattctggattgacaagttttgtaagacgataattgttaaacttctgacctgcagaatcaaaattattgaataagaacacttgcactagatccaagttgtattacctaatacagacagtccctcatacttgtacctatgattaattatagcctaatgggacagctactgcttgcttttttttaatgaaatgtcaaccaaatgtaaactacaaaaatgccaagggacagttcaatctataaaatgaactaataccgtgccaactattaacaaattttggtgctagttatctgaggggttaatgcaatctcatggcccattaacccatcaactgatcaactcaacactgaatgcataaatatactgtttggtagggttaggatctggtggtttggtatacctgctgggctttactttcttgattaaatggcgttgtattcaatttaaacatttcaggtgaaggtgttatccatgaagaaacatatttcttgaactataagtaaatgttggagaccttaacctccagtctattgctctaccaagcaaatagagtagcatactgatgtaaaacagttatcatctaagaaagttctggtgtagtggtaggatagaataatagaactctgtttgattgttgcatgggatgtaaattaaaagtactcttcctgtaacctatgagaatcttaagttttccaaaacatgctgcagctggaaggatttttctcacttctcaggggagttttacctcccttgcactgagaatatgaggtcccttctgcttacatacctgagaagccagttcatggaagaaactaagccctcctatacagggccctaatcgtcctccctcatgtatttaaatcaaagaatacttacaagctatggcgaaaagtttatcaagagatcctggtagatttataacttttgcaagcggtgcctccggtcttttgttcctctgtgaatacatatgtattgtcactcttttccattctaaagccatagaatgaccattattagcttttaattcattcttctcattgtcttgattcaatgcagaacatctgttgtactctccaaagtgttgatgcatcatctgtaaagatttttccatcacctcggtagagaacctgtgatcttggttcatcttctgccgaatacgaaagaattctaatcatcattctgcataaaaaggtatattataaaacaagacaccatgatgataccaagacatgaactaacctgggaaagattgttcagaataactcgtctgtcatcgctgttttccttgataatgttctttagcactgctgtgttcagccttaatagttgtgaaactttgattgtatggaaagcacatggctgggggatgctgcagataactcctatttctccaaatatttcaccattgcacagtacttcctggacctggattttgtaattatacatgtcaaattctgcattacccttttaaccattgttctttagaacatatgaacttttgttaagtcaccttttctgttccatcgatctctacccgctcttcctgccaaacaaaataacaacagttacactagtatccatagttgtatgaactgcaaagggtgcag

SEQ ID NO: 42631 - DNA, 6575 bp, Oryza sativa
tgccaaatcagctaattcactatataaaatatgacagtacagctactagggaaaaaaagagagagagaaatatactaccaattataaagaataaaggaaaacactttaatttggttgtccctgatagaaacaaattctaaccatctgttacttgtggaaacaaattctaaccattcattaagagaactaccatcaagaacaaaaacagcgatatgctattgattaaataataaaggatatcttcagtctaccgttgtgcatgcatgcaaagtaaaagcagatcagtacattggctgcacaacagctatgccttggcacctgctgccgttgagggccacagatgctggcagtagcagcagccacagcagcaacaagccaacaacagcaaaggcagccgagcagaccctatgcctctgtcaaggagttgtggaccgtatattcgataattgatcaatccaagaacaataatgcaaaatatataagtgcgtgcatggttcctcaacatctgatacgttaggtttgggatttaggacatcaatactcaagaataggaagctgatggaacaaaacttcgagtgacaagtatagacaaaatgtcaaatttaactcaatcagaacagcatatactagctgtgaaattgaaatcttgtggggaatcaagcataatagaaatcccgcttatttattaaactgccaatggctctgtaacatatatcgttaccaggcgagtacaggctttggagttgtgttgtggttcttatgtttcaagactacagctggcatgtagcagctatagaagaaatgcaggccaacaaggatatctacaagcaattgagttgtttcctgcattcaccatccaccaactaagaaaccatgctctgtccaaccattcgagttgattttgtattttaagttagatatttggatcaattgcaaataaggaacacatcaaacataaaaaatggagcaatggaaaggataattatgacgatagacaggatagttatgatatgcaagctttcatcctgaattgaatataaataataggattaaccagaaaatagtatcgcccacttagcaagaattcaaacttatgaaataggataagtgaaatttgaccaatggttgagcttcaaagctcacctcaccacaaagttcttcaaagaaattctttacatctaattgagtaacctgcagggaaaggtgaaagatgtcatatgtttgaattctatagcttccgaagcttgaaaaaatataaataaccagaggatgaaacgaaaacaagtcaaaactatagcacactatgaagtaaaaaggagacatgtaccttcttatctatgtttgtacaataaacagttcttatgaccatttccttctcatcctccgtctatgggccagacacaacacagtatgagtactaaggttatgtggagaagaggaataattctggcatcaaaaggtgaaacaacgcatacaatacaagaacttaccctaggaaggaactttggattcacaggcaatatagctgtctttgaaggtaagactctaacagggtagaaaccaagcattgtgccaccaaggttaagtgcagttcttgcgccctctttagaacaaataaaacttacatacatcaaaaaatagattcactatgggagaaggcacttcagtagaaggtgaaactatattaccttcatcagcaaactcaatgaatgcaaaccttagaactgagtgtggatcaccacagattctgcagtcaacgaccttcaggagagagagggtattagtatggttttggaaattttcattccataatttcagtaataaaaacaataaccccagaaattgcagtacttgatattgtacacaatataagcaaaaaaaaaaccgaataaccaaaatagtttcatttcctttcttaataacaagaaaaaaattactaatagaagagatgttgggtttttattctaacatacaaatgcactcaccctttgtcactcatgtacttacagtttagagcataaaaaaccatcatgaaaaatttcgaaagaagttctagatgtacttctcaaggtcctgtacatatgtataaaacttcaaatatattctatagtcagcagggaaaaaagaaaaagggccaatactaccacccatagcaaacttgtttttcaaaaatgtttcttttagtccattttaaatgtaaaaatctttcaagggaggtagactgcatcatcaaatcctttctctggaattatttattacgatttggaaccctaaccgaaagttgagtgcacgagcgcaacaaaagggtgagtgcacatgttacctttatttccatcaactcgacggtcattaagtacagacttgctaataagtggaacaatatgatcaactagtagaaattctctagttcaatgcgagcattggaatagtgaaaaatcttatttgcagtatttcatacataataccagtacaacttgatacttcaggttgaaggaacttacttgcccacagttagcaaatatatcagcaagtctctcctccgtcacctaacagatgctcagctcatcagacataacagctcctctagaatacgtatgcatgcttagaaaaatcctcaactactcacagtatggtcaatatcagaaacataaacagttcgccgaatgctgtcttccctgtctgcatgccttgctctctcgttcatcctcctccttccttgactgaggtatccattcctcctctgacaaaaaaaaaaacaaccattacatcctattctgatcttatattaattttctttttccatggacttgccaactccaaacttaattcttacaagcagctgatcatcatctgttaaatcctagtcagcaaaataaacaaagaaaccaagtgggagaataatagaaaccctgaaaggggagtctaatctcaaactttccccatatttggggaaaatagtctcaatctttgtcgtctaatatctgaaccactaagaaaagttatgctaaaaaataaaaagaattctcagcatgggttgcctcattacaagacgatttgagcgcggatcaaagaactagcagtttcaaagaaaaaatagcgtttggtaatttggattgtctacctactataaataaataaaaaaagcaggaattctcagcatggattaccttaatgcaagacgatttgatttgagagtggatcaaagaactattccatgtccatggcagttttgaagaaacattacggtactgtacaactattcgaaatgaaatataatagaattgtgcatagtgcattgactggttttgcagtgtcataaaaaaaattaatcatcaaaaataaaataggtaaacctttcacgaaagaataccaactaccgcaccacgaaccaccaaccgataatgcaatccaacacaaggggaaaaaagaatccaatctttacctaccaaactaatggaaagaaataatcaaataaacaaccaaatcccccacacaggcacaatcacaaccaaccaattcagtttctcaagaacagcagagtttttaactcagatttttttttcttttacccgacgctgctggtaggcgtcggcgccggattccttgccgcccccgttccagcctccgatcgagttgtagtcgaacaccggcgcgtccgccgacagcgccttcctggacggcgacgagaccgccgccgacgaggggacgaactccttggcagccgggttcagcttggacagcaggtccaccagcttctgcacgcccttctggtattccgcctccttcgccaccgccgccacggcagcggaatccgccggtggagccgcgcgcgatccccccgccaccgccgccatcccccagagccgggctcctcagaccagacggcacggccgaccaatcttggtcaaatcaaatcaatcgccgccttccctcgcgctgggctctacgcctctactcctacagaagcgaggccatccggtggctctggggcgggcggaggaggaggaggtggaggttgggggaggctaccgcgtggtggtgttgcgcgctcgagctctcgccaatggcgtcgattagtggcgagtgggttttgctttttacaaggttttggccatttttttttaattcatcgcaacagctgcgaattggaagaaatggtattttggaaaggaaaggacagtgaggaaggagagggtatagagtctgcgtggacgcggtctatgcaccggcaggtgtgaagcacgtgcgctactgtgcacgtatactgtaccagcatggtccatgtccatcggtccatagccatgaggccgtattaaatgatggagtaattagtgtggttgatttgatggattaaagcctaccaaaatttccatgtggaaaattaaactattttctatgcatttttttttgttttcaaggaggctaaggttgaatagtaaatacacattcatccctttgtagtacttttttttctaagcctatttagaaaaaaaaagtaaagagtaattagggagccacagagtagttatttttctaattccaaggtgttgatatcactacatgtcaaactatatcagccctttaaagcagcaaaggcaaaatgtgggaaaactgcaatagcaatatatttgtcgttttctaatggaagacattgtgaaacagattttcctaataagaaaagtatgtaaaggaattagtaatatgcctcgccaagaaaggaagtgtactaatatgcctcgcaaagaaaaaggatttactatctaattaagatattacttatatgtaaagtacacgattttggtttctacacaatagtggaatccctgtaaaaacgtaatgtagggcaatgctcaatactaattattttcttccatttcgaacactaaaataatactagtagtactatctcggtggaataagaactcagactctgactctgttttggaaggaaggtcgttcgcgttaaacaagatgaagcacgaagaaggctgaactccatatcaagagtattcatcaaatcgccaagattctccattaagtttgtccatgctaatccaggtgtacgttacaactaattgcattaatgctcgtaccttccgtagaccataatcataggttattatcccctagccattgattaaattgcggggtattactcatttagtttagctattattactctctctattttcaaaatataaggcgcaatcttcactaatataaaggccaagaaataattattatcaattgtttgtttggattacttcaataaaacaatccattgcatactccacccctcaagatcttggaggtgttagttaacttgagggtggagaaatccaatgggggttaatatccaatgaaattaaacatctctaattttaaaaaaaagggttaatttcactagatcaccctaaagatctctaatttaacaaaaataaaagaatgatggtgttagttaattacatgcatgcatgcatgtgcatgtttatattatgaaacgttgaaaaagtggttgcgcatcttattttgagttggagggagtatttggattagcaggaataacttactgcttatcataattatgtagatgtactttcaaaatgtgtttactccttagaatttgagtcatccatcatcttctccccactccaatgccgcacgaagcgtagccacctccttcctaaaaaaataaataaataaatagttagttaacggaaaaccggttagatctaatgttttatgctcaattcacactcttagcctatccttagtttgtatggacaggtgtagctcatcccacatcgtatgggcccattgcgatatacaaaaatattagctaaagactgtctgtagctttcatctcttttgagtttgtgttgtaggtaagatatccttttttatgtttctcataatcaatatcttttctagacattagctcattacagaaaaatttactcaagtttttcaaaaagaaatgatgcatactactttaagctcagttcgtttgtctatgttctcaacctctccctctcgatttccgtgcgcgcgcttttcaaactattattttggtacgttttttttaaaaaaaagtttctatacaaaagttgtttaaaaaaattatattgttccatttttgaaaaaaattagctaatacttaattaatcacgcgctaatggatcgctctgtcttctgcgctggaggcaaacgttccgaacctgctctctccaacagagcctaactacagtttagatatatgttaatggtactaaataccgatgtaaaaaaacaaccaaatatattttatggataaatattttatatctatgttattaacggtgtgcaagtcaagaaaatagaccatgatgaaaaaaaattgtatgtttgtacagtaatgtaatttattgtatatttgtatactatatgtgatactaccaggggaaaaagaagcgcctgctggaatcaacaccgtcgaaatcgatgggtttcttacgtatcatttcttggatggaatcggaccacttctcgggcatcatttcccttgacaatcgcttttgttattgatgggctaatca

SEQ ID NO: 42632 - DNA, 2782 bp, Oryza sativa
  unsure (1)..(2782): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctccaaatacggggcagttgaggaggagcggcaccgaggcctcgcgccctcgccgatgattgggaccctgtcagatctgcggccaccggtcgccggctcgccgccgccatctctctctgatctccaattgagcaaggcaagttcaaggcttcgagaggctgtgggcccgcggccgaggatgaggacgtgaggtgatacctgggccttcatagatagtacagcccatatgatgtggcctgcacctgtaattccatgactagacaatcctgggcaaaatcttttaaaaagggaataagtccacattgactcccttaaaagtgacccgaatctaatacatgaccctcaaccgcaaaactgaataggacgactcaccgaactattgaaaccaatgcaatttaactccctatgaagggtcgttttgaccaatatatacacacttgacacccgcccagagaccactccttcacaagaacattggattttcacaagggtgttgtaccaagatcttgggacgtcaatttatattcctatttagttgatttccatcgttgcattgccctggtataaatgatgcatattatatcctagttgattgtagtgtatcatatataaatacacaacgcacccagcataacataattattggtgattagtactccctccattccaaaatataaggcacaaccaccttagacccaaagaccaagaaataattattatcacctctttgtttgaataatcccaactaatactatacatgcacccaatagaattaagcatcttgatttaaaaattaataatctaggtgagagaatttgctattaattgtcatgcatacatgcacgctttatattatgaaacacctttaaaaagtagttgcgccctatattttgaaacggagggagtaaatgcattgtatatttataagtaataattttacatattatttattaatggcatttaacttccttaaattggccttattgttttgatgtttcctttatactattttccattgtcttcccaccttcctgtttaccaataaataattcttgtatgttgatttactaaaaaagctataggaagttgtgaattttaaattatgaatcatatatgctatatgctcaaaatgattatctaaagagaccgcacttatttactatgaatattcacatttgacaactcacatactttttaaagaaatccatccaaatgattaagtagcttaacaaaatagaggattagaaggggaacgattttcactattacgtgagaagagaacggaagaggagagaagagtttggatctgagagaattgaggaaaaatgaacctatcttgctttgcccatctgaaaattcaggacttgaggacaactacggtgggcaccagcactggtgcggcgacacgatggaggaaggcgcgagctgctggtggagttggcggtggattagagcagcagtggtggtagatgacaacgatggcattggtggcgacggcggatttgggcaagcgatagcaccggtggtggaagtggatgacgatggctgatggatttgggcgagaaatagatagcgatggtgctgatggtgaatctaaccgagcgatggagatatcgttagctggggattaattgacgtgcatgtttaggagtagtgaccttctccttttttactgccctatgtttggatgggatactaaatggtcacctttcttgagtatacaaaagttacctcttcatcttctctaaggtaacctctttacttttttagagaattcaggggccagctaatatacttgattttcttccctcgtagagcattcacgggatatagtacactgtatctccttggacacgtggcagtttttggagagggctttgcctaatttctaggacgccacgcgacccaacaggatgcaagatcttagtccctgaattaggtctttaagatttccttgttagaaaagagcctgacaatggtcaattgcaaaacaaagataacaatgcattgaccaggccaaagaccagaaatagacactgctcttctgtacgtcaaatgataaccacagaacacgatagaccacaacaacggtcaaaccatccacgcccgtacgtgcgtagccaaactgcatgcacggccattctcgagtcgaccaccctataaattgagcgtccctgcggttccactccaaccttgcgggccaagatggcgcagaagtttctcctcgggggcgtgggcgcgatcctcgtcgtcgcggtcgtcgtcggcgtggtcgccaccgtcacccgctccggcaacaaggccggggacaacttcaccgtcccgggggaggccaacctcgccacctccggcaagtccgtcgagtccctgtgcgcgcccacgctgtacaaggagtcgtgcgagaagacgctcaccacggccaccagtggcaccgagaaccccaaggaggtgttctctaccgtcgccaagtcggcgctcgagtcgatcaagtcggcggtggagaagtcgaaggcgatcggcgaagccaagaccagcgacagcatgacggaaagcgcgc

SEQ ID NO: 42633 - DNA, 2746 bp, Oryza sativa
tcaagaagctcgacctcgacatgttcaagggtgagaatcccattcaccggagcctcatcgcggagcaggaaacggtgggcggcttcccgtcgtggatgaaggcgcccgacaggaagctgctcgcctccggcgaccgcaaccggccgcagcccaacgcggtggtggcccaggacggcagcggccagttcaagaccatccaggaggccgtgaacagcatgcccaaggccaccagggccggtacgtcatctacgtgaaggccggcctgtacgacgagatcgtcatggtccccaaggacaaggtgaacatcttcatgtacggcgacgggcccaagcgcagccgcgtcaccggccgcaagagcttcgccgacggcatcaccaccatgaagaccgccaccttctccgtcgaggcggccgggttcatctgcaagaacatggggttccacaacaccgccggcgcggagcggcaccaggcggtggcgctgcgcatcaacggcgacctcggggccttctacaactgccggttcgacgcgttccaggacaccctgtacgtgcacgcccggcgccagttcttccgcaactgcgtcatctccggcaccatcgacttcatcttcggcaactccgccgccgtcttccagaactgcctcatcatcacccgccgccccatggacaaccagcagaactcggtgacggcgcacggccgcaccgaccccaacatgaagtccggcctcgtcatccagaactgccgcctcgtgcccgaccagaagctcttcccggacaggttcaagatcccctcctacctcggccgcccatggaaggagtactcccgcctcgtcatcatggagagcaccatcgccgacttcatcaagccggagggctacatgccatggaacggcgaattcgcgctcaacacgctctactacgccgagttcaacaaccgcggccccggcgccggcaccagcaagcgcgtcaactggaaggggttccgcgtcatcggccagaaggaggccgagcagttcaccgccgggccgttcgtcgacggcgggacctggctcaagttcaccggcacgccgcacttcctcggcttcaaggtctaaagaccctagccccctacatggcgtgaagggtgggatcgatgcatggacgtgtgcatgggagatttgcacgagaggatccgaggtgacattcatgcatgcgtacgttcgtgtgtgtaccaaatatgtgtgatggctgagacgtgcaggacacctgatcagggtgggcgtgctgcatgcgctggggggcagggctaacatttgtgcttttaactctttccggtttcttttttctcgaacagattttcttggagaatttcttctgtataagtatatgttgcaaaacgattgttgtacaatggcttggttggaaaagcgctgttcaaatgtcccgtttgttgctggcaatcttcacccatccgttcatcagaaacagtcaaaactcaaaacaagcttccaaagcaggctagctagcagttagcatttacacctcacccaagtggctaagtatcatgtgctctggcattcaactatcctctaatgcgtgacgacgccctggatgcaagaaaattacaaacggctatgaacaccagtagaaatttcggccaactcacacgacaagtgtcacacttcccaggatgcatcatctccttgcaccgtcttgcatcctcctacaaaaggaggggcctccacctcagtgtccctcaccgtgtgctcagtgttcatcttctccaaaacttcaatcaggttgtccctctgatctcctgaagaagaatggattcaatccagaggcaggactcctttgatgacttgattaacctcgccgacgatgtggttgtggaggcgcctactctctccagcgaggagatggaccgtgcaagggtatatctatgctctgttttagtatgtactacctgtaatttgtagtttttgtgccgtgcttctaggttcagatttagcatctacatatggtttgtgtttgttccaccatgtcgatttcgcgccttttttcaaacaagttttcgcgccttttctttgtttgaaccctttttttttaaaaaaaaaatgaggcacaatcattttgcgtttttgtgctcgttcagtttctagtgcgatagcacatagcgtatattttttttctactcaagttagattagttgaagtaatgttctttcactttggaacggatgatttttccatactgacgctggaattgaactgttcatatgagaatcctataatattattgtgtgattcctatgctcgaaagggaaactaatatgtataatagtagtgttcttaaccattatatagttccaatcaataggtacttcaattttacacaacatatatggcaacatagcaaatctgaataaaggatacagtaagcagatgccacaaacaactcaaagttacatgggccccaaattttatcacaatctaaatatggtgtgggatttccaagttggtactttgtgatcaataatagagggattttgccatccttgaagagataccaaaagatactccacttaagattgaaaataagctggaccaaattaactgaaaagaagtgaatcatatacgaggatactttccacattgagctttaggccttgttctcctagtagttttttctttaccgcgttttcagcagcagtattgattgcttggtatcttctgaagtgcacttaccacagtttgacccccccatcc

SEQ ID NO: 42634 - DNA, 9911 bp, Oryza sativa
ccgagatcgactcgcggccggtcgggtcgagaagcctacctgctcctgcggtgcgtgcgccgtccagctcctctacccgctctgtgcctgagaataatcgtgtctagtgtgctgaacaccagccgtttcctttagagaagttaaaccatgtttgcttgttttggccgcccgtattccggtctcgtgttcgtcgtgcctctcatctgcctcctgcgtatgtgcggtcacggagataggtgtacgttgcgacattgcttcgtgcgttgtgcggagagttcacgcgcggtgcggcgcggcggacggaccacgtacgcgtgcaacgcctgcgcctaggcgtccggacgtgagcggcgcagcggcggtagcggaggaaggcctcggcgcccgcttggctcgtcgcgtgacgcgcgtttttcttttctttcttcggcttcggttttccgttcgccggttgccgatcaaccgcgcgctgccaaattcgtgacgaggctgggtctgttgccgccttgtccctgtctgagtgacggcctcttcatcgacaattttggccgatcgaccgaagtctgggaggttgagaaggtaagagcagtcatcacaattgttctcacgtttttaagtccacataaacttttgtacggaatttctccacttcatttaccgatctcctagaattttctcggaattctagcgtcgttttgatcgtgaaacggatgggatcaaggaatagtgcggcatacccccggaacggtactgccgctagcgtgccgcatcccctcatccgtcgtgatttgggaagaattcggggttacatgggccggttaatggcccaataacgtacagacattgggagaggagccgcgcgagaaggctattgcgcggtcagtcgcgcgcccccctttccccacgcgcggactggacacgtgtcgcgcgcggagagagggcggcggacgcgccaggcggcagagcgagttttccgttttttttcgtgtttttcgtttctgttcggtttgctttttttttttttagtttttacggtactgttcagtttggttttccttttttttcgttttctcttctgttttctttcggttttttttaaagatgtatgaatacaaagtttgtatttgtatgtatatcaagctagtttatattcgtatgtatgtaaagtttgtatacgcgtatacaaagattatatacgcgtatgcaaactttgtatacgtgttgtaatttcttttttatatattttttaatacatatatatatataaagtttgtatacatcgtatacaaagtttatatatatcctacataaactttgtatatattgtatataaactttgtatatgtgtaatattttttatgcattaaaaatatattccaaaatatatacatacacgtatatacatatgtatatacatgtgtatatgtaatatatacataagtatagtattagtaggtacatataagagactagaggggggacgactgaaccgcgcgccccgcgcggtcaaagttatagttgggcttgggccggtggtatcaacgagtcgatcccctcacctcgatcgtgtcgcccgccgcttgatcgatcgcgcggtgcaagagcgttttttatgctcctctgtgacgacgacgggcgcagcgcggtagcgtcatgcacgcctacgcagctagtacgcttttgtcctggccctccctgcgcgcgtgcgtggtcatggagttagatagatgtagtatatcacagtatatgtcacttttttttttccatgtcactatggcgcagcccgcaatgtggaggtgtccatactccatcgtccttgcttggccgtttgccggtgccaccaccgcgcgcagccaaactttctgatgtgaggtattggttgccgcgttgtcctctgtctctacacggacacaatgtacaagcagagtcgagtcgactgtgcgattacacagacaaacggactgcgtgttcgatctagccatcgtactaacaaaaagttataacttgtgtttttttgttccaaaaaaaaagttacattttcgtcatgatttctatcataattttttttcgtagtgcttagaatagtttcccgatgtgggatactgcagcacaccctgaaacggtaatgccgttgatgtgctgaggcttttgttcgcaaaagatttctcgtttttatttttcacatataccaggcctaaaatttaggttaattggatccataccattataaatgtgataaatcagaaaaatgtcactacctttcatgaaatcgggtagatgccattgtaattttttaaaattacaaccatgccacaacttcacgatttccgtcctccctgtcacatttttcgtcgtctccatcttcatcttcttgtcgtcttcgtctcgacagacaaaccagcgccggaggaggagggcacggcggcggatggggaaggggtggggcaggacaggaggagagctcctcggcgaggatggcggagagcgagacgtgcattccaccgctcatcggtgcgggggtgttcttgtcgtcttcgtctcaacggacaaactggcggcgagcgacgagaggacagggagaaggcgaggcggcgctggcgagcggtgaaaggatggggagaaggtgaggcggccatggcatcttcttccgccatcgtcgatgagctcttccaccagatctgcgcccctccacgaccatgctcgccggcgacggccacacctgctcccgtgcccctccacaacctccctgcgaccatcctcgccgacagccgcctcgtcctctcgccgctcgccaacgcctcctcgtcctcgccgctcgccctctccccgtcctctcgtctcctcgcgcttgtcggcgccgcctcgccttctccccgtgccaacatgagagaggaggacgaaaatagtgatgggagtggcatggttctaattttaaaagttttcattgacacccagctaataacgcgaatagtagttttatttttctgatttgtcacatttgcaatggcatgtatccaattaatcctaaaaattatgcacgtaattcattcactctctacgaataccacgaatggatttctgataatgtgacgtgtacatatctgctcatgaacatgatagcttgccgcaaacataattgttcatggagcgcatgcttgagaacgaccccattcttcaattatttcaacaacacgccaataattattcgcacaatcttgaaaaatggtatactacaaccacacgatcatcctgactgatcagctagagagctagaaggagaacttgaaggccatgtcgtgcctgtacacctggccgggcctgaccgtcatggaggggaactccgggtggttcacggcgtccacgtacccctgcgtctccaggcagaacccgccgtactgctggtacaccttgccgcccttgcccttgatgttgttcagccagttgccggtgtacagctgcatggccggctggttcgcccacagctccagcgcgcggcccgacgcgccgtcccgcgccgcggccaccttccgcatgccctcgccgtcgatcacgtagttgatgtcgtacccggcgatgcgcccgcccatcacctgccggatgcgcgcgccgatcggggtggggtgccggaagtcgtagggcgtgccggcgacgggcgcgacgacgcccgacgacgggaggagctcctcgtccagcggggtgtaccgcgacgccgacagctgcagcgtgtgccccagcacgtcgccgcggccctgcccgccgaggttccagtacgtgtgctgcaggaagttcaccggcgtcgccttgttcagcgccgtcgcgttcatgcgcagcgccagcacgtacgggctcgacagctggtacgtcacgtacgcgtccaggtccccggggaaacctgatcgatagccattcacaaattaatttacgactccaaatttcataaaagagaaactcgatctttcatctggaatttcgttgcacaccttgctctccgtcgaagctgcggtagtacaaggtgatgtacggcgagtcgccgccgccgacgtactccttcaccgtccatatgactttgctgaaccctctgtgtccacctgaatgtgagttcagtgaatttaataatctgttggccaggctgatctgaggtctgaaggcatgcgtccatgcaccaatgcataccgtgaatcgcgttcctgccgtcgttgatgtacgtgtgatacaccttcccgtcgagaacgaaccgccccctggctatcctctgcccgacccgtccggtaaccggcccgaagtaattagtgtcgttctggttggcatgagcaagaagatcattacagataaaaacaacttgaattattttgccatattttcgacagtgataacgcaaatgttaatgtctattgattcagaccgttcttcggtatggtaaacaaaagctgcttgtgtgtttgaatgatattccagatgatgagaagaaaatggataagggtagaacggaacagtgatttggagatgcggaccatcgttttctggcaagctcaaggtttttagataagcattctgaaatttttgctggctggctgaacctctgaagattagctatttattttttgcttagactcgattctattgaagggatgatactctgaccacgtcatagttggactaagtgacagtgtgaaacatatggaaaatgacaataataaaagggatttacatcagctttgcatgttgacagatgacaagggaagagtactgccaaggcgatccccccggtcaaacgattgttttcagaggaaattacgtcatatggtatttgttgttttgcctgtgctgatgagcattgtttatcttctagtagtaacttggtcacttgcagacaaagaatcataatttattgcatactgtttgatacggagtatgtttgtcagggtttgttccaatcgtatttcatttgtgatttaaaattttctaaagagtaaatttcacaaaactacatatactatgatcaaactatcacaaaactatatatttaactcggtgtatcacaaaactacacattcaacaccaaatttatcacaaaacaacatatttaaaatgaactattataaaactacatgttaagtaactaaattattataaaactacagttttagaactaatttagtcacagaacaataatatttatagctccagcataataatggtgctagggatttaaactctaaaagctgtagtttcgtgacaacttcaatattaaatatgtagttttgtgatacttaaccttaaatctatagttttgtgataaatatggtgctaaatctgtagttttgtggtataacgccttaaatctatagttttacgatagtttaatcaaaatatttgtagttttgtgaaaattactcttttcaaaattccaccatctttttgtcagttatacatcctttttacacctttctcatcactgtatctggaataagttccaaatgagtgcagggcaagcaatttcttgatcagacaagtacttttatcttgtgtatagtgtacaggggaaaaaaaaggaaatttaaagaatataagattcattcatccattcattaatagctgaggccttaactgtcgagaacaagtttgggtttcaatggactatgagaagaaggcaaaagaagaagctgaatgatattgccatttcctgcccaaaacattaaattttggaaggggtttggtgttcttaccacgtactcagcaatggtgtctaggccaagcacaacatcagccaaattccctgcagaaacacaagcactgcaaattcagaccaacacacgcaagtacacaaacgccataaagaaaaaaagctcaacagaggggacatgacggtacctttggaatcagggaggacgaccgacatcatggttgctccccagttggtgatcttcacggagaagtcccccttcctgagcacgtactcgccgaccgtcttcctcgcaccggcgccgccggcgagcgcggaggccaccaccaccaccacaaagcacaggaacgcgagagacaaccgagctccagccattgtgagcaaagcgattcgtcttgggcaactcacaggacgagaggagagggatgcatgcaactcattctcgatggtctcctgatatagatgtagatataggcggataccggccgcgatctcggacgagtttgttcgaggcgggaccggaccagcctggttacggacagacacctgcgctgcgcgcgtgctagcgtgtgatctttttgattgatctgatcctttcatccgtttgtgtcctcaagtcgcagcgaaacggagccaggtacacggtccgcttgcattggtcgcaggttgtgcatgctcgatcggccggaatccggtggtccgcccgcgagcgagtgggatgacaatttgtcattggggaagttggcaagtgtgctagtacgtgcgtggccactcttgaaactgtgcacagctcttcaaaaagaaaggaaaaaaagaaactgaaacgggccaatgataagattttgaacttgtcagttgtcacccacgtgcgccgtaggatgcctgccgccgccgcatcatgcaaaactatctcccacaagtcagaactcagaaccatcctttggacgtgttcttaataaacggtttgaaggacttgctacaagcagctgaaattttggaaaatgtcaattgatttttggacggataggatggctttaagattcgtgccaaatctctccaaatctacctttctctcttctttctcgtgccgccgccaccacattcctcttcccctttctcattgtctctcattctcttgttccctatggcatgtccacatgtgtattgatttaccttatgtttttgtgatatgtttccactttgtacacatgttgtgttgatcgttgtgttaggcttcatgttattttcattttttcctgctatgaggtgcttgtgagagcgactcacaacgacctggaagttccgagtggctgtcttggcttggttgagaaagctgctaggaagtttcgccctattaaatttaaccgttgcgatcggagaattttaagaaacacctattcgaccactcccgccaagtgacatctatgggctttcaacgctcgcctcaatagatctaacgcccgtcaacatactgtccatgcagttttggtgacacctcgtcgcccgcctttgtgttccgtccacaatcaggttcccctccaccccggccatccctctaaaaccgcccttacccccccccacccccacccccgcattgcctcgaactttgaaaacctagtacgtcggttctctgctggagttcaaaggtcaccaccatcgaggctcgccatcactgttgctggtaaatccatcttttacctcccattcctcttctcccacctcccccggtctaaaaggtggaagacgataggcatgccattgcatcttaatccacaaaaaatcaacgattgtctgaaatttggggaaattttagtgcatagatgaatagcaaatgtgcagtttgaatagttaataattgaagccttccaggatgctagtaaattatagctcaataacgttcttttttctaaacaacatggtaaaataaaaccatgcaaaaggtcgaaagaaaggaaaataagtgcataatcaacctcattattgattcatccgaacacaggacgtaagtccacgacttctataaatagaaatactacaaaacggtatattgttccaaacaaaatagctgacgttattatgatgttagcatggtatagtacttatgaaatatcatgcctggttgttgacagaaaacacgtggcctgggagatctgcttaactccagtgcaggtcaaagctcgccttcgggtgtgttagcatgccagttgatttgatcatgtaatcaacaagaaataaaagcaaagaaatcgcggttaaatctataaatgatagccgatcggccagatgccgatgacatatcatttatctttgagccgatgtcatctgtgtatcgatcggcagtcgtgaataagtaagaaagaactaaatctactcgatcggctgtagatattaacgatatatactccttatatcgatatatatttaaatcaagtgattgggatagatcggtcgccatgccgagacagtataaatcacttagattgaaacatatatcaataacaagactatatatctttatagcatagccgatcaaatagatctagcatgtatcggctaatactccgatacttccctatatcaggatattaaagcaggtataatatatcgaacagaggcctaacatgcttagatatagcaatatcttgatataaagggcagatttaacatattaatgaagcatatagaacaaatatagttaaattagatacgatcggctgaaactccgatactattctaatcggcaactagaaggtaggctagagatcgatattctaagcacgacttaatatatcaaactcaactgatacatcattaagtatgaaaagaagaacgacatctagacaatcaagccgctagaagtttcatagaatggtggatatcttatataatctagatcaacgtcaaaatctaacctaatcagttgccctctgctaacagatgttagccgataataggttagatggtgatattgctagagattatgtaagatatatgataactcgacgaattacataaataagattagagtatcataaagatggaagcactaatcctaagaacacaatccgtcataacaagttttacctcttgttgaagatcgaaaccgatgcagctcaacccgaaagcaagaactcgtcgaaacaaaactaaagcaaaagggtggcgatgcgccgaaattgtattgaacgtgtgtgttgtaaattacatagggctcggggtctatttatacccgagaattacaagacatgcccataccggacacgactgttatctctaacaaactctaagataccataagtctttgcggcaaacttttgccctaaacatatctctaaggaaattacataaaacatcctaattaatagatacaattgccttctcaggactctatccatgcgtggcaaccatcttgaagcacatcttctcaacccgatgttgtacaccaagtcgtattgttggaatcggctgtatcggcttatctagcccgactcagacccagccgatactaatcatagccgatccagactccagccgattcttgctctgtttccgaactcgatctccgcctctgactttgctttgatccaatcttctttcctgacacagatgttaccaaatttggttgttaacactggtatctacggttccaaatctggttcctacgtgagatcgagcatttgtttggatggttagcgacgccggtgggcacattgcccacgagcgttcgaaccccaagttcgacgctcgtgctcacccgggttttttccccctcttttcccgggactgactttggttggtcccggttaggtataatggtacacacgcgcgtgcgcattcagtggttgcatatttcccgtgcactgaggcctagtgccttcaatctcaatcctagtatgtgttagggacgcgcacacgtgtgtatgcgtgtgttgtggtgtgtgttcgtgtgtgtcctgatttgtaccctcccaaaaaaaaatctggtacctacgttaccatgctaaaacatcgatgtcattatgatatgtaagtatcaaagtctgatatctataagtattgtgtctggtataacggttcatatctgataccaataataccatatctgttatctacgataccatactaacattgtgttgaagtcagcacacataacctattacgttggaatggtaagtagctagccctcttccgtaaaactttgggtatgagagaagtggctctcgtatgg

SEQ ID NO: 42635 - DNA, 6456 bp, Oryza sativa
ttgcccgccgccgtcgcgttcatgtgcacgctcagcacgtacgggccggacagctggtacgtcacgtacacgtctagggcgcctgggaatcctgttcgacagaggcataattttgaccgttaggccctgtttggcacagctccagctcctaactccaccttacctagagctggagttatgccaaacggttcggattcatccaaaagaggaacggagcagtgcagatcgctccaaaaaattacactagcgtggtggagcggggaaaacacaactccacagctccactcccagcctgattacagcgctacccattacttttcgcaaaaattataagcagaatgccaccgcccctaccccttcgttccccaccgcaccgagccagactagcgcacatcgcgtttctcctcgaggccgcgaagagagaagggggagggaggactgaggcagcggcggcggtagcagtgaaggcacacggcgcatggtggcggtggtggcggctgcctcctctcgcacagcaagggcgccgggcggaggtctgggcggcgctgggcggaggtcagggcagcgcacggcggttggatttggcgctgagacctcatggcggcggcacttggcggcgggagcggctccccacagcgaggaggcgcacggcaggagctgggcgacgccggtggcatagcagatctggtgcaaggagcaaggtaaccctaaaccctggactagctccctcaaaccctagactctctctcccccaaatttctcccgatctgtgtgtattgcttgattttagtttgtatactttaaccatattctcactatacttagatttctagaaagaattggtcagaaaaatttatatgtatgtggcaaaatatgtatttggtagcattacagttgtttgtcatttgtagataacattgcaactatatttattttttttcgggggtaggaaatgactgtataagaattcaatggtatgattcatatagtgtatgaatgagagttttattttttgggtttctaaaccaggcagtaagtatttcaaaattatgtgttaaattggaaaacaaatgtgccaaaatagttgttctaaatcattttacaatgacattgtgcaggacataccaggctgcaccaaatttattaagactggcttgcaaaatgaagagctacttgagaagatgtttgaagatatccgcaataccggtgctaaccattggtctttggggcaaggcaccataccaacagccatggatgcatttcgtgattacctagccggtcgtattgcaggttgatggacatatatcgtattttgtgttgttttgcggtcttatgctctatctttcgatgataatggtactagttattattactaaatatatgtcatgcaacaactttaatttttactttattttggagtaccaatcatataatgattgattgaatgtgttcccccctccctggcaatgaatggcagtgggtagctagctcgtttcttgttgtcttttaaaaacaaccaagacaaacaagggccgggcagggcagtcagtcccaatcaatcgatggtcaaaatggaaaagaaattaataatcaccgtgctgaaattattaaggaaatgaaaaagaaattaataatcaccgtgctgaacttattaaggaaatgaaaaataaattaatattcaccgtgctgaacttattaaggaaaagtatctattattaatcctaagtcagcaatgaaaaaacacaagggtagtattgtctatctaccctctatcctctctttcaggatttttggagctgagcaagcaagttagccaaacactttcagaccacctacagctcctagtggagctagctcccactggagttggagtttggagttaggagttgagagctgtagctctaccaaacagggccttagtttgactcagtaaatactacggaaatggattaaaggggtttcaacaaaattgcatttcaggtcttttgaagttatcttgtttgatccaatccaaatccaaggtcaagttcattgaattgtcatgtaaaaaagtcaaaagcatattgcatgaaagtgcaaagatagttcctctattttaaaatatagcgatatctaaataagacacgatcttatactgcgaatttggataatatgttcgtgcttgtaaaaattatattgtgtctaatccaatactaaattgttgtattttggaaaggtgaaagtagatgatacttctgctgatttgcattgaccataccttgttctccgtcaaagctatggtagtacagtgtgatgtatggtgcgtcacctccaccaacatgctccttcactgtccatgtaacattgctgaaacccctgtgaccaccttcagaaaaatgagataaaattagcttactgttcgtagagatgaaccatgcaccatggatttcttgcacctcgggaaatttctcaagaataccgtgaagtgtgtttttgccatcatttggatacagatgataagcttttccatcgagcacgaaccgcgccttggcaattctgttggctacccgtccgacgagcgctccaaagtaagtagaagaattctgaacagcagaattcagaaggcaaactgaagtgaggtaatttagcatttaccctttaaggtacttgaatacagtgaactcagagctgtcattttctttgatgggttacccagcttgcaattttttttttgaacggaaagcttgcaaatgaactactatgtaaaaaagattagttagaaacttttttgcccttctgaaagtaggtagactttgtcaaaaactcaattggtctgcataagattttgctcgtgcttgtgctgctctgttcatgtgattggattgtgatttgggatagtattatatgtagagagaagtgaaggttcagaaagaagaacagaacaaagaaaaaaaaagtatttatatggctattgcaaaagtgcgggacaagtaataactaggcaacacaccggcatcacatggtgaggttgtcagctgtctctctctttcgtgagactgatatactatttcttgggtaacaaactaacatggccactggcttaaagaaaactgcatccatctaatccttttgtcgatcatatgtttcttgctatttcttttcctcttctctatgcttatgcaactacgccataatattgaattttcctagacgtggcaacagcatctctatttgtgtcaattgtttttttttatctatcttggacctccatgtttgaaaactgaccccaaactgaaggcgacaacaaaggtctcgtgagagttttttaaaacgttcaaataattgagagcatttttatgggatagtcaatggccaattaagttgatcatccctgcttctcgggtccagaaatgtagcaggtgattaggtgaaattgaaactgggtgatgagcaacagaaaactaatttgagtaaactggatgcagacagaagtgcaaaaaaaaaaaactcaaacacacaaactatcgctatgtaatgctgttctacaatccatatcaaacgacaatgaggacagggaactatcgctatgtaatgaggtttcacaagttgtgtgtagaaacaggtaagtaaacagtgaaaatatgagcatatgcactgccttaaaagaagaacagggacaatgaggtcagcaaatcttacaacatattcagcaatggtgtcatatccaagaacaacatcgtccaatttccctggcagaaaacaagtctccaaagtttcagctcgaaacccccatgaaacgagcagagaaatcacgaggcaaatgaagctctggtgtccttgacggagagagagagaggctcacctctggagtcaggaagcacgacggacatgatgaccgctccccaattggtgaccctgatggagaaatctcccttcctgagctcatagacgccgaccgtcgtcgccttcctctccgccgcatcggcaccgccggcggaggcggcggccactaggcacaccgccgcgagaagaagcagcagcggagctggtctagccatcgcccaacactgctctctctctctctctctctctctctctctctctctctctctctctctctctctctctctctatctatctatctatctgcgagtgaggaagacggagacagaagggacgcgacaagctctgcccgggatggttgctggccttggccggatggacggatatgtaatgtagtcaaaagcgtagtagtagtagcaactagcaacttggggatgcgataagatggtgacaaagttgaagtgttcgtgtgtgctcccaaggcgtctccgagaaaatgtcgcgcgcgagccgagcgcgcggggccagcgcgagcgatttgtccttgactcccgcgcagcgtgcgctagtgtttttgcacagcgatccggggtccagcgatcgattttgtcctggctctcactgcgatgcgatgcgatccgtgcccacgcggccggcgtcttccgcggcgaatggatcgtgcacgatcgatggtacatggacggcgacggcgtggtgcacggcgaatattcgctcgcttgccctgtgatcttagatgatgagctgaatgattgatgagtttgatgactcgctcgctggttcagcatctggatggcttttgtgtcgatgtgccatgtagtatcatgacctcgtgtctacttttgcccacacggcatggtgcacgtgcaactggtacacactttgccaccgtttgatggaatggaatggaagggagaaaaaagtgtagccgtatcgtcctagctgcaaagggaacgcctgggcaccaccaaatgggcatgggggcaatggcctttttgttggagcaacgtggctgtgtagagaaatgcagcggaagcaccgagcaccgtagtgaggagaaaggtgcggaccacaactccacaaaggcaggcccaaacaaatggcacgcggccctggcccatcatcgacaatgcgacagacaaaaaaatacaagcaggcacgcagacccttcaagacttttaactcgccgttcatcatccggacctgcttgacaaggtaggagaacttgaatatcttaaactaacccaaattaatctgtaaaaatccctacatgcaatgcccgctattctcttcttttcgagattaacaaaggtcttaaagagtaaggaaccacaagcaagtaataacacaaacaggtaaaccaatacacaaattttattgccagttcctccgactgactaaactgacatgagaaggtgttcaggacaattgccacggacatgaatgtacaaatgactggactaaagcaaccacggaccatttatctagacaaaggaaaaaaagccaaagaagttcaaatcggcaaaataaattgccttgtttatgtacacaaccaaactaacagaattcggcagccggagaagcaaattcagagcttatccatgtcggcgttcctgaagctgccaccgaggagtgacaagaggccgccaccgtgcacccttccctccggaacggcacagcctccctctctgcccccatgcacggtaggttcggacgacgatgagggcatcatagagcgaggcaccagcacctggggaggtatcatcatcgcctggctcctcaccgtgccgtcgcagtccgacgcggtgctgatgcccgacgacgagtactcgttcgtcatgctgctcgtggcagcgacggtcactatgccgctgaaaaggcctggcgggatcatgcccgcgccgttgttcgccgcgtcgcgctcttgctgcttggccgccaaggtcccatgcgcggcgcacaggccgctcctgccgcgggcgaacttctcgcagcccgttccccaagtgcaccgcttgccgccgccgtgggctttgcagaagtccgtgctcccctgggcgctcttgctgcagttgtcgaccttgcacctcttgccaccaccgtgcttcacgcaacagtccgtgcggccacgggcactcttggtgcagccagccaccgaacagcgcttccctcctccgtgcgccacgcagtactcagtgccaccatggacgctctttgggcagacgccgccaccttcgaacatgcatcgcttcccgccaccgtgtgctttgcacagaggcgtgctcccctcagcacctttgctgcagccgtcaaagatacaccgcttgccaccgccatgccctttgcagtacaatgtgctgccttgagcccccttactgcagtccgggaactggcaccggcggccaccaccatgagaaatgcagagcccggccttaccctcagcgctccggatgcaaccttgcaccgtgcatctcttaccaccaccgtgcttgatgcaccgcccagacttaccccgtgcagctttaggacagccatcatgttcacaacgacgacctccaccgtgagcgatacaataatctgtcttcccttcagcactcttggtgcaaccaagctcct

SEQ ID NO: 42636 - DNA, 13172 bp, Oryza sativa
ctgcagccccaatgtcccaggatcggtgatagtcaaaccctgtccagataacgaaggagcttctttaagcttgtcgactccagtgggctgacactctgcagagtaaaaattcggcgttggacccaacccaaggactaacctgcaaccatcatctctagttgtgatgctatcaatgcactgtatattttgattaccatggccataattagccattgcagatcccaggcagtccatgtggggtgtgcttttgccaaggttcaccatgtagctctgagctgagggttccattaacacaaacgggttattcattggaggttgatttgggatatccacaaagctgttatccatcacagcttgacaatatgacaacggggtgagagcaaatgacaactgaatcactgaatagctgaagaacagggaactgatgatctttcaaacacagatcacagaatagacaaaatggaagaatatcagcaggagtgtagtactgaagcaaccaccactgacaaagcctgaggtgtctgcacggtccatgcctgtcttgttttggttgaatttatgatccaatgctacttgacctccacagcactaaacaacatctttgatagttgacatcaagcataggcaggagcctcgaaatgcttactggttgggaggtcctcaactgacaaaagcaaaacaaaatattaaccaaaattcagatgtcaaatatatgtttggcgtgaccttattaaaactattataataccatagacaggtcaccaagccagtaaagcaaaccacaattagtgttgtgcaaagattaaataatcagaagtgaatacattttattccatccattcaagtatacatggcgtgctttattcacacacatgttcaactatatagggtaacacagttttcgaagtgattttgcacatatttgcccatacaaactccttttagcagcacagcattgaacactccattggttcctaagcaactctcattaatcaagtagttgatggcaacttagtcatttgtgctggattcggtctacaagtgaaaaggaaaacacaccatatatactagaactgagagagtacaaggaaactgcaattatgaagtggtttcaagcaagcaaaaatagtagccgagatcaatgcaaaacaaactccaaacatgtttgattggtaaagctacatgttaaattattattaagattatccttttgggggcataaatcatttaataatacctttaggtaaagaagattgaagggtcaaagtgagtaactaacacgacaaaagtctttctccagaaaggaggcaaaaatgtggagtctatttaatttgagcaacagcatgcacaagcaactcccgtagcaagaatttgcacagtagaaatctcaaaatattgacagaacctatctgccctttattatactcgtaataccagccaaccaggtgctacctttgccgccttgagtgaaataaatggtttaaccaaggccaagcagtgtcaataactcaaaatgaggtgatcgataaaccaggaaatcaaccacattgcaatgcgcaatctacaaaggggaatagtatgaagtaatgaaccctcatcagtttacctaatgagtacaataaccaagatcagcagtcataaatacatgttattctccatgaaaaggtaaccaaaagattggatagaaaacaagtaacaaatgtctctgttttttctttcttaaccaaaaacgactgtcatacatttttggtcttctgcatacgactgcaagacctgtgcctcttattacatatctaaataccataacaattcaactttcctaaaatcatccacacattctataacattcccaacagtaaaaaatattggattacactgaacatatcattcctaatacaggtgcatttctgactgactagaagggttcagacttaagcagtatcaatttaaaaatagatgcctaacaagtactgctcaacaaagagcatcccgaatctccctttggaatattgtatcacggattgctgagaagtgcacaagatcactacacgcaaaatttctaatatccaagaattccagtccagaacagttagttcattcttgtcctaatattttttttttctgaacttcgcctgattctctcctagtcctaggtacggagtactattatttagggtctcgtgtactagctaaccaggaagataagtccatatactgcaacaatctatctatgtacttaactagttagattgagagtaaatagtaaaagaaaagaagacagggaagagaaaacaggaagaaatggaagaggacaggattatagcgctaattatctaagaatacagggttaagacttaagagactcagagcctcagaccatcacaattgcagaacatcccaaaacaacaagaactaagtatcccaaaatcaggaaccttctactccatcctgaaccttcacagaaccccacaaaatcctgcaattctcctacgacaacaaactagaataccatggcacagaacagatctgattgtttcctgaaaaaaaaaaacttccaccaaaccgaacatggcacacatgaaattccccaatcgggacaccacgaggggcgacctaaaagggggactgggaccaacaaacccatccccgcaaaacccctgcagccatgacatgcgaagagaaagggaaggcaaggacgtaaacacataatcgcggtgagatggagcaggcttgagtcaccttagcgcgcgagagcggaggaggagagggaggaggggtctcgctacggagcggggcgaggagggcggggagtcgatcgctgcgggcggaggcggaggcggaggcgggggcggaggaggcggtgtgttttgctgcctttctggtggcttccctagtgcgcgagaaggggagaagtactggcctccgtgtggagtatgtatggaatgcgggtgtgcggagcgagggggaaaaatcggtaggagggctcgtcgcgtgtgcaggtggggcgggacaggacgggacgggacggcggggtggggtggatggatgacggcgggattacctggcgagcctggctggctggcaggctccgctcggcggctgcgcgagccagccacgcgaccgaccggcagcgacccagctgtttctttgcccttctttttcttaatgtttttatgtgttgccttgcgttctcttttttcctttttggttttggtttgttttgtatctggccggatatcatgtggtgacgaactaacgataggctttagcctgtgggttggattcatccactcgccatgataaggtgcgtcatcactcatcatttgcatatggattaggatgcgtttgagagttgtttttcgcgtacacgcttccaaactgttaaacggtgtttaaaaaaaattaatagaaaaattactttaaaaatcacattaatctattttcaagtttaaaataattaatacttaattaaatacatactaatagtttacctctttttttatcttcttaatattttttatttctctctttcttaaacaggaatgattacatgggatctcatcatggactaccttttacggaggttgaaatcatcccacatctttgcctcctcctcgtgagtccgtcactgtcctatccttatgccatgcgctcgcgtcccgtgccttgagcagaggcgcgggcatcagttggtaggaaagaatggcaacaatgctagtaggaggtagtggcatcaacatcggtattagcgaatgtgacactagaaggcaacgacataggcaatgaagttggccacagtagtagcaacaggaagccgaggagaaagggagaagacgaaaggaggtgctagcagcatgcggctcgttggtccaccaagtcgaggcaatatgtgtcccctcttgcaccttaatactagataatatatcgaatttgttactccatgggtactgtgggtaccaactggtacctcagaggtaccaaatctgatacttgttgatacctaggatagtactatgtccgataaccgtaggtattagctatgataccacaagtactactcgagaatgatgtgtcgcatgatgtacttaccacaacaccgacgatgagcatgacggcttcactgccacgtagcccgctaatcaaagctccagatccagccgcttcgttgccctccccctctatcaccatcgacaaagcttgggaggaggtgcttgtgctggccttcttgacaacctccctttccccctggttgtccccttccgccatgggagtcagatattgtggatgtcgccatgcctcaagcatgagacagaggagaaggccatggaccgtcgtagtccactgccctcgtcaccgacgtatacttgggtcagatccggcatcaaggaggcctagacctccagatccggcgtttgtcgatggcccagaatgcctccatacctaaccatagattggtggaggaaggagaagagggggagcacgggaggggaacgataggaagagagtggaggagaaaaaagaggccaaggaagatgagagggcaacgcaccgtggtggtgggcgttaagtatccgcacccggatggaacatcgttctatagattatctaaagtgaagggagaacttgcttgtgatttggatttgagaaaattccttgtatgcccctagaaagttacctaatcccttgtatgcctctgaaacttacttgatccctttcatacctttgaaattttgatttgatcccttacacgtctctaccgttaggtttacttcattccactcgttaatttggttgaaaatgtccataatacccttcaagttgtaggagctggaaattgagcgcatgtttggctgtcaacttgataaaagactgtaatattcatgagtgcacactgtgtgttttagagactaaataattagtacatacaatttttaacataaatttggaagaagaaatttaatgtgtttaccttatagcattcagcataaattaaacataaaattggtggaagaaatttaatagtgttttatgagactaaataattatgacatacaatttttaacatgaatttggaagaagaaatttaatgtgtttatcttttgttatagcactcaacagaaatttaacataaatttggaagaagaaatttaatagatctttttggtgatacgagaaataccataaggagcatacaaaattatcaggagcatcaattgacgggaaggaaaaaaaacatctgaagcatccatacaccatcagggatacacaattaacaatttgattaattatggtgcatccatacaccatcagcattaagcaaccacagatccattgatttatacatcatgagcatgacggcgcgagagggtggtgggacgtcgagagctcgtgtatccaggtgccgaggacggaattcgagcactgacgggatgccgaaccgccgctacgacgggatgcgaagccactgccgcgcgcgggatgcagagccgatattgagccaccatcgccgactggatgcaggagccgttgcatgacgggatgtggagcaacgacgatttggagattggaggtgataacctgtggcatttttgtctttcttaaaaaaaactgataagctaacacacgccttcactcgtatatcttacggaaatctaatggtaagggtatgtaaatgattaaatcaaaattttagaggcatacaggggattgagtaactcttcaggacacagaaggaattttctctttgaatctactgacactttgattggctataacaaaagatagaagatacttaatttgttaattatgccagcatagtcggttttgtttttcaaaatatcaatcatttccttatcttcgacctcagtttagctcattggtgccatccaaacaaggaggcaaatgctaaacataaaagatggtgtgccgcgcggccggccggccggggaagggggggacgctagatttggcaacgatgaacatggttcaagtgggaagactcgcataaaagttcaattttagtcttgattgtagcataaacatgataaaggaaatcgaattatggatcgttggttgtcatgcacgatctaaaacattgtagcttggcctaatcgaaaactgtgtgtgttcaatggtagtaaaaggaatagaacagagcagagtaaggaagtgttttacattgatttcgttcataagtggatccaatggcaagcaacatccaaaaccaaaatcgaactgctcatatttttttatgacgtggccactataactttgcgaaaaaaaaagtttacttctttcatacccccttgtcctcttgcacccctataattttttttcatccgaaacttattttttagaactttccatccgaaactctcctgattaatccaacctaaggttccgttcatttctccaataagaattagataaagataaagattttcatctcatattttttaaactgctaaacggtgtgtttttgtgcgaaaactttatatataaaagttactctaaaatatcatattaatctatttttaagttaaaacttaatcaatcatacattaataccatatagttatacgtaaaaaaaaacttaatcttttatcttgagaacctaagtgcatgactcaaatgatctaaatacgacaaacaggctagagcagatctcagatctgcagcggcagtttggagcagtgaccccccatttcatttggccatttcctcccatcgctttcaccgaaaagcagggggccccacgtagagcgacgcatggccaagcgatccgggagagccgtttacgtgcacaagttgcgcccgttttgggccccggccacgttggaccattgcacgctcgcaacatccctcgtggagcccagaacttgtttggtagcacagtgcctacaaatcctggagccgtgggccacccactgttactcctcctgattgctaccacaagccgagccactgaagccagcactgttcatacgcagcctcggctcggctcggctcatcggcgcgattcgctctccaccgtccgtcccgcgaaccgcacccgattcgccgtgtcctccacttgtcgacatcccacaggccgcctcccattctctagtggcgttcacgcgcccgagacgcctcccctaggaaaaaaaagtaatatctccgtcccaaaatataagatgattggacacggttatttaaaaaaaatagatagaagtaagtggtggaagattgtgattggatgaatagtgagggtaggtgagaaaagtagatggtggagggttgtaatgggaagagaatgttgatggagaaattgttatattttaagataaatcctaagggctaacagttgttatattttgggacggagggagtagcaggggacacactcgcttacataaaaaaacaaaagaaaaacactcttacccacgacacgacagcgcccacgctaaccgccatgtgggccccgcaacctttccctgccccacccgtcatccgccccaccagcggaatctcgcctgtacgctcggctctcggggcccacgccccccgcgcgtcccgccggccggccacgcgtcgcgcctccgattcgctcgtcccctctgccaggtgggccccgccgtcctccgcccgttttgggcctgggcccagtactagcgtaacctagagcctttgccaccgcatctgctgtgcgcgacgacgcgagggcggtggcgtctggtggcggcgcgcggcggccgcactgtcgcggtggtgacgccagccgacgcgagggccgcgtgtttctcttctctcgcttggcggtggggaccagcagagagacgcgacgctttttttactaagagcaagtttaatagtatagccaactattagctctaaattatctatagctaatgtaatagccaattcatacaatagttgcttattatactattaatatctggtcctacctgtcatacacacattacgttttagaatccgtgctacagctggctacaaatctgtagcccgctgctttttttctctctatttagctctttaaaatatgtttatagcatgtttatagctgacttataacttactattgtacatgctctaaaggctaaaggacgctgctgacgtctcctcctccgttggcttggctccgtgcgtgtactggcgatcgaccacgagaacgacgacgacgagtttggtgggggctcgtcacgccgagacaatcagattttcttcaccgcctggtgatgtaatcgccttttaattaacttgtgagcgtgcacgtttaaaatcctgaagggaccatgtggattgcgtcaccgctgacaacgaaaggatttactagtggtagaggagtacagacaggagaagcttagctttgatcgtttgtatttaaaaagagagagtagcaaatggcaccaaaacatcaccactagaagccagatttgtaaaaggaaatacacaaatagttttgtttgggcaagagaaccttcgggatccacacggtcgagcctcagcttcagctcctgcggcgtccagatcagaaatgagaaataaattaagcaccgatcgagccaataatcgtttggccgataccaatattgtacagcaaattgggccaatagcattgggtcaaactggtttaactactgatcgaatcccatagattggtgcctgcctaccgtgggctatataatcctgtatgcaaataattggtgcaacctgctatctggtcgctgaagtcgtcactcgtcagttactagtcgtgtcacttcaaaaataaatcagttaggggtatttagatctagggtgtaaagtttcagcgcgtcacatcgggtatcatgtaggatgtcttatggggtgttcggatactaataaaaaaaactaattacagaatccgttagtaaaccgcgggacaaacattaaacctaattaatctatcattagcacatgttcactgtagcaccacattgttaaatcatagagcaattaggcttaaaagatttgtctcacaaattagtcataatctgtgcaattagttattttttaacttatagtatttaatacttcacgcatgtgttaaaacattcgatatgataggatataaaattttaaggtggaatctaaacagcgcctcactttaccgtttcaagcaatgacaaatggcaccatcgtttacatgtcacagattcaccattactgtaacgaggttgcatcaatccctcggtccttcactaagcttgaatcctttatttacatttctgaaaacaaatgaaaatctccgggccaatttgtctccaaaaacgagccagaatatatgaatatactccctctgtttcgttttatttgtcgctatcagtccaaaccgaaaacatcctttttattatttgacgctctagttcatctctacctgctatcctacgcgaaattccatccttacccctcgcgccctctccatcccgcaaggccacaacccagtctccagtagcgctggcgcgcagcatggcgacctcggtctcgcgtgctcggcaggcgtggcgatggcgaacatgaggagcagcagcaggacgtcgtcgtcgtcgccggcggcggcgttgctgcggtggggggcgctgacatctgcgccgcggtgcatggcgtgcggcgggacgaggcgggaggagtgccgcctgtgcacgcggtagtccgactcccggggtgacctccgggtgccgggcgtgcgccagcacgcggcgggcgccctgccggagctgcggcaggtcgggcaccggacgtcacgcccccgtccacgcctcctccgcgccgccacggtgaccgggtcgatcagaagctgtcgctgtcgcctccgcgccgatggattaatcaaacccccaggctctcgatcgccgccatccgccgacatcgaactccgagctgcgaatttattttgttggcaggttcagtgtccatggaagaccaaacagctggccaatgaagcttgctcagttggctaagaagttgcagcagaggatggtgtcagtcagtgctagtggacagaaggcggtcaccgccgatgattgctgctcagcggcggcggtggaggcgggctcgcgaagagacgggagggaggtgagagaaggtgtaggaagaggggaatgagaaaagggagtatgtgcatacgtgtgtgtgctcaccggcggggggaagcaggatgccggcgccgctacctgtgggaaggggaagccgcagcaagggaggtggggaagagcgccgccgtccccgccgtcggccctgccgtggcgctggggattgggatggggcgccgccgccgcaacgtgtggaagaggaacgaatcggggaagaggaagggcaaaagggtaaattcgcgtgaaccttaatttcgccgaagttgtcggaaacgacaaataaaaagaaacggagggagtataatgcagtatgccctgctggaacttttttcatacagggaccataaaattatgtagcaggaccacattgcaaaggaaggtagctacaatgggccatatatgggctaaagatgtatggttgaaatttgggccgagatagaccctcaacgtagtggacttaaaacggcccaattaccaattactcgtgttgctcctgaaagaattgagaggagtgcctctcgtacctacattctgctctgctgctaatattttttatttttgtgctctcttttagattacatgacactgacacgactgaatgggcccatatgccccagcagaaggtaggctaaaggtgattctgtgaaacatgaaacaaactcctactaaagcttacgcagataaatgtgaacagcacgagcactgaagtcacgcccattgctcaaccaccgtagcgacgaaggtgcttttcctgatttctttgtcattgcttatttgcatttgacaatggccgcaaggttttttcatgcttaaaaagcttttaaaaacctttctttggcacaagggctcgagtcatatgtataatctactttacaaagcttaattagcctaacatgatcaccctcattttaacatggaattcgctattgaccgccgaaatgaccgggatagttacttctatagatgacatcttctcttctcttcgctgcttctgcttctgaagtcggtgtagcaccacaggtcggggtagaggtagcaggcagctgcatcgagtcatggatcaccagattgatgccgaaaccgttgccagtgatctcatcagcgcgtctctccgcctctccaggcgcaacctgctctgtcgtactccctgtctcctgtaataagccatttttagttattttcatttatctcggaataagtttattttcaaataatcattgtatcggagttcatgaaagtatggagtggttgtattgggagtagctaaattaaagagtaattgcataataatttgataaaataggggtattttaatctttttattttatatggatatgtgtgggatgtgtgaaaaataaatttattttgggacggagggagtataatgcagctgtgtttcctcttcaacgcctcttctagataaattaaggtcccgtttggtaacttgaaagcctgttaatctgttataaccatgggccaacttcaaagcctgttataactgagaggaatatatatttcaaagataacctaatccgaagattgctagatataccaaagctatggcatcacgcccttttcttgcagattcttgcagcagataagaagagaaaaaaaagaaggtacgccggccagaaagcatcaacggaggaaaatttggtggatgagacggagtgacaagtgagctgtgagcaatacatggaatctctcagggttttttaagtgacggctgagtgtggggttgtgggggtggagatgtgcttaccacgtgaacaaccctatatactttgacccaaggctggcaggcatctttctcgttactgtttttcattgtgggagtagaagcacaacttccttttcactgccaactctagattgcacccaagtggatttatcgcagatgcaagctgttgcaaaagcacaactgctttacttttttccccttctataatttgagcaaataatgcagctatccattttcagatatccttctacattagtgtatggctgtatttagttctttaggtgtaaaaactttgaagtatacggacgcacatttgaagtattaaacgtagaataataacaaaacaaattacagattccgtccgtaaactgcgagacaaatttattaaacctaattattccattattagcaaatgtttactgtagcatcatgttgtcaaatcatgacgtaattaggctcaaaagattcatctcgcaatttatgtgcaaactgtgtaattggtttttttccacatttaatgccccatgcatgtatccaaatatttgatgtgacgtttttggcaaaaaaaaaaactttggaatctaaacacggcatatgtctgataatgtctaaaacgtactaggtaccatgcatgtcctgtgttctaaaagtggaacatttggaaacagttaatatgtggcagtatatacaattgattctttttactctctctagggcatgtacaatggtgtttaataacggtctctcttcgttgtcatgcaagtaaatttggtgacgtggaagaaagagaggaaggaatgagaaacatcgttgctacgtatgacaacggctcagagtcgactcttagcatttattaacataaaatttgttgcatgaaagtgcagaaaaggaaagaagtataataaaaattatttagtatattaatggtttagaaatctcattgtctctactattgtaggaggatagtctctagtgatattaattagtatagagagatcatattagactctatatttgtacatgcctttataggctggcctgctaaattttattaaggttgtgttctaaagaaaggttggcctggactaatcattcatttatcgtaagcatgctttgcaaactattaaacaatgtgtttcatttaaaatctttctatataaaaatttcttttaaaaaaatcaaataaactatttttacgctgatggctcgtctcattttctatgtcaccaactaactatccccaacagacagcagctgtatcgaactcagcctaagacacgaagaatataaagtacaatgtgcagtccctatagtaa

SEQ ID NO: 42637 - DNA, 13082 bp, Oryza sativa
tttcgaaatacaattattatgggacaaatgtagtacgaggtaagatgttttccactgggataacaggtgacttatcagttgctaattttaaaaaagattttactacaatactcctatcttttaaaaagttttgcatttcctaacataacgattaccagtactccctagagatgatagatttatggaatagagattctacaaagattaaatggacaaaatttaaaattcagacaaatactactacctctatactaaaatattactacaacataggccatgtttagttcctcctcttttttttttatgtatacggacgcacatgcacattttaagtattaagcgtagactaataagaaaacaaattgcagattccgcctataaactgtgacacgaatttattaagcctaattaatccatcattagcaaatgtttaatgtagcacaacattgtcaaatcatggcgtaattaggctcaaaagattcatatcgcaatttacatgcaaactgtgtaattggtttttttcggtccacatttaatgctcaatgcatgtgttcaaacatttgatgtgatggaatttttgaaagtttgaagggaactaaacacaaccatagaataaaattttgacaataaatccgcagattgcaatgttttgagtctggaaaaaatacttttctcactaactaatacagcagatatttcgggtgaagtgccgcatgtcagcttagggtgtgtttagttcatataaaattggaagttttgttgaaattagaacgatgtgacgaaaaaattgaaagtttgtgtgtgtagaaaaaatttgatgtgataaaaaagttaaaagtataaagaaaaagtttagaaataaactcggccctattgtcatcccatccctctttttctgcatccctctccatttctaggcgtactactacatttttctttgtggaaaagacatgaagcttttcgaatccacagccacagtgatgctatctcaaagctcaccggggggcggggccgcgggggccatagccacgggcttggtatagtacatttctgatccgaaactctgaactcgaggcggtgtttagttcttcaaacttccaacttttttatcacattaaaactttcctacacacataaactttcaactttttcatcacatcgttctaatttcaaccaaactttcaattttaacgtgaactaaacacagtctgagtgaaccacatcaacaagtacggaacacttagaccgagtttagatctaaactttttcttaaaactttcaactttttcatcacatcaaaactttcctacacacataggctgtgtttagatttaaactttggatccaaacttctaactttttccatcacatcaacctgtcatacacatacaacttttcagtcatatcgtaccaatttcaacccaaactttcaattttggaaggaactaaacacagccataaatttccaacttttccatcacatcgttttaatttcaaccaaatgttcaattttagcgtgaactagacccacccttactacagctctaatggcgctggagacatacgtcacgactgatcctaaaacaaaccatcacatcgacgtgccatttcgatggcacccagcaccgttgccaatttgtcattttcacgaggtcctcgacgacgcgttgaatcttccactgtctttgttagggctagtagtatcagatctttttatattatcaaaaaaatcaagtctttgtttcgttcttgtaccaaatctctcagcctaagaaatataaggttcactgaaagtgacataatgagcaaatgcaaagaaggtaaatttgttccgtagtatttccgtcagacttgcggctgccgacttttctctcttaacagaataaaaatccgcaaagagatacctatgggtaacacacaattgatcctcttttttcatagacaattcacagtctacagttgaattgtgcgtccccccccctctcttacatgcatatgtattatgagctggcagttgaaagtcaatgcatggttgtgatgataaattctagaaatctttttagattaaactacatggatgttagatgcttcctaaactttgaagttcgtaaactgtttcatagatagcccccgtggaaactctgtttcaaagtctcctttggagcacaaaaaaaaattgtacagcttttatagagtatattttttaacatactcttttatttagagtgttgacaaaaactttcaaattctctacgctcacacgagtctcgattaagaatgagtatttcttattacaaggaatgtaactagcttttctaacttctaaatgatattgggctatgttcagcaacactgctctgcagctataaccggttgtgctatacagtcagtgtatatattttctttaccatgcactatagcgctgttgtgcagctgcagtttagctacaccgaacaaacccgcgatttcgagaaaattatatataaaaaaatcattatcaaaccattttaaatacacttttaacttcataagattttgatcattcgactattcagccaagaaaaaacacatatcctaaaatacttctcgggagcgtaattaataaactctagggcctattcactttaatgccattttcaaccttaccaaattttagtaaaattactaaaaaaatagctacatttagtttgttgctaaattttagtaactatataagaaatcctattaaaattttagcaaattactaaaattttagtatttagcatcaaagtaaacaggcgtatagtcttctgagtacaacgcataagcattgaagcaaaagcaagtactactatcaccaccatccgatgggtgggtctcaactctgtcttaaccacaacgcccaaagaggcgtagaccgtggacgtagaccagcacggtccaccgttttgaccggaatccgagctggcacatcacgggccccaccgctcgtagaaaaaacagaaaaaaaaaacggacgggacgggatcctctctctcatcgttcgtcgtccatccatccatccatccatccatccatcccctgcgccccgccagagcagcgcacaggcatctcaaccccacccccagcgcgtgcgtgacgacccgccactggctccccgcctccgcccccccccccccagtgggcccgtccccctgacaaggtggggcccacgtggcgcagcaggtgcggcagggtacggatgccgcaccggatcccgtcatcacgaggggactttttgactgcgggattagctggcctcctgacgcgtgggcccggggacagtgaaggcgagggtaaggtacgtggctagtacgtgaacctgccgtactgcaccgcgagtttttgggatggccgtgccgctgtgcgtgtaccggtttttgggatacttctacaaacagggcacaaaaatgactggactggggggaagtaagtacaacccgtacgaggtgtgtgcgagcgcatgaccactgctgtgaactggagtggcaacgtactggagtactatcaccgtaggaacgaccatggtattgtgtattagatttttaatatttagccattcgtgagatggaacaaacagaaatactgaagtagtagagcatttgattgaaaatagagtttggcacatcgtggtaacgctgttttgctctcgttttaattatcagctcttgaaaacttgtgagctagaaagttttttttttaactcaggtagatctttatatgtcaattacttgtttaaaaaatatatacttcagttagtaaagtaacatagaaaatattatgcgttttcattgcttggggttgttagacagtggccccaccatatgaaaacatgttaaatatggcttgtttcaaggtgagctgcatttactcactccatcccctaagcataaaattaagagttaatgctctattaatagctaataattaagattgactcttaggtaccatggaaccatgaacctaatttgtatacctatgtaaaataaaaaagcttatatataatactactatacatatactaaaataaaaagatagtattatgcacacgaaacttttaaccctagcaaaattatggtaaatatcatttaattcacaataattttttaataaaaagcgctttaccagagaatcttttaaacttacacccatgatacattacaagtttggttttctaagagaacaatataaattgttggtgagaaatttgaaaaaacaacaacagaaacccctggattctttccatgaattacagcatagaagaaaaggcctaataattcatggaccgaaaaataataccagcgactcggcgagaagtcggtaaaaaagacaaacaaaacgtgaaatttgacaagcgagggacagtccgagttctgacgaaacggctgcattcctcgagaggccggagaataattgggacgggcgtacgaggaccgtgtccaccaaaaaaaacccctccgcatcacgcccaagccagcggcttccccatccctcctctcctccagtcctcctgctacacttcgatctcccactaaccccatcacctcgcccagcccgaaccattcccacccctccaaacagacgatctcccgctgacgcgtgggccccacctctcctcgcccccacctgtcagtaaaagttacgcgggcgacgcgcggtaactctcgccgccaccccccgaacaggtctcctttaccaatggaacaatttaggttggaacacacactgggtctcggccaaaattttaaaagtctcgagctgaataaaaacactggtaaaaaaaaaaggagagagagaggagagacaggtcgcttcctgcttccattggagaagaggagaggagaggagaggagaccgagccggcggcggcggcgacgaggagagggagctgatcgggcggtccccccctttgccgaggggacgccggcggcctccgggttgggtccacttggcagcggtgagcggcggcgggggatggcggaggcgcggctgctgcggcggcggcggctgtgcttggcggtggcggtcgtgtgggtggtggcggtggccgtgagccgggtcggcgccaacacggagggttagtgtgatttttcatcgaattcagctccgtttttcggcggattacgcccacccctatttttggacttgctttcggattcgatgaatctattggtcatcgggtgattccgtttgggtactagtacatgttacctgcttctcggtacatatgggcgtggatggattgactcatttaaggggatggagcatacgcccaccgaccttccttttgtagactcgatggattatctaggctatagctctttgttttgctgcctctcatggtgtgttgtgaatttgctcccagcagggagatttgtccgaggtaggaaacgtttcttgagtaagtttggtaggtgtgatttgtatgtgcacagaaatgggatagcttttttttttagataatggaataaatcctgacagaaatgggattgctaatatctgggatgagtttggtgtgctattttggccactctgaatgaagaaaatggaactggcttcctcattaggttcgagtatggaaagaatattgcttgtgagttgtgaatcttctcttgtgaaaagagattttttttttaaaaaaaatctgaattactgactagtatagctaattggtttcttacggtaggagtatgtgttatagattgctcttcaataggtaagggccatcgttagtatcaagtttaagcttttcccgaacaggaaaaagggtcatcatcttttgttatcacctaaccaatttcacctctttaaaatgcccctcaacatgcttttcctgatatatccttggtagtaaccatgttctaagaaaatttggtgattttggcgttgtgatgtttatgacactagattgcaaaaggtgccttagctattgtaagttctagttagtgattatgactaagataagtgttctttctagttgtttcttatgcaattatttcagtctttttaagcaactttatgtgctatccttttccacatttaggtcttgttaatcgcaagtacctctgtagcatagatactaactaatgttcaaacactaatcttgagaaagattgggagttatgcagatagtattgtaagaaatgaaagtactgtatcttataccttcttgtactcaatatatgcttgcatactttagcctgaaaaggcgattgaatttgccaaaattttgacgagaagctactgtcactattgtctacttccttaaatactatgttgctgatgttgagggtatgttcgatgtcaggtgatgccctatatagtctgcgccaaagtctgaaagatgctaacaatgtgctgcagagttgggatcccactctggtcaatccatgcacatggttccatgtaacttgtaaccctgacaacagcgtgatcagagtgtaagtttttgacagaattatcatttttaggcttgtcaaaagtaagaaatgtgatcattttgtgtgttgactgatctattttcctttcgcagtgatcttggaaatgcacaactgtcaggtgcattggttccccagcttgggcagttgaaaaatctgcaatatctgtaagtttacacttccagtctttggagaattatgtttttagttacaccatgcagtagcgtatctattcaagttgtcataatatactgcattgaagcttggttttcaaaactcttggaatatggcttatccttgtggtaaagatggttgtgttgccaccttctttcttgcatttttattgtgaaatttaattatgttgtgactaattacagggagctttacagcaacaacataagtgggacaatacctaatgaactgggaaacttaactaacttggtcagtttggatctttacctgaacaacttcactggttttattccggaaaccttggggcaactctacaagctgcgtttcctgtaagtgtactccactttttttttattatgaatagaattataaattgtgtatatcattgaaggccttcctgtttgaatgatcataacataattctttatttgcatgtcttcttgtaaggatagtcgtcttaacaacaacagtctttctggttcaattccaaaatccttgaccaatatcactactcttcaagttctgtaagttccctttctgctaattcatatttggtgtctacctgtagaaattattgcttacatggtaatagactttaagatggatacatattaacaaaatgtccaataatttatgcagggatctctcaaataacaatctctcaggagaggttccgtctactggctccttttcactctttacccctataaggtgctttttctagatagaatttaggttcttagtgcttactacatcttgtgaggctgacaaatggttatttcattgtcgcagttttgctaataataaagatctttgtggcccgggtactacaaaaccctgccctggagctccacctttttctccaccacctcctttcaatcccccaacacctactgtgtcacaaggtgattctctatagttttaattctgttacatttgtgatactgcttgggatatgcatatgcataaatgatgcagacaggggatttgacatattcgggtggaattaattctattccatcaggtgactccaaaactggagcaattgctggaggtgttgctgcagctgctgcattgctgtttgcggttccggcaattggatttgcatggtggcggcggcgtaaacctgaagaacacttctttgatgtccctggttggtattatagttgcatactgcagttcatgatacttatgttatccatttaaataatctatattctcctttaaattcagctgaggaggatccggaagtgcaccttggccaacttaagagattctcactccgggagcttcaagttgctactgataactttagcaataagaatattctgggaagaggtggctttggaaaggtgtacaaaggtagactggcagatggctcgttggtagcagtgaaaagattaaaagaagaacgtacccctggtggtgagctccagttccaaacagaagttgaaatgattagcatggcggtgcataggaacctgcttcggctccgtggattttgcatgacgcctacagaacggttacttgtctatccctacatggctaatgggagtgtcgcatcacgattgcgaggtgccttaatcttccttactttttcttagagtaaatccattaatagtttcttacacgtttgtttgcatgcttaaacataaatggcacagctattatggttattgaaatcacttaagcactctttttaatttcatctactcacagcatatacctagttgtttcagttgacatatcacattgttcatttaaggttatgactaagactgtaataatgaatggttgagtgcatgccttctgcagagtccggaataaatatattccttcatctaaaaatgcacgcccataaattaattatttcagtttttgagtcgtggtatatgattttgtagagcggcagccaaatgatccgccgcttgaatggcaaacaagaactcggattgcgctgggatctgccagaggattgtcctacttgcacgaccattgtgatcccaagatcattcatcgtgatgtcaaagctgcaaatattctgttggatgaagattttgaggcagtcgtgggtgactttggactggccaaacttatggattacaaggacactcatgtaaccacagctgttcgtgggacgatcggacacattgctcctgagtacctctctactgggaagtcctctgagaagactgatgtttttggctatggaatcatgcttcttgagctcattacaggacaaagggcatttgatcttgctcgtcttgcaaacgatgatgatgtgatgttgctcgattgggtaagtaccaccacatctttatatattggggcaaccatggaagttttggttttgtttttccttgtgcatgctagttgtcctccaggacacatctttcttagctgtgtctcagttctagtccaggaattagaacaaatggttgaaattattggactgttggcagtgataaagcgagctggcagttcagtctccatgtgtcatcaattatggagatgcacgccatgacaaattggcagctagtttttcgccatttctgataccgagacatgatccatctgcacgcatgacttagcaaaattttgtactactacatttggaaactgacaggcaagtaactaaactggtttttgtcttttcaggtgaaagggctcctgaaagagaagaaggtggagatgctggtggacccggacctccagagcggcttcgtggagcatgaggtggagtcactcatccaggtggctctgctctgcacgcagggctccccgatggaccggcccaagatgtcggaggtggtgaggatgctggagggcgatggcctcgcggagcggtgggaggagtggcagaaggtggaggtggtccggcaggaggcggagctggccccccgccacaacgactggatcgtcgactcgacctacaatctccgggcaatggagctgtccggcccgaggtaaaagaaacgaaagacaaaatcacaaagcatccaacctttgctcgacggcttcctcgcccttgtttgtgtatatgacagacagatcgatagctggcaaatctggagggaaaaatggtttacttgtaaccctccctggtgcctcggtaattttcaagtaggctctgcacttggttgtcgttagaaatgcatggccgggcggaattgcaacacattgttgtggcggctctgcgtctgtaatggctgaacaactgatgcctctctctctgctgtattgtacgtacaactctctcttttgacggtgctaaacatcctaggcaatcttttttggtctcccgggtcacaccgtgtccgcctgtactttgttactcttcgttgaaaaactatactggtagcaaactcaactctttatctgaaaaaaacaaggtccatggcatatgcaacggctgatacggacgagctggtgtattgaggttgcaggctggatcaatgatcatgcagccgtgcaggttgcctgtgtgcgctctctcatggtgtcatgcatgcgagtgccagagtgccagaccatcaccagaaccgctacacataaacaaatccactgctgcctgacacggtgttcagccagcgtcccgttttttcggcattttctgcctcccgattagccatacaaaccgttagtgttctgcatcagagaacgccagaacggcctaaatattaggccataccaacaaaggaacaaaatgatcgacaaaagttcacgcccaggttaattacgtactctaccaaggacagccaaaagtgcaaaactataactagccaaaacaaaagtgcaaaagaaagggacgagagctagtgcagcaagcgtgctcgcgtagatgctggccggcagcctacctgcccacacgcgtgctagggcctaggagtacaaaatacaacgcggcattagaaaatcctctctctacctatccacccatcaacgtgtcggcgtcgcacgcacgggcgcacggccgcgcgacgcgaactcggctggctagagggtgggcacgcggaagaacctgccgcggcacatgcagcggtacgcgacggggcacgactccgcggcctcggcgcaccggaggctcaccatcacgcgccggcacggggagcacggcccgcacgcgtgcgtgcagtccggcagccgcgatcccgtcgccgcctccgccgcgttgcccatctccgtcgtcgtctcttcctccggctgtgcgccctgctgcacctggaacgtcgccgtctggccgccggtgcctctgtcgtcgtaggcggtggtggtgctcccgttcgcagcagcagcagatggagccgtgccgccgttgtgtaggccaccggctgaaccttgcacacctgctgcattacgtatacataaaaacgtagtacgtacataatgaacgaaatgtgggcacaagttaaatgcaggtgattcaggccgtgaagggacatgccacatgatgcatccgccgtacgacgtgccatctttactagtagtgcacactacacaggagtagcactaaaagcttactacatgaacacgtgtattcctagtcagattagtacgtactccagtgggaagctctggtgaattacctggtatcgtcctgacgccatcagcaacgcacgagctcatcacgaccactgcaaacgctagcgccatggcactaaacctcctcattgccgccggtgaatccgtcactaaagcaccaacgcgaagttggagcagctagctgatcagcacaagcacaagatcgatcgacacgccaagcagagagagcagtcagcgacagtgagcacgcaagcaaggagaggctcagcgcgaggcgaacgtatatatggccggctgccgacccgcgagcgctcgccgcgtgcgtgcgagaacgagcgcgcgatcataaataaaccccactgcggcggcatgcacgcgctggctcacaggatcctcgacgttggtggatccaccacacgcagcccgtgcgcggctgcgcgcgcgcgaggcccaaagagcggacacgaagaagacgacgagggaaggaggtagcgatgcgtgtgacgggcagcaatggcgaagccccgctgcggcgcccggtgcattatttatgcagcggcgcagggagacgctgttgttataattgcggcacctcggagaggagcaccgcaccggcgagagatcagctactacgcactatacgtcagaagaggccgacgtgggggttcccgtggagatgcattactgtacctgccgctgctactgtttctgaagaactgaaattctgatcgcgagctcaaaaaagttttgctgcctcgtgctttcgacgatgtgcaaaactgcaagtctgtagctctagtcagactgccccgtcaccgttctcatcaatgcgcgcctgcaaatccgttgttgcagttaagagatgtactccaataaatgaagctccaaggtttttgcccatggatatcagaattggattgattgttcgtgctttgcttcttcagtcagaagtattagcttcttcagtttagaatatgggatatgaactgaaactgaaactttctttgcttctaaaagaacagagcctaggagtattagctttcatgacctgatctgacctctttgtgtgatctgtcatatgttttgggcctttggctttggtacaatctataggtagactggagttttgtactccatccggactgcgttttggagaagcagaggtactatcgtcatcatcctttgcatgagatttgggtcatggatgcatggagggtgagtttttgaatgaagaggcaggcatttctggcattgcctcctcttcaataatggggttcactgaaaggccgaggggaggcttgaatgcctctgctatctggacaattgtgctgctgaatccttattatgctgctttttgcagacctgaaatctgcactttcatgtaaaggaggacggaagaacagtatacagttctctgaactttgttggcccaaaggtgcaaaatcaggaagatttcaccccctcggtgtgatagcatgtaacggttcacccaatgaaatatatgtaagtatgtttttccagcgaagaaagtttaatagaggaagaggacgaaatcatgcggttttcctaaactttcagttgatgaaggattcctgtgttctgttttcattgattataaaacttttgcgtaatatgtcaagccggatccgtggcgcaatggtagcgcgtctgactccagatcagaaggttgcgtgttcgattcacgtcggtttcaataccccgaaccaagccgggattatttttttcacctgtgtacatttatatttaggctacccataatttgttgatgcctttccatgatagcagtttgtttgatcttttttttccctgtacaaaccccaatccaaatttgaattatgttttgcccagcacaatttatttagtctatccaca

SEQ ID NO: 42638 - DNA, 4770 bp, Oryza sativa
taattattttttgtccctgtacaatatattcagggtgttgacgtctttttatgatagcagtttgttgatcattttattttgcccatgtacaaacccctatccaaatccggattatgttttgccctttacaatttatttaggatatccacaaatgttgatgtcctttcatgatatatataacttttcatgcatgacaacaatttcttgattattttttgccgctgtaaaatttatttagtgtatccacaatatgttgtttattatttttttgctcctatacaatctacgtaaggatttgttgaagtcttttcgactcatcatcctcaatttgttgatgtgtatgatcgtggtcaaaacaacctttcttttgttgttgcttatagggtgtgtttagttcacgctaaaattagaagtttggttgaaattgaaacgatgtgacgaaaaagttagaagtttgtgtgtgcagaaaaattttgatgtgatgaaaaagttggaagtttgaagaaaaagtttgtaactaaacttggccatagtcatttttgtctctatccttgttcatgaaagatgacatagatctgatgtgatacgtccaatctcttcccatcaactcttcccattttggctgaattcaaacatattttacaaaattcagaacttgtcccaaattttggaaataatagtcattcatttttttccaaaaaaatagttgattttttttgtaaatttttttgatttctacaatttgggacagcttttaaaattgtacaaagtgtttaaaatcagccacaagtttttcaaatttaaattcggtaaggttctccaagggtaaaaatcgtctttaatgtcatgaatgaattttgccaactaactttaagcgtgaaccatgtgagttgttgaggggaaaaaaaggtaagttcgatttgctactcttaaccatcgtaaatatctgatttattcccctaaactataataccagtggcggtgacctccttcccacaggttctccacctccaactcggtgtagcccatgccatagattgttgttagcttgatgtcgcaactctcctctctctgccgccatatcggcacaatagttctttactcagcaatacatcctctctctcgaaggtgacggaccaggtggacgatcccaacggcactattccttagcgagctcaatgataggggacctatgtgttcctctgccgcttgattgagagagaaatacataaagaaacaataaataagggaattccagcggaagaagaaatggcacttgtgtaatttactgactgaattgacacgtgtgtgtcacgtagaataaaaaaccactctcaactaagttgaggtaattccagtggcagagctaggcattttgtgaaccgctaccagacatattaaacagttaaaaaaacaaaaaaaattattatagaagtggactgttagtatgcctggtctcctgcattgatgcttaaacgctgcttaattcacataactaatttttccggcataaagtgcatgcacaaatagacgatatccaccgaacttgcatgcacgcaccagcaagaatcaagaacccatcttgctccactgaaatacattactagatgaggtgattaactgacactttgccaaaaaagcagcaaatcaacacacataaatcactcgaatctcaatggatcgcacgctgagcctaggcaactgcccacctagccgggcggtgaattcatcgctgggtaattcattcggtgtaagagcttagagggtgtaaaatatttggtattggagttgagagaggtaattcatccttttacgaaactagtgttgatgtttgctaagactactagactacgctagttttttctaaggaaaattaatggtaaaatacattgtgtttgactttttaaatcttggaggtgttactttaatcaataatttatggctaattttgctacaggacacttaaattttgtgtaatttgctaggatacatcgtaaaaatatttcatggctgaaagacatcaagtctagtaatttgctgaaggacagtttcaactcaattgaagtgagaaattcttcaaaaggacaagaatgccctagagagtcaaaaccttttgagctgaggctggagtgaagatgaaatacgatgtatgctagtgatgtacttgggatgatgacaaatttagagttgcataatttctaaattttcactctaacgtcatgtttaaagcatgtggtcttatatacattctcgtctttcttaagaatttatctctttaattgagccaaaaatggcctctagcaaaacaccagttttttaaggtgtctcttagacatgacacatttttcgatgtctatcagcaaattgcacgaattttaggtattctgtagcaaagtttgccataatttatactctctttatctcaaaacaagtctacgttcgtatatgaatctgaatatagcacatgtccagatttatatataaaagtgaacttatctcatatatgtagtattaaaataactttataaaatacaatacggttagatatttggtaaaatattagtacattcttaagtacaatattacatacgcctgagtatatactccctctgtccaattttaagtgtaaccatgagttttcgtgttcatctttaatcgtgtgtcttatttaaaaattttttataattagtattttttgttgttacgagaggataaaacatgaacagtactgtacttgtgacttatgtttttaaatgttttttaaaaatttttaaataagacagacgattaaaattggacgcgaaaaaacattgatgcactagaaaataggacggatggagtagtgccgtagagatttgccgttgcttctaatctctttcgcaacgtgttagtggtcgtacttaaggggggtgtgtgtggtttgcgagttgtataggtcttccatctaatcggagaaaaaagaaatgtgccttttttactatacaacgtccaatggtctgacactcttgactgtgtgacagtgtgtgcggcttccagctctcttggcaaatccttccaccattccacgcgattttctcggctcggcagtcggcacccgccatctcccgcgcggcagcgccccgcccgcccatgaacggtagtatatgctccgtgttctcctctccttccctcactctcactctcgatcgctagcccccgcgcgcgcgcgcgcgcgggagcaacggataccaattcgccaagctttttgctcttctttttgtttctcactgtgaccactgttaccgccagctcgacgccttcacaaatgggcggccaccgcgcggctggtgctcctcctcttagccgctgctgcggcggcggcggcggcggcggcggggcgcagggaggtggtgacctcgccgcacggcgccgtggcggcggacgacgggcggtgctcgaggatcgggcgcgacgcgctccgcgacggcggtaacgccgtggacgccgccgtcgccgcgtcgctctgcctcggcgtcgtcagcccggcgtccagcggggtcggcggcggcgccttcatgctcgtccggctcgccgacggcaccgccctcgcgtacgactcccgcgagaccgcccccctcgccgcctcccaggtcagcgcgattccgatcctcccaatcactcgcgtacggtagcgtacaatccggtgtagtcaaagccggcgacttcacttacgtttacgctattcaattacatatggttttctagataatgagttcaatcacatgattcccgactgattacgatgttctaaccactcaacacgatatttaaatggttctaaaccttcagcaatgctgactgaactgaagaattttatgatatcttattacttggatatatatttctctttatctgtcacaacttatcagtaaattaatcaactcgagagcagtcattttccaatccttgttaaaaagcacaagacttggccgaggtctccaggtcgtctgattgatctgtagaaaatgcatggagtaacaattagtcatgccaaatgttactgcttatgctaccactatccgtactagtccactaagccagtgggtagttggttgattcacatggtacttgttgcttcctgatttccttttcttttcctctcttttatgaaaaacgaatgcttctggacctgttctattctattctatcacaacaaattaaacagaaaacacagaaaagggcatgagttaattgacttagatgcacccccccccccctgatagctagcataattggggatttattagtcatgttgcttcagtggcggatgtgccatggagtgacgggaagaacaatgagcataacgagccatgtggctggaaacatatccttgtaggtgaagtctgtacatgccctagtggtgccatctactatgccggtccttgtcttggttcgcctctcatcctgttgaatgtgtctcacgctatcgtccactagccgtctgccccctacatttcgcaccattcatggctggtccagcccgaattctgggaaagccaaatggaatccgagttagggatagcgcctcatgcagcgatacaatcacgtcaatatcagttcgtgttgcttttgcgagggcatgtgcagcattgtagaagcgagaaatctgcctgccagtcgttgatcagtgagagaaaatacacaccaagctgttaactgatcaaacacatgccacgtattgccatgtatttttcagaaaacataattagaaaacgaaattgctaaatggca

SEQ ID NO: 42639 - DNA, 11077 bp, Oryza sativa
gtagccattagttgacatgcaataaacgggtggacgtccactcgagctattagaatccatccccccagtatcagcgatgacccgcgacaagttagggttggatcctaggttgggatgggggtgggaaggggtatggggatgggaggcagcggcctgcggcttggcggttggtggtggacatgtgagggtggcgaggcaccaccggcggcggcaccgaagccgtggggatggaggaaggcgatgggccagctttggtgacggggcaaagcaaagtgaatgcttaggagagtggtaggtggtggcagattcggtggcagggagtcacgagagacaggaaagatggcggatgaggacacacctcatcactactggcttgaggaggagatcgtttggggaggcctcaccgaagccttctgggcttccagctaggtggcgatggcaacgaagggggtggggtggagttctagtcatgtgcgatggtggtggattgggaagagggagggttagggttggggagaacgacacgaatcttaaagtaattcaatggcctacaattcgaaagatttaggagagtgttggtcgcatggtttaagttaatctaaatgggttttaatggtaagcagaagaaaaaatgttttatatactcgccaagccttgaactaagtgtgtcaatttgagtattgaagtactacttagaaaacaaagcagaaaacaaagcaccaccctaacttttgttaggaaatataagagatatctaggagaacctaatcgtttaaaataaaaaaaaatgttgctctaatttgatccaaagaagactggaaccgaagtggcagaaaattaggagggtatatccacaagcaatcaagtatccatagtaaaaagaattgtcctaattaattttcttttactggtattatcatgctccattctaaacaaacagagttaacgctagaaatgtcaattgtgcattcaggatatgtatggtggcaacgaaacgctgaaagcaaggggagctctatccatagcagttccaggggaaattgcaggtctgtatgaggcatggaagcgccatggcaagcttccttggaagaggttagtgatgccagcagcaaagcttgcccgtgcattcagagtgtcaccttatctgaggaagcagatggaggcaaccagagatggaattctccaaaataagggaataagtggagtgtacacctcaaatggagatatccttaatgttggagatgtatgccgcaacattaggcttgcaagaacactggtggctgtcgcggagaaagggccggatgtgttctacaaaggcgcagttggtgatcagctggcgaaggatattcaggaagttggagggatcataacaatggaagatctgaagaaataccaagttaagatacgtcggccacttttagagaatgtattgggactgacagtattaagcatgcctcctccttcagctggtggtgctgggctaatgcttgtaagtttttctttgtactaaattttgttcactgttctttggtagcttaagtttgttgatttcaggtagcaaatttaattagtagaatcaactctatcggataatagaacctttaaaaaaatcttaatcttttctgcactagtattatcattttatcttgatacccttgctcaacaaacaggttctgaatatccttactcagtatggcctccctgctggtttttctggctcacttgggatccatcgtctaattgagtccttgaagcattactttgcaataaggatgaaccttggcgaccctgagtttgtaaatgttaacgaagtcgtctctgatatgatgtcccctaaatttgctgctgacctgaagaaaaccatctatgataacatgacatttgaccctaaacactatggtggcaggtaaagcttctcttttgtgcacaaatatgtcttccttttcaagtagaactgtcagcaaagtcctattaaattcctgcatatactagtatactactattactggtgaactaatttagtaatctgcattattacaggtggaacatccttcaggaccatggaacaagccacctgtccatcgtcgacagcgagaggaacgccgtttcgatgaccaccactgtcaacgcgtactttggatccctgatcctgtctccgagcacaggcattttgctcaacaacgagatggacgacttctccatgccggcgaacacgtcggccaactctccgccgcctgcccccgccaatttcgttaggcctctgaaacggcctctctcctcgatgactccgacgataatactcaaggtgaccaccacctcgcgcaatggaaaataacacgaactctcaactctgaagaaagttcatttgaaatgtctgaaaagttcagtcttctgaagatggttttttttgttctgattggtttgtgctttatctgtcgtaggatggcaatctgaaggctgcggttggagctagtggtgggagcatgatccctgctggaaccatggaagtgctcctcaaccatttcgtcaagaacatggacccgttgtcctctgtcatggcgccaagagtgtatcaccaggtgatctgggcttaacgtctgccttttcttctcttcgtagaaattcttctttctgatgagctttggtttgattcttgccatggctgtttgccctctctggctggctgcagctgatcccgaacgtggtccagtacgagaactggacgacggtgaccggcgaccacttcgagctggacgccgcgacgagagccgacctgcggaggaaaggccacgtcttggagccgctcgccggagggaccatcagccagctcgtcgtggacgacgtcgagcgccacggcggtctgaccgccgtcagcgaccccaggaaaggcggcttcccggccggctattagaccggagtggctgagctatagctgcctagctttgatgcagcgatgattgcttgctgcgccattcatggacatatttgtacacgtcgttctgttctatgattctatcgaataaataatactccctcagcttataaaatgttttaactttgatcaaacttaaactgcttcaaatttaactactccatccgttttacaatgtaagtcattctattatttcctatattcatattgatgctaatgaatctagacatatatacctatctagattcattagtatcaatatgaatgtgaaaaatgctagaatgacttacattgtgaaacggaaaaaatagtttatagacaaatatagaaatatttataaacttggtcaaacttgaagcagtttgattttgattaaattcagaatattttataacttaaaacggatggagtaataactgcagtgaattttaaatttttgtttgaaattgttagcgatcatccgtgcaaaataagctactccagtactgttttgtggacacgtttgtcacgtgacacgtcacggtgcgtttgggatattgagatggcccagatatcccatgactactaaggcctggactggacgtggctaagtggttgctcctagtccgtggcctgtgggtttacggcccacttgaatcagaattggcctgcgccggatttggggtttggcacgtactgtttttttttcttttttttagacacactacaaacgcaacaaacgcagacactcaacttaaaaaaaataataataagcagtaaatacaagtattggtgttaagtctaagacttaaacctaggtgaactgatttccccataagaaacttaatcacttgagttatgttaaatttacaaacctcatgctcatagcaggaggaaggaaaaaaaatagcgaatcgtaggagataccacgcgtacatgcatgtgtgcggctgtcgtctgtgagactgtgacccgtgttgatcatggtcggcggcggcggcggcggcgtgccggcactggcaacgtcgagagccactgtgtcactggtcgccgatcgatggaaacgcatggctaggactcatgagaaaatcaagttatctcctgtgttatctaaaaaaaaaagagaaattcaagtttcaaatcctgcgtagaaggagcaaggaggagggcacggacgagacgagagtgagtgaccggagagcgccggcaggcgatcgatcggtgtggagcgttacttccgaagagtggcagctgctatcacaatccgtcgatggtggctcagttaggtacacaaggaagcactgatttgaacatttcatatacgcattgtttcgatccatgtcgactcacaccccactaattaatctattgctagtacaagctagtacttgacttcaacagctaccaaacatgccagttaatttacttgtgacgtatcgctgggaagttaatttttcatcagttctcacgccgggtcaaggctctccctatcggtctcagcgtgcctgtgttgtgtacgtgtcatggcaacgggcaatggaattcatgcaccaacccaaaatcgagagagcaagagagttacacgccgtttacctgctagctaaccaagactccgactcttctattagtacctacacatatggcagtgagactctctctagtaattacagtaagacacacttctcagaaaagaagtacagagcttgcccagagagaaagagagaggtgaagatggaatccatggtagcaggagacctcgtacaggcctacgtgttgaagaaagcctgcaaggagaagatgagggccgaaacaaacgccggcgaggcagcggcggcggcgatgacaggaaagaagacggcggtgggcggtggatcgtccgaaaagaagacggcgcctgaggttagcaagggagaacgccggggattctctgggctgatgatgatgaagaagaaggtgcacccgaagtaagctagcagatcgaactagctagctatcttcaaaccaccactgattgcagatttgcagggcttggtcatcactcgtcagtggcacatagttgttgctaggttgtttttgctctaaattaagcctgtaaaactgttctcgtgtttccttgtttcgctcttaaggagtgcaagtgtataattatggcaatacatgaaggcatgaaccagcaaatttcttggttactttgcaaaatgttgtggaatgttttagtaattttctcggagaaggaaaatgggttttaaggggctgttcaaattgatgtcatttttaatcataccattttttttctgacatagttgctaaaaatatctctacgtttagtttgttgccaaactttagtaaatacatagaaaatcttttggtaaaattttgataatattactaacttaccaaaattttagcaatatttattttagttacaatttgaatagaccctaaaaaatcttcaacacggaagatcctgacttctaaagaaggacatatcattagttacagttcacaagctaacaaaaattgcagcgtacgtgccggccattcagcaagctgcacaaagcttacgacaagccaagggacggtaacagcagcttacctaagtacctcgtgttacttaaagacacaaaacaaatattctagtaccctaaactcctaatctccttttcacctgagttctggaggatttcacgagcatcaaactgcattctgtatccggccgctcttcgtgctgtggtatactgtcctgtctgtgtaagcggacaaatagcactttgggccataagttgggctagctgtgccacgctactttatgggattctttatattgggcctaagtctccttgctaaagaaactatccaatttgattccctcaactataggttgagtctaattcatatccctcacctgcaaaatcaggtataacaacacctccaactattaaaacaagtgcaaaatgattacctcgataatattgatggtagttttcattgacgtgacacattgacatagtcttcatcctacgtgtcaattttacaagaaaaaaaaccatgggaccacatgtcagtcactagggaaaaaaattgcggtgccacttgttagccattcctcctctcttctctctcgtcccatgtaaatggaggggtgatggcgaggagtcatgcagaagtaggcctctaaagcaacggcggaggacagcaggttaacctagtctcaggatgaggagaagaagagcacgatgtggaggagggaagaggagcagcatcgctacgctcagtaaggaggtggcccgcacaaggaggaacaacggtggccatcctcgtcattgttgccaacctgccatcatcgctgctggcctcttcgttctctttcctcgtcagcctgtaagagaggagggtgtgaaggtagaggagagaggggaagagaggaaagagatggggtagcgctcacttacctagccaccgctagccagcactggcaggaggagcgcaacgtgatgatgttcgcaaggaggagcacgtgctaacggcagctactgtcctcttgcctcgagcctgggtggccgcctctgtgctattttcttgatttcgttgaagatttggtacgaaacatgaatgcccgattcattgatttgttgaagttttggcgtggttgcagatggcggtcctatccgtgctagtgcacgtgaacatgacgattgtgggagaggagtgggtcagggtatgtcagggtgcttacaagcactgcttttaggtggctccatagacacgtgcaccttgcactacaaaccgacccgcgtgcaggccagcaatgatgctcgagctcactgatattccatcagtgtgctcatgaaaatagataggagggtgtcctttgtgcgatgtcccaaccgaatcaattcaatggttagggtggtgacaagatctgggtgaacgaccgatctacaactctcatttaatctccaacattatctttgtggttttcgtcagccgctatgtcagcgaaattcgaccggtataaatgttatacggaggtactgtttttttatttgaggaagacaagaactatatatataacttgcaagctatggggataaataacggttgtgtatatttttgtcaactatagattaagcttatctttatctttaggctggtaatctaagtaaatttcttgttttcaattaagctatgattttataatacaaattaatttaacatgaaatgtttttaataactagttatagtttctttaaagtaaaggacgaaatgattttcattatcaaaagcaattcatcttgaccaacttccctcctgatatgcatactcgggcatatactataggaggaagggaaaaaaaacagggccggattttttttactccttttttcatgatgcatttttctttatccacgatcatcaagtgcgcggtgtgcatgctaattagctactactactaattattgtttcagtacgtagtagtactagacagtttgcatttgtacatcattagtcgtttcttgatcatggccgccgtattgttgccgcagcgcaggcacagcctcctttgctggagaagacgacgacgaggcctccttattctttccccacagtacgaaatacagcccaatgattaccagagcagatcctatcacactgcatatatgtatatatgcacatgattaatgccaatcaatttatactagtaattagacatgatcgatcgatgtgatgagcgtaactaacgtacgtacattccaagatggagttgctcatggagaacgatgacgttgatagcagctgcgatgatctggatgaggggcgtgaacgccgtcgtgaacacaggccctctctgctccacgcaccatgacatcgccaagaacgctattcctgatccaactatcccctgcatttatattcatatcatactacaaaacgctataatgttgaatactatacagtttacgttactgacattagcatgatatctaggtatatcatgtgtatattatgtctgctacctgacgccagtaaatcaagtattccgttggaaagtaacgggtataggcttcccctactcgtcctccattcatatcgatcacaattactgtagcaattactactaactaattaaggtgtatatatcaattaaacgtaccacaaagagcacggtgatgatctgaagcttcgttgttaagatccatggggataagctaattctgtcgacggccaacgcgactgcagccatctgaaggaagctgagcaggaacatcagggcagtgcccgagtagagcgccgggtacttcttggcgatcctcgactgcaggatgaaccacagggaccagcaagctgaaccgcccagcagcgccaccgacccgatcgcccacctgtgcgcgccgccgccgctgccatgaccgacgactgccgccgttgcagaagaagaagatgatgacgatgatgatcgagcagcagcaggtcctagcttggtgagcgatggaccctggtagagagcgaggatcatcgctccgctgaatcctaacactgtgcctcccacttttgctatgccagctcctgtcttcaggtccactttctccagcctgcactagtactagcttagcttacatctttccgaggaagtgatttcatgcatgccacctaaatagttataatttttttaaaaaaattgtcatctatattgctaattttttttaaaaaaattaatatctattttgatgacatgcaaacaacgaaaggatgtctccttgaggaataaaaatccacatcccatctttcaaatatttcttcttctttagtactactcctaagtagttactccctccattccaaaatatcactctgtccaaatttatagtattaggatatgtctcatccggttctagattactatattctaaaacgagggagtagttaggttgttaattgcgtacccataaggcagtgctacaatgaaagtgaagatgggagtcatgttgatgaaggcgcaagcgaatgttgctgtggtgtactgcagccccaagaagaagagccattgggtaagggacgctctgcatgcaccattttattattattaattactatgtaattaatcaattcatttgttagagaaaagaatatatatcgatctttcaattcatcaagttaaaattgctagctactactagatatattatacatatatgaaaatgacttgcccgagcactgcactgaagaagagacacaccaagatttcagccgtaagctttggtcttgtcttcctgcatgcatatttggcacatacgtatcaaccaactagtaattaatacacatatatatggtactatacagctgctagctagcaatatatagtagtaccaatactaatcgattaacgcatatatacgaaattaaaacctatcaattaactgatatgcatcggactaaacgaataactgccatttatacaaaacacttatcctgagcacactcaagggaaccatagataggtaagtgaaatccaattcatgaaataatttaatccatggacggcaccattgtggtaaaggtcgtaattcaagtgaatcaaaaagaattaagtgtatatttacctctcccggaagtaggcgattggggcgaggaagagagtggcgatgagctgacggagcgtgatgaggacggtggagcgcatcccctcgttgaaggccatcttggtgagggtgttcatcaccgcgaacaccaccaccaccccaaccattgtcaacgttggcttccaactattacagctacccattaattcaggatctcttgaccataatcttctttttatctggctagagcttagctatacctatctgcaaatgtatatgtgtgcttgctaatgttgctttcgccttgctatatggcatcaagcatgctgctggtggcaacaatttatatgcatgcctggcctccaagtgacaatttgacaatattccgttccttgctttactacatatatcaacatatatcgcgcggtacgtacgtatttctgcattgctttaattatgtgcactcaattagaaggatgccaataagatattatagtattaattagccttactttcttacaccactcaagttgaacaacttatcatcttcatgcccaaaaatatttttttaagaaaaagatagaggaagaatttgttcatcagctttatatatgcattttctctttaaaaaaaaaagaaaagaagaatgagaaggttggatgcttggctggcatggaaaataggacaaggtacgcgtttagattacataacaaggagtaatatatgtatgtcaaagacagtagtaatgatgatgagattttcaggtattgtttggtgccacatactgtagtatagttagtattatatataaatcatatcttcaggttagtagtaatgatgatgagatcttcaggtctgttcttttctccttccttattagatcgatcatatctagctacctagtagtgattaattaatttgtcgtgcagttttaatttgatcacagggagagagatgctggctgcatatatatatatatatatttatcaaagctggcaacatgtataactttatagggattaaaaaacatttttattctgaaagaaaatgagatagatgctttaatttctttggtgcgtcatccgttgttggtcagcaaggtgactaggagggaagggggaaaaaggttaaagctgacttatagtatatgccccaacaaggaaaagaatgatcattaaaaaaacaaacattaagatggaacaaatatatatagcaattaaactatataaatcagataccatgcatagctgggcctctcctctcagctagagcatccgatgctccattgaatactagtagaacattcaatgcacgtacgcatgaaggaattgatccgatgtgtcatttttgccggatggaacacatgggctggccgggcgaccaatttatgttactaacaattaagtttttctaaggatggcacgtcattgtataaggagatactaacacaattatgttactttagtcttcttcagggcatcttaattaattactctaaatattattttcttccgctggaattcttccgtttgcaagcgaaagcaaccgtgtcacacgctgtcacttcgtaccggccatactcata

SEQ ID NO: 42640 - DNA, 17358 bp, Oryza sativa
cctatgtaagattcgatcgaagtggaaggtactgagatatgctggtagccgacactgacaattaatggtttgcaaagcaaaggcattcgatccttgacgttctatgtctctcttgatcgagttaattcgataaatttcaaatcttttttttcccttttgtatgcgggccttgtaatcatcgtatgaatatttttcaattgtttggaatcaaacgatggatggatggagagtatatgtacttctagctagccctttattttagttttccccttaatttcgcaaaaaaaaaaaaggcagagaagaggaagaagaacaagtatatattccatttgtctaaatatttaacgttacgaggaacatataataaaacttccagaactttgacatcaataattctcaaatattcaagttctttttaaaaagtgatatatgtatatttggcttaatattttaaacatattatattttataaagttaataataaaaagtaatagttggagcaattgaatcttattttaaattatatatatttataatcaaatcatatcttatactaaacgtcaaatgttagttaaatactgcatgcaattaatccgtgcgtatatgcataagttagctcatatatatatatatatatatatatatatatatatatatatatatatatatatatatatatatatatatatatatatatatatatatatatagtgaaagagcatgtagtctagtggttgtagtgatctgagtaacaccctgtttcataagttcaaatctttggctaagttccatgtttaataggttaaattcctactccctccatttcataatataagagagataattggtgaatgtgatcacatcctagtgtaagggagtaatttaaaatggctgcataatatatccggttggatataaaggccgaaaaaaaaaacccttccaaaaaaatagttatatataggaggatactgtatcactggagtatgcacgtacgtatgcagtgcactgtttgactgacgtactataaggtaggaggactaacgaatattgatcttcatcgaccattcttcttatcagtattcgttcgttcgttcatttatttgtcatcgatgatatgatccatccatcattccatcttcaaccgattcaattctcatcttccctttcacaaaagaaaccgaccgacagacagagaataactagtccacgtctctgcatagtgtatactcctgctcccgtggatctgatcttcttcctcaatcgtcaattcgtcagcatactgctcgcttactatatatgacgaatcattctgcccggggtttgataaaataaatctacatcctattattaattcaagatctacagattattaaattttagcatattttgttttaacaaaaagtagcacattgtgtgtacattaaaggaaattatatcattttctagatatttttttaatttctacataaatttattatagcttttgatcccacggtgtcctttttccttcctaaatagtaggaagttggtggtggggttgtaagatcaaaaaaaaaccgagcttaccatagggaggtgaaaagtgataacattagcagaagtcaaataaccaaacttcgatagataaaaaactcaccccaaccttaaaaaccaaaagatcaaactttgacactctaaccggatctgtacgggtggctaatcgggcttagaactggtttgactgaagtacaattactagttcgatcgtcagattaaaaagaaccttacatcacttgtgtaaaatcttgttttctctaaaaccagccattagatcgagctctaatcttgacaggaaactaagagacaaatctatcgaagggtcatgcaaaagtaataaacggtttaagagaaaacatctcaaaagctagacgtctcagaaatttcatcaaatatgaataaaacataaattttaagcaaattcgagtcaagcaaataccaatgaaaccttttagatctgatctataatataatagaaatgtttcgggtggattaacttgaacaaaaccataacaaaactgaagaatcacaaattaatgccaaaaacgaaaaaaataaagattacaaaaccagtaaaagatcgttgacgccttgttgattgaatatgatatttctttttcaagtagtattcataagacggtcattgcacctctcacgaatttctcacataaccctaacacaaagagtagtaaactctttaatctctcaattgtggcttaccctcaatgcatagcctcccttattcacatctaattacaaaatcaaactaaactccaactctcttgaacttggactccaatccaaattcaacttatccatacgcacacaattccccttgtcacctccatgtgcattattctctagccttggtatccacatgatctccttgatcttctagaactcaacttctaccaagtctagtcttgatccatcatcggcaatactctcgtgacctcaagcaacagctacacgttaacaaacaaagaaaccatatttgagcacaagatcttccccaatttgactcacatatatctcacgtatagaaaccatctaaaagtcataaacatttagcaatcaacatattcgatagaatcaacccaaaactgattcatcaggagtttgccggtctaagtgctccctcccatggcagtcagatcgctggccccatggtggtgagaccactcttgccatgaaacttcgccaaattcaacatcacttcacaaacatcagctcaatcacttttttatcactcttaataattctttatcaccagaatcaaatcaacaccttaatttaataagggtggtgataaattcaccactcaccaccaccgctactctcttttaaaaagagttagaatagattactaattctctgcagttgtgatagttcaatccagttgaccaactataagatgtttttgattaattggggagtttcttttcagagatcccaactagtatacaaacaatatgagaagggctacaatgttttccaaaaataaaaaaaacacaaatcgcaacgcacaagggtcaattactcttttagacggtgcccatatagaaagcccaccgggcttgctttcaaccgtcatgtgggctaatgttggatttaagtatcaggctttaatgtttgatgttaatcacatggcaaatcggtgatgcaagtgtagctcaactggttatgtttttcttgtggtggaatcaacccacctgagttttagtcctatacttaacatcgatgctcatatttacatctaattattctttcgatggtaggtggctgtcggtgacacgggaccaggagtaccatgactagaggcttgaggcagacataatcgcccacgtggcctggcaccctcgggggacgtcgggcccgagggtgacgtgttcgccctcctcttagtctccccaagggggtcgggccactcccgcctcggccccgagggccgaagcgccccgacccctcgtggtttctcctccgcgtgtatgggttaggtgagcacagcggggctcacctaaccgcatttattgcggtttggttgaacctgtcatgccgcatgtaacgcagtgcagtgcgctcgtttatccggtctgtgacaggtcacagaccggtcagatcgcggtcaggtcgcgacaggcggtctgacgcacgcctcgccccatcccgtcaggacgagggcttctaggcgctcgttcccagacggagctagcgtgttacctcttagagatggcacgttagtcccggttagatatatgccaggcttcattctaaccattacagacaagatgttgtgtgaagaagggcaaacatgcatattgctaagctgacgcgtggtggacaagaatgaccgatttgtgaccagtctgacactgatcatgtcgtcagcagacagccacgtttcccacgtcgcacctgcctccggcggaagtggaggtaggtatgtgccgtcccatcagaagatcattcggacagcaatgatacaaatctccgtccatttatgaagagagggcaagtccagtttggaaagggagagagggtgcatgtggtatccccttaagatataaaaggaggaccttgcccactaagagagagggacgggactctggtagattgagaacggagagcaacggagactctggttcatactttgtagctccttcatacacagatccaccaaaaacacaggagtagggtcttacgcatttcagcggcccgaacctgtatacatcgcctgtgcctcgtgtgctctttcgactctcgcgaacattgtacacacagagagcttaggatttcaccctgagcccccggtcgaaccggcaaaggggggcctgcgcggtctcccggtgaggagccccgcgctccgtcagtggcatacctattgacaacgaagtgcccgtgtggtgatcgacaccttcattaatctcaagatatgttggtctaatattttaggggtgttaatagggatagggtgtgcgtgagttttttcgaggtgttcatatggatatataatgtgtatatgtgttcctatagggtgagtgtgtgcgcattgtgagtacttgtatttgtactgtgtttaaaaagaatcatattttagaggtgttcgtaggaataggatgtggtgaatcttttagaggtattcttagccatatggtgtacttgtgtgcccgtggtgatgggcacctttgtcgatctaaagatatattgattcagtctgttggtaaaatgggaactgtaatacccatttacctggtaaaagcattattatcaaataaatagtatgctcagaatgtccttaaaaataaaaaaggaaaccctagggtggcgtagctaggggcccactccggagggccccaggcccacctaaaatttcatacatggggttcactccggctgaggaggaatattgagtgtatggcccaaaactctgagtatcaaagcagcttggggcctagcttgggtcccaagcataccctaaagtatataccttaagaatgtaacctaaggtctgcccggggcccgatcccattccgggccctaggctcaccctagtcctcgcaggttctacggttcccggcaagaggagtgtaaaacatgcaagacctatatgccttaagaggataaactatggtctgcctcgggcccggccaagtcctgggcctcaggctcaccttaatccttacaagtcacgcattactcaaggaagaggggtgacggggcttgccaagcataaaggcgtaaaccaaggtgtgcttcgggccccgagctcaacttggaccttgtatagcttgcgttcctctgcttagagggttgtccaaaggtacaagacgcacaatcttaagatattcttccatcaacaacgccttcgagaagctcctcacggaataattaaccttctttaagtgcgacagggcgcgatctcagaaacttccaggaagttggccgtgctccacagccaactataaggtagcacgccccgccataaatgaaacaggtttatggggggattcccgaccagtctgagttgaaaggacgtagacaagacgccagagctaagtcactttggacggtggcgcctgggacacgcgtcgcacatgccccatgccacttcatttagccaaatagacagataagtactgtggccttgtttcgggcaagtcgggcctcgtcgagcccaccacgcaccacgtggtgagcacactggcgaaagctcaactatttcagacgaagcccgggagcccggggtaatatgaactgtaagacttgaacggtttcttggggctgcgttatgacaccggctggcaatgacaagacggttgatgagacaagactaagagtagatttgtaataatgtgagcccctctttggactataaaaggaaggggactagatacagatgaagggttggattcttctaggccaaatctattgctttgtagccgaagaaggcctccttcgtacttagttgatctagagaaaaagaacgaacaccaacacagaagtaaggtattacatcttcgaatggcctgaacctatataacctcctgcctcctcctcgcggggtggtcagaccccatgaatccaccgcgatcgcagataccatgaaccgtacgccgactaaccccctggccaaatcttcactcagggagagaggtctccactccccgctgtctgagggaccacaccctccgacacattcttttgaaggtgttcatgtagatatttagtgtgcgtgcgttcatatgagatgaatgcgtatgcatgttgtgggcaattattatttgtcctgtgcttaaaaaaaatcatatggcagattgtgttgctagttccgttgaaaacgagagacaaaatcatgctaccaatttgatttgtgatcttccgatctgcttcgcgaatggcaaactactagtactccacttcagtacaaccaatcgacggttcggccataaatgccactgacttcagctgtccaccatccagcctcccaaggttctggatcacatcgtgccaccgtgccggctcggctcacgcgtggatggggaagacggcgaccgaaggggacaaggaggcggggcggggcggcggcggcggcggcggcgcccgccgccccgtggtgctggtgacgggctgctcggagggcgggatcgggcacgcgatggcgcgggcgttcgcggcggccgggtgcgccgtcgtggccacggcgcggtcgcgcgcctccatgcgcgggctggagggggacccgcggtacctgctgctggagctcgacgtgcgctccgacgagagcgcgcgcgctgccgtggccgacgccgtccgggagctcggccgcgtcgacgtgctcgtcaacaacgccggggtccacctcgtcgcgccgctcgccgaggtgcccatggaagagttccagcaggtgttcgacaccaatgtctatggtaggggtggaaatttttgctcccttttttttcttctttgttttaattgctgtctctcgtgcttgctggtatttggtgattgcgatgttctcgaagaagacgggattttagatcctgcgatcaggtggtccattaagtatgattagtaggcaattaaaatgtttgttcttgtatctatcgattggttgagtagtacaacggcagaaaagttgcaaatttaggattactttgtcaagacattttatcctgttagtgccagtactaatttaggaaaagtatgtaaaatcttctgtagtcacttgcagcactggattacttataagtttgcaactaggaaccctatgttagcaaggagatgcgttaatatttagtagatcacactgagctggttctagttgtgcaccacaatgaaaatccaaccaaaagaatagcttggtggcatgatatgtttagtaacatggggtttcattggcgaaattgcagtaccaatagttgaaagatgtattatacacttgcacactctaacactagtcagatcagtgctcccagggcacgcttcctgtcagttgcacaaattgacagtcaaagtgcagtgacgatgctgcgatgatgttgattgggaagcaactggaatgtggaattgactcattctctcattggatctgacaaattattttgtcccattaagtgtatgattcacaatagctcttaaaccaatgtaaaggtatttgaaaggagcatagcctgttaacctacaattaggctttccacgctgtttcatacgctgataaatagtcttcaaccggacgtaaatatatgtaattccaatgtaaaaatgtatgctggttgaactgctgagttattgtttcataatgctagaatgatgatggaggcgcaggggggaatagttatcaattaggctttccacattgtttcataatgcttgaatggttcatggcttcatgcttgtgcaacagcttgtttgagattacttacattgggcctgcacttatgaaaatgtctaaatgactgtcttttcatctacaggagcaatgaggctgattcatgctgttattccccaaatgatagaaagggaacaaggtacaatagtgaatgttggaagtataacagctttggctcctggaccatgggctggtgtatattcagcatcaaaagccgctcttcatgcattgagcgatacgctaaggtctgtacattcaaggagcactctatactatgctggtattattatgccacattgtttttctctccgtattactgctggtttatcactactctgagaacttgctaaattgtttgatcgtgcaacaaaatgcttttcaacagaagctataataagaaataaaaatgaataacgatacaatagtgtgagactattcgaaattcccatttgtttgttttccatgtcatcttcttgtatattcagttcttttcgacttgcaccgcatgatctgtggcttttgacgctgaaattatttttcacttttgacactgtcagttgacacgacagtttttatcactgcagactggagctaaaaagtttcggaattaatgttatgattgttgcacctggagggacaaagtcgaatctgggaagtaactctacatccaagtatgttcaaatacgtgactggaagtactacaaaaaattcgaggaatccctcagagccaggactgatgcttcccagggtcctggttctactccagcagaagacctcgcaaaaagggttgttgctttggttcttaagaagaatcctccagcctggtttgcttacggccagttcagtgctattctaagcttgttgtactatgcaccactatggtttagagattacttctataagattgtcatgaaatgctagaacttctgatgtcagtaagttcaaaggacaaagaggttgccactcagataacccgcaatacatacttgcatacagttttacagggaccattcattcaagcgaaaaggcccctcccagtgtatgccatcttttttcacctgtaataatagcggtgctagtttgttcatgtagtgccaaaggatggcaatctgaaatatgtggcctgaagaaactggtttccttgcaacctccactgttgacatggcctgcatcttcctgtctcaggaaatcaaatttcgacgcgcaaacgggtcgaacacttgtgatctgattgtttgaagtttgcattctactatgtctggcagcatctgctgtagttggggggcgtcaagtgcacacggtgaaactgaccagttgcgcatcattgttcagatcagagccaagctctgcaaatatctgacgatactgcaacagttcatttggagagtgataatgcttctcagttttaagtgggaaatgaattgttttggcaaaatattaccatgaaattcttattcttacattccaattggccttaaccttaacggccatttccggcaaatgtatttttttacaacagttttgcggtaatttcacgtaaagaaatcgagtccaacatgaaagaagaacgcaactgaactggaatacttgtcaaatcgctcaggattttactgcggggcggtctcacaccagcgacccgtccccacaaatcacaagcagcgtcgtgggcaggatatagtccacgtggcgtccacctgcgcggcaaaatccgatggcgcgcgctccccattggccggcgacatatccaccctagctccccggggatttccccatcctgtggccgcggcgctccgcggcgccacgattaaatatcaactcgcccgccgtgaccgtcctgctcgctcccgatcacaccgtccgccaccggaagagagagcccccctacgacgacgacgaccatggcgctcgcctccacctccgccaccgcgtccgcggccgtgctcaagacgcccttcctcggggcgaagcgcgcgctcgccaatgccgtcggcgtcgcgggcgccaagcccgcgccgcgccgcgcgctcgtcgtgtcggccaagaagtcgtggatcccggccttcaagagcgacgccgagttcatcaacccgccgtggctcgatggctcgtaagttcttcttctcttttttcctcttcctcttcttcctcctcctcgcgccgccgcattgtgtttggctggctgacaacccgagcgcgtctcgtgtatggaacgggcaggctccccggtgacttcggcttcgacccgctggggctgggcaaggacccggcgttcctcaagtggtacagggaggcggagctgatccacgggcggtgggcgatggcggcggtgctggggatcttcgtcgggcaggcgtggagcggcgtgccgtggttcgaggccggcgcgcagccggaggccatcgcgcccttctccttcggctccctcctcgggacgcagctgctgctcatgggctgggtagagtccaagcggtgggtcgacttcttcaacccggactcgcaggcggtggagtgggccacgccgtggtcgcgcaccgccgagaacttctccaacgccaccggcgagcagggctaccccggcggcaagttcttcgacccgctcggcctcggcggcgagaccagggacggcgtctacatcccggacaccgacaagctcgaccggctcaagctcgccgagatcaagcacgcccgcctcgccatgctcgccatgctcatcttctacttcgaggccggccagggcaagacgccgctcggcgccctcggcctatgagcaatcaaccccgctctcgctcgccatggatctgacacacagagttgggtttcgcttgcatgcgcgcttcgtgtttgatcgctagctgttgcatcgatcgggcgcgtgcatgggctcggatcgaacgattggaggtcggaggagcagtagcaaaatgtatcttgttgtgttcgtggccgcttttgggttgggtggtgtgcgtgaaccaaatgggggaattaatcaaggagttatttttttttatttttcttcccagtgtatgtaccatatgtaatatatataattaaggctgcaggatgagcaaggatatttcattgatctcatggtgttcgtgccattcctttgtcatgtgcactctgtttggccgcttgcctgcatggcgaaattgcatcagctaaaggccgcattgctacgaaatatctcatccgctcttcgaggttcgaaatgaccatagtattttgtttcttccattgcgccgaaggaagaaacgtgctatagtagctctggcaaagataagtaggagcatatggtaagaactgaagaatactctctctgcaaactgaagaactccagagtacctgccactctttcttcaatggctgcatttgccttgaagcagatacaacatcgatactgcatttggtcgtaacatgagctgatttcaagtacaggagcagatcacattcccaatctcaaccattgcaatacctgccggtaccaaactccactctgcaaattagtgcaaactagatacctctgctctgcttggagctgtcatttttttcaatccaaaatggaagagaacgaaattaactaattaaacaggcataaataattaacaaaactccacgcctatctatatcagattatccggcactaatccgagctcgacccccagtgacagatgggactgtccgggaagtcgctcatgtccaccacttgcgcgacaccgaggagaccctccagcatgtcgtcgtcgtcgacatgcacggtctccggagcgacgctcccatccccgccggctccggccgccacgtccttcccctgctcgccgccgccgccgtcggtgtcggtcccctgcaggcagctgtagtagagcttcatcagctcgtcgatggagctgcggtccgcctccgggacgacgtcgatgtccgccggcagagagagctgcatctcctcgccgccgccgccgccgccgccgccgacctcgcgcttgcgcttgtcggcgtgcgactcgcgcggcgtcggcccctcgttgggttcgtcgtcgtcgtcgtcgagcggcgtgatgtggagggagcgcagcgcgtggcggctgagcgcctcctcctgggtgatgacgcgggaccaggtatcggcgtccctggcgctcatcttgtgctgaagccgcttggactgccacacgagcttgcgaatctggtcgaaccgcgggctcaggtgcttgatgacggcgctagctctgagcagggagatcttccacgccttcttgaggtcgtgcggcttccggtacggcggcgggccctggctggcctgcgcctcgccctgcaggccccaccacgcctcgccgccggtcggccaccacggcggcggcaggccgcggtcgagcgggaagctccgctgcggtggctcgcagtgctggatcagcgccgacagcagcgaccccagcgtgctgtcctggatgtcgaggagcccgtgcaggaacgacgccgccgccgcggggctccgcgggctcccccggccgcctcggcccgacagcgccgtcggccccgcccggtcgaatgcgacgtcgtccttccaccacccgcggaggctgtcggaggagccggacaccggcacgccggactcgtccacgatgccgtacacgaacccgcgcgcgttgcaggcctccatcatcttgagcatgtggcggagcacgccgtcctgcgcccggagcatcgccttccgccggtaccgcgcctcgggcggctcctcctccgccgcctgctcctgccccctgacgacccggtggtcctgcgccgccagggcgccttcgtggcccgaccggccctcgagcttcatgagcagcatctggtccttccacatccgcttcttcaggtcggcgatctcgatggactcggacccggactcggagtcactaaagaactcctcctgctccggcgccgcctcggcagcagcagcggcgtcagcagccttggctttgcctttgtcgtccatggcggcggttggccgtggcagcggctcgagagcaggaggtttctgtttctgtggataggcgaggctttccatgaggagagcttgctgtgtgaagcggaactcgtggaaaaggtggcacggaagggtggcgggaaaggttgcggcgtgcttacttatgtacgtgcagacgttccgggcggatcgaaggatgtggaagaagctaggcttggtaggtggatttgctgtggcacgcagcgccttggagcccgaagggacttgtagggagtagggacgggagcactgaccagcgaggcactcactgagtgcggagtagggtggtggtggaccggtggtgtacggtagcacccgtccgcaccgcacatgcttgtaggagaagaatacacacgcggctaagactaagaagcctaattttttatgcttttgtgctttcttgtgccacagcgcggacgcgataatttttctgctctctaggagaaggttgagggtaatgacgagccctgcacttatctttcaattattgttcttgtagtatttgtttatgatgttactgggcctgttcagcaggccggctacaacggctgcagctgcagctacacatattgagtgtggcactgttcacattagctatgggctgcggcgcagcagcagccccggctaccaaacaggcccactagtgatctttttcatgcaattatcactcttgctgttgtttcgaaaagaactatattcattcggttagggctaacgccgggggctactgtcaataatatggtccaggggtatcatgtttggagggaagaggccaccccgaaacccacatggcacttccccgagggggatcgggcccgatgtggagtgacggctgccccctcttcgcctgagggtattaaaacttgagggaggaggctgctcctagcacccacgtggcactcccccgaagagggtcgggcccggggtagggcggcggctgccccctccatgattgggggttggactgccccaacccccaccgcatgatgccacgtatgcggagttaggtgggcgcccccaacggccacctaaccgcatttaaagcggccagagtgcgtgctgtgcacgtgaccggttgaatgattgatggaaccggagtagtgcgcctgtgcactactcacatgtcaggcggcgtgcgatctaacctgccccgtcacatcgtgaagcctctcatcccgaccggagtcggttcatccactctagtaagcaaggctcccgttttccggtgcaaacgggaacccagaagtcttcacccattaaatgccgaatgacacgagcgtccctcgtgttaggcggttcaatttgatgggcccatgttgcgacacttgtgcgcatggcttccaagacaaggcacaacacacacatttaatgtagagaacatttttcctctttggtaggtagcactctcaacacccgtggtaaccctttgaagtataaagggaggtccatgtatagcgagggagggggatcgaaaggtgaaaaggcttagccctagcttgtataccagagattcagagactttgtaagctcagaaaaatcatcatacacatgagtagagtattatactccttagcgacccgaacctggataactccctagcgtctcatcttcaccgagggcccgaccctctcgttttctcccaatccttccagttcctcaactttcacccgctgtccccgaccaaactaacaaaagaggggcctcacggttccctgctcgaggagttcaccctccgacacatacgtacatatatcaatatggcgtaaaattcttttattttagatagaaagtaactttatatatatatagtttatatgtgtgtataaaaaatatttgcatataaattatatatatacctatatacaattttatatatgtgtaaatttatacgcatatgcatacttttgatgtatataaaagtttatatatacgtgtactacatatacatataccagcggttttatcgaatacgggatgctactgcagacataaaagggccggatcgcggaagggagttcgcgtgtttctgagttctgacgtagcacgatcgcacaggaccacgatgcggggggaggtgtgggcggctcgtggactcgagcgttttacctggatgcatgtacgccatttgtgacggcgccacactgccatgctgtatcatcctgtgctgctgacgtccgcaccgcgtacgcaattactcgctccgtccaaaaaagaagcgatccctgatccggatccccaatgtaagtttagtactaatgtgaaaagacgaaaatgcccttctgacaagatccaggagtagtatgccagaagcatctgatgcagagtaaaaaatgccaaacgcttcacgtgcacaaagcaaatactaaaaaaaaaaaatctctccagttgagaaaatactagtactagtagagcatgaacatcgcaagaaccatgatttgcctccaccactgcaagaatcaagaacgtatcaccgtcgcctccaccaccgccgacgccgcgtctcccagtcgcctccgccgacgacgacgacgtgtctcctggacgcctccgccgccaccgacgccgcgtctcctcgacgcctccgccgccgccgccgccgacgccgcgtctcctcgtcgcctccgccgccgacgacgacgcgtcttcccgtcgcctccgccgccgccaacgaagccgcgtctccccgttgccttcgccgagcgggaggtaggtgcagagggggtcgaaagcttggtgaggtctcgcatcttaccgccgccgcattgatgcagtcaatttgggaacgggagagaaacgcgagagaaagagagggacgcgagactggtagagacgggcaggcgataagatttttgcggtgtgaatgtgaacgagagaagaagtcgctgtccaccagggcccacaaatgatacgatagatttgaagttttcttgatttctgtggaggaatcctcccttccagaaatcgtctcttttaggacggagggagtacgtactactaccaccgccacatgagtatgtgtatgtcctcccatttcttgtgaatgcttacatagttacacggccagccagtctactagcgacgttgcatttgactcgtttgagacgaagatcccgatctatggcactgaattccacagacgcggacaagttttagcatgtttctgatgatcatctccgtgctgtagtgaagattctcgttcagccatcaactccggcccggcacgccgttacccccgcagacttttcaacagaaccatgcttgggcctatctaggacttctgggccgtatcgtcgaatccacgggccacggcccaatctaggcagaaaagaggccgtcggcaggtcccatttgtccacttgttctggaatcttggaagcaggtttcagaattgcccctttcctaacttcagaagcaatcaaacaaaatctgttctgagttctgacttctgaagaaacaacatcaaactccagactccagagcacccatggttcacatatatactgtatactccagtacaagtatacacaacgacaggcctgtcggacactgatgtgtaaacagccgtgaggtctcgatgccgcatgtacatttcatatagagattatgccgacacaaaaacgatacatggaaatcaataagccagtcatggtgacattgaaggtgtgaatggagtgatgctgacatgttaccaactggagtgagcaccggatcgtccgaccgatccaacgctggtttcatcttattaccctcttaaaatcgtataattattttagcatcctcccctcaatgtaaaaaaaaggatcaatcactgcaatgcacgacagcacgagcagtcgagcagtagaccacatacgcgtaaggtacataattacacgggaatccaaagagaatctacgatttatttacagcacggtgaccctcggctcgtcggcgtcggcggcggcggcgtccttggccttgttgcagttgtcgacgacggcgtagaggcggtagggcgatgcgtcggtggcgagccactgctcgacggtgaagagctgctgcgcgcagccgaggtggggacccgtgacggtggcctcgaggtagttgcagtaccagccgtggtgcgggccggtgccgtcggaggtgaggttcatccggcacggcgcctggcgcatgcaggggccgcggccgctgaagatgtcgaggttgccgcgctcgtagtagtcgtggccgtcgcccatgaggccgccccaccgctccaggtcgcggatccgcaccccggagccgtcggcgcccagcagcgtcacgccgatcaccgagtccgtcccgcccttccagatcgtccccgtccgcacgtatatcgtgtacacgcacttgttctccgggtccgacgacgcctccgccaccgtgatcccctcagccgccgccgccgcgtcgtcgtccg

SEQ ID NO: 42641 - DNA, 2106 bp, Oryza sativa
gaggtaggagtagtaccataaggccataaggggaaccgggtggggcccacctgacagtgacactagctaggaggagcatccaggtggcatatccttctggatacatacagagaaaaaaaatttcttatccaaccaaacggtgcaaggaaatcaattctgccgcgttcacgtgtaacacgcactcgagccaaaatttactgtaccttttcttttttttttttgacaaacaaccgacggaaataggccacgacctccaccgatcggccctgaatcttgggaagcagagataagatttcatctctaggaaaacaggagcacgacctccaccgatcggccctgatcctgttgattacaatgagtttcaatgctctatacttcttccgtctcataaaaaaactaatctagtattagatatgatatattctagtactatgaatatacatgtacatttgtacagatttataatattagaatgtatcatattcaattatatatttgttttttaatagaacggagggatcatataattatcatttggcgagggcgaagccggtctactactacatgttaatttggggtagttggcgaagacagtgacactaagcaggtgtcagacgagaaatagttggccaaatagtagtacataagctgataagcagtcaagaattcaagaagaaaagtttcttctatctaaaataaaagaattttgctgatttatttattgctatatccaatttatggaattgatacaccgtttaattgatatcatttagcaaaatgaaacatagcatatgcatccatctttcggctcgagaatttcacgggacggagatatggtatatagtggcaggacaaggcctcccaagcgtgttcaattgttgatatttttcagaacgacatcaccgtgtgtgtcatgcgttgtgctactggctccacctatgttccttttgcatctttgtttaggcctcgtttagttaaaaaaaaaagcctttccttcatcgcatcgaatgttcggacacatacatgaagtactaaatgtgaaaaaatatatatattacacagtttgcgtgtaaattgcgagacgaatcttttaagtctaattacgccataatttgataatatggtgctacaataaacatttgctaatgacagattaattaggcttaataaattcgtctcgcagtttcctggccgaatctgtaatttattttaatttattttattattagagtacttttaatactttaaatatgtatccgtatattcgatgtgataactaaacctaaaatttttttccaaataaacgaggtcttagtctgccgattggcaaatgaagttagctactccacactacatgattgagtaaatacgaaatgtggaacagtcaggcattcaagctcaaccggcttggatatacagtaacagcaacatattcttaagtttgttttaacagtattgacttttcccttgatcccatctgcttatgaaaagagcatttattcatgccacaaatggtacaatgccacgttgtcatcttctcctgtaagagcatccccagcagctcatccatatttaatcctctaaatacccatatggatagtcatcaaaaaaagattcctcattcatatccattcccactccaacaaatcatccatattacgtcattcatatcccaccctcctatattttaataatatcttccaactaaccttacttttacttttgtatttttaagggacatattttgaactactaaattttaacagtgttatttatcacgataatatttcgaaatgagtatattttaacggatacatttttaatggatagttttttaattgatatatttgaattgagtgaagcattttttttggatatattcgtagcaacatccaaaaaaaaatgaacacaacaaaaataaacatctgtatatttccctttctctactcaggctgcacagtagtgaacatactactagaatttttttaaaaaataatacgattttaatagaaaatcgcaaaaatataggtcggttcgacgaaatcgtaaatttagcaccctgtcgaacaaccgtgtctcgatagaggtacttatcgaactatgcag

SEQ ID NO: 42642 - DNA, 4250 bp, Oryza sativa
cctgcagcccgtacgcctattcctccccaccttcactgctctatggctccaccagccggtgtaccacggcgtcgcctgctcgttccggaagagggcgggagctcgcgacggatgtggtggttgggatatggcgtgaggagagagaaacgccaaatctgacgtttctctctccaatatggagcacgatgactagatggaagatctgctggagcatcaattttctctcagatactctatttttaggatggagtagctgctggtcatgctctaaggccattcgtaatacgctgatgtgccattcagcccggagagcccagctcggagattctactccacgactgtgtttttcattgctccatgaggaacgcggaaccaattattgctacaggtacctcgccaggatttgcatgtttggacccaccactttcatgccccgcgccacagggaagggagagggagaacgggaagaaagcatccgaccgaaggaggccgcatcgactgccaccgaagagctcaacagggacggtagcctcccgctccgtgccgccgccagggagcttgtcgaccctccctccagtttgcaccgccaatctccatcttcatcgctcgatccgcccatggcccaccaatggcggcgagatgcagggattggtaggcaaaatcagagaagagaagggagagccgcagccctcgacggagctcgcctcgacagcggcgcttcatcccttgtcagcatgagccaccgacggatccaccggattggagaccgaggggggggggggcgtggggcgaagctcgcggcggcgtaggcctgagccgctgtggggacctcgccagcctcaatccgtgctcgccgctgaggccctcctcgatccacgccgccagaagctcgaggtgggaaatgccgccgtcgctaagctcgatatccagccgtttccttgtcctgtcgttcgagcttgacgggaaaggcgacgacgggaccggagaagagagaggctggtgcggcgagaggagaggagcgacgaagagggagaggaagacatgagggaggagagggaggcgacggagagcgagaggagcttgaggtcgaggccgcgccaccgaggtcgatccggagccggcgggggaggcgacggagagggagaggacctcccgagattagcagctcggtgccaccaccgttccgccgccacgccaccgtcgtccacggcttccgcccctcgcggacctcgcacgtcgcccgctgccgtgccaccgactccgctgaactcgccgacctcacccgtccctcgctcccactccgctgaccccgccgctgcttcgggggaggagagaggggtggatctggcgagcaccgacgccttccttcgcctgctgactcagtctgctagtggggaatggattagaggagagagagagagggggggagttaagaagtaaaaaagatagtactagtgcacccatctattatctatctatctatcttctatcttctatctatctatctattatatactaaaagtccattaaacatcctacaaacgctctcaagccgctatatggcgctcctacaattgctcctaggccgccacgtggcacaatctaatctcaccgtcgattttcatttaaattgatggacccgttattttataccgttagattagatctatgctgttaattttcatttaaattggtggatccattattttttaaccaataaaccagatctatatataatacctttatgctatatgtaatgtttgcctgaaggaagaaaacatcacgataaagatgaaaacttcctcatgtttaacatacaggcgctactaccgtatgtatgagttcatacgtacgatacaaatacttccatacgtgcaaacgtacatgatctttcctaatcttgctggaaaaaaaatacacatgaacttaaaaaagatagaagaaacacacatccataaaaattaacggtctttaaaatatgatttttgataaaatatattaattcataaatataaatatatttagttaaataaagctctataataaatatccaatcaatgttctttaaaccatcttctaaatctatctattatatattaaaagtatattaaactttctacaaatgcttttgcactgctacgtgactctcaaataaattagagaaatcctaaaaatctattatatactaaaaatctatgaaacttactgcaaacgctcctacatattttcacgtggcgctctaatttagagtaatcctagaaatttagagtaaaaaaggaaaatcatccaaccttcaattttcacttaaattagtggacccatcattttaaacattagattagagctcttaaaattcctattgctaatctctataaaaaaaataacgtgcttatgtcgtacgatcatctccctaccggaaaaaaaacaaaatttaaatacctacaccatatatgatgaaaaaaagataaagccaaaaaataaaagaaaacataaacacgtacattgtagaatcggaaagaaatactaaaaaggaaaaatcatcgatgcctgcacagatttattgtgaacagcctttaatatacgattttaagattttcatccccaatctaatattatagtcccagtgtagatagaaattcctttatggtctaattctgagcggtagtaaataccaggacttagtaatatttgattgatcacaatttggtatattccatttattataaaggttgctaaggaattcattataggaatgcttccattggaaatggtttgcttttgcacatcgaaacaaaaaattaaacgtgtggatacgtataattcggaagaatagatgagtgattcatactcagcatccctttcttttatcgaaggttctagcaattgatatcgggattttaataggtgagtgattcatattcagcatccctttcctttatcgaaggttctagcaattgatatagggatttttatttagatctaagagacattcttatcacataaatagtatattaaaatctaccatctattttacagtaaatatatttatttttttattataggataatctaaattcccttacagtatatatatagtgatgtatgattccttatagtattttttttaataacaaataagatgcccgtgtatttgtgcggaattcctttccgatttatattcaggaaatgttcttcaatttatattctatcgttatagtgtttgaaaaacaaactacaatacatacccgcgcggcgcgggctaccttcctagttataaataacttgcactgtagagcatgtatggttcttgtctagttggtatatgaggtccgataaaaacctaggacgcgctgctaatgccctaagaaaccaaactttacatgttgccaatattggcttattgctgcatcaacgctcaaatctcgcactgctcgccatacaccgacgaccagctcggaccacctcaagaaaaatgacaggtgcaacagcatcacaattcaagaacaccctcaggcgcatgctcagcgctcctcctcgcccccggggcggctcttggcgcagacgctccgctcggcgtaaagctggtaaggcggcgcgtcggtggcgagccactgctcgacgtcgaacgccgccttggcgcacccggcgtgggggcccgtggcggtgacctccacggacttgcagtaccacccgtggtgcgcgccggcgccgtcggaggtcaggttcatccggcacggcggggacggcaggcacggcgcgcgcccgctgaacacgtcgacgttgccgcgctcgtagtagtcgtgcccggcgcccatgagcccgccccaccgctccaggtccccgacggcgaagccgctgccgtccgccgccgcgagctccacgccgatcgccgcgtccgtgccggccttccagatccacccggtctccacgtacagcgtgtacacgcactcgttcttgtcgttgtccccgccggcgaccagctggccacggcgcggcagcgccgccacgccgtccggtgatttcgatccggcggcctgcgtacgtgcgcgtatgcaaaaacctggccagatcaactcacaggtcacagcagcgagacgaccagaaaagaaaatgcacgtaccaagaccaccatggaaacgagcgaggcgaaggcgaagcacaagaacttgtcagcagccattgtcaaaggcttgaagaactccctctatttggaatttttggattggatgcgcgctgctgtgagctaagctg

SEQ ID NO: 42643 - DNA, 5391 bp, Oryza sativa
  unsure (1)..(5391): unsure at all n locations
tgacaacaagttgaacgagacaattagcgatgtgagatgcgaaagattattccagaacagatcacaagcaggcctgtgacaatcatgtgacgcacaaggagagagtatgggaagtaaagtcaaacaaacgagtacatgatgagcatttttagacggatttaggacttgacgagtggtctaaaaacctgataaatcaggtacgtttattcaagaaaaacataaaacatttttttgccacctactacattattagtgcgcacattaccagcagccctggcttattatcacaactcaacactttgacagaacaagcacataaactagaggacgtgctcagtgctcagctcagctctcctcctcggcggcggcggtggccgtgctgatcttgccgcagacgctccgctcggcgtagagctggtacggcggcgcgtcggtggcgagccactgctggacgtcgaacgccgccctgttgcacctggcgtggggaccggcgacggtgacctcgacggacttgcagaaccacccgtggtgctcgccggcgccgttggagacgagcttcatgcggcagacgggggctcccaggcatggcccgcggccgctgaagatgtcgacgttgctccgctcgaagtagtcgtggccggccgccatgaggccgccccacgcctgcaggttcctgatgaggatgccgttgccggccgccgtgtagagctccacgccgatcgccgcgtcggtgccggccttccagatcgagcccgtctccacgtagagcgtgtacacgcactggttcgaccccgtcgagcccgggagcagcagcgcgcccgtgtcctcctccgacgttgctccggcggcctgcgcattcaaggttatatatggtgaagctgatcacgagatggactcataagcgagactcagaaaatgtagaacacgtaccaaagccgccatggaaatgagtgccgcaaagcagaggagcttatgcgccattgttgaaggcttgaagaagcagactgtctcgacctttatctgcactttttgagatgttatgtgcaccgacgatgatctacttcagctggctaatgaggcttcttatagacggagacaaaacggataggggaattggaaatgctaccgtaagattaaactagcatggtggcccgcgcagattgcgcggctagcatcattatattttctctcatataatagcatatatgttttctcattatattattcaaatatattaaaatgaaaacataattttaaattttgcaataactttacaaaactactaatgtgtaatattcatattatattttatatacgtgttagttattaattatttttaatgtcaaattttagttatttgtaaattatatatactcctatatgtactctagacttgtcttttaatacttcttttttttaattctgaattttctgtaaattgtatttctatatagactgtttgctcttctttcaatattatttatttttatttttgaattgttattattactaattgcatttatatgtggactctaaacttatctttcaatattctttaattttaatttcgaatttcagttacttctaaattgtatttctatatttgtattcctatattgaccttaaactcttcttcccatgttattcttaatttcgaatttcgaattttagttatttgtaaattgtatttttatacatactctaaactctacttttaattttattatatttattccaaattttagttagttttgaattcctatatggactctatactctacttctaatattccttattttttaattctaaatttctacttttttcttaattgtatttctatatggattctatactctacttctaatattccttattttaaattgggtgaatagctaatatgctccctgaagtttcacttcgggctcagtttagtccttgatgttttaaatcgtccaaacaagtcctccaaattaatcatttgagttaatatagtgcttggacccaaaaaagtgccacaaattaattatttgggttaatataatccttggacccacaaaaagtgccacgtgagcatgtcaagtcatcctcgcatgcagcggtatgaatgaaatgaacattctacccttatataccatataaaaaagaaaacaaatatttcacacatgtatggacattttagaattgtcacttacgattgctgcagcctaatcgtataaattcctttgtcggccaccctccgcaacaatgttgggcctaggttagctttttttttgtgtcttttatttcttttctatatagtatataggggtagaatagtcatttcattcatatcgctgcatgcgaggatgacttggcatactcatgtaccatttttttggtataaggactatattaacccaaataattaatttggaggacatgtatagacgatttgaaacctgactaaactgagcctgaagcgaaacttcagggaccatattagctattcaccctttttaattccaaatttctattatttcctaattgtatttctatatggactctatactctacttctaatattccttatttttaattccgaatttcagttatttccaaattatatttctatatggactctatactctacttctattattccttatttttaattccgaatttaagttatttcctaattgtatttctatatggactctagtctcctcttctaatattccttattttttaattctaaatttcagttatttcctaattgtatttctatatggactctagtctcctcttctaatattccttatttttaattccgaatttcagttatttcctaattgtatttctatatggactctagtctcctcttctaatattccttattttttaattctaaatttcagctatttcctaattgtatttctatatggactctagtctcctcttctaatattccttatttttaattcagaatttcagctatttataaattgtatttctatatggactctgctttttctttttctccgattaatgtgagaatttctaggccatgagagcgaacgtggaggctcatttttctattcctttaataatataatagatgattagtgtactgtttttttagatgaatgtgtcgttttttatgctttgattagacaacaagttgaattcaagaatgaggggatacaggattcttcaacggatcaatcgatgaatcgatcatgtgatgcacaaggatgatgtatcacgtagggggatttaagtcaaacaacgagcttactgtatattcaactgctctgctctagctggcctgccagtagagcacaatagtgctcagatatgatcaccatctatgcatcttctgttttggaggagttgaatttcattctatactcggcaatgatttttttaaaatttaattattactctttttctgtgaatcatgtgttagaaagctgcattaatggcccagctcggtgttttgtgattcacatttcagaactttaggacagcttcaaagtttaccaacattatctagtagtatagagtaggacccaagacatgtcattcatatttgcgaatggatataggctatgtttagttcctgaaaaaagttagaagatgagggaaagttggaagattggaaaaaaagttagaagtttatgtgtgtaggaaagttttggatgtgatgtgatgtgatggaaagttaaaagttggtgatgaactaaacacggccataaacgtcaaatctgaaataagtggcgaacacaactttaaaatatagatgggatgacatttagcaaggagctagccctagttcgatgatggcacatcacatataaaatcatagtcaccggctcatggacccggcacggtgacacaccgcacaaacatcaagcaagttaacaatgaaaattaaccggcgaacaaactcggagttaggtaggtgaggtactaagctagtcatgaatatgagacagtgatgaagaccttatgtcagaaattaaggatgaaaatggtcaaaccaaaaattattaatttagaaacaatttacaaaattttccatttgtaaaaaggtcctttttactctcctgttccgtactatttcatcaaatcacttaacctctaaaatattttatttcttattgtatccctaaactaataaagatggtttgctttactaattaattgcaattttgttttttgtttctctttatacaactcgtaaaaaatgttaagccataaacgacaccataaccaaagttctaaaatattttcaaaattagtgcttccaacctatataaacaatgataaaaaaatgttaacaagtagattataatggatctaccaatcctattaaatttcaatgcaaatatgccttatatagagataaaaaaatgagaaatattgttagggtgcgagtgaaccatcttcaatagttcgggttgtaaaataagctaaaaaattatttagaatgaccagtgctccaccaacatagttcgaggcagtaaaatagaactttttaaatatatttaccaatttaactatttagtatagactaggtactaaataaataaaaaaattcaaattttatgtatggcaaaaatggggaacagtcaaaatagtaccaattataaaaaataatacttattcgaccgtgaatttccataaatatttttatccctgttcaaagtacttgatttatctaatggtttgaaagtgggctgacggctaatgtgctagaaatgggctctaagggtgtgaggcggtacagaccgtagctggaccgactgacccaccccgcttaatgggtgtgtccacccctatccgaaatacaataatactttgcttatctattggaatgggaaatcctcttaaaatttgcctaattctgaatagctgggccaatttacgcttgcctcgaatatgaaacctaaaggcatttggaaaacaataaaatgtgcctatatatacttgcagtggcttagctgctccttggactagatcggtataactacttgaatatgaatcagtgagggggcgatgtatcctagctagctagaacgaatcacttacaattggtggccatgtgatgcacaataagaggaccaaacaggtaacacaagtgggatacaaatgcttatatataaccttacatcacctatgttatctgaattagatctagtctttctttttgttcttcttattcttatgtgaatcatgtgatagaaagatgatgaattattaattgcacccaacataagtgtgaacatatcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42644 - DNA, 1769 bp, Oryza sativa
gtaagtgcctatgagttatctggctgaaacggcacctgcatttactgcttgagaataaagtttgagtgccagttgctgagttaaaataaccacgcaaaacaatgcacaacccacagatcagatctcgtgaattgctttctctggctgctagaattggcactttccagtggatcttacgttttcctgaattaaatgcatagctccctgtcacttgccgtttggttcatggtcactctttgccacacctcaacttaggtagctttggccgagatagttcattgtcacgcttgtggcaagatttttttttaagcaccttggtcccacatggcattgttcaccatattggggtgggtgccaaatttgttcgtctaaccttagacaagcttggcaagaaaactatggcaaccctaggcaatgttataatacaaaccaaacaacgaatgtcaggctatcatgattctgtggtatgtatttttgtaatctttacatgttttcccttgtttttttcaacagaagaaaaggggcagtcgcaaacacggcacaggagctcagtcttgtcttccaggaagttatgtagttgactgaccacacactgtcatacatacacaactgaatgggaaatgcattcccgctgatggcaccaatgttgggcatcagttgccatggagagctgttcgttcgtgcccagtcaccgagctccaaggcacagcagcagtggataacattttgttgccactgtttgttcctcttgtacacacactaaccaacagtgctcgagatccttgtctgttgtcacttttgaagggaagctgccatgagcggtgacatctgccggcagcgttcttcgcgtttgtctcattggtttctgaagataccagtttgcccttgatagatgtggatgaccgtgagatggagcgaatgtcagcgattgtaatgccttgctggctgtagcctcttctctcgtgtcttgtgttagcgggttgcatttgatagtttattgtttggttgtgatgtctggtcgattcaatgacaagattgatgaagagtgattgagctccttgtacacctgtacatcagttttcttttgaatagtatttgagatctatactcttgatcgacacctttgttactcgttggcttgtcacgtccctacaacagctaatgtctgagttttgatgaaacatttctttgcttgtaagtgagatatgccctttggagtattatctggagggtcatgaacatttcattgttaagcttcatcttctgggtaaaaacacaactgtaccttcaattttttttcagggtacagaacagtaaactcctgaataattctgctcacattcacaaaatcaaacaaaccaacatacaatctcattaaactcgtaaccacatttcacacgacaaaggacctaccatgcaacatcaaaaacaccatataattaagaagactagaacaacaacaaacattgggcctaaacaaattaattcgacgacatatatgagatgagaggcactcatgcaagtgcagcatgcccctgcttattcccttctttaccaagcaggcaaaacaagctaattaccatgatcaaggctactacgaaaccgaaggattcgatggatgaatcgaatcgcggcaagaacgagctagccgcaggtggggatgcaggacttggagcacttggcggagcacttggtgtgcgccgacatggtgcaggtcttgccgcacatgagcctcttcttgtggcactcctccttggtcacgcagctct

SEQ ID NO: 42645 - DNA, 1489 bp, Oryza sativa
gccaactcctcctccacattgtgcagcagctggtgggcgtcggtgtcggtgtcggcgtcggagtctgccaggaggatccgctcgttgtgcgtcgcctcctcgtgcgcgggctcctccgccgccgtggtggcggcgctggccgtgacgacggcgagcatgaggaggagcactgacactaccgcgaagctggagctgcaggagcgagacgacgacatggctgcctttattgactacgtttccttcttcgcgccttgggtggtgtggctgcgagaagctggggttgctgctcctatccgtgtttatagctagagctcagcatgctgcgttgctcgataaatagcgatgagatcgatagctagcttagctgcatgagcgtgcatggcgtggcgcaactaaccgagaatacttcggtgaggagcgggagatgcatgccgctagatgggaatggtggcaattggcgattttgaaatacaccgttgcctcatctttttttcatcattacactcctttttcacactgtaaaaaaaaatcggtgttgtggtgttaaggccactccccgcgactttggtacattttcataaatccttcgaaaaacagtaatccattcatttcacaatgtaagtcattttagcgttttccacatttatatttatgttaatgaatctagacatacatcaatatgaatgtgggaaatgatagaatgaattacattgtgaaattgtgaaacagaggaagtatatacatttaaaaaaatatgaaaggaacaatatagttttaaaatttaatctagcaactgctaagcaagaaaattcccatgaaaaactgcatgggctttactggcagctgctactgttaatctgaataagttactcacaatatactgcatctatctatctactcaaacgagatcaaccaaaggataacattattggtgccttttcagttaacatggactcacctaaatatttgcggtgttaatagagttgccaactaacttaatctagaaaagctcgtgacgaagatgggtttagaaaaaaaatcaaaaccgattaggcggagccaatttaaagaacaaaccagtcttaagaccgatttaaaatcaatttagagataactacatgttttatgggctaatcaaaaagtttacgggacaaccctagaaaaatatcacactcttgcagcaatgacattcttgtcccatcaaccaaaaggagtctgtcagcgcgattgtctttggacaacaattgtctaccctcatttgttatgtttttttttttcttttcgctgtctctttataagttatatcaagacatttgagtatgtaactaaatctcttctttttataaagttaatgtccactaaacacttaatgtccatcattagcaaatatttactgtggcaccacattgtcatatcatgacgcaattaggtttaaaagattcgtctcgcaatttacacgtaaactatgtaatttatttttttcgtatat

SEQ ID NO: 42646 - DNA, 1841 bp, Oryza sativa
ggataatccatcgcctatagctagcactagcagatcgtctcgacgtgccttccatatgagcatatacagtcataacatactgctactgcaaattcaatcgacgaccatgaccgggattattcagagtttcagaccaatcgatatcgatacaatgccgggatttgctgagcacaaggtcttcgatccacaaaggagacaagcggcataatcgcataatctcagggaggattattggctattgcagaacgagacgagaggaagtcgtcgttcatcatgtgcgatttactccgtagccgccaacctatgaagattatcataatagtagcttttctgctcgaccacgaccatgcagattggcagatatgcagacagatcgatcctccggtcacgtcagatcgagaccaaaacaaacaagaaaaagcctactgctagtaatttagtgccaggtaaaagaaacatcccggcgtacggccgcatccatgacagtatgcacactacactattctgttctcctccatcttgccggccggccggccgcaactgccgccgttgtcgccggcagaaaaagtactgaattctgtgtaattgtaccaccctcttcttctactactacacatgtgttacctgaagggtgagtagcagcagtagattggattacttaaagggcaaagcgacaatggcttgccggattgtgcagggacaggcaaagatgcggccttccgtggcagggacagccaaggataacatcataaaccaaccctgttttttataactgaacttgagctctgaaacactgaacatagagaggatgtgagaagctttttgttgttgtgcctgacgaacggcgaggccgaaggcatgcaccgaccacatctcggtctcctggctcccgaaccgcacgcagagggctatcctgcgtctgcctcctgctcgcgtcgcggtttcgccataaacaaagctgtggtttcgccgggaggaggcaaagcatggcgagcctgaaagttcttgattccgtacgggtcgaatcgtgttgccggcagagtagtatatgttacgtttacaggtctttgtgtcgcaggatcaacacaacacgatgaagaacagatccagatcagtctctgaattatgaacagaaagtaaggaaaaaaagttaaggtacgtgcgtatgttccgtttctgaattctgacacaagaacagggaaaggattcacaaggctcacaagacaaacaacacatcgatccccaaattacacagaaaaacttcatgtcaatgtggccgatctcacacagaaacttcaggtcaggtggccgatcaattaatgaccatgaacgcactcaactagaataccaaaatacagagacatgagccacgcagttacagatatactccatatactacagatactgagcaatgagaatgaaatgtacagagtagagcaatcgaggtatcaacgcgggcgtcgaagtcaggggggatgcaaatggcaaatggattgagaaccaaggtgctgtctgtcactctgtctacatgcgggtcatgccgatgccgccgacaatgggcgggggcacggcggcggcgtggcgggccttggcgaagaagaggtagtggagctcggcgaagagcgcggtgaggaaggtgaaggcggcgccggcggcgaacacgcccttgcgcagcatcgcgcagcgcggtggcccgctaatcaccagcgtgctgtacttggtgtggtacgcgttccgcaccgaccccgccagcaggcacagctccgcgatcacgaacgtgaacctgtccataaatccacccaccatcatcagctcatcaattcaataaaagcaattttact

SEQ ID NO: 42647 - DNA, 4348 bp, Oryza sativa
ctacggaggcaacgaagaaggggagctagctagctagcgtgatatgcttaattgctgattaaattaccagcagacgatgaagcagaatccggagaaggcgcgccaccggccgggggacagcgcgcggccgcagcagaagcagcgggtgaccaccatgacgacggcctgcccggcgagcagcagcagcagcgccccgatgccgtaccccgtcgccgcgtcggagctgtacacgcagtactgcctgccgctcgtgtcctcgctaaaggtggcctgcatcgttcccaaccagctccctctcgtcagacgacgacgacgacgacgacccatagtatggatttcgctagctatagctcaccgtgctccggcgcttctcggcgccgatggcgaggacgaaggcgagggcgtcgaggacgaacacgaccaccacgaggattatggacgccatggatggattcgaactaatttacgtacctcccttaattaatccaacttggactactgattcgtgcagcgagcgagccaagaggagctctcactttcctcttgttgcagaaagagaggaggattaggacaagcgagctagggaaagatgggggcgtcaaagacgagaggaaagcttagcagcaagtcgagggagatgaggcgatgcaccacgtacactgctgctttggtagccggtgaaggtgacatgtttcactctaaccattctcgcgactttggtggttctgttccactggcacctgcctccggcctctagctgaggctgacgcgtgggcccccccggctcgccaccaaagtattcggcgtggatgattggaaacggtaggccagtgggagtgggatttggatgtgctatcatatgctcatgtactcgcattttggcttttattaaagcaggtgtggaaaatatttttcccctttaatgtgggttagtaattaatttgttttgcaccaaggtcagtaaaggaagcttggtggcgcaggaggaatattttgtttttcctttaactggaccagttatttctaggcacctatgtttttttattatcgaaacctagggtttgttcgctttattaccaaattcagcctgattttattagattttagtagcgttgatgcattttcaaaatttggtagcgtttttataagataatggttttgaaactactagaatttgattatatgggggtggtgaggtagcgtttagtttattaccataccaaatttgaaaaaagtggcgataaagtgaaacggccaatagaattcgttccgatcgtatggcctgcagctgataattgctgtaaaattgcacgtccgaataattttggctgaaaagcaggtacaggaaatatttttcattccatctacgtgggcgagtaattaatttgtgtttcaccaaggtcagtaaaggtagcttagtggggaggaatatttgttttacctttacctgcgatcggacattaaccagttactcctaagcactgcctcctccgttccaaaatacttgtcgctttaagtttttgtttgtaatttttatcatttgtcttattctaaaaaatatgaaattattatttattttgtttatgatttgctttattatctaaagtactttaagtatgacttatcattttttatatttacataaatttttcaaataagacgaatggtcaaacgttacaagaaaaatgttaaagcaaccactaatttgggacggaggcagtagcattgtaggagtacgtttttttttccttaaaaaaaatcgaaaccagtactgtgtgttcgaccgtcacaacgtctaagtccctatcgtctggcttcatagttaaaacttttttatatatgctatttgcagtttaaaagccaattttaaaagataaaccatagtaaaaacctcagatcaacactaatatcaagttttaaaattcagattttaacggtggtcgaaaggcaaatgatgagcttatgctagcaaagcaaaggtagttccaactacacgcataagaaagggtgtaaccacagatgcaaagctgagcgctcctattgctaagaagggcaattaactagtagtgctttgctttcatcgggcaattaactactagtgtttgcgttcatcggccaactaacaagaggttgattgaaaccagggataacataattaaaaagttcatcaccaaaaataaagcgtaattaaagaaagtaagagcaacacagggacagctgaccgcaccggacaaccaaacatccacctcgtttcagcttttcttaccgcgaaaaaaggatgccggtggtagtgcttgctagttgctactatactttgtttccgaccgaagaaaagctcagagcataatgttataattgattgggccttctttgtagcttcttctacttaatgggccagaagagagtctatattctttagattgggctgaaaactcggcccattatctcaggaagcatctagaagatgggctgcatccaaagagccgacccgtcctctttccagtggcatcgatctcgaggtatgtttggtgcagcttcagcttcgtcgctcaaccaaacaattttaacttcatttaaaattggagcggagctgggtgaagatctatcacaaaataaaccagaggtggagctgaatttatacagtttcaaagctccacttcagacccaacttctaaagctaaatttaggagtaggagttttaccaaatgcctatttggtacagctccaactcctaaatttagctccaagagttgagtctggagtggagttctggagctgtctaaacccagctccacaactctagtatattttgtgacaaaaaaggctccaaataggccatacatattggtcttcagtatacagcactacagcacagctagtcagccactgtatacagcctacttacgtatggtcttatccaaatgtacatatatgcaaatgcaattggctttgaagcctatcatgattcagtccaagttgcactaataattggtcatctctgtgcaggttaattatgcgaaagagaatcttaatcccaggggctttggttgcagtattgcacacggaagcaattgtaccagcgcggaagaatcagatgcatccatggatgggattatggaaggagaaagtgatgctagctacttaccagcaggtgatgaagcagaagccggcgaaggcgcgccaccgccccggcgagagcgcgcggccgcagcaaaagcaccgagtcgccaccatgatcatcgcctgccctgccgccagcagcaccagcgccccgatgccgtaccccgtcgccgcgtcggagccgtagacgcagtacggccgcgcgttctggtcgacgttcacgtacgccgcctgcatcatccaatcaacacacacctcctcgatcgtcagcacgcagcagatgatcgatcggcttcgtctccggcgacggcgatggcgacgacacatgtatgcatcaacgcgttcgagagctctcaccgtgttccggcgtttctcggcgccgatggcgaggacgaaggcgaggacgtcgaggacgaacacgacggccaggatgattatggacgccatggacatcgaatcgcagcaagaatcagtcacctagctaagcttcgaatatagttcaatttgcaggttttgtggtgcaagcaaagctcactttcctgtggttaatcggcagcacaaaatgtggattaggacgagagaatcaaatgatcagagctagctggaggcgatgctgctgctactgctaagcagctatccgtgaggttgacatttgaagacgtgacatgtttcacttcaccccgttcccgcggctttgtattttgttaagttttcctcctgtggttgacgagtgggcccctccatgatgaactgatgattaaccctgcgatattcggtgtccatgattggaacttacagatggaccgacgaatactcgaatctcagctttaaaatatggaaataatttatatatcttcattgtggacgaagaatttgattcattttgattaaattgcactgggatgatgtgccatgtaacaacaaagaaaacagagcaacacagtgacatctgaccggacacaagcctgggaaatatattactgggccttgtatgggctgttcatctaccaatatgggccaacctgggaagtgggccgtgctctatactgagctgggccaacaaaccaaccaacatgtagaagtctagaagagggcgagagacatggaaggcgaattttttttatttataattttttttattaaaagttttacaaaaataattttccattttgaaaattgacggaaatagtcgcctaccgccctctgggagggcgatttttaaaaatcg

SEQ ID NO: 42648 - DNA, 1476 bp, Oryza sativa
  unsure (1)..(1476): unsure at all n locations
ggggggcatgaaatttgcaagggggcccccttgccgccctccgcgagggcgattttgcactgtgcgggggccgcctgcaaatggcgggcgagggggcatggaatttgcaggcggcccccttgccgccctgggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttctattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagagaaagagctggcgaacgcgcccgaagaggtggcgaacgcccctgcggagctcgtggaagcgccggtcgtgcctgcgaacgcgctcgaaggcatacgaggtcctgcgatgaggaaacgtgcagttaaaacatggtgacataatcgtgcaaaagctgaaacaaaannnnnnnnnnnnnnnnnnnnnnnnnnnnnnnn

SEQ ID NO: 42649 - DNA, 2895 bp, Oryza sativa
  unsure (1)..(2895): unsure at all n locations
tctagaggatccccatggggtagggcattggaggcatgtttactggggcaccagggactacagcttcagggacaggggcatgcatgccataggctatatgaggtgcagcaggaacaggaagtgtaacaggagtgccaactgcggacacaagaggaccaccaactggctgtccaattgtcgtaccataagcatcgacgcctggaggcgcatttgctggctgtagagactgcttagaggattttccaggatttgctgatgggccatttggctgacctgtgattggcccctgagcagcagatgtatctccattgttcacgctggttatgtcatgtatacttgatcgccgcctctctctgttcattgagttcaggcgaataaaatacttctgtgcatgactagctacttgggtgggtgtccttgagatcacaaagtttcttgagatactcctccagtcgcctttgccgtacttctcaagtccaagaaggaacagcctgcaaattaaaatcaagtggtaggacacatcaataaccatatgagtaaagggcagtctgcatgaattaatcaactttggatatttctcatcctgaagagaggggtaatagctacaaatttatgcatcagaacaaaaggaggttagttgtgccatttttacaaccatgctttcacttgagttgtaatcaatatcatgcatgtgcatacatggcaatgaacgaacaacacattagcatccatcagggcatcaggttacttctacttgaaacgtattttcatgctctgcatcatcttggtatgttatgtctatttcactcattcagccattcaaacagacaaaaatacccgataatcacatcattttatatggggatctgacaagcatactgccttatatactgataaaacacattcaatattaccaatatgccaataagatatcaaaattttatctccttggaccagaaatactgtccacaatatcatggaagaaacaggttgcaaatgaaaacaggactatgtctaaaagacacaanaaccaattatatgcgcacagcaagcatgtactagcttgttccggtctaaagctagcaggaaaatttcaactaaaatagcatatcaaatacggaaaaaaaaatggaaatgtgaaacaaatgcgttcaaaatgttcattttgctgaaataaatttaagatggacaaaaatcagttataagctaccattgtcctgattcctctaactccttttagggaaaattcgtccatgacacacgctgaccattaaattcagaaaatagcacaaaccttcataatgccacaggttgtgggtttttctaggggaaataccactaccgtcatcttttgagctaacgggagtttatttggacaaaattgtccctcagattgagcctagatgattcgaacccatcttgtaagttcctgactgaacaataattccccatctcctccaaatcctcaaatcccttgatctaaccccctcttccgctgctggggcctgcttgtgtttcgtcattctcggcaggcacgggctagtggtggccgccattcccctcccctgtatgctcgcgattgctggacgcggcagtgtggtcacttgctggtgccaccgcctcaccctcaaccaactcctgtgagctcgaagcttagcgacgtccatggtgattgccgtccctccaacctgcacacagcaaacgcgcttggtggatgtggccgtatggttgcttgccagtgacgctagcctgctggctcaccacgtgttaacccaggtcaatggctaatcgatcttctagctggaagccaaggcgcacatgcacaacatcgttcttcactccactttgaagccaaatgaccaagtttaattttgtattccatgaactgctggagctatgtaggggattgagcattggcgttcggaaaatcaaagtagatgcaagcagacagatttgctttctttcttttatttgtacctatgaaataggagatttctgtaatggtgacaaagatatttgataaactatctgtttgatctgttggtttgtgattaaagatgatgtatgagctaatggaggtgtcagattgaacaaagagaaggagaacgcgccagaggaaccccagcaaacaggaatgcgtaagaggtaggtcttgttgcattgcaattgaagtaaaattattttggtctttcggtggtatttttcaaacaaaaaactgatgcgctatggtattaagcagagtgagaaaaagcttagttgtattttacgaattgtgctatgaacagaattttctcatccttttaggaggaaggtgaaatatgctaagatgaatcaattaaacaagccttcagcaagaagaaatgagaaacaaacctaaaactaaatcagtgggatgtagctcgaaatgcataggatccaccataagaagtaacgtgaataggttattgttagaaaacagtttataattcaaaaattgattgagttaagtagttactggagttgtcgaaactagcaaggaagaaacaacatctccaatgaaccacttccagttgaaaacaagtatgcagcacaagtaatcagccgctccatctgagaagaactatgcaggatgtaacataaactgccaagtggtgaaacccataaaaaaaccatgcgggacaaaacctagcacacacaaaccaacaagcctacttcctggggtctgaagcagtaatttccaaaatcgtaaacaggctgcaataattttttaaaaccccagacaaaccaatcggcaaaattcccaacaacacagaagcggtacctaattcacgattaaataaactactattctagcttctatgcaatcatttattcaaagaaatagaaaagggagctacctaattgtccagtgcaaag

SEQ ID NO: 42650 - DNA, 2577 bp, Oryza sativa
cccacccccaccgccacccccaccacgaccgccgccactggtgctgctcgcctcctccaccgccatgagctcaaaccctaaaacagcgcgcggcgcagcgagattttgtggggagggattgcagcggcggataagggagggagatttaattcgttttaggaaggctgcgggtttgcggggaaggaataaattgggggtttcctccgagaagagagagaggaagagcaggacacggtggaggtggaggaggaggagatctaccgcgcagcggcggccgcggcgggggaggagtgtgatggatgttaccgcgaggcgaggcgaggcgaggcgggggatattttggttcaccgcgacagtggctggctggctggctggggggagtgcggtgtcgggtcgggccaggcttcctcctcggggaggaaggagacagacagcggatgcagacgcggacatggccgctggctggcgcgacgccggccgtattatttctccgtctcttttttttttctttttttttcctttttcattttgttctctttctgtgattttgtggggagggacttttctttttgggtgttatagatgtactagctggttactactctctccgtatttcaatgtataacgtcgttgactttttaaccaatgtttgactattcgttttatttttgtgtaaaatgaaaatatttatatcatgcttaaagaatatttgatgatgaattaagtcacactaaaatgaataataattatatacattttttgaataagacgaatgatcaaacgttagataaaaaatcaacagcgtctaggcagtattaatcatgagttcgtgtttatctcttcctgtcgctgtccatatgctcctgattaccggtgatagcgagagcatgatttgcatcttttcaattatttatattcaacaagttttgtcgtgtttcaagcgtgatagcggtttataaagaacagatatatttaattgttttaccaatatagacatataatgtttggcgtaaataaatgttctcagttcatggatatatgggacttatctagttatcttatatgtataaaaaatggaattcatgcagtaaaatggaggtaaatctatgtctaccagtatattagttatctaaaaaggctatttttgaccataatactctacatcatggatttaaatattacaaaaacaaatactccttccgtctcataatacaaagaattttagaggggagtgacactttctaggactacgaatcttgacaggctctttatccagattcgtagtcctaagaagtgtcacatcccttcaaaattctttatattatgggatgaagtgagtaattcatgagctagaattataacatggttagttacctagaaggatcatcccatcaccctattatttgtttagctatattagcaccaccctgtaagcttttaagtagggatgaaactggttcggatagttttcgtccgtccggaccatttttcggattaggatagtttcagtcggaattatccggaaattctcggattcggaaacgaattcggatattttttcttggaaacgaaaacgaatacagtaagggtaatatccgtcggaatcagaaaacggtcggaaactatccagaatttttttcagatatccgcagacattaagcaaattatataaaaaacacgtatatatacataactttttcatacggaatcagatgaagacaaactttatatcaacattgtagagctcgatgagatctacaactttattattgactattttattatttgaggtcatttatgggtctaaatattcattataatataccatattaatttttacaaaatctcagatctacaattcaacgacatctgaggagatgtgttccatatcaaaattgtagagctcaatgggatctaccactttgcagtttataacatttgtatttgaaagcatttaaagtacaatacaaacattacaagtttcgaagatgtgaagtaaaataaacaaaatctccaatttatacaatggtaagtaagttatacatctagtgaaaggtctcgggaatagaaaatgataatcatatttgcatatggatctcttagaggaacagccatgaaaatcgatttccacatacagttgtgggaccgtctataaaattgacgatataaatgttggagatgttgaactaaaataataagcgatatctcttccttgatcaagaaactcaatttgaggggttttttatataccgataaatattcgctaccgtattcgttccgtctcgtattcgctccgtatttgtattcgataatattcgatttcatttccgtatccaagttttcgattccgattccgatttcgaaaaaaaatattaaaacgaatatgataaagctagtttccgtccgttttcatccctacttttaagtaatagtagtacaagattatttagggactgtcattagatacaacagctgagactataaatctctaaccattgactaattttttattactattctctcttttttttcacccttatgtaaccatgttttcaatatagaggtcaaaagtcattg

SEQ ID NO: 42651 - DNA, 4396 bp, Oryza sativa
caaaaaagtccaaataaacaaaactttgatatttcaaggtcaaatgagcaagggtaagaatggcaatttatcccttagttaacaatgttatattgtcttcacgataaacaaaaagccttgatctgttttcaagagggtcaaataaacaaacctgaaaaaacaagatcagattgatagtttgacttcaaaagaggataaaatgagcaattgtcccttcatcatttgataaattaggtgaaaccccgcgcattgctgcgggaatttagtatgataacaataaaaaaaataacgtgtaagatagctagataacatcagattaattaaattaatgtggtttatgatagtttaaatttaaatagtatgtagaacggtgattcaaacgtaaaaagtaaggtgatatgactttatggaagaagaaaaatagggagataatttggaccgtagattaatcatctaaaggctaaaaaacaattgatgtgatatgacttaattagaggaaaaaagaagaaagataatttggaccatagattaatcatttaaacactaactaagtgaggatgaactatataagtatataggatatcataaaacacaataaagatatacattaaaacattatatgaattatgttggatgataatttaacatgtttatatttaaaaaactcttaaattataaaaactataaagatatagcatgtttgcatgatgtttaaatgtgatgattgttaatggatgatgatgtggcatcttgttaattagtggattaatggatgatgatgtgatatctttgtatgagcttaaggaattagtgggggtaactttatagtaagataggattagatgcaattaatattcaaccattttttttaaacgaaccggtattaatattcaaccattggggcaagttgctatgggtttactccactcggagaactgactatatttctagctcttttagcgattggttcttgatcgatcggttctttctccaactttactaactcatctaccttgttttacacgggcacgctttttaaactactgaatggtatttttttaaaaaaaattatctatacgaaagttgctttaaaaagatatattaacccattttttttaaaaaaaattagtaaatatttaattaattataaaaaaaaatatgccgctccgttttatacgtgaagaaaatgggtttccaacgcaaggaaaggaacacagcctactagctatggtgtgttgtttctctctgtaatttaattggaatgtttgcactcagtttctaatcctcgtccccaaatcgatcaaagatgttatgcttttttaattgtcacagcttttcctgaagaatgtttcacatttcaaacggtaagcataccaacgactcttttttcactggtgatttgggtaaacgagaattacaggtgtattttcattaaaaataaggggaaaaatatgtggtgttcccaaatcccaagcaggccctagagaaaaatacaccaggggaatccaagctaagtcccccacttcctactacgcgcatatcgttccgactcctatagttcacctccttttggcactaaaagaagtgattttggtataataatcctatttttgagctaggatagcacaaaccttaccatttttttttatttcggcaagcatgtcccaattcaggaaacaaaatctaagacatactcccttgtttcaaagcgattaataatatttcaaagcgacttaattattataatatgaaaggaagacttataatatgatgaacagagacaaagtaagatagaaaaagtgaaaccaaaaccatgaaggaaaaagtgtaaccaacacaatgaagaatgtgagccggtaaattagtaatccgttatttctatagtgacgttcttttctcttgaagatgaagttttatacgcaaaacgagatgatattaatatatgattaattgggttttaattattacaaactagaaaatagattaatatgacattttaaagtaactttcatatagaaagttttcgcacgaaacgcatcgtttagtaatttgaaaagcgtgccacgagtatccaaaattttatcaaattttgttgaagaaaagaacagggtcacagtgataccaattaattacagttataattatgatcctagagctcaacactcggcaagccaagtcgtcactcatataaggagataacacaaattaagagtgccattaaatggtagcatgacttcattacaaaccactgcagaggtgactatcaaaatacatcgaagtatgaaatggacagcacaggagaatgtccgaacttgttcacaacactgcccagatggtatcgctgccagcatacaatctcgatttatgagggatcatttggagttcccctttcctactgttgtcgttgccattggcatgataaacactcggcaccacctccacaccggtcaagacagtaatgttcttcccaattaattcatcggagtccccttggggagtcttattgtgaaagaaccttgcaatgcagaacttgcccgagccaaggttgacaagttgagaatccttgcatcgcttccattcctctggctggtcaaactccttacaagtagctagtagctgtggctgggaattcatcgatgagagatcagcagcagccaagtcttgggtgtcggcagaaatgccaacccagagcttgagctcaggtacatactcaaccttgccggtgaagggtagcatccatttgccgaggtggctccatgtgaagctccgcatgtccatacaataggtgccgacaccttttacagagatgcagatgttcgagccgtcaccaagcaaagcataggaactgatctccaggtacctgcccaagtatgctctgtcatagatacatggcggtggcaggaggatctggcgggtccaggacttcaaggtgctgcttccacgatagtggcagtagatgaaggcctcgaattgattgtttcctaactttcctgttttactcctcttatccattatgtaaaggttgccaccgtcgaagtcaccggcttcctccaggcaggggacgaagatggagatgggtatctccttgggctggtgaagacagggcagcataaccacgcgtcttcttccgcctcaaagataaagcagcgtcccgactggtctgcacacaccaccctgcgatcaaaaagcggcaagcagtctatcttccaatagtcgtcaatacctgaacgtgaagcttggaagttgaagatggggcttggaagttgaatcctatccatgctgcttacggtggcggtggcggcctcctccttattattgttctgcttctggatgcaggcatcagccgcgacaactttggactctggtccgtttcggttcggtggagtagcgttgaagaaattgtggagcgtgaggtcgatgcagcgcagcgatttggattctgggaagcggctgtccatgatcagattcagaaacctccgagagagggccattatcggagtgaacttcaagataaaaaataaactacaggaaaagcatttgttaccaagaagaaggatgaaatcatcaaaatcaaaataaacaggaaagatttgtttaccaagggaaggggaaaaaacatgcctaccttaggtccaggtacagctgctattgtgagggaatgagtgattccagcaaggaggagagcgtatagctgcagggttggcaagaaggcatcaagtgagcagccttataatcatcagagagaacaaggaaagagagtggatgtagatctcggagaaagggcatacctcgccaagccggagaagggaaggaggagcacccagcacccccaacagaatggcggcggccggcggggatgggagtagggagatctgctagggataggttctgccgaaatcgctaaaaagcgatcagtcgcgggcctcccctcctgcgcggcgcggccacgtggcacgcgcggagagggggccgcggtggaacggcgcgggagcgccgtgcgcgcgtttctcgttttctttttcgttttttttctttcggtttttcttttcgtttttttctgtttttttccagatttggcgtttctcgttttttttctttcggttttcttttcgtttttttctggttttttttctatacgtggtgttttttttgtttttttcttggttttcggttttcaaatatgtatgtatttacatatatacaaagtttgtatacgcgtacacaaagtttgtatacagtagtgtagtagtagtatagtagtacaccgaaggtccctcaacttgtcatcgagttaaaaaatcatcctcgaaccgtaaaaccgaatacaacgcatccctcaacgtacaaaaccagtgcaaactaggtccctcgggaagaagaggctgacacgtgggac

SEQ ID NO: 42652 - DNA, 8239 bp, Oryza sativa
  unsure (1)..(8239): unsure at all n locations
gcggcgcgtcgctagttgccaagcgtcgccgtcgtgtcgaccatcgtcggccgccaacgccctcgtcctctccctcctcgccccgccgaaggcaacagcccgccgacgtcctccctagctgcctacccaaacaggagaagagtgagagagagagagaggagaaagggagaggagggagagggtgatgacatggccagctaacatgtgggggcacacgtgggtcccacgctgactcagccgccaagttagacaaaactgggttggaaaaccatcgagggacatattgtgactggttttggttagttaagagaccccgcatatctggttttacggttcgaggacgtttttttatcctgatgacaagttgagggaccttcggtgtacttattccaactatttatatatactagcaaagtgcccatgcgttgcatcggcaacactcaaatttcacgagatgattaatttttaagattggagcactttaaaagaatgatattgctagagaaattacacagttacaactcatccctaacaaataaatcaatccaaacgtatatgacggatctaccttctatgacagataagtaaaaagcaaggaaataaaattactacttcctctgttttataatgtaagtcattttagtatttcccacattcatagtgatgttaatgaatctagataaacatatatgtctagatttattagcatcaatatgaatatggaaaatgatagaatgacttacattatgaaacggagggagtataacacttccattgaaagtaggatgttcggcataatttgtttcgtatagaatggcacacaatcagaaaaaagccatgaagcaaaataatcaagctaactcaaataacttgattagctcaaattctaagataaatacttaaaaattaaatggaaaaaaaatacaacttgattagctcagatcttgagataaagacatataaaaaataaaagagaaaagagaaagctgtcatctcgttgtcgtcgtccctacgccatttggtgcctgaagggaagttcctcggcccggtgcagttctccaccgccgggtgcatcgctggcttcatgtgtgtgcgtcgtcgtcgtcgaggggaacgacccggccgccgtcggcagccaggagatcgcggtgccctaccgctatacccgctactcaagcacatgcagcaggcgcaagctagggcatggagatgtcgaggaggacgaagctgaaccgtcttcggtatgtcgtcttgcccgttgctgacctggcgagctcgttgccatgggccggctcgtcgccactccccctgacgttcgcgcttctccccaacggtggcccgacgtggagcggaaggcaaaagatgaggtagcaccgatctgatgaagcggaaaggaagggaagagaagagatatagtcattgacaggtgggctccacaagatgactcggcagcttagaccaagtcaaagcgtcacatcagcgaaacctcccttcaaaaccactgatagagttaaattaaaccagttctaatagttgagtgtaaagatatgtggtattgtgattcagggatgtgaattagattgaagttactccctccatccctaaatgtttgatgccgttgacttttttaaacatttttgaccgtttgtcttattcaaaaaattttatgaaatatataaaactatatgtatacataaaaatatatttaacaatgaatcaaatgatagaaaaataattaaaaaatacttaaatttttttgaataagacgaacggtcaaacatgattaaaaaagtcaacggtgtcaaatattttgggatggaaggagtatatgggagggagttaaaattaggggtgcaagtggggctggctttttttatggcccgtagtcccgccccacaaaaaagcccgtaaatttgcgggcgggccatcccgtatggttttgcaaaattgtttggcccatcccgcatagcccgttgggcgccaccacattagggcacgagactgggtctctgggagacgcgagacaccgccgcagccgagacgggagacggcggcggtgctactctcgtcttcctcgtcgcccatccatcttcctcggcgagacgacgccgcagcagccatccccaacccccacgtgtgttcggtgcgagcctgctacgctacccgtgctgctgcctccaactctctacccatcactggctccatcggcctgggagactgggagcaggtaacttcgagctgccatggaagagggctgcagttccaattggccggccacaccttgtgccgcagcgacgacggccggtcaattgtttttcctccttcaagatttgtttgttcttcaagcagcaggggatttgtttcttcaagatttgtttgttcttcaaggagcaggggatttgtttgatgagaagtgatttctactcgtttggattattgaataagaacttcagattaaataataagcatttgggtgagatttggttttggatcaagtcgctaagaatggttagcaggccaggactggcttggactatacttgttatgtcattgaaaaatgaagtgttgaacacatgttaacatccttatgtaccagtttgatgtagaccatgtgcaccgggcttcatccgagctgtcgatggtcgcctggtcctttacgttgccccatcacgccggccaatgcttggtggctcaaggtgaggcatggactatgagcagcaataccgtcattgatttgtcccgcggtcccgccaataacttgttgcacctccttgatttctctgctctagcaacttgtgcgacttttatttttcttcttttttttctaggattatcggctggtttagttctaatgcatgcaagactatgattgctcgattgttttttcaatcgatctttgatgttatgatttgtactccttacgcgattaggattttgtatggatctctctctctcttttgctttggttgttgtacgcgattacgcacgtgcggagacggagggcgtcgctcggtcggactcacggacgaaaaaattatgatgatcagaaagttacttatttttgaagtagttaatgtgtcccgaaataataatgatgttttcgccgataatttagtacgtcgtccgtatttgagtcggtttctaagttcgttcgtttttttaatacatcaagtatttatcttgaaggttagtgaaatatgcgttgaaggttagtgaagcgcagggccttgctaggggtgaaaaaaactgaccgctggtgagtcgatcatcggattctactctgcggtacggtctggggtttatgaagatcgattcttgttttgtttatccggtctaggtacccgaaaaagccgaaataccagatgatcatgtgctttcccactcccatcatctatcccatccctactcccagcgcttgagctcccccatccgccgtccatacatccatcaatggggtgggaaaaaaaaagtccaaactgaaagagcatgatggagactgaaaatatcgagactaagaaattccgtcgtaagtatttaatttattttagttagcagccttcattaaccgaaacgagaaaaatatctctttttgtctgacagagtacattatactccctctattcgaaattgatctacatattttaaaggtacatcaagaccaagaaaagttaataactctcttatactatatttactctagcaacaaactcaatgcatgcaccatccccactattttctggctaatagcaaatcaagatattgtatgtgggttataaatgcttatgtgcatggatgcatgcatcaatgttcatttactccaatgtacaaataacaaatagacctaatgaatgaacacaaatatgtagatcatttaggaataacctcaaaaaagactatatataaatcaatttggaatcgagggagtagttaatctattgaatggaagtaggagtacgtactactaagagcaagtctaatagtacagcccactactagctctaattcatctatagccaatttaatagctaattcatacaatagttgtttactatactattaatatatggtcccacctgtcatacacacagtatgtcttaaagtctgtgctgtagctggctacagatctgtagcccgctgctcttatctctcattgtatatctcattaaaatatatttatagctggctaatagcattagcctgctattgtacctgctctaattgaatagtacgagcacccaccagtagcaagtggtcccatcgatttgcacgtcgtgttcaccaaaatactattttcggttatttttgtaaatagaaatgtttttgcaattttactattttctcagaccaaaatacccttgatgtagaccccacctgtcattccctctccccctctctttccccttttcctgtctcgaggaccggcgccggtggccggcgagcgtggcctaatgcacgtcgtcagctgctccttgggggcacgggggcatccccggcttggaacaccttgaatttcgagaagcacgggcaggggaagggcactcataagcagcgcccggacgagcgcggcgttcccgttgccggcggcgaggaagagcgcacgccttgagccacaccaccccggcgtagttcacgtccgcacgcccagacgcgagcagcttcccggccttccttaaaatatgcggnggcgatgctctgctctggtcttgctgagttgttgcttctgctggtccgcacatcttgaggagtaggggcagccagcgacaacagtagcagtggagagagttggggaagatgagttgctgttgctggccgaggcctaccagagcgccatcgcggatgtccgccgcgcggcgggggcttccgggaccatgggttaccccgagggcggcaggcgcctggatgacgagcccgtcacaaggagctgcacggtgttccgcggcgaggagacccacgtcgagcgcgtgcgcgaggtcaatggcgaagccgacgtcgagcaggacctcggagatgcggacagtgatggcgtggactacctcagcggcgatgaggactacgtcggtcgcgagatccaccggccactgcccgcctcccggccgccggccactgcccgcagcacgccacccccaccagccgacggcgtcatcgagagaggaaaagtggtaagagagagggaagagactatgacaggtggggctcgcgtcagaggtattttggtccagaaaaatataaaattgagcaaaaacatttttatttacaaaaataaccaaaaatggtattttagtgaacaccttcaatttaggatggcattccagtgaatcactttgaagcggtagcatttcagcgaaaacattcttttatgatagtataatcccaattttctccctacagagaaaattgggattaaaactcccaattcatcgctgctcccctccagcaccgcgcctctcgcttcctccgtctctggtcgcgcctctcgctgcctccacggctccaccccatccgcgccgctcgctgttttcctccaccgcgttgtctctatccccaccggcaccgctcgctgcttccatgcatcgctccgcagctccggcaaccggattagggacggaagggcgcggggaagacggagaggagaggaggcagatgaggctgccgcagccgccgccgctcaaagcgtccagatctgggtcgtcctctccgattcctcctgctttctctcatccagcatgatcttgtggctataagatctggcggcggtgagctcgggggcgcctgatccagcaacccgcccgctgtagtcgttgaagaagagggtgaaaaccctcaagcggctagaggtagaccaaatattagtttttttaattggtatttttatttgttttttaagcttttgttcttgttcttggctttgtggtggtagtattaaagctatgaaactttgggacaattattccaactttgggaggattttgttaatacaacttggttttcctttctttgattctgaggatgcaaacaacgatcggggttcaggacgatgggcgcgatgggatttgttcttgactgttttatttatttcggattcttttcgatccgagtaatcgggtatgatgcgcaggggtggaggggatcgtgagcaatgcggacaattagcgcttacacggacgaaaaacaagtgacgaaaggaaaaatacgaatcttttaattaggttattagttaatataagatataaaaatacgaatcttttaattaggttacccaagtcgggtagacctatccctagcagatctccctactcccatccccgccggctgccgccattctgttgggggtgctgggtgctcctccttcccttctccggcttggcgaggtatgccctttccccgagatctacatccactctctttccttgttctctctgatgattatataaggctgctcacttgatgccttcttgccaaccctgcaactatacgctctcctccttgctggaatcactcattccctcacaatagcagctgtacctggacctaaggtaggcctgttttttccccttcccttggtaaacaaatctttcctgtttattttgattttgattttgatgatttcatccttacttcttggtaacaaatgcttttcgtgttgtttattttgattttgaagttcactccgataatggccctctcccggaggtttctgaatctaatcgtggacaacggcttccctggatccaaatcgctgcgctgcatcgacctcacgctctagaatttcttcaacgctactccaccgaatcggaacggatcagagtccaaagttatcgcggctgatgcctgcatccagaagcagaagaataataataaggaggaggaggaggccggcgcaagcagcatggatagtattcaacttccaagacccatcttcaacttccaagcttcaagtgtggcccatcactgggagattggatgcttcccgcttagaggtcgcgaggtgctctgcatcgaccagaatgggtgttgttttctcttcgacggagacacacgcaacgctgttaccatgcccggcctctgtcagcccaagcgattcccactctccttgtttgtccccagcaccggagttgataatgacagcggcagcctcttcatcatggagtctgttgttaaaccgaagtcgacaagcagtgggccgcgcagcgatcagtttgaggcctttgtctaccgcacgccctcccctcgccgccacctttcgtccacctgccaatccctccctccaccccctttcgtccgagaccccaaattctccaacatacgcaccaagatcacctcgtacgcagtggttagtggtggctctgagatgtgcatatcggttgaaggggctggcacttactgcatggacacagtgaagcatacatggaggcatgtcggtgagtggatcttgcccttcaacggcaaggttaagtatgtacccgagctcaagctctggtttggcctctctgccaagaccaaccacttggctgctactgacctctccgccatggacgacgactgcttccagcagccagagctattgaaaacttggatggagctttccccacccaagaattggtgggatttatccaactctcatcttgtcagtctgggctctggcaggttctgcattgcaaggtttttctacactcgccatctcatgggctactattatgatcaaatagttgataatcgttttgttgtcttgactggtgtcgatgtcgtgccgtgtgtccatgatactagtagtggcattgcaaatggcggcacgggggatctccgaatgatcaagtatgagtctaaacttcacgtgcctaatggcagcggtgagatcgagagagtgttctgaataatttggatcttgcgttcaactctcttatctattactccctcaatctctaaatatttgacgccgttgacttttttaaacatgtttgaccattcgtcttattcaaaaatttaagtaattattaattcttttcttatcatttgaatcattgttaaatatacttttatgtatacatatagtttacatatttcataaattttttgaataagacgaacgattaaatatattaaaaaaagtcaacggtgtcaaatatttagggacggagggagtatgtagtatgtctaaataattttgggactagggctgtaaaagacatctgggtattccgtttggtttggtagtgtgtattatgtcctattttagtttcgt

SEQ ID NO: 42653 - DNA, 2728 bp, Oryza sativa
aaaagtttgatttgtaaaggtaaattcctttcatttgataacagagggagtactacagaatccatttattaagatactagtgattgcgttaataaaaaaaacacaacagcaaaataacctattttttggcttgcaagcatacaatgacagatttgagatttctggagagagttattgtattgtttatattgtttaactaagggggtgtttagatctatggttgtaaagttttggcgtgtcacatcgaatatatggacacacatttgaagtattaaacgtagactaataacaaaataaattacataatccgcatgtaaattcgagacggatttattaagcttaattaatccgtcataagtaattatttattgtagcaccccattgttaaatcatagagcaattatgcttaaaagattcgtctcgcaatttacacgcaatctgtgtaattagttatttttttcgtttatatttaatactcaatgcatgtgtccaaatattcggtgtgagagggtgaaaaattttgcgaggggatctaaacagaccctaacaatatgccggtactaacgtacggtggcatttgttcttttaactttcactatgttgcttatgaaaagcaagtgcacagaaattgcttaacaaaagttttggtacgtagcctcatttgtaaaataacatcgcaactttaaagaaaaatgatatgccttggtcttttttttttttgctaaaattactaaaacatatatactggctttcatttggtgaataaattcatataacatttgcatctggtgaatagattcaggcaataattgcatcctcatggtaaaaggaggaactatggagacgacatcatgagaaaccttttcacacttactgcgtctgaatttcatttcctggagtgttagtcatgtacctcggctatgtaacagagtagctcatgaactggcagctatgggtagtgtctgcgatccgacggaggcccctgttttggctcctattccggcacaaatgatgtacctggttgttgatgattcagcattgtcatagtaatggaaatcctgatttcccctaaaaaaaaaaacttttcacacttgcatgcctatcttttatttattttctgtgatacatgattaagatggttaactaagatcttattagtgctgatgagcaaaccaactgcaaaattcccaagaggttaatttagcatgttggcaaactctatgttggtcgttagacctcaaacccagagtataaacctcattattatgatagttgatttttgtacctaacatttcgtcaaaataatacaacgcaacttttctagtgcatgcacaacaatttggtccatacacgaacaagaagtctgcccgttcgtcatgggaatatcttcaggaagttctagtgttgcgctcgcaattcacacgaacaggaacgcattgcacacgccacgggcctccctcttttctgctgctcctcctcatctcccttttgttgtgcatttgctcacatgatcagcaattataatcctccaaaaaaactttagctccattcaaattatctttcaattctccagaatgaagcataaaaagttaaaaactgctttgttccaacgcataaatgtagaactagaagctgtaaaagaaatgaggtatttaataaagctaagtaatttgataggaatacagaactgctgattgaaacttgaatactccctccatccacaaaagttacacatatttcacatttgagtttttctaaataaattgttcctatttgtagtctttatgcacttaagacttaaatgaatagataaattaaatatttgattagaactcaaggattcatctaaatactcattggttgcatgattgcatttactctttaattttgtaacatccaagatgatttaatttctccttggtcatggtaacaaaagtaacaggaagtaataggtgtaacttttgttgatgaagggagtataatataagtgataggcatttaacattgtaataatatatactccctccgtcctataatataagggattttgattttttgtttgtattgtttgacctctcgtcttattcaaaaaattttggaattattattttttttgacttactttattatccaaagtactttaagcacaacttttcgtttattatatttgcataaatttgttgaataagacgagtggtaaaacaatataagtaaaaactcaaaatctattatattatgggacggagggagtaatataatataggaaaataattatatactccggtgagtacgtacacatgcttcagtcgaccgtccatccattcaaccaacgcagagatcacatatccgatcgaacctacacagccaaaaagatcccgggataatttaactaaccatcgctgattatttctcagtaaagcgagacatctctggcgaaacagacgcggtggcgtgcgtccatggcgctatccatcggcaattcggccatgatgccagcgcgatccgtcggcgattcggccaggaagcgaggcccggtggctacaggtaatccatcggcggtacagcgacgacggcgtggtggtccatctcggccgatcggcgtcatgacctgggcacaactaggcactactcccccgtcctaaaaaaactcaattcctgagtttccatgtctaacgtttgactgttcgtcttatttgaaaaaaatatgaaaaaattaaaaagataagtc

SEQ ID NO: 42654 - DNA, 3941 bp, Oryza sativa
ggtgtctagtcaatgaatcacggcaacgttcggtagaaacctatccgtcgtatcttgatggatggcatgttcccggatgacaagggatagagcattcttcttaccgccgatcaccctgcccctaaataaaggggatcggcagcactcctagggggttaggcactctcttcactcaacactcaatacacagataatccaccaaacaactggactagggtattacctatcctgagggactgaacccgtataaataagtgtcaccatttctttctagcatctagcgcaccctataaattttattgccgatcttagaaatcgacacaagtgctaggaggccctcgtactccaattatacttatttcaatttcagctgaaattaatgagctcacatactcctattataagtaaaaacttgccgcattattatgcagtgttctaaggtcatacaatctgcagttttgcagttactgaaatgttcacagattcaggcaactcaatgctcagcaagcaacaacaaccactcatataccaaattagacatttgcaaccaggttctcatatatccctgttcagcacatcagaactgctgaataatgtttcacctttttttatgacaaaaatcaagattacataatcaatttccacgatacagaacctgagaaccacacaatacagaaccacagagcaggggcaggggcatttcacaatacagaaccacacagccttgggggcattttcgcaaacacctcgcggacacaggaaacggtgcagcgttctccactggacgaagccgtgcgacggcgtcccccctcgccggtgacgaagtgggtgactgaccggtgcgggctcgtacgctgaaccccatcaacgagtcgaggccgccgaaattggaggtgcggcgcgggcggagtgtgttcctgacgaccggtcggagcaccgcggcctcctccacccgccgggctcgggatgtggccctgcccgcctgcatcagcgcgccatcagccctgccggccggccgcctccacgcacccccggtcgcagcggcagggcagggcggcctggcgcctcttcggtcgcggcggcggcgctggcggacgccgatctggagcgaggtgcgaggccgtctcaggccgcgtggcctcctgttaggcatttgttttgcctgcgtgcgggcccaagtaaagcagccgttcgattcggtttggacggccaagatgcacgcagtgtcatcctgtgacatgcatatactaaagctgtgtttgtttcaattaagattattgtaatctagattattgagccagattactataagctggattataataagccgacatagaataaattgttacctgtttgtttctctggattattagttgtttgttagctgttagccacctaataatctaaaaaaacacctttagagtggattatcatattatagtaatgtggcttatagattataataagctatcacaataagctatctgtttgtttcaacttactcctaataatctagattataataatcctaaggtggtgattggatccagggactaaactttagtccctgtcatatcggatgaatttggagtattaaacataggcaacttataaaactaattacataaataagagctaattcgcgtgacaaattttttaagtctaattaatccataattagtgtatgtttactgtagcatcacataggctaatcatggattaattaggctcaatagattcgtcttgcaaattagtccaagattatggatgagttttattaataatctacgtttaatatttataattagtgtccaaacatccgatgtgagagggacttagtaaaagttttagtcccatctaaaaaggctaaggccctgtttcttccagcttgtgattattataatctagattattgagtcagattactataagctagattgttataatctgtattagaataagcggttagttgtttctttcctagattattagagtctagattattgggtttgcaagtctaaagaggaagtggggtggcatggtgggtaatttttcactcaataatctaaaaaaaaagttcacctaaatgagcttatcagattataataagctgagcttcaaattataataaactaatttaataagttatctgtttcttttagattactcatgataatctggattataataatccagaactgcaaaccacaccccaccccccccccccaaaaaaaaaaaaaagcgcaaagcgacgggaggtcggagcgagcagagaagaacgcatttgattcagaaatctccatttgaatctctctcgtctcccctcgatccctagcttcctccctgacaccatgctgccgtcgcacctcaacggccactcccccctcgcgcgccgctgccctcgcctctccgccgcctcgccgccagccaccggggattccgatgcggcggcggcggcggcggacgctccgctggcggagcacgaccgcatctacttccagtcatactcccacatcggaatccacgaggccatgatcaagggaagccgccatgcccacatccgtacccgattcagtcgccctcttcgtacaaaccctaaacccccacaacccctgggccgacccgtgttgtgagtccgaagtcgcgatttggtggggatgacgtgtgttccgtttccttgggcaggatcgcgttaggacggatgcttaccggtctggcatcatgcaccaccagaagttcatcgacgggaaggtcaatgtgctcgccgaatagagggcggatgattattgcgtgctgttgggattggattacaaatttcggtgattgatttcgaaactttatgctatgcaggttgtgatggatgtggggtgtggaactggaatactctcggtgttctgtgctcgcgctggtgcaaaatgtgtaagctacaaaatccctgtgctgagatgattggccaatttaaatgcatagcataatgtttggatcatgcttgcaaaactaatttgaccgtgctctctcatccagtgaatcctactttagtgtaaagaagtacattttgtgctgattcagaggtactagtatagttttgcatgcttgcaaattgagcagcgataagtgttgtaagatggatttttttcaatgcttcattttgttgtgctatacaaaaggaaaaaccagctcagttcttgtttgtgaaagaaaaacagcttttaattttatcatttctatgtcctaacaaaagtgacatggatctgtgtgtgctaactaactgatggcagctgtgtttttccctgattcaactagatgttaagtcttgtagtatatggcactcttaacgtatttttctgttttcactggtccatttgtctgccttataacagtgaactttttccatgtgtattcaaatggacttacaggtgtatgcagtggaagctagtgaaatggcaactcaggtaacattattttttaggatatatactctaatattaaattgtattctttccatatcttgtttgttgttcttttgttgtttatgtgtggaccatttttttagttatacaatataaggacatagaatacacggttgcaaaatgacagcactcaagtgtattcatgaactaggtgtttgtagtggtatccataacaaagattgacagtgaagcttcctactcatcttctataaaataccagttaccagttaatactaccagtcacaactcacaagagagtatataacaatatattaaaatagtgtattgatcttgatctttgcagatattgaatattagtgtcatatttatagtaatctagcggatcatactattttgaaaagtaactactcttatgggtatgctgcggcaaataaatgtactcctttttgcgcaggctcgtgaaattgtaaaggcaaataatctggatgataaggtcgtcgttgttcatgg

SEQ ID NO: 42655 - DNA, 2046 bp, Oryza sativa
tctgagtcattattgtttgaaaatatatttacattagtatttttacatctttactttttttatctgcatttttttaacttacactgaattgacagtgcaggatgttgaagttgaggataaggttgatgtgataatatcagagtggatgggttatatgcttctctatgaggttcattcttttatatggttgttttttgcgtcacaatttgatattctcttatcttccctagttctatctccttctgatttctctagttctgttttcgtctgatctgcagagtatgctgcctagtgtcctgtttgcaagggataaatggcttaaacctggtggtcttatccttccatctcatgctacggtatataattatcacatgtcattttatttctcatgcatgtgcatataaaataagatagacctagagaaaaaaaatcctacttttgcaaccaatatcttacctatcttacatgtgcatacaaattacagaacagttctaagccttggcacaaattgcagaacagttctaagcctgattaactatgtatccttcttttcgatagctcttcatggcacccataacaaattctgagaggtatgaaggaagtgttgatttctggtctgatgtctatggcataaatagtaagttactattgttttgttattagagccgcattatgcatcacattcaccatctcatgttggatgctgatttttgcacactataacttgatttcgtgcttgtactgctacagtgtctgcacttgtgccacttgccaaaaagtttacatcggaggagccctccattgaaataatcggtggagagaatgttttgagctggccatttgtggtgagtcttcacaagactgttgtggataatacttttcaaataaataaccatatttacctgttgaggcttattaacttctttatgtctacttacaggtcaaacacatagattgatacacttttaaggccgaggagctcaaatctttcacaactaaatacaaagtttcatccatgatgttaggtgaatcgtctcttttcctgaataatattattcctgatgcggaatctgctatttgactcgaatctataaaatcttcttcaatcttcatccacatacagtttatcatatgaaacatcaatgctcagctgcatttttcaatgtttattcagttctgaaactactgatcggtctttgattgctcatctttctgtttatacaccatacatatcctatcttaatttgctgatagaaaatatcttccatgtgaagctcccattcatggctttggtttatggtttgaagtggagttcaatggcccttcaaatcccacagacaaatctccttccgatttgaatccactcgatgttattcgtaagaaaaggcgccgaggatcagaagatccagtggtgctatccacagccccagaggatgagccaactcattggcatcaggttctgatttctgaaaatggtgttatccttaattgatctattcaatatattacgctattcctgctcttcttggtgtaaatgtgtaatatggtcatttcttgttctgcagactattctgtacttccctgatcctatagaggtgaaacaagaccaaattatagaaggctctgtaaaagtgtctcagagtgaggaaaacccacgttttctgaatattcaactagattgcacgtaagttcttactagagattgctattttgtcgtccggctcaacacagttgctcgatagatgttataatcttgtagttacatggattcagatttagccaagctacacaagcactctgaattccttatagcatgctctgttttgaattttgtccatggtgtcaggatgtgaattatgctgcccatatgggcgattgaaatttgcaaggatgataaattgcatacattgcctgcttgtgcctctagcggatcattttgttggattctgatatagaagtccctgtttcctagcaagttcgaatttacatttgtgtagtactatagcttgatttagttcattttgagctttggtgcaagttttgttt

SEQ ID NO: 42656 - DNA, 1354 bp, Oryza sativa
tgcctcagcctgcacaaagtgagcctttttttttttgttggtggtgttccaactcaaagcgaccaatgtggttgaattggaccttttggtttcacccaatcgtgaagcaggatgtagacttaagattttctgtcagatagattgacttaataaatctcgtgatattcttctttcgctgcagtaataaactatagttaacgtgcctgtagattaaagctgctgtagccatcgtaaactttaaccccttgaattcttacttcccggtgttgactggtgagtgctgacagtcaggtgctttgagcgtgcagtcgtgcgtgtgttcacgtggatgcgactgacactggtcttaatttactaatcttttccctgacactgctctgtttgaagtttccagataaattatgttaagcgtgatcttacgtgtgcatcatttcccgcagcaaatggctgctagcgttgtctccacatctgcacaggccacaagcccacaacaggtcaggttgaaatgcaaaagctgatgtgctacattattgttcccaggacatcacccctaacgcaagcaaagctaacaaacttgttacatttgtctgcaccaggggctgtattatcatgcatacagatacagtggtagaactgaacctgtcaccaactcaccatgcatggttaactcatcattcttccaacttgcatgcattgcacagttgcagtacatattacagtacttggccatttgacaagttcagaacttcaggaaaggcctaatagctgcactttctctggacaatacttcctccgtttcacaatgtaagtgattctagcattttccctattcatattaatgttaatgaatctagatagatatatatgtctagatttattaatatcaatatgaatgtgggaaatgctagaatgacttacattgtgaaacggagggagtagtatctatctatacataatatgtacggtcatactccgtatgtgcccatacttggcaagcacgtgtgtgccactcgaggggtatacgtgctacatgtggagtagtaaagtataggtacttggtagcctgatagcgagtacgagtagtgtactgcttatatatacttctagcatgtattgggtccgaagccgacgtatccgttggctgagtcgacggtgatctggatcccttcctgctgtatgttccccaggatggagatccccgacgacgacggcgcgaacgccaggcagaacacggtgccgacgacctccaccagcagggtcctcgccggcagcgtcagcacggcgccctggtcgaagtagaacgacacggtcggcacgcgcacgctcgcgtacccgctcaggtcgtagcacgtgt

SEQ ID NO: 42657 - DNA, 2468 bp, Oryza sativa
acgtcgaagccaccagccgcttctccaggtgctcgacgcgggcattgtcgcgcgcgacgaggccgacgacttggtgccggcgcgacgggtacgtggcgccggagatcgcgtcgcggtgcaccaaggagagcgaagggttgttgttgttgcggctacggtgaacggccgacgccgacgccgacgacgacgatgacgccggcgtggtgaagttgtgagggttgatgtagtggaagcgcggcggcgaggcgggggacacaatgagcaccgatgtggagacgaaaaggaggaagaggatgaccttgccgttggcgacgaactccatggttttcttggcacgttttttccctcttggtgtagttgaaatgctttgcaagtgtgtgaggaggcgcgggcgaggctggtgaatttatctctctgtgcctgggagcctggccgtggcactagtgcaagtctcaaagtgtcaaggtctgcaactagtgctatgtacttgtacagatgtagtggtatagttgttgggagtagatgtgtcttcacctttcggatctttgacgctatcaattcttccatgagtgaaattcttttgttggaagagtgaaactatttcttcatgcatgatatcaaccactgttttaagggagaaaaaaaaagttagggagttgatcaaccagagtccagagcccaagactcaagcaaatgtagtttttgcttgcaaaatgcagaaaagtgaccgactttttgctaccgatggtttgaagtttagaacctggacaacttctctgggttcattcagaaatttcttcaggaattaacttgtcacgttagtaaacttttccttatcggtgatcacatcctgacacaatggaaaaaacttgaagacaaaagcattcatcagcctaactcgtgcgtgcgtgcagcattagtggagttggattacagtcagtttgacagcgaggcaacatgattcagttttgtccgtttttgggtttttgaatcttttaaggtgatgcctttaatagtttgcacgaacaaaaaggcctttcgcatttagattcgatatcgtcctttgcctttcttgatgcttctttttcttcttcgccggcagatgcagcacataaacgaatattggtatgtatatacttgctaattccagctctgacagaacaagttcatgaaaaaatgtggcaagttaaccctttgataccacatttttcgctgtaattgtgacagatttctggaggcatgcagccatggaactcaagtactagcacaagtgtcatgaactgaacctactcgccaaggtagaaaggaataatctttattaatcatgcctattggagattgcagcatggtgacgactgacgaggactaactgattgtgttttgatgagaaggtgctttcagatgtccctctagcctgtatcgatcaaaagcatgaagggaccgcacaaaattaagctccagtttgcatgctggattagcctttaagattggttctgaaaacaacaaaaaaaattctgctagctgatattcaaattagcaggtactgagatacttctgcacatgctcaccaaggcagggaatcatgtacagatacaaaattcagcataaaaatacaacagagtctactatacaatcaaacatgaaaagtataaacagagtctagtatatatgccatgctgcatctagaaacaaaacgtttgcatgcatgcaattgataatcaaaacttgattacaagaagaaagttactatcattgttgtctttttccaactaattatgatgtgccagtgagtgggatgagttagaaagttaggtttcttttggttacttttgtaggctgtgtggagagggattgtgtgtaagcatatactgtactaacatatcatcatctaaatatatgcaaacacatgtcattgttcaaaacatgacatctgagtcggccgtctttttgtcgttgaaaacaagttgttcagtccctttccaagcgttttcgaaatggtgtgctcactataccaaccattaaataagtagtagtagatcgatcgagttagttgaagtgttgaacacaaagttggcagtccattgcgtgctgaaagattaattagcgtatgatttgctcctgccactagtactatcattctctttctctaatctctgcattgtgatcgctgttggttgcatgcgtggttatcaaaagccggcgacaaaaatggtgtctcattttgttaacttgtacgatcgaaaatgacagattcacgccttaacctgtatagttaatctcatatctttacatgagcagcaaaaatattctcaaatgctacagacatttgcatatataccctctacgaaatgaacaccaaattgactcatgtaaagcctcatatattccatgtaaatattgtgtttcagtttgattgagagtttaacagacaggctcagttctgaaggactataatagcaacagtagct

SEQ ID NO: 42658 - DNA, 2850 bp, Oryza sativa
gataaggtactcgggaagtgctggattacattgggggcattcaaatgcgaacatgcaatagaagaatctgagtcttttgtagaaatatggtctttaagtggtgttcattaactaagaaatcatatcgaactctatctttgtttatgcctaaagtttgtgttaaaaaaaatctaagtagtactagtcagatttctatttgtgttttaaatttatccaaaatcactatagaaaaactcaataaaactggcagaaaaacgtctcgtgcagcaagcaaaaatggcccaatgccccaatccgattcgtggtgcgaccttgaaaaattttgctggtgggccgtcggaaaatgttcgcacgcaaagaaacgagcgcacgcccattttctggtgtggaagtggaacagatgctgcttcctctgtgtagtgtactgtctgttgtgccaggctgctcccttcgtttgcgtaatccgttcgtaatttcatttattggcgtctaagaaaagagaacgagcttttctccttgctgttatctacgcccaatacactcatacgtatcgtaagcaggttttaccaaaccgtgtggttatcatgttttcgtggttaccatggtaaccgccgaaccgcggggtgcgtggtgaagagtcatggcagagtttgcaagttgatatcccgtgtttactgcttagtaatcagtaatcacaactatgaccaagaagctcataagagtgagatgctacttcgttggcatgctacttatcagctcatttctttcccttgtaccagatgttccgcgttaccgagcttcacctctccggggccggcgccggcgccgaacagggactcgatctgctccagcgacttgccgctcatctccggcacgaacacgtggacgaacaccacggacagcgccgagaaggcggcgaacgcggcgaagggcacccgggacggacaccggggccgcagaaggaaaggaacgacatgggcaccgggccgctggtcagcctgttcacggagaaaccgagcgccaccgcctgcgcgcgcaggcgcagcgggtagatctccgagctcagcaccatgttgatcggcccgatccccaccgagaagaacgccacgaagccgcacaccgtcaggatgggccgcccgatcgccgccgcccgcggcagcgcgccgtgcgcgagcagggagagcgacgcggcgagcgcggccaggcacgcggtgatcccggccgtgctgacgtacagcagcggctttcgcccgacgcggtcgacgaggacgatggcgatcacgatgaacaccgcttggagagccccacgccgacggtggcggcgagcagctggctctcggtggtgatgccggcgtcccggaatatcgtcgggctgtagtagaccagcgcgtcgatgccggtgatctgctggaagagctgcacgccgatgccggtcaccagcatgcggcggatcaccggggacggcctcaggagctcgcgccacacggccttgccgttgccggtggccgtgacgcgcgccgcctcctcgatctcggcgagcctctcctgcgcctcgtcctcgccatcggtgaccttgagaagcaccgcgcgcgccttggcggcccggccctgcatgacgagccaccgcggcgactccgggatcaccagcagcacgaacgcgacggagatggaagggacgatgccggcggcgagcatgactcgccagttgatgtggtcggggagaccggagaaggcgaggttggagacgtacccgaggaggatgccgaggctgatgaagatctccgggaacgaggcgtacgacccccgcagcgtggccggcgtgatctccgatatgtacaccggcgccaccatgatcccgatcccgatgccgatgccggccagcagccggcccatcatgagcacggcgaaggacggcgcgagcgtcatgacggccgcgccggcctggaacacggcagcggcgagcccgatggtccatttccgaccgacggcgtcggacgtcctcccggcggcgaggctgccgaggagggagatgaagctgaggcacccgacgagcacttcttgctgcacttcactgatgtggaggtccttctggatgaatatgatgcagccactcatcacaccaacatctgaaaattaacagccacgatgtaacacaggatttgacaatttgtgcaaagatatttcatccatttgaaagtttgatcgattgttcacgagacaaacaatgtcaatggctgtctgagagagagactcagataaagattaacaaccataacaagtatctgaaccaaattaccggtcaaaatttacatttcatctgaatctgaagcagaatgggctgtcagtgatgataacttttcaaacactttcatcttctaaaagcatattaacatgacatacaatccccatattttactagctgcaaatcttgctttaatcagaaaataaacccctgattatgtgtaatacaaccaaatctgaatcaagaacagtcaaattcaggagaggggctcaccgtagccgagcaggacatggttgagggaggcgaagacagagcaggcaaagacgtatctcccgctgccgccgccgccgcggacacgaacgacgccgccgccgccgccgccatctccctgctcatccgggagcacgtcgtccatgcgcacgtacttgctcttcctccccaagaaatccggaaggctcctcatgccgccgccgttgcccgtcgccgcctcggtggcacgaagccccattctcaccgtctttcttgtgctgtgctctggctatggttggctcatcctcttctctcctcttgcaagctccaagaatgtggcttgtgaatgggaaaaggac

SEQ ID NO: 42659 - DNA, 3468 bp, Oryza sativa
  unsure (1)..(3468): unsure at all n locations
cttttgctcaacgccaaattgtgtagcgttgaatttagacacctcagcgccaaatagcatgacgctgaatgtacgttggcacgctgacttagtctcccatccgtcgtggcaccgcattcagcgccagctaacgtggcgctgagatgtctaagttcagcgccacatgatttggcattgagcaaaagggtcagatttgaaataagttttggcagcggttcatttgtaaaaatagtttttgcaaaaagtcaaattgtcaaaatttgtatcaggaatctgcccacattttcatggttgtgttattgtgtattcagtagtaaggcttagagtgaaattttggagctgtggtcagtcattttggcatgaacttgcacaattgctgaattgcagagtattaaacttgaggtatcaccttgttctgaatattcactcgagataattgctcttataccatgtggttagatgtcaaacttccatttggcataaaatttcttctatttgctaaaatatcatataactcactggaaattcgctctttttcaatgaatttgaataattcagttcagaatctatttacattcactgtaatggtttcatggatgtgcaagtgtagcttactagcattaccaactgtgactgattgactggcacagtggcaccaacatttacactgtatgattcgttgatgctacagaggattctgaagttggaaaagagtatgagatattttctttcctattagtgctctaaaacaaaacaatttggtttgcaatttgcattcaccgcaacaccagtatctagtaatactgttaaaacccacctaaaaaaatggccaagttcacattgatccatttggtcaataactcaagatcctcatcccttgtgcaccaggtgctcgccgtaacggagctcaacctttccccgcgccgcttcgccgtcgcccgccgccgcgccaaagagcagctcgatctcttcagcgtcttgccgctcgtttncggcacgtaccggtagacgaacacgacggacagggcggatatgacggcgaagacggagaaggcgccggcaaccgagatggcgcggcagacggacaggaaggacatggccacggcgccgctggtcaccctgttcatcaccgcgccgagcgccgccgcctgagaccgcagccggagcgggaagatctccgagctcatcacccagcagatgggccctatcccgacggagaagaacgcgacgtcgccgcacacggtcaggatggcgacggcgatgccagcgctcctggacgccgacccgtgcgcgagcgcggcgagcgtcgccgcgagcacgacgaggcaggccgtcatgccgaccgtgctgacgtacagcagcggcttcctcccgacgcggtcgatgagcacgatggcaagcgcgatgaacgccgtcttgaagaacccgacggcgacggtggcgacgaggagctggctctcggtggtgatcccggcgtcccggaatatcgtcgggctgtagtagacgagcgcgtcgatgccggtgatctgctggaagcactggatgcctagcccggtgatgagcatccgccggatcaccggagacggcctcgtcagctcctgccacaccgtcttgtcgccgtacttgccggcgctcgcgacggcggcggcggcccgctcgatctcggcaagcctctccttcgcctcgtcctcgctgtcggggaccttgagaagcacctcgcgcgcctcgtcggccctgttcttcatgaccagccaccgcggcgactctgggatcaccagcagtgcaaaggcgatggacaccgacgggaggatgccgacggcgagcatgacgcgccagctgacgtggtccgggaggccggagaaggcgtagttggagatgtacccgaggaggatgccgaggttgatgaagatctccgggaaggaggtgaaggagccccgcgacgccgccggggagatctcggcgatgtacaccggcgcgatcatgacgccgaacccgatgccgacgccggccagcagcctcccgaccatgagcacctcgaacgacggggcgagcgtcatgacggccgcgccggcctggaacacgatggcggcgaggccgatcgtccatttccggccgacggcgtccgacgtccttccgccggcgaggctgccgaggagggagatgaagttgaggcacccgacgagcacttcttgctgcacttcattgatgtggaggtctctctggatgaagagaatgcagccgctcatcacaccaacatctgggaacaaaaggtttattaccacacagaaattgaattatatatgcattttgtgtgtaattatcttaaacttaatttttgcccgggtgcaatttcatcttaatgaaatcaattccattatcttaaaagaaaaagttagttctagtcaaatttttagtgtgttgctaaaatgctgtcgaaaaaaaaaaagctactacgagctagctgccgttgactgaaattagcatcgcgatgattccaaataagtggactattcgatatcagtagtgaatagaaatccatctgaacaaaacattgtgatactagttactactgattcttgattatgaagaaactgcattgctaattactaaccagttaactagtaaccgtagtttagactactcaacaactcctactaaacgccacaaggtaacagacatggaataagctggagagtcgccatcaaagaccgaagactaatgaagaagaaatagtcaacgcgattggccaaaacatttcctactccttgtgcaggatcaccaagaacttgccaagatccaagcacgcgtatcgaaattctccatcgattcagccaacacgaacacatatacgtgcgagagagattcatgtggaaacggaggagattagttaccgtagccgaggaggacggagttgagggaggcgaagacagagcaggcgaagacgtagcgcctgctgctgtggctccggcggacgcggacgcctccgcctccgccgccgacgccgtcctcctcctgctcctgcggcagcacgtcgtccatgcggacgtacttgctcttgccgccgaagaatccagggaggccgccgccgctggccgccggcggctcggcgccggggagccccatgccttctgcttatctgatgcgctccctttgctccgtcttcctcctctccggcgagtagagggcggcgcttcgaatggtactaatggtggtatcgcggattgctggatctgaggaggaggaggaggaagaagaagtggaggcagcgagagagattttataagtttctaattctgtccgcttttgagttttgacacgcgatttgctgttcaacgccaaagcggaggaggtcgaattttcaaatgggtcattttgtgttcaagcccttgtactactcgtgatttctgacaagggtactgtgggctcttggggcattgggctgggcagtacttgcacttggggatcctc

SEQ ID NO: 42660 - DNA, 9735 bp, Oryza sativa
cttcttgatcaaaactcaaattctcaatctacaattgtagtagttagcaatcaagtccataaagctcaaaaagaagacaaaattgtctggcttgaatacagcttgagcgacagcatagtaatatcagttcatcagttaccttgtgtaacactgcaatatagattgatcgtccaacaacggcaataactcttcaagcaagagaaactagctgaggatacagaggtccaatctaactctatgaacacaatcgatggcctacaacacaagtataaagggcatataatcacaaaggttcctaaactgttgcatttcatcatcacatttcagtatctttcgaattcctgatccaatgtcaacattgttgtctttcttcagagaagcttcccgcttacactctggcactctgcatgtacaggcatttgacaatctgagccggaaggtgcttgctttggcacgacaacaaacttcaaattttttggagcacatttatgtatgtgtagcttgagaataggacaaacaatctcctgaacctataaacacaagcaaaatgtcagtttcctgaatatattgtaaaacacacaagttttgagaattttgagccccttaaatgcttcatttctttcccatcatgcagtatcacacaaaaaacaagtctaacaatgagttctcaaaaatacaaacaaccagtcttacagtagtcaaagaaacaattgagattgtatatgttggccatgactttttttgggtgtcaaagggatgattcttatgaggtactacgtctatattgcaaggtagaaacttctttttaagtgataattttgaaccacacaatatatatagtacttcctagaagtagacaacatttaagtagtgaaaacaaaattttcaacttaccaaacccactggcttttgtgtgaagccattgcctcaaagcttctggaagggctattattaacaagagtataagttggttgttttgagcttgaggagagggtggaagatagccaaatgtcaactggaccactgtacttgcgaaaaatgttcaagcttacctatccaaataaacaggcataatccaggttagcttcttcaaattaatgtattcacagggaattgtttagaggttaactagcctagtgccaataaaaatcatagaaattagccatcaaatgagatagacacatcaagcaattcaaatctatgcagagaaggcatgtgtagtgttattgttttctgtctttacttccaacgaaaatgatgatatcaatgcatttaagcacgcaattcataaattcaagaaagcaatgcacaggctcttttagactctggaataagtagagtatatggcaacgtgaagaaaataaagctaggatatcagggaagaattttacaagctcccatgcttcaatgtgtccttgcccgttgtcacgcagaagcttgctgttcatagaaaaatagatttattaagactccaaagaaaaatgctagaaacaccctgcagaaatatgctacatatgtgtaatctagactgtcataagtgaaagaaatgtaagcaaatccggcattaaatagatggaataagtgcacatcaccaaccaagagctacaggccatagtcatgacatacatgaattagccaaactgttcaattaaagtgtgaccccaaaacaacttatattatatatgcatgaaagggatgagatcatgggagagaaagagagaacccttacaaaggggtgtggtgatgggaaaggggaggccacagttatgttgaagttaggtaatacactttctttcggcagaacatgttgtgacttgacaagatatgtaacttaacaactatgtagatattatagaagcttgtgcggacaagctaacaatataaaatacatcagtaccagaaaatttttcttacaagagggcatcaaactcaaacagttgttattctaaaaatgctaaacaacaaagttgaactaaccagattccatgatgaacatcgcaatgatttggatggcctgatactcctcgggaatcgaaggcaacaatctaaaatgacaacaaatattgcaggagtaaataggggaatcggaatgaacaaaatgcaaaatttccatattttgaggtctagaaaatcaggacgaaaaaggcatttcacttgcacaatcatatgatgtactcaacctgggtacctgtttgcagcaacaccgcactgagatttggaacagattaactaatacagttttaaatggcatataatacagataggcgcacttgatgctcctgtttcttcactatattttttatttttaaagttgttcagaacagtaaagctcgaagcgaaacataatacaggaaagcaccaaagttgatagagtatagatatgaattattattactgggagatcatctgaatcttgacatggaatcattaccgtgtcgatattccataactgggattgtgccagggtaagttctgctattagtccatgatcccaatttttatgaaatccatcctacaaggtacattgtgtaaacttaagtatatatttggaacagtacctacatacaagcaggtcggcaaaaatgagctcataataaagcacctgcagttctgagtggtccaagactttaacttgctcagctggaatctgtaaatacatgatccatttcaacacatttttcaatggacaaccgaggtcaaaagaccctctccaaggggtataatggagcagagtaggacttattaccttaagagtgacacaggcaaggtagagttcctctttgcggatatttccaaggccatcagcattgcctaatatggggattaaattgacaatcagaacgaccgactcagatgaggtttcttatccaaataatggcgcccttaaagagtagaaatacatatgattgagctgagacatactggaaaagcgaaatacgcacataggatcagagtgtagacgtcttttaccttgagacaagcacaagatatgaatgctgtgaccttttgacttgaggaaaagaatagtcggagcaaaaaacctgtatcagcaacatgacaatcaatcagaatcaaccaaaacaaatactataaacaagatttcccctaaacagttccacaaaataataaaaagttcagctgttcacttagtttcatttctgtaatcatcctgcttttgtaagaactttgtttcatttctgttaaatggaaatggagggagaatgctcccttagctcaaaaaaaaaaaaactgttcacttgttcaggaatttcatcgagcaggtaccgtgcacaggagttagcctattaagcttcattgttagcggttactggaactgtagccccacgatttacacagcgaggctcgcaaacgataagagacatgaggaggaagaagcagtacatggattcgtcgtcggggtgggcgagaacgaggaggacattccggctcatcctgtcgccgcgaggaggggagaggaaggtggagttggcaggcagacacgccggcgaggaggaggagagcacccgccccagagaaaccgcccacaggagcacggcccccgccgccatgagcatccagatccacgccatagccttttccggcggccgcgcgcgccactcttccccgtgcctgtgtggctgcgcggtggtggactggcctctcgtcggtctcctcgagttctcgccgacgcccagctcgccgccttcctcccccgtggcgccaccgctcgccggtgggctcctcgtcccctcgacgtcgacgacttccggcgacgaatacggtgtgacagcgctcatggcgtgagaagtggcttaatgggccagtgctggtcggcccatttaaatgaagaaacgggccggttggattgggtactgggccttgcatccggcctggagcccaccatcctgtttctaattttcgtatggattaattaaggatcgtattaatgtcatttcaaaccatactattttcttaagtaaagttaacaaagatacgcattcatttagttttttaaccaaactttggtaaatataaaataaatcatgtcaaaacttgacaatattatcaaattgccaaaatttggtaaggtttattttggctcccctaaacaagtggttaattacttaatttaggtggacaaatcgataatgtaagcctgtggttttattgcatgatttgtcgggtaaaaaaaaattactaattgtacatcacttgacaggcctctctcactgaaagctgaaaccccctaaaccccgaagaaattaacagttgaaacgaatgggtaaataataaactcagacgaggccgacgagcttctcgctgaggtcccagagcttcctggccttctccgggtcgctggcctcctgcgagagctggttctcgaacgacgccgagtccttgttccagctccagtacacgccggacttggtcaggctcgggtcgcccaccacctgcgccagccgcttcccggactccgcctccgacacgaaccccttcgtcacgaaccgctggaacggcgggaacagcagccggaacagcgggatgtgctcgcggaacaagcccgtcgtcgcgatgcaccccgggtacagcgacgcgaacgtgatcccggtctcctcgtggaatctccggtggaactcctgcatcgtcagcatgttacagatcttgctgtccttgtacgccttggcgccgtcgaagctctccgcgccgtcgatcatcgccgacccgttctgcccgcggagcccgccggcgagcccccggaggtcgcctagcccggccttgggagggacgttgccggcgagggtgttggtgttgccggtgatggagccgaggatgatgagccgccgcgacgggtagtcggatttcttgaggtcgtcgagcatgaggcgggcgaggaggaagtggcccaggtggttcaccccgacgctcatctcgtacccgtcggcggtgaacgtcggctgccgcgccgtcggccggtagatggcggcgttgcacaccagcgcgtcgagcggcatgccggagcgccggaagttgtccacgaactggcggacgctgtcgagggaggcgaggtccaggtgcatgacggtgtagctccccgccgccatccccgccgccttcgccgccgtcgccgccttcaggaagtcgcggcacgccatcaccacgtgccacttccccgtctccgccagcgccttcgccgccgcgagcccgagccccgacgacgcgccggtgatcaccaccaccccctgccgcagcgtcttcttcccgtccgccttcgacgtgcccgcgccggggctcgccaccggcgccgccggcgtcgccaccgccctcaccaccagcgacggcttcttggccttctggctcacgctaaggaaccccggctccttcaccaccgcgctcaagttaccctgatcagtcgtcacacataatccaatcaaaaacttgttcaaaatgcacaaacttcacacaaataaatccatttttgacagaattcaacaatgcagatgatttttgggtgcgcattgttaccttcttggggacagagagagcagagggcaggagtgcggcctgaacttggagagccattggtgtgagtgtttgagtttggagtgagctcaagtgtactatgtttctggtgtccttttgcttcgtgttggtgaccagcaagagtgagttccggagggtatttatacacggacccgaggagcgaggagcgccacgggctaaggataagggggtgggccccccaccacgctggacgcctcccagccaatcgcagctcgtgcctcggattttccgctacgatttttttccttcgagatattgtcctgtgaaagcgacacgtggtgggatattttttcgtaaccgacacgggggacagcgacgtcgcgggatcttctgcgcatggctgcccgtaacatatggtgacgtggcgttgtgtgattgggtcgtggctatcgcgacccgtgtgcggtgtttgggcgtggaggacgggatgggagtcgcaaataatgcagcatgggaggtgtgggccactgatgggtgggaccagatagggcagatctgtcgttttgcgtgggaagatgacgcgagttcgtgcccatgtgaacgtgcggtaaacgactggctgtggcccgagacacgtaggaaaggcccattgggtctgtgctgacttggcaaccgacgtggcacgatatccgttgcacttttcatcgcctcttcttggtgtcagcatcgcagcattggtaagattttcttttcattgacaaatacagtacaaaagtaggtgttcataaggcgcgtagactcatccctataaacacacatatgcacactctatcctataaatatattgaaaaactaagttgggagattgacgaaatcaccaccgacggaataagatttaaatcagctgaggatagtgtagtactccctccattactaaaagaccatctttcaactttaaccagttactggttaatctgaccagtaacttgacccaaatttcaactttttacgctaacgcataaaagaattacacgtcaatatattagcaaggaacaaatttcacttttcaagttgcaacttgcaggtagtacgaaactatttctaatctctgtccaaaatgtcaggtaaagtggtaatggcttgcatgaaatgcgtacaccagtctcagttctgaaatgtcttactagcagttaagccaagtatacttttttctaggtgaagttaagggcatgctcagcttacttggtcacaactgcaaacacaagagagtttttgctgatggttatcgctgttgcatttgtgttgcgctgcagctgcgaccaactcaatcatgcaaggcctagcaagtacttgatgcggttgtgcggaatagtgcattgtctttttggttatgcttatccgcatagtttattaacaaccaaatagtatatattataagtaaaaatttatacatgtgtctatagcaatttaaaagcaaacgccataaaataaaaatacgatgaaaaatcataaaatcatatcaaattaaaaatttaaatttaaattttagcttacaaatataagcataagcaaaaatgataaggctattcgatccagaagctgtctctcggcgaacaaaatgaacacctgagagacaaaatgaacaaaatgaagcaaatcttctaattaagcccaatacgtttcatttccaggaggcccattgctatgggccccatcacttcctcatgcaggccacaaaaacctgggctaattacccacaacaaataaagcccaattgcccatgaggccattcaacccagagattcaaccaagatgcatgacgagttgccctctggtcgttatcgtcctaatcagacggtgcctattttagcttccttctccatcaggatctcgctggaaagtccaacttacctacatcagtatatgacatttttcattcacatcaatcttagcaagcatgacataatttactatatgatattatagaccgtcgtacgctcatactaatgtgattatctgctgatgatggacatcgaccagcacactcgtccttatcgtttgaccaaaatgacctgatccaactaatcatatacatgcgagatcctgtgtactatagtaatgtattgtagcgctaattaaattgagatgatgggcgaagaggcgtgcttggtcgagagaggtaggatgcgtgtgtccacgaacaatagaccagggttcagcttaaaatgtttaactagacgcatgcagatgcagaagcttgcgagttgttcatatgataattattaattcagaatatattacagctgatcgatcgagctggtagctactgtagctagcatgcggccgcgattccgatcgatccatcagctgggcgtcgccgtcgccggtaacattggtcggtaggacaccggattttaaaaatgttgatggtttctgaagcaacacccaagtgttaattattggagtatattgtgtgtaagagtgacaggtgctaccaaaaaaaacgctgttcaatctcccgtaggagcatattactaattgctagctgatgatctatgattaagctctgactgacttctcgggggtcagcaatgctcgaagctactagaatacaattccgttcccagcaacttgtgaacttttagctagcgatcgaggaataaaagctagatgatcgagcaagttctgaacattgttgggttggtgtgtgcatgacatgtgctaatcctaactgatgtaattgggatcggactatgtgcattcgtggccagtagaattggaaggctccacggcgctcgagtcaaggcgcacgcccgggcatggtatggtggtcaggcatcggcaaacgacagacaaggcagccaggcagagcacgttgtgcgtactctatatccaccgaaagctagtgcgtgccgtctatgttctgtattgacacaagtactatctttctattctaaatatatatatttatctttctattttaaatatattgtatatatcgttgttaaattttttataaatgtttaaccatttattatatttatttttcaaaaaatataaaagatatactccctccgtcccaagaaaaggcaaaccctgggtttccatgttcaactttgactgtccgtcttatataaaatttttttataattcgtatttttattcttgttaaatgataaaacatgattaatattttatgcgtgacttgtctttttaattttttttataattttttcaaataagacggacggtcaaacgttgggcacggaaaccagagtttgtctttttttggacggagagagtaagttgcttcatccgttacacaatgtaaattattttagtatttttcatatttatattgatgttaatgaatctaaaaatactggaatgacttagattgtaaaacggaggaagtatgtttgaagagccttcagtatgtaatgaattaagtcataagaacttaaataaaaaatatcagccgcacgcgcacgctcacgcaccaccttgtttcgcgggccgagcgtcatacaagggagagcgtgatgcgtgtctctcgcataacgacatcgttacgttcacacgaataagcagcattcacaataggcgatggcaatcacaggataaaaaacacaattatatatcagtccaattgttcgggctcgtatggagaaaccgcgctctcagtaaacaaaccaagccaaaaaaaaaataagattctaatttgaaactaacatcctctagtaatttactatgggctacatacggcggccgaagtatcaaagtagactcatatcagttgacggggtgttgacaggttaattattttccaagtttagtcgcttcatggttgggggataattgatcaacccacccggtcagaaatcccagccgcagagaattcagattccaatttactgcttttcacgagctacagggcggcagcgcgctgatgacaaaccaaaccacggatgcatgcgccgatccgacgagatgcactgcacgtatgcacgcaccgtggctgcgtcggccgacaggtcgcggtgcgcgtgtgccccgcgcggcgagcagcgggcagcccgagctggggccagcagccgacgcgctgcactgcactgcactgcagagaagcgagcgagcgagcaacgcattcgattcgattcgagagtaggagaagcaatgcaaggcggggggcgacggtgacagcgcaatatttcgcggaggcggggcccgtcc

SEQ ID NO: 42661 - DNA, 5266 bp, Oryza sativa; identical to SEQ ID NO: 6471

SEQ ID NO: 42662 - DNA, 1410 bp, Oryza sativa
atccaaccaacatacgaaggcaattaaacaacagatttgttccttaatgttgcagttgcattgacaacagatcaatcaggatgacaaaaaagtaagggaaaaaacagatagatcacgattcaattatactatctcagtaaaatcttccgagtaaatcacaataacagtcctataattataaaggctgagtagaaaaatcataacaaccaaactaagttatgcaaaacaattccacatacagatctttatagctgaagtgtgaaaagattaggatcaagtaagagtgctgtttcccaggttacgaggcatggcaatgatacatatttcacagacaggccaatgaagtcaaagaatagaccatcctagcaagttgaaacaaattcacgcctagtgcaagaatctttcaccagtgcaaaactgtagtgctcaacaaccactcaaccaatttcacttttctatcagcaagatgtagccaaatgttgcatgctgaagcctacgctcaattactatggcaaaatgacaaaatgcattgttttccaaatagcccgttgatttgatctttagcctttttaacaatgcgggccttactgccgtactaaacatcatcaaaacaacaaacgacttcttttctgtcctactatctagacaacactaaaacgaaacataactttttccttgttgccctgaagaacaaggcagtgtgatggtttattattgtgattttttagaacatatgccagagtgccaaaagttatgatttaacagtttaacattcaatcgaaagatcacaaagttcgcacctgagatttggaccatgatagatcaagaacatcggcggcgtgacccaatagagagcatactggtttatctctgaacccaaacacacattcaggcacaactagatgatcagagccaacagacttccggctgctttgcatccttggcctcctcttcttctccacaaaacccccgtcagcacagctcaatgacaatgttgccagctccggcgatccattcccaacagctgcaagaaacgggctgcagccaccaccgttctcccttgccaccgtaccttccccgagcaattctccctttctttctccctctgatacctcccacacatggatgacacggtcctcgccagcgcttgcaaggtatcgtccatccaagctgaagttgatacaccagattgagcccgaatgggcagccaattcttgtgtcatgaacagcccggtgagctccttgcacgccttcccatactgccgcaccctgaccctccctgcattgcgcgagccgttgccgtcaaggctgtcatcggtggcggagctcaggcgccgcgcttccctctccttcttctccttctccttctccttgtccctctcatcggtgctgctgcgcccgtatgcaacg

SEQ ID NO: 42663 - DNA, 2852 bp, Oryza sativa
ccggatccatgtggcccgccgccgccgccgaagcttccggcattgcgacaccctcccctccggcgaggcggccgcgcgcaaatggggatttatatgtggcgaggaggttttggttttggattatggtgtgggtgtttgtctagttcgtgcggggtgcgacgtcgtcggcgtgcagttggagttgggaagacaacaacgagggcgccatttggatcaacaagtctcctctctcatctccctcgactttggactttgcagacgactcgactcgactcgatgatgatggaggcgccgccgtggcaaaattgctgctgatccctagtatcagggggatcggagggtatatccttgccgggggctggggacaatgacaggtggggcccccggggaggtatcgggccaaaattagccggaccgctcgattagataatgcgaaatgtgcatgcgtcattttgaggcatggaacataggatacatatcctgcctaggatcaagatgtcttggtttatgacattattaattttgtgatgctaataatgtttcatgctaagaatttgttcgtggttaggttaactcttgtgtagtatcaatggagtagtagtatcgctctttgtgtggttgccagtaattttcccctctccaacaaccaatcacatcgtttctactgtgcacttaggcctctcacagtgccgcacgttttgtaccactagcaatttcatttttcagatgaaggtccagtttagataaaaacatcacatcgaatctttggacacatgtatagagcattaaatataaattaaaaaaactaattgtacagttaggaagaaaatcgcgagacggatcttttaagcctaattaatccatgattagccataagtgttagagtaacccacatgttctaatgacggattaaataggctcaaaagattcttcttgcggtttccaaacgagttatgaaattagttttttttattcgtgtccgaaaaccccttccgacatccggtcaaacatttgatgtgatacctaaaaattttcttttcgcgaactaaacacacccgacgggttttgatgggagggttttgtactccccacattaaatgaacttattgggaaaacttcaatcaaatcttatcctaaacgttgatcggaaagagtagcatatttccgtggtggagttgaaaagaaaaaaaaaacttaggtgctgtacctgtgaagattgaaatcagagtttttctttaaaagaaaaatcagagtatatataatagttacagtgaatcagagttatgatactgtagtatggattaggcaaaataattgcattgcgtgcagctagcagcggatgtcggagaaatcgaaggcgcaaaggttcatggtaggggtgttatgttaaggcttgtttatatcccctcgcaaaattttacaccatgttatgtcgaatgtttggacgcatgcataaagtattaaaaataaaaaataaataattaattacacaaattgtatgtaaattgcaagacgaatattttaagcctaattatgccatgatttgacaatgtagtgctccagtacacattattaacgacggattaattaggtttaataaattcgtctagcggattatgtaatttgttttgttattagattatatttaatactttaaatatgtgtccgtatacccgatatgacacaccaaaactttatacccctgtctaaatacagccttaggccatgtttacatcccaccctaaaatttttcaccctatcatatcgaacgtttgaatacatgtatgaaatattaaatatagactaaaaaaataactaattgcacagattgcaactaatttgcaagacaaatcttttaagcctaattcctccatgatttgataatgttgtgttacagtaaacatctgctaataacggattaattaggttaataaattcatctcgtggtttaatgatggactatgtaattagtttttttattagtgcttaaacacctcatacgacaccctatgtaagacaccttaaaactttatatccctatatctaaacacctcctttgttagttttttttttaagaacattatattagctgtatgctgcactccggtgctgtgcccgcacgtaggacgagatcgacggatggaattacgtggagagcagttcacttcacgcgttacctagaaaccagcagagattcagatttcagaggaatcaatcaatcatggtgttggccggagttggagccacgtttgcgacgacgacgatttcaacaagtcaatttgcaactgtgcgatcctcgccggctagccgcgccgaccgcgatgaaccccaatgcacattggatctgagccaatggagaatcaaaaggaaaaaaagggtaaaattaacagagatgattaaagctaagtagctagctagagaccgacctgcagtccagcttgattattctttcgtcagattaattaatcgtgcttagctaatacggagtactagagtaaggcgccgcgtcaggctctttcttcttcttcttcttcctgtgaataaacatgcacattcgtcagtagccaccaccaaccttgcactggattaaagaaacagggactgcacgttctggctaccttagctagctacgattcgatcctctatctgcactctgtttgggttaatatatttcttcattggagagaagaccaccttagttcgcactgattagattccagcctagatcattagcgttcgtgcgtgcgtgcatgcttctgttcttccgtggatcgatcggaggttgggtgggttagttgctagtacttgctactactacttgctgctgaaaaggtggaaggaatccaaagagg

SEQ ID NO: 42664 - DNA, 1503 bp, Oryza sativa
ttatactcctatacaccccgcccgctgcttctcctttttattggcattggtattttaaaaatcgaatatgattatcaatggggtttatcttttttgctttctagaagtcccgacaatcgccttgctcgtttgcttcacagcctgcctgtcgttcttccttttaatcgtcattaggattctatttggtgttttattaacagtttttatatgtcatatcaaccgccaccactctactcctttataggcttgttacttaatttatctcgtcatgtgttttagatggtcttttctttcaatagtctttatttttatcacatttttagttatttataaattgtattcctaattgaaatcttgtttttcttctttttctaattttagaatttattttttaaaaaaataaataatatgtatcgtgttcttttaatatttttatttttttattttcaatttcagttgtttcaaaattgtattcctacttgaactctcttttattttttctaattttggatattattttatttttttattctaaattttaattaatctcatattgggttcttatatggatttttctttcaacagtgtttatttttaattccgaatttcagctaattttaaattgtattcctacttgaactcttcttttttttttgctaattttggattttatattccggcttggttcctgagcttccaagcttccaaaaatcatggagtctggttggttccgttgattttaacttggaatcagtatcggtattatgttttacttttttaaaattagagttacgctactactgcttcaaaaaatactgtcatgatacgatttcacgtttgcactgctgcctaagtgcctagtagcatgtagtagtcttctatgttagagttctattccggcttggttcctgagcttccaagcttccaaaaatcagactggagtctggttggttcctgtttggtttattgacactgtttccataaaatatgtagactcatattaaatcacaaccattaatctagatctattttaatccaatggctaatatttttctttttttttccgattaatgtgggaatttctagccactacagcgaacgtggagccttctttcaaagctgttttaataatataatagatagatagatagatagatagatttttcgtacatgtagtactactcttcgtacatacgctggtagcaactagcaactgctaactgaataaccgattattcatcgagtgcaaccaccacagctcgtagccaacatcaaaagccatttttgcgttgcgcccacacatgtcatgcgatccaacatgtcccgcgtctgctacgaacggtaaaaaatcaaaatattttcagagaacgctccgaggttgtttcaggctccctcccatggcgcaaacacatgaacacactaaatgctcgcgacgcgaacgcgaggctcctcttcccgctataaatactcctcacagatcgcactcgcttctccaagaaatcc

SEQ ID NO: 42665 - DNA, 9180 bp, Oryza sativa
gagcctgtcgcggctgtcgcgcctcaagcagctctacctcgagggcagcatgctcgccggcggcgtccccggcagcgtcctcagcggcatggcctccctccagtacctgtcgctcgccggaaaccggttcgaggggaagctgccgccggagctcgggtcactcccggggctggtgcagatcaacctcgccgggaatcggctctccggcgaggtgccgccgagctacaagaatctctccaggttggcgtatctcgacctgagcaacaacctcctctccggtgcaattccggcgttctttgggcagcagctcaagagcctggccatgcttgacctcagcaacaacggcttctccggcgagattccggcgtcgctgtgcggcctacgcaacctcactgatctctccctgcgccataacaagctcaccggcgtgatcccttctcagatcggcagcatttcttctctgaattctctctccattgacagcaatctgctcgtaggctcgatcccagagtcactgtttggtctgcagaagctgtggaacctgaacctgtcaagaaacgggttgtcaggttcacttcctcccggaatccgccatggattgccgtctctcgtgtccatggacctctctcacaaccatctcgtcggcggcattgatcacttcttcagaagcatatcaccagcaaggaggctgaccaagaatgcaagctcagacatgtcagtgatctttcttcctcggcaactacaacacctggacctgtccaagaacagtatcaccggagccttgccggagttcggcgccggcgcgagcttgaggtggctggacgtgtcgggcaatgccatcggcggccagataccaagctcggtgtggaggctggtcgggctccagaggctggacatctcccggaacaagatcaggggcaccatcccggcatccgtggcgtcgatggcgagcctccggtggctggacatctccggcaacgcgctcgtcgggaggataccggacagcttcgcccggatggcgaggctccggcacgcgagcttccggggcaacaagctgtgcggcaagataccgcaggccaggccgttcaacctgctccccgccgccgcgtacgccggcaacctgtgcctctgcggcaagccgctgccgccgtgcaggcagatttgaccggcgccgccgtgcgtggcagtgattgctgcttcgccatgggtgacatatatggtgcatttcgatcggtacagcacaagactactttgtgtgagatgttttacgaggtttagagaaatagagtagtagtgcattgtctgatttgtaatatctcctgatcatatactttgtaaatcgggaagttacacaaatctagtttagggtagaggaggatgataaatgttgtggtcgcactgtaaaatgataacgtggaagtcggtattgggcactgtagctgcgtactaatttcgtttctgtcatacgtatctaattgagttttaatgttttatcaaggaactacctatatatattgatcaaaggagaaagacctgaaaccaggtgtgccatagttgaggtaggcagcatagacttttaatttgtagaccggcccattaagaccttacttggatagacccataccaacggggcggctaaaggtgttctttttgggagtgagtttatactgaaattgcttcagttggggcatgccagacgaacaaattcgccatctttattgccattttcaaagaaattcatcgcgtatgcattttcatatatacatcggtgctcatacattaaacctaatctgagtagcagagcttccaaaaacggatggattcacagaaactagtattggtaaaaatgtaaaaatacacgcctctaccacctgctaatctcaactcaacggatggattcacagaaatggagatggatcaacgcctctacaaagctcgatcagaccttgagcttgaagctgcagctgttggagcggatgcggatctgcctgccggcgacgaggttgtcgacgacgaggttgcaggtcgccttcccggtcatcttccacagcttgatggcgccgaacttgatgcggatcggcacgcgcgcccacaccgtgagcggcacgaacccggcctgctgctgccgcgccagctgcagcgccacggcgctgtccagccgcgtttcgccggcgagcaggatgacggggcgcaccgtgctccggtggccctggtacagcgccgggaacccgccgcggcacagctccgtgccgttgaacgacgccgtcacctcgccgccgtcgtagtagatcccgatccgccggttcgggttcgtcgacgtcacctccacctcgaacgcgtcgctcaccgtcgccgccgtcgcgttcacgtcgaaccgcgtcacggtgagccggtccacgtggaagtccggtatcttgggcttgaacaccgcgtacaggatgcccgccgtggcgcccagcgccacggcgaggacgagtacggcgagcagcgtccagcacacgcaccggcagcaccgccgcccgcggctcctgcgccgcggcggcggcggcggcagcggtgccggcgcgtacggccgtggcgcggtgatcggcagctgctccttctcaccgtagctcgccgtcgacctccccttgccgacctgctgctggctgtccggcgccggcgccggcgagccgacgcccaccgggtggattcggtggtaatccattgcgatggagatgctgctttgcaccgtcaagggaagaggaggacaatcgacgaaatggcagagttgatttggtgaaaacgttatggatgtctaagtacacagtgcaatttatacgtgacgattcgtgacacgttttcgtttttggtttggttaatttggcttctagacgtgatggatttattagtttatcatgttcagctcttgacttggttgccatggctgccgcatgtgtgattgacttcaaggttgctgattactcctcagtctcaaaaaaaaagtgtaattttataccgtccaatctaatatttgaccattttatcttatttaaataattttatgattattatttttattgttattaaatgataaaatatgaatcgtactttatgtgtgactaatttttaattttttatatctttttaaataagacgaaccgtcaaacgttgtgcacagatagctacagctgtacttattttaggtcggaggtagtattatttgtacttattttaggtcggaggtagtattatttttttcttcttgaaattaattggagaacacaagaaatctatgctgattctcgcaggaatggtcatgtccctttccttttaactttctgtgtgttcagattttgactactctttgtacgacgcgttacatttataatcatttacagtagcagctggattagttattgattaattaccgtcatgtgatcgctcaggttatcgccgtgttgcgtttcgatacgaattaagcgacttgcagaaatgtatccctccgtttcaaaatgtttgacaccgttgactttttagtacatgtttgaccattcgtcttatttaaaagtttaagtaattatttattatttttatatcatttgattcattgttaaatatactttcatgtacacatatagttttacatatttcacaaatttttttaataagacaaatggttaaatatgtactaaaaagtcaacagtgtcaaatattttgaaaatgatgaagtatgagctgcgcccgagtgctacccatgtacgctgaatctgatgtcacggtccgtacatcgtgttgaatggttgttgttaaccgagggacggaattactgacgagatcacatgaaaaactcttgaaaaaacatttgctcacaaccataatgacatcatgtcatgcgtagctgccgtcgatcacgaagcttcaggttagcaaagagcaagttcgtcaggagaaataggttgaataattgcctggaagacgcctctctaatctctgaataattaaccacgctgcagctgaccggacggctgcttgtcgtgttgaaaattcagagaggctactgcatcaatttggggatcttcaggcatgacgtgatcaacggttgccgacggtccttccgtattttgtatttacacgacaagcccaacaaactccgtgttaacaaaactcaaatggaatatcaacgtgtgcacatctagtagcatatatataaaaacaaattggtgtgacacgctagctactacctaacctatgtaactcaagcctctccaaaaacatatgtgttttttttttaatggaaccaaaaacatatgtgttgctgctactgaagcttgcaagctacatggtccttcctctgatgatttttataggatgttttgttttttaaaaccggatctttgttatgatttttaataaacaattagtcaaactataaatataactagttcaatacataatattccctcctttactaaatgtttgacactgttgacttttttaaacatatttgaccgttcgtcttattcaaaaacttttgtgaaatgtgtaaaactatatgtatacataaaagtatatttaacaataaatcaaatgatagaaaaagaattaataattgcttaaattttttgaataagacgaacggtcaaacatttttaaaaaagttaacggcgtcaaacattttaggatggagggagtagataaattgcatcatggatacaccaaattgcgtgagtggatgtgattaagtactttatagctaacaagaatatattttatggcagtccatggatagccaaacaatgcatattgcccgctttgccgtcatacactaaaatgtcattccatttcctggtggaatgcaaatacattagaaaaatctgggacaccttatctaattagatggcatgtgaatagctcaaaccgttactaatatctttgtcgttttacatacccgtacttctctatcttaaagttaactcaaacggggcgcttaggtagtgtttgaatctagagactaattagtccctgtcagatcggatgttttattatggattaattaggtttaaaaaatttatctcgcgaattagctctcatttatgcaattagttttattatttatctgcgtttaatacttctaattagtgtcaaacatccgatatgacagcgactaaaatttaatccattagcagcccagacagaagtgtgaattcaacaaggcaagtcttggtttgtggcctctcactctgacttcagtcagataccagctaatgatcagtttgattttcaaataaatgcatagtagctactgcataggatagacagccaaattccttcagtgcagctttcaacaaaaattcacaatacaaaatacgatccacccacaattccattttgcacaatatgtactttccatttcaacacaaaaatctgatcgtatatatcaacatttctaacaacatgatgaatttacaggtacatataatacatgtgtaaagtaccgacatttccgatgtgggtcatctcgatctcaacctcgatgtccatctcctggtatcctgaggcctcaagagctgtacaggagcagctgggattcgcagccaccactctctcagtctcctcaccaacttctcgctgctcttcttcctcgccggcatatgcctcgtgtatgcttccagcacaatcagtacaagtatgcttctcaagggcaggtacgcgaatatcgcagatgccacgagcattgtagctgctactttgttcgtgctctgaccagacaataacaattgttatatagtaattgcagaatgttgcaagatttagagttttgatgtgatggtttacaaagtaattcgtagttgtgagtgataatgtgagaagaagtaacgtacttgagggaacgctgcaagcaggagggatcggagcttgagaagaaaaatgtttccggcttgcacttgtgcctctaattgcgagatagcttgttgcagcgccagtagctgttctacagttcgtctcctaggtggagttgtgacttcaaatgcgcctatcatctgcccgttcccggtatgcctttgccatagcatgaagatggtagaaccaagcagaaagacagggaaaatgtaccaaatccagcctctgcagggtttagtatggaataggtattaacattgctccgtgaaacaaaattttttaactactggtagaagtatttcagttcgttttagccaaaaaaaaaagagaggtgatttcagatattacctttaaactatgaagaggaaacagaacaagaagacgtatgatttaagtggatcttcccactcagccaaaaagagaagccttttgcctattttaattaacggaaatagcagtttctgcatattaacagtaaatcaacaaacattaatacacttaataatggcttgaattgtgatcaatcttgatgacattggaagcaactatcagtctacaattattgagcaatctaaaactatgaatggaaattcaggcttaggtatgcctgtacaggtcactcagagctcagtggttgttccagaactcaagacttttcctatctgaattcatatcttagtttagaagattatgagaaaatgacatttagtaccttcaggacagccacattagtgtcgatgtcttccactttgacctgatcaagggtcgccctcgcagcctccactctgccagagtaacctacagatctctctagagccatttgcactgagctagttcctcccgtctgcacatctcggacagtgagatcccattcctcgggattgtcctcctctttgagtgtcaacaaacccatgttcaccaaagtatatgcagaaagtgggaaaggatcagcaagcgtcagatcatctgaactgctttgaacagaatcttcatctactctgaaccttgaggaataatctttcatctgaccatacaatgcttccagtatcttgtcccccttgggcaatttctctgccaaattgaaggcaagggtagtcttgaaatgtgcaggcagtatgtggaatccctccttcaccgtgcggtatctgagaattcctagtgtcgcaacagaaagcgcctcggccttatgtaaattgatcatcctgtacttcctaatgaacttgtgagcgtgcaacacctctttgatgattgcaaaccagtagtctcgacgagtgtgacctttgaattgaggaaattcgaagaacaccggctctcttctgtcaaagtaaaattgtatgagcaaagctacaagatgagcagaaacttaaaaaaaattttattctacagtagtaattactcacgtagagctagatttgtacatgacagctttgtcaaatagctgagcaccccatgggccagttgattcacgttttatagactgcttcaagtcccttgacagatcatacaccacagcctcgttgtatgagaaatcaacactgactggctcaaagtacaaagcatgggttgtcagtgtgagcctccctgcaaaatatgcaccttatacaccttaaggccatagtgaaggaaacaattcaccaacactgatcaaaattaccatagggaggattcttaaccaggccaagtggacgtcccaatgtgttgaagaatcggcttggttgtcgcggcaccatagatatcaaggatcacttctccatcagaaagttgaagagctggagctttgtgtccacctgatatacgtttcgcaaatctcagcaccctaacatcagaaaccagaggcgccatagtaaggcaatcatgcagtgaaagtaaccgagtgcctgaatattcagtaatgctcattgttcaggtttcagagaatgacaataactgtaacaatgaagagaaacaagagaagctggtgccaatgcatacttgtctaaacatttgaggtacttatggtagatgagaaaatgcaggcggcctcccgtagagtttgtgagcgcatcaaataagttgcgaacagtgatcgcgtgtgccattgcaggacacgcaggaataatcttggcaaatgcttcaggactgaccgttctcctcccatcaacctaaatatttcatcaaatgtttggattgatacttgagaaaccacaaaatatgtcaaattgacagagatatatatataacctgaatggccatttgtgtggggctcaaacagaacatggacccacaatcgtcgtcatccttgccgtcaacgaagctaaatgacattttctgttatagcgtatcggtttctgatcagagttgcgtatgaacaacaaacaagatggtgatgttgaattgggggtgaaaaaaaaaaagaaaaccggggtgtcatcacctgcaacgcggcgtccgtctcgtcgtcgggggcttcccaggcgatcatcatgtcgtaggtgagcgagtggaactcgctgtcgctgaggtagtcatggcgcttggtctcgacgcgcagggcaatgtaggagcagtactccacgacgctcctggcgtacgccagcggctggtcccccttctccggctcgaaccgccgcagcagctgctccacctccacgccggcgatcctgcagccacgatcgataaaaaaatacacgaatattaagaaataacgacctaatatcaaataatcagaagaggtgaggtttcgaacccaggttgacgtttctcgccgcgatcgatcaggaatcgatcaattaaatcaaattggacattaatccatacgacgaggaggagatgagggagatcataccgggcgcatcggtggacgaccgaaggcggcggttggggggggggaggttggggaaaggggagggatggcgtagtcgggcgccgccatggcctcgccgtcgccgccgccaccgccgtcgacgcgcggggcgaggaggaggtcctcaaggagacccatctggggtggcgacgacggagcaccaggagggacgcatcgttcgttcgttcgttcgatcgtcggcagtgtgtccccgtcaccccgcccgtttaaggcaagcgagatttgttggagacgtgccgtgcttttgacggatgctctgcgacgcaatgcgatgcatgcgttccgccttgcccttttcgcggacagttaggcgcgcgcgggtttttttttccttctttccttcgtctccgacggactcggccgtccacccagccactcctccctgtgctgtttgccctctcgaattatcggattgtaaacgttattattagttt

SEQ ID NO: 42666 - DNA, 1091 bp, Oryza sativa
tgtattaccacaaataacgttgcagaatacatagttcatgcaattagtataccgttaaacggctcaggcccccgattaccaaccaagatttcgtaccccggtcaccggaatcttaaacaagacaaaaatccatatggccatatgggcacaccagattcctgatgaatcctgggacattcttttttaactcgtatacaacgacaatgatgccaatattattatcaactccatcgacatcacctgaaaaaacagtaatcaaacaacacagtagctaccagaaaattgtgcaggcatggaatagaaaccacctgccatactacatggcatcgacgataaatagagctctacataatggagttctatctctcctcattttaccagcaaatctatgtaacgaaaggcaccctgcgaactgcaggggctgatacggtaattaaattgtctcccaaagatggactatgggagtaaaaacaagcatagcagtttttgttttgccacttaacccagcaaaatggcgctaagaagacaccgtgtagcgattacttcacgatgcagatcttgatcacggatgcgacgccaatacggtgcagagcaacaacagcatcaccaggcttgcacaactgcttctgtacagctgacttgagagcagcatcaaggatgacctctgtcgactccgaatcggtggctttggcagaaccctcagccaggagaggaacaagacctctgtagattaggctgtgccttgctgggccctccgagctgattgtccagtcgaatgaatcggttgtcaacacggggacaaccacagagaggattggaaccctgggacgatacttggcaaccagctttgccgtggtaccaccacgagtcaagacaacaatcagggctgccttggccttgttggctgtgcgtacagcagaggatgcgagagactccaatgggctcatcggaaggggcgcagacctgatcatctccttgaagacagcttcgttgtcaagggaagactctgcctcaacacatatacgtgccatgatcttcacagctacttcagggtatgctccagcagcactctctccactaagcatgacgca

SEQ ID NO: 42667 - DNA, 4040 bp, Oryza sativa
aatgtacaaaggcagagaccaaacaattctggctccagtatataccagaaagggacaacaaaacattaattaaagcatctaactgagaagtattgtcactcaaccgtcctggtaattaaatacttaagcaaactgtggaactgaaaacctaacaggacccaaaaaatagtgataatgattacaaacctttgacatcagcttgatgcgctttgcatgctgtccaagaagttgtctgacggtaaccaaatctgatcctttacggacaaacgacagagcaatcatgtctatgtcatttggcacaccccatcccaaaatgtcttctttatccttctcagtcagtgtaggaaggtccacaacaattcctggcagattgcaattctttctctcgccaagcattgctgtgttctcacacctacacctcacagttccagcctttggatcacaggacaaaacagtcaaagagattgtaccatcggcgcagagaatgacatttccaggcttcacatcaactggcagtttcttgtaactcatggtaatcatgttctcatcacccttgatctcataatcggtggtaacagtgagttcttgaccctttgttagcttgattggcttgccatccttcaaaaatccagtacgaatctcaggaccctgaagcaatgaatgaaatgttcagaacagtcaccacagaatcgccttaaatatgctactaaacaggtaaaaataatggaactaattgcagtacaagaagtgataaaaaagataaactgtgtgcagtacaattctgtaagtaacttatttgaactacaaagcaaaccatgaagtgtgagagtgtaaaaagataagcaccaatagttacgtgcatgccagaaacatcaaggcataatagaagaaatgactacactaataaagccttcttttacgtgttaatcatatcctcctacaaaagcaacaaaatcagaacactaggatttgaacactccatactccaaagccaccgatcccaagatctgttaaccatccttccaatccaactctacaaatgaataaattaacttgaaaaagcatagagacgaactgtaaagctaaatatgacaaacaagatgcacgcagctcatcaatctcaccaacaccgcaaacggatcacactacgaaccagttacacacttacacttgctcagaatccataagactccaaaactaactacccacatggagacgcaagcctgagcccccaatccaagatccagccatctgcgacaaggcaaaagcgcaagcgcaggcaaatctaaccccggataccattttgtcgagtcctccaaagtcaaaccgctgtaaactcaactcataatcctaccatgctgcctccaaatcaaacccagcttctcccgataaaaaagacgagcagatccaaatcgaaatccgctctgtatcaaacgcaagctaccccgactggtccgatccgaacaacccagcagcatacaagcatgtagagatcgacaagcaaagcagtgagggggtaaccttggtatcgagcatgacggcgcagaggacgccggtgttgtgcatggcctggcggaggttgtcgagggtctcctggtggtactcgtgggtgccgtgggagaagttaaagcgcgcgacgttcatcccggcgcggagcagcttctcgagcatggggacggagcgggagcccgggccgagcgtgcagaccagcttggtcttgggcacccgcgcgtcgtcgttctccagccccgccaggatcttccccatgtcgatgttcgccatggctgctccctcctcctccggtggtcgccgcgatccgggaggcggaagcttgcagaccacgagagagagagagagagagagagagagagagttgtgtgagttgtgctggctaaacgaggcgagatttgggggaggatttttatagagatggagtggaggaggggaatttttttggcgattcagtgggcgaagggagggaggaagaagagaagaggactggaggagaatagcggagaaagaaagatgagagatgtggacgcgtggtcaccaccgagttgaggggcagagggtcgaggtgaggcgattcagtgcctgcctcactgtctccatttctccacatggaaatcatccccactgatcttcttggggaagaagttacaaaatgcaactagtaggactgtttgatttgggactggtttagttctcaatttttttttcaaatttctaaatttttttatcacatcaaaactttcctacgtacataaacttttaacttttctgtcgtatcattttaatttcaattaaatttttaattttaacatgaacttaacacaactttaaggtttataatttgaaacttgtggtgtcgtggctaatatgcagtgtggctaattactggccaaaatcgcactgaatggagttggttgggtaaagtgtgtgggcgtgctaatcttggggtgagtttgacatctcgaggagatgattccaagacaacggcatataccagcgaacggcgatggggcggtgggcaatcagggcggcgccagcatccggcaaaaccagcgacgtccgcgtcaaaaaccgcgacctcaccctctgtttcccattcgtcggtccagcgatccatctgctagctggctgcctgggctttctcctcttccgttttcctttctctctacatctccacaactctgcttctattcctccatcattttgttatttttgctgtgtttagttccctttaaacttttaatttttccttcacatcatttgcacacatgtataagtattaaatgtggacgaaaaaacaatttacatgtaaattacgagatgaatcttttgagcctaattacgccatgatttgataatgtgatgttacagtaaacattttttaataacagattaattagacttaataaattcgtctcgcgatttactgacggattctgtaattagttttgttattagtctacgtttaatacttcaaatgtgtgtatgtatatgataattttttttccaaaacaactaaacacggccaaaacattaatttgttttgttttgccaaaaaaaatttagaaagaatctgcagttcgaattctcttgtgacgattgaccaacagtgtacgtacacgcgatgggcagacgtggttgcgtccattgatcatcctgcaccgaagtcaacttatcagaaacctctttaataaaaaagaaaaaatatgtaaattttgtataacaaatggtttcttccgcgagacagttcacaattggcttgcttaattgatgagaaaataagcgcatgaaagaatcaagaatggaactttcttttgtcctcttttcttcttctttagtcttttattaccagagaagaaacttctttagtcctttgttacaagaggaaaaggttctgttgagtttggaatttctcaatccgtttgacgatcatttttgtttcgtaggcatggttctagaattggaacagtcaccgtcgaccttgacaacaacatcgaagaaaataaaataattttacagcaaaacagaagcaggtagtacatactccctccgtccaaaaaaaaaaagacaaactctggtttccgtgcccaacgtttgaccgtctgttttatttaaaaaaattataaaaaaaattaaaaagacaagtcacgtataaaatattaattatattttatcatctaacaataataaaaatacgaattataaaaaaaaattatataagacggacagtcaaaattggacacggaaacttagggtttgacttttttttgggacggagggagttctttacatggtaggttaggccaggtcaatacccgtggcatgtttattgaagccaaaactaaaggagtatttgattttctcgttgtgatagtggatttaatctaaactagcaaatcgcatgcatagcttatactacaacattaaagcaagctaagctgggtgaattcctaaagctaaagaaaaagccaaaggtgccttggacagtttgaccacggtcagttgcggctccctccatccgccatcag

SEQ ID NO: 42668 - DNA, 764 bp, Oryza sativa
  unsure (1)..(764): unsure at all n locations
nnnnnnnnnnnnnnnnnnnnnnnnnnnnnnnnatcctgcacaaaagagctctaacagctgaaaatctgctaatccaccattgggaatgtgattggatatatcccctttgtagaagcgcctgtgaagacactgaccatctttttagggagtgtgatttcattagaaccacttggagcctagtggcggtagctcagggcatgcaaactgcgataaattcaaactccaccgctgaatggatgatggctttagctcatggaaccaataaggctgaatcaaaacgaagagtgggaattctgatcaaaacctggtgacacgtttggctacaaataaatgctaaggtcttcaagcaacaagagccatatgcacaacaagcggcccagcagatcggggaagacattcaagaaaatgagtttgtttttcagcctccttgatgaagtctgctctactcctttctttctttctctattgcagtctacctcctatcgtttgtctgctttctttttgcttgctgaaagttgttccgttacgtctctaataatacgctcctaagcgatttgtaactcatactccctccggattgataataccttgtcgttttggacaaggacatggtctctaaaaaaacaactttgatcattatttaaattgttaacaaatatatgatcatattaaagtattttttaagactaatctatacatgtagtcatcatatttgaaagacaaatattttaaaaatgattcataatcaaagattgtaaagtttg

SEQ ID NO: 42669 - DNA, 2559 bp, Oryza sativa
atagccttcacccgttgtaacacacggacattttttccagtaaaaagaaaaaaagggaaaaataattcttcggattgggcctaacgtatatgagggccatgctttctatagcacctaaattagcccaaaaggaccgatcagttctattacgaacggattagcgaccattaattaagagagcgcgtgacggattaagcgaagcgaaccacgcaaataatactacacacgcgcgtcacggacaccacccagtcccctccccacaccacgcgccgcccaaaacctccgccgcgtttcgcaccaccaccaccgccgccgaccatggcctccttcttcgccgacgacggcgccgacgagctcccccgcaccgcctcccaccccttcgacgccgacgacgacgccgcgcccgatgcatcaggaggcgccgccgccgacgacaccggatacggcggctacgcctccttcgtcgacggcggcgtaaaggatgtggaggaggaggaggaggagatcgccgtggagtccgagggggtcccgatcggccacgtctccggagggttctcgccctcgcccttctcccccgacccggagctggacggcggcgacggccctatcctcccgccgccggcccagatgggggcggaggaggggatcctcctccgcgagtggcgcaggtgagcaccgcatctgatctgtccgggcctttgccgtttcggctactgcttgcttgctttcgctggtgctagggttccgacgcatcgagcgagatctaacgcttagatctgatatttcgcctaattttcagctaggtggggcggaatagagtttgtagtgaggctgtattatcgtattatatgtcgattttagttaggatgaaacttgaacttgttgtttaggaattgcagtgattgattaggctgaggcttcaactggttctgaattcttagctagtggtactgaatttagttagtgcaattgaatctggtttggcaggagctgttgttaaatgcctttgcttgtgaggaaagtttgttagctctggtactggtatatgtacaaaataatcgctagttagcttctactcatagaacaacaagatgcttgatcagtgttgcacacactccaaaggggaattgatgtctttgcatgtgcattaaaaggctcatgtttcttgtttagtgaagttaaaacactttaagtacttgaaccattcttctctatcatcatggtgtggaaatgagcataaggccaatctcattttgcaattcacccatggtctgttacatgtttcaactttcaagataagcctcaggcttaagcaataatgcagtacacgtaacagttttctgagttaatgagcaaatgcttagtttatcttgagctatcttacatgtttcttggtgaatggtgatattaatcctaggtcttaccatgatgatggttcgcacccttactccttttgatgcttgtcttaggatgctttaattgatcttaaaatcagcttgatttgccagaacataaatcaccatttttagtgctatgccacatgggcatggaacgtgctcggcaaaggtgtgtgccaacaggagcaaactggctacttgtttgtgcttctgaaatttgcattttgtctgtcatgatcttatattctgcacttgcacgctcttctgcacctgtcaaatttttagtagtttcatgtatatccattctcagctcaaattttgtaaggtggtaatgttagcagttttactaccagtggtatgtgtttttgtgcctaatttatcctgtgcttggtataatctggtcattacaattgcaacagtatattttgcattagtatatagcgcaggtgagccacatctgatctgtttcggctatgccatttctgctattgtttgtttgcttccgtgggagctagggttccaccccttcaagcgagatccaacgcttagatctgctatcttccctaattttcagctagggagggcgtcatacagttgtagtgaaattgtcgttaaggaaatggcaagtgatcgattagtttgaaggtacaaccaattctgatctggttctcatgcccctgcagtatcgttcttcaagagctgctgtttaactgcctttgcttgtgaggaaagttttctagctctggtatacgtacaaaataatcattacttaacttttaccgatggaacaacaaggtgcttgattcattatgcgcacactccaaagggggctgatgtctttccatgtgcaataaaaggcttatgttgatttgtttagtgaagaaaacctaagtacatgcaccgatttcttttttcagcctggcatggaaattagtgtgaggccagtgtcattttacaatacatgtatggtctattacatgtttcaactctcaagataagcctaaagcttaagcagcactgcagtaggctaacagttttgtgatttatgatcacaggcttgtaaggctagtttgtcttgagctacattatctgttttcttccagttggatatcttggtgaatcctaatatttatccagaacttactcctttggatatttatgt

SEQ ID NO: 42670 - DNA, 17910 bp, Oryza sativa
  unsure (1)..(17910): unsure at all n locations
tgcagcatcggagtaacttatggtagctctacaggaacgcccgaaccttgactgcagatatggaaatgcattttatttctaatccctggatctgtctatcctgtatttatctttttatggagatttgcgtcaggatggctatgtatcagctctcagaacattcagcttagtatcacagcaattgtactctttacttgttttcacctggtacaagtagcttcagtggatactttgtgatcataagttcagaactgaaagcgtaactgaatgatggatatcagacacgatttcttccctgtggatactctgtgatcataagttcagaactgaaagcgcaactgagtgatggattatacacgatttctctctcctgtgccatgtctacagaagctgttctgttcaattgcccccaaaattaatgtccaacaagcagcgatcttgaattgctctgacgtaaacaagtcaggatcaacctactactatttacaagatctagatgccgcaatttgcacaaggaatggaaagaaacaacacgattcacaattggcacacatctaaacgtgtgccctctatgcactgtcactcaactcaacatgcaaaggtaagacaagaaacatagacccagcatcagcatcaatcagcctggtgatgttttccttccattttcaccttgggctgatctcggacaccgtgggtggcaccaccgtgctgaacatgtcggaggtgtcggacgccgagtgcttgaacctcgagttgctggagttggtggccttggagaccgtgccattgtagtcgtggatgtagcccggcgccgtgagctcgcgctcgttgatgcggatgggcttggacagcatcgtcaccacctgcggcattgacgggcggcgcgccgccgccgcctgcgtgcagaagagggccgtcttgatgtaccggaggacctcctcttcagggtaatctcccatttctgaatccaccagctccttgagcttccctacctcatgtagctcccatgcctgttaattgtgaaagctaggctgagtttggcagcaagagttggtaactcatcccccacacgcacgtaaaacggagcgactcattagtacataattaactaactttttttttttcaaaatatggattaatatgttctttttaaaaacaacttctcttttgcaaaaaaaaaatagcgtttaacagtttaaaagacatgcgcgtggaaaacgatagagatgagttgggaaatatagctgcgtaattaacacggccttaattgatgcagaggctggaattatacttccattctctaataaaagatttagatggagagtccagcgattacggcttaattggaatgtctctagagcaaatgtctgaaggtgaaagcaaatctctgaattttggatagtaaagatgatagtaagactgaccttctctaggagaatcttatcgtcagccaggagactccttgaactactcttgccacttacgatctcaagtacaaggacgccaaaactgtatatatcggctctcttcgtcaattggccatgccatgcatattccggtgcaaggtagcctctgcattgaacaaatagatcagttcagttactgcaactgcaaggttactttctactcaaacaaactgctaaatgctgaaatactcacgtcgttccagcaacacgggtactgatgtgggtgatattatcagggaataacttggctaaaccgaagtccccgatcttggggttgtaaagcttgtcaagaagtatattgctagccttgatatctctgtgcacaatcggtgacgcaatctcttcatgcaggtatgcaagtcctttggcgattcctatgcatatagcagatcttatgctccaagtaaaatttgcaggttcgctattagaacctacagaacacaagataaaaggttaagcaacaaacgaaatcaatgcacttatatagaaaaatagtcattgtaacatatcaatattcatacccaacaatgcacggtcaaggctgctgttttctaaatactcgtataccaaaattcgattgtttccttcaacacaacagccaattaattcaacaaggttgggatgcttcacattggtaataacatcaatttctgtcaaaaattctcgaacgccctgcctggattcagcagaaagaactttcaccgcaacatctcgcccatttctaatagttccctgaaacatcaaagcattggtaagaatgcaaggactgatggcttcagatttgaaagggatataaccctcaatggactcctcccttccacatataaagaaaaacaaacattaccttgtatactgtcccaaagccacctcggccaattttattactgcggttgaagttttctgttgctgatctcaactcagaataagagaaaagccttatgtttttctcaggcggaatacctgaaagttagttacatttagttaagtaaagcatggaatcttaaaatggagcttcagtactggcattctctagcctaatatgatcgaatctgtgatagggacaatatacatgtttctatttcataaactctgttggctgctatgcaaattcagcataaattttgcaagcaaatacagttcgtaccgctaacgccatgagagtaaggattctctcctttcttggattttggaatgcaacaccaccagctcatatcctcagttgttgtggctgtcttgtacacttcaacatgcagaagaggaatcttcaggaataattattctgcaggaattcattgcgaaacaaccacttagagagttgcaaattgagttcatttgtacattttatatattttggatatatagtacagaaaagggaaaataaaaagtaggacatgactctctttagacagaagtctgcgcaaaacttcttgttagaactgataggtagatgcagatccacccacattagcctgtactagagtaggtcaggaactggagtacaattaaatctcctttttgaaaccgagtacaattagatcttaaatccatcattcctcatgattaaagcacaaaagaacctcatactggcaagctttcaatgataactgattaatcggtgccatgattgtgaacttgcgattctcatgatgaaaagaaacatgacccaaaattttggggatgccaggtgcatttggaccacatagctccaatctcaggtgaatataccagatgttccactggatccaatggccatgtatggcacatgtaaatactaggttagcacctcatccactgaacagttcacatgatttgcaaagcaaacggccagatggcatagctgccaagaacaatcaccaaagcaagctgaagtttggtgatttcttctaacaccatggtccactcgcctcaatctgtatgcttgtacatatgcatattttcatgggagtatcagcatgtcttaaaccattatcatccacttcttttccccaatcaattcaaacacctcataagtaacggatcatccaacttgtttattcagaccacaattccaagaattcttttgttcgcatcccagcggatgattcgacggcatcacttattttcagaatctctgtccgaatgatgctttgccactcaagaaaaactcttgacagatcgtcatctgatgaacacaaactcccagagcatcaccacatcacaggtcaggactccagacgcatcatcagaaatcaggtggagaaactctaggctaaaactagtgtgcgagaaagcccaagaactaggaaatcaagaacacgaggggataaaaacaacaagaggcaagaaatgcttcgagaaagcagcagaaaagtaccaaagaaaaacaaaacgttgaacactatggttacctttcttgcttggcgctctcttccgatgagatcgacggcagaggagatcgaagaggacggagaccaaggaagtttaaagggggaagagaaaggtggttggggctcaattatcagcagatatatctgtagcagctggccagttgagcgaacttgctaacgattgcagtgttgcagattggcaggttcagctcagctcagcacgagcaacagcagcagctgctgcaataaagaccaacagcgaaaatggtacgagggaagaaggagctaccagcacgccacaaaacctaaataaaaagttggaacaaaataatactactatcaagaagatgtaggtgagagatagcagccggctgggaatgaggaagaggaggaggaagaagaagaggtcttcttgctgatgctaattgctattcctacctcctactaagtaattgctactcccactgaagtccctttgataaaaaaaattaaaaaaatcactacttactccgttataaaatataataataaattattttagttttcttgttcctgaaaatattctatctatctcctaaaatataatagtttcttcatcagtattctattttcaaccagttaaagcaacttatcttttaatttcttcacctaattaattttctcaactaatcatattcttttttaagctttggtccttcttaattaattttctcaactatttttttcttttaattttgtctgttgttcacactactttttctaacctcaaattttttttatatttcgaaagagagataattctgtggagcttgcctggatgttgccacctgccgccaggcgtggagctgtcacctgtcacaagaacactcaatagctagtatcctgctaattaccagcgcgcgacgcaatcgctgccgccatcagcacagataattagcattaagccctgcccgatcattctccctaattattgcgagaccaagattattttagagtataattaggtgctactactgctggtattgtatcccaaccaacctgccggtgccagccagggacattgctcgctgccctgagcctgtattggcgcctaacctgatgaatcatatccatcagggtcgtcgcgtacgccgcccgcagttcgatagatcgcacgcgggccacttccacactggggattgtctgtggaactagggacttgtttagttaccaaaatatttttcccccaaatatcccatggactctttagacatatacatggacccttatatatatatatatatatatatatatatatatatatatatatatatatatatatatatatatatatatatatatatatatatnanctaattgcacagttaatcgtaatacaatttttttagcctaattagtctataattaactataagtgctacaataactcacctgtgctaatgatagattaattaggcttaataaattagtctcgtggttttcagacgagttatgaaattagttttttattcgtgtccgtaaaccccttctgatactgataaaacgtttgatgtggcacccaaaatttttttttcgtgaactaaaacaccctagcttgatcatctggaccagcggctgccaacgaacgaggagtcagtagaaaaaacttggtgttttcatcgctcttgtcactacgtgtagcctacgtatgttaacagtacacgaaagaggagagatatttacgtgcttgagaaataattttctacggtcctgtcgtttcgctcacgcttatagttattcttattcgtattacttgttagcaatcaaaaaataatttaagtaattattttatgtgtgtacttgatgattcagaattaaatattgtaaaataaactacgatgaacaaatcatgaaatcagcttttaaaatttaaattttgtcttataggtttcactataagtgaaatgataaggttgtacgtatcaaagctagggcatgttgtttttaaggaattgaagaatggaatgcatgagttattagacggtgtagttttcacaaagaaattttctgaaaaaaatggattaatacctgacctctaaatccaaacagttgtacacatgaaaagaaagtaaactgctttaaatttatattttaactctatgtggtcacaaaatcattcatctaacccgaacaaaaatcaagccctaattagagttaattaacgcaagttaattaatactactacatgatttaactcctcgttttaagtgagctcctgtgttttcttgctgttggcttaggtggactggtgacgagtcaacgactgacatccgctgctatttcctgttttggttttggatgattgctgccttcttgtcaaccaattatgctctgttactgttgatgttcacacgtccatctggtgtgatctgatttgttttgaaggagtctacgccacgatcatccaattgccctattgttgttgttactgtataagactaatgtgactcgtcagaagcgaagagctccatatctctgacggcatcgtataaaaatagtattatgtgttctctcctgttgtgtttttgttgtgttgtgccaaactactacttttcagcgtgacctaatcctttcgtcacaggttgtcaccagccacgagcacgaaatgataatgcatgtcattgatccttctcataaatcaatcgtatcttaaagtctgaaattaacgttttttttatttactactactcagtttaagtgagggtgatcactacctttgtcattacatccattggtacagcacgcgcgagagcgaaaacttttacaaaccctcaattaagcctcatctaaaatgaatacaatgggattttgtttatgaaatgaactaatttctataaaaatcctgtaaaattcctatgttcaaaaataactcctaaacatatgaattgttggaaatttagaatgaaaatgctagaagtattgtcaccaattgtttattaaaaaaacatttgatttctgaactgctagattacatcaaaatttggaatgaaattgctagaactctatcgccaattgttcgtcgaaaagattttctatttctagagtatcatattgcatcaaaatttgttcagggagaaggggaaaaaaatgtacgatgcgcatggaaggtgggtatagaatgcacgatctgcaagacacaaacacgtgtctacaggtcaactgtgtcacacgctgtttttataagttaaataaaagttactgtaaccatactatagttatgctctaaagattttcttttttcttaaaaaagaaaactgttgtcagatttggatagccccaatcaataatcatcagtggaatgagacgtataaccaacgaatcatcttgcggtaacgtagccggccggccgccttcccacggaggccggcaatggtgattcgttgaacattttgatcgattccccgctgctgacctcccagcgttgatggcgatccagccatatcttaccatatatccccgagcatccctgctaagagcaaggataatagtgggctataaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagtaagctatatgtttatctgaaagagaaagataaacaaaaaaatagggagtattggctctcatgcaagagttaactgcacacaaactccaagaaatatgcattaaattcatggtgagagaaagagagaggatgaagaaaataatgataaacttatagccaatttactatacatgttagctttagacattgactaatagtaagtagtgagctctactattaaacttgctctaatgctgccaatggcaacactgttagcttccataattactgcgcattatactgcctcatttgaccgtggattttttttctctgcatttctgcctcctgttcgtggccaaaaattcagacaacgctgcatcagacgtgttatagtactcttgttatttagtatttgacttgaaggtcatctaatctaccggtagagaggcacattcgtatgttgctcattatagtggtacacttgttggttagtggtaatgctatccagtgggcaggcagtggcatctccattgcttttcgccattattatcaccgtgactccagctgcttcaccatgtgatttgctgaccgtcatgttggtgcatgcatcaactcttttcccatgtgtttcttttcacataaattgatctgacgatcttcaagttgcttgcagtaatacgtacagttcgtttggtaaaattcagagaggtgtatcaatagtaggagtagaatgaaccttgtgttcagcttccacgcaatgtcctccgacatgacaaatgacagtttatgggactagatcaaacgattatctatttcattatctttaaaaaaatcgacggttcagtcaaaaagtactgcatttcttaggataaattactcgttattgttcgtcgcgatgtgcagatagatgcagtttagtttggttttgcctgcatccacggatgataggtacttgacagaacaacgagcactatgcgactaagttggatgcttcagttttacaggaaaaagagcagaggactgatgttgattcaacctgcagtacctgaggccacaacactttgcctaagtcatgggtcgttgacatttgatatctataattttctttaatctatagcgtcttttactaacgaaataagattttttttctctgcctcaaaaaaaccaagtcaaaaggtttcaaagatgccatcttgcaaccaggtgccattccatgagggcagcggccattcatttttcacgagcttcactatttatgtatagtaccatcaaggacaagttcatttggcgttggaccagcggtgactactcaactctttggcaaagtggcggaccaaccaaatgtaagctttttctttggttggtgattcagcgatgctgctggatgatcgatagtatgctcagttaagggatggagaaccactcgatgtgccccttctgtgcgcaggaagaggagataacaaaccacatccttatctattgcgtctttgctaggtaagtcttgtgcaatctactccctccgtactagtaaaggaaatggtttaggataatgtttaagtcaaacattagaaatataaattatgaataactctcaagttattaagtttgaaaatgtaaaacttatatgaatagatttgtcttgaaaacactttcataaaagtatacatatatcacttttcaataaatatttttatagaaacaataagtcaaagttgtgttttggagaccgtgtcactgtcaaaaacgacttcctttacaagtacggagggagtattgatttttgatggactagctactctctcaccaggccgtcactcagtgctctaagattagtggcaagcttttgcggcatcgccaccataataagagtaggaaatgtctcgactcccttgtcaactatggaaggagaggaatgcccatgtccttgatgatgttctatctcaagtgctgatggtggtggagcagattgtggaagaagggaggcaatgggtggcgacaactgccaatccagttggagagttgttaggcacatagcttagttatgtttagtgtagtttcttcctctctcggtctcagcttaggagctttgttgggtgatcgtctaggcgtgtcactttttttctaatatattaacatgcaagaggtcatagcttaggagctttgctggttgatcgtctcggcgtgtcacttttttttctaatatattaatatgcaaagtttttttacgtgttagcatatatatatatatatatatatatatatatatatatatatatatattatagagagagtaacgtctctgactttttaaaggtgacaagaacagtagatcgcccattggaattatccatagaaagctgatgagtacgatgaattaaagctggtcatgggattggtcaattaatataacactatatgattgccttttttttcctccgcttggtcataacaaaagacagagaattgatacatagggctcggtcattttcttctagatacaagaaaattttgccccgttcttttctaattaagattcatattttatctcagttttcgttagcacacttttcaaactactaaacggtgtgtttcgtacgagaactttctatatagaagttgctttaaaataccaaatatgtggatttgtcaagtttgtaataattaaaacttaattaatcatgtgctaatggcattctcgttttccgtacgccaacttaattttcatcttcatcggttttatgtcaagtcagcatattttactctaccaattactagtggaaggtgcaatgaagctgaaaaaacatgtgaggaaaacctgcagattaaaaatatatttatatagaactgatataaatatatttttaatctttatatagaacatgtgaggaaagcttgtatgcaaaaactttagcatgcatccaagctttgaaattagctaatgatatgggaatgggccacattattgttgaaactgatgctcaagctctgaaagcggctttgttggatgaaacacatgatagaagtgtaaacgctgttatcattagagaggccaaatttttgcttgcaatgaattttaatgtccatcaagtcatgtattgtcctagagaatgtaatcgtgctgcgcatgagcttgctaaaattggtgcttctctgggtccacgaagccaatttgtttggcttgaaggattcccggatgatgtttgcaatttggtagctagtgattcagctggactacctgcttaatggaattgttcttcttcaaaaaaaataaaaatatatttatatagaactggtcaggtgaagaaatgctactacaggccaaaaatactggtgaactattattggacctgagcattattccgacaaaacatattgaagctgaaaacatgggcgaatcacctgtaaattaaaaaatctagaactgggcaggtgaagaattagtgctactataagccaaaaatactggcgaattattgaacctgagcatagaattattcagacaaaaaaaatatactactatatggcatcgtcgaagtgtcgatcgagtcgttgcatatttggtgagctgtgaccctaccatccaatccatggtcgcactcaacgcatcttataaattagttagatatttagtagttttaaatagaccgatacgtgcggaaaagatgcttcttggaatgttgtttgggattcaaatatttaaatgcaggacaagttggataaagtattagcgaccatttctcatctggagaagcagtctctgatggaaatacttaaacgtatgaatggaagcacacgctttcaaagtaaaatctctgatgaggattacttggcttgtctgcatttgatctgaaaaatccatgtagcttttgtggctgttttagtgtgggcggctgcgcacaaaagtctagggtcaaaaggctgggagagatgacaattatttggagagttttcaaccgatacattgtcaaaatcatcccatttctcctctttgaatagttccattttctctctttgactctggaatggagaagaatctttgtctctttcttttgttagtttaccctgataaggtagataaaatcttgcagctgctgttgatttcttcagagagagagagagagagataaaaagaagatttcttaagagcatcttcaacagatgtacaaaattagaaccccaaaaatcccagacaaacgcgagagatcatcttcgattcttgtactggcccagaaatgatgtgtacgcgggtggcccaacttgttcagtccacacggcctgacggcccgcgtgcgagaatagcccagcggcgcaagggagcctgggataacggcctagtacgcggggcgggggatgttccttgatgggccttcgcagcttctcatctcggcctatggcccaccgagcatctaaggccgaaagccgccacagctcacaggtgtgcaatgggcccggcactgcgcttctgcacgatcagatctgcaaaccgtaggtaaagtcgcatcgtcagggtcaagctatgggataagtgccgattcgggtggcttccatttttacgattctcacaaataaatactccgtacagtatcttgccctatctctatgcactgctgctaaatctgacgtactgctactacataggaagaagtcacatccagctacatgaatctggataaaaggtagtacagatttattgtcttagaaaaaatcacatccccagctacatgaatctggataaaagggtagtacagattcattgttttagaagaaatcatatcccctccaccatttttttttgggacgaatgaagtacttgtcacaagcataataaattttatatatctggataagtttttttaagctatttcccttgttttaaaatgtagattcattatattataaaatatcgtatcataataacattttaaaacaggggtaatatataatttgacattaatagtactcttacgtatgaaaaaacttgtctaaatatctctaattttattttgaaacaagccttacttgtgtggacggagatactccctccgtttcgaaatgtttgacacttgatttttagcacatgtttaaccgttcgtcttatttaaaaacttttgtgagatatataaaattatatgcctacataaaaatatatttaacaatgaatcaaatgatataaaaataattaataattacttagacgaatggtcaaatatgtgataaaaagtcaacgacgtcaaacatttcgaaacagagggagtagtacaaagcgagctcatcagtgttcactccaaccgttttaggttgtgtttagtttagcacaaagtttaaattttgattgaaattagagatgatgtaactcgcgagctcatcagtgttcactccaaccgttttaggttgtgtttagttcagcacaaagtttaaattttaattaaaattatagatgatgtaactgaaaagttatgtgtgtatgacaggttgatgcgatggaaaaagactgaaatttaaatccaaactttagatctaaacacagcaattagcaaataagccaaaacgaaccaacccaaaaatgagatgtgcatagccaaacaccatttactatcatgggcaattataagcaacccaaaaaagagaccgaactggattgagtgaagcaaactctttcttattcatcattcatagtatgtaccatgacatgccacccgcgaccgagaatatacattgccgagaggcgagagcccaaagatggacataaaaatttaaaaagaagaggtgaaaattaagtaaaaacaccgcagaaaaatagattggcgcgcttccacgctagctgcaaatatcgctctaataatctgcatgcttcggacggagaagcacatcggatatagagaggaggaagaagaggaggaagagatgagcggcggcggcaaacggcgagaaggccggcggcgagggcaggcgcacggcgacgagacgacggcgtacggagcgccatcatcaggcggcagcgtcgtcccaggtggcggcccagttggtggcgctgccgacgcggggcatggagttgatcttggtgaaggtgtcgaccttgaaggtggcgccgcacatgacgccctcgctgtccacccgcggcatcgccttcagccggttcatcgggtgctcgaagctcttgagccccccctcgctgtggaacatgcaccccaccgggaacggcgcgtacgacttgccgcaccctcccttcacgatctccctctcgtcgcagatcaccaccgacccatccgccgcgatcccccaatacaacggcacctccccatccgtactttgcatcgcgcaaagcgaatgaacgtcaatatataagaaaaagaaaagcagaacaatcagaaactgaagcttaggaactactacggcggctaaacacaactcctaacagcgggaaggggacagggccacgctacactcacaggaagttcaatttgaagcacaaattcatcaattcgattcagaaaaccagtctagtagtggtttaaattaccagggcggcgaagacggcgccggacttgttgtcgaagacgacgaaggcgaaggagccggagagatccttgacgacctggtcggcggggtaggggccgcggtcgcggagggtgcggtaggcctcgatgacgagcagcgcctcgttggtggagcggctgcacagcccgtactgccggatcaggctgctcaggttgtccagcctccccatgaacacgcagtagatgtcatccagcccacagaacatcctgtgtacacacccatttaccattattatcgatcccctacgttttaatcaccttaattattcggattcattgcctcatcgattaaattgatttaatttacctctcgtagccagagaggccattgcgggcgtggccggcgacgcaggcgagggcggcgccgccgccgaaggaggtggagaaggcctcgatggggtggagggcgtggaagtccctgaggatctcgtcggggttcttgggcttcgccgcgctgctccgcgggctgttcagctccgccggcgcgtgcgccacctgcttctggaatatggccaacattttcttcttcctcttgctagctagctccgacgaatcaaactccggcgccgacgaagacgaaagaacacgtagtactttagcttagcttagcttgagctgctgctgctgttcgttgcgtgaagatgagagacgtgtcgggttggcgagtggaatggaatggaggtgaggatagagatgtgcacggctttatagacgggatttaggatggcacgaacgcgaacgaaaatatcctatccatccctcgctcgcgcgcgctgtttgatgagcgtgttattggagtcagtgctgatgtgagaagccaaagcaagcagcgaacgggataaagacggcgagacgacgaggataagatcatcacgtaataccagttgccgctgccgatgtgacaccagtagtagtaaccggccaccttaaccgtgacgtgcggtgccctcaccccctacggtaccctgcacccaaagcctacataagtaattgtttactacttccgttttaaaatataaaaaaaattaaatagatataacacatactactaatctacatagaaaatttgtttaaatttatagtattaaaatttatccatctatataaatcttttatattacaaggcgaaaggagtattacacacctcctcgtgttggttgttgatacggttttcttccgtttctatcgagtcgctgcacgagcactgttttcttgtgaaattcctaccctgcacaagtgaggatgctgtacatggtctacacaaaacgtgattaaaaagaaattcgcaagaaagaaagagcaaagtagaacaaaagacaaactagtaaactgatgtcgtagatctgtagaacttcatgtttttgccgccggggtagccgagtaggatgaccggaggtgagcgaaaaacggaggaaacagcagcgagggacgccttttccgtgggctgccgccgttagtttggcgggagcggtttattatattaccccgtaattattgctcgctgaaccacctgtcggacacgtcatcgcctactcgaactgcgtgctcacgggggccacctctctacggcctccgtggacgcggcgtgccacgtaggctcgcgcaccgccctcacagcctcacccaccgcaactgccacgtgcgcgccgcctccttcccgtgggctggggaggtaaacgccggtgagcgccgagccgtacactgacagggtggggcccacaccgagcgacgacaaaagtgtgggcccggattggggataaggctggcacggtatggtcgctcggtacacgtcacccgcgcgtcggaccggagcgataaggtccgcgcgagcaagcggttgaaccggacgcggcaccaacgtgttgtcacgtgtccgactcggcagcgagtcaccttttttttttctctcttttctctctcttggcagggcggcaacgaacgtgtttatactaatagtaatcccaaggttgtggtcgcttgtacgcgtgttaattatggtgattaaaacctggtcaggtcgatcgagcggcgagcgatgagcagttgagcacatgcattggatcaggaggcgtgactagagtacaggtcgccaggtcggtagcgctgatcttggatggccagtagattggccagacgcttatccaggccagagttgttaataatctctatattgctacttagatgtagcttacggctgacagaatcctgctgatgagatctagtatcctctaccggatcatgacagtccaaactgtgtgtttacataagcagtatggaagatgtcaacagatgctgcatcgcaaggagccaaggaacaactcgcatgaaattgttgtactagtgtaagttactccctctgtgtttcatgttataaggcattttgactttagccaaaatcaaactgatttaagtcaataatttaatatattttcataataaatttgtcttggcttgaaaatattattattatttctataaatttaattaaatttaaagtattttgactttgatcaaattaaaaaaaaatcttatgacttgaaacagagggagtactgctaagggatcgagtgcatgcaggttgccagttgtaatagttaggaattaaaaacatatttattgttatccgatggtattgtagaaattctatatctatagccttttgcacgcttactactgccacacgctcatctcatgctcgacagctccaggaatactagctagtaagtcagaaacggtcgctttcgtcgtcatactttgtaattatgccattttaattttgctccaggagtacatttctttggcatgtttctatcctacgccgttggattcttgatacttgccaactttccgttctgctttactcgacggagacgtgcgtttcacaagctctgattggtccgagcagctgacggagatgtgactcagcagattaattacctttatttacatatatagcaccaataatccaccactagttaagttaaaactaaaaaaaaatcgatgagggtttaaggagtgtgtgggacagagtcgcactgatgaagattaactttttgtttgaaaacttgatcaagattaacttttatattaactgtcacttttcactggagcggtggtgcacacggcttggccagatctagcggcgcgtaaggtgtggtgagactcgtccatcggcgggcgcgtggaccgctgcgtgttcagctgccacatcgccacgtcgactggtttattcaacggcgtaccgcttcttacagttaacggtaagcatcggtacgtaccctgcatgataaacacctagctagagtacttactagtgcgtacttacaaaattcattagcgtactgtgcgtatatcatgttcaatctgcaccaaacgtcccaacatccacgggatctctccccttccatgtgggaccacctcaaacatgtggagcggctaagagcaaccacaatgtggcaaaaaaccaggtaacaagcatttatttcaagcctactacccagtagtaagcattgtgggaagaggtagtagttaatacctgatatttgtgctattgccggtaacaaccaaataa

SEQ ID NO: 42671 - DNA, 5550 bp, Oryza sativa
gccttgttcttcctacatgatacttcaagattaaaaccagctgaacaaattattgcaagcacctaagggtagtaaaacatttacctgctcttgaaacttcaatatagcagttatctcttggcttacgcattctagaaacatctacaaaaagagtaccaatgttcaaagcagttacaatttactagtttaccaaagaaaagagacttttttcgccgaaacacaggataataactcaacaagagcagagagcatgtttctcaaaagaatcagaacataagatatgccaacccatacatttcccaggtaacatgtagcaaagtgagtattgattaatcagactcagctgatgaccacgaaacatgcaaatatctaactatacaacgcaacacctcaaacagataaattcagttactaacattattcttgattgagtgtaaggacatggaactatggtttaaatcacataaagattcgatggatctacatgagctttgaaatctacagtaccaaaagactcatgtattatgactaaaatatacagacaggcaaggaaatcaagcaccattaatgttgttgaatagtatttgaactaaattgtagcagtgtgtaaatccggtatggaagttgagggtacagggcatacaattctcactgcggtgtgtatttggttcagcagaacttggaaatcccatcctgtcaatcacaccaggttttgcatcttcccgggtttctttcagaaaattccagaaaacccttttggggaaaaaacaacaccattccttcgaggaaggtatatttgacaagtaaaatcatctgtttcactgtttttgctccctgcatcaactttatctgcatcagctttggcattatttaactttcgtagttcactatatcttgattggaccctaaacggtgacattcttccagcagaaatttctctcctagaatccggagccatttccattctagaagttgttctgggaacaacaggtgccacatcagcactttctttccttgaatcagtagcagactctacccttctgcctgccttaaaaagaagaggtgcagaatctggggccacttccatccgcgaactagtcttcggagcagcagcagatgctacatcagtactttctttcctagattcaacagaagactctaaccttctgcctgacttgggaacaataggtgccgagtcagcgcttacttccattcttaagttagctctgggaccaacaacaggtgctgaatcagaggccatttctgttctagagtttgttctgggaacaacagctgctgccacatcagaactttctttcctagaatcatttgcaatctctattcttctaccactcttagaaagaacagggcccacatcagcagcatcactcctagaatcagtagccagctctggtcctgagctagttcttggtattatcacaggcaccacatcaattttgctaaaattctgaagactagaagagttgttactcttcagtgaacctctcttcaggttggtgccactagatgcaaaggttgaatttccaactgttttggtactggagccattaccagctctctgaggtgtgactggaaccaacccgcttgcttcaatatggtaagaacagataaataaaggacacattaggcatatcaagtgtttcaactgaatataaacgtgtaaagacagagaaaatcagtgacatacaagttgttgattttgtctctttcaatgcagagtctgaattttgagaaactgataatcttcctgtagaagactttatgttattctcagaattttgtagaactgataaccgcccaatgttagcccttgaaccactgtcattttgtaatggcatagtgctacttgacgaacttttcaactctgaatgaccatttaattttgttgaagtacccgttgcatatggctcaagacgctgaaaattgatggtttttagtacattataactaaaaacaaatggggaacttcaatgaaaataatatattggtgttagaactgtagcagggaagccagaaacataccgttagatctacaacccatattccaacacaactttgattaaatgaacaaccaagaagttttccctcgtggacatttagatcagacagtctagaccatcccacatcaacggtatcatgacatcttattggttcccaagagaaaacctgcttagattaagagaagtttatctctaggaaacatggagaagaaatttgttgccatgctgtaacatgagaaagtaatgaccatacctttaaactttcatgcaacccacacaacagagatcttccatcaggattgaatgtcatggatcgaacacctgttgtctgatattcaaatagagacgtcagcaagtaatataatggatcttttattttgaggttctcaggaactttgggcagcctgtgctaatcttgatgtatatatgctagttgtcactacagcagcatataaagcactaactacacttgaatgttgaaaggccatgctatgccataagcaaatggaccatagaattaggtaagcacaggtgattgtataaggacatgtaattgcgagccttctagcatatgcactagaacaggtagcccacatgttttgaggagataatgaggttatgacatgctgttgagagctgattacgacatagtaaaatatggttgggcacaccaaatagagaaatatcacaaaagaattaaaatataatcaatgatgtcatgacttaagagaactatgcagtatgctatttaattctagattggtgcttctatgctctaccaaaattagagtgacacaaatcctaaagtactgagtagtcgaacagcaaccaatgagtggctgaaaaccatgcagttaatgtgattaaaaaattaaaagaaagcctgtgtgttggaaactaatgattagttgttagtgtaatggagtaatataagaaagaacaaatatgaggacaaacatttgaagcactcctttacatgttcaagaagtcctccaacattttttggttgagaaatctgtgcctactaaaagtcatccggtcttgcaagcataacaaagctttatagcgaaaccccaaggttttacatacctcaggtccagtagacccaatcaattcaaaggtctccaaatcccaaaacttgacagttttatcggatgaacctgaatgaggcaaacaggagtcatacaatgaatctttagtagcaaagcgtacaggaaacaaaaaagaggcaagcacaacttctgacataaacagttatattcgaacagtgcccaggctgcaaaaatggtatgcatctccatgataactgaaatgggattcttattctacaccaatgaacaaaatatttctaactacattgttgtattgcacacaatttcaatggaggaaaagattataacataccaatatcttaaaaattcatgcaaatctttcatttcaaaaataggtcattaaaatatgcaaaaatatatatttcgcaaagaaataataaccgatgtactgacatagcaatttaaaaaatgccagaacaagacaatttgatgtttggcattgttggacagcaaaaaaggggagtgtattaaaactgccaggactttcacaatatatatatgggcacataccatttatagccataatatggtgaattgcagtttaccatttaaattattttcaaatactactatactagcatgtacagcatatgtttctaatcactaaacgaaggaagcccaagagttaagtataacagactacgctgtacaaccaaaagggtcaaagaaaagttgatgactaagtgtcagattagcattgtaacatctgaacctaacctgttgccagaaggaactcatggggatggaaatctatgcactgaatctggccttcatgacacttgaaatcatgtaataactttccagctgtcagatcccagagctgccaaggcaaacttaccataagaaaaaacaagttctatggaaaatttactgtaaggcaaattcatcatcatcatgttgagttcactaaaggaaaatcaacctgtttgctaaaatcttcacgctagcagaatctaccgcagaatcagcacaacgatgtagtgtatgatttgaaagattattaggcattgacaattcttaccttcacaacattatcttcaccaccagacacaacccagcggccatcaggtgtgaatctaattgcatttacacctcttgtgtggcctttgtacgtgtggatacagcccttccttcttatatcccatatcttcagatttgtgtccagtgaccccgaggcaaagaattctccaaaaggatggaaatcaactgacatgcagtttgacctatgtccagtaagcgtgcggacaactgcatacaaaacaaatcaagtggtgctaatcaaataagataggacacagaatgtagtcagtatacatgcgatagtaaaaagcatttgcattcacatatagacaaggaatgtggtcaggtatatatgcaacagcaaaaggcattcgcattcacgtactttttgcctcctctaaatcccatagttttattgttccactggctgctcctgcggccacgaaaacttctgtggaatcaaaattaacagactccacagcactggtgtgccctgataaactctgtataacaacaaaaagaagttaatcaaataaagtattccatcagctgaaacaacacagatgacacctccagtagctagacccactgtgatcgaacacatgtaaggtagtaggttgacacttcacataaaagtagcccctagttaataaaacaccaacatacagaaagtgatgctggagaagtcgacaagagctaaaatggtgaaattttcatctggtggttaattaaatgccccattgactattgggtagacttacttgcctgttttgctatagaaccacattttacatagtaggcatactagtcagaacaggacaatagagacttaccaaaattgaattgggcttcccaatagcccaaagattaaccttatggtcatctcctcctgtcacgagaactcgtgaagtcttcctcccaatcttgaggcagttgacattggatgaatgcgccacaaactcctctacgccaaacgcaagtcaaggcattccaatgtcgcaagttcacccacaaaatcacccccaaataaatcatgttgcaatcttcaggcagttcataagcacaaagcagcagtaatcccacttgtccgacaatcagacataaccacggtcactactaactagtgatcagcaacagcttaagtgataaaatcgagcaaacactaaatcccccattatcttaacgaggggcaagcgagataaaagcataataaaatgatgggttaaatttgaagaactaaatcgcccagctagcagaatgaatgcgacagtggcgatggatcggtcaaacagacacaatgtacctcgaaaaaaaatacaaaaaatactagtcaaaaatactggaaacgaattcgcgaggatacggagcttgtaggcgcgcttggtgttggtcgtcat

SEQ ID NO: 42672 - DNA, 2770 bp, Oryza sativa
gtggcgatttggggtttggtgcgcgcgggcaaggtggtggtggaggcggagccggaggggggaatggagctgtctggttggggccgggtggtggagaaggaagacgcagccctcctccgcttcgaaaattttgaattaacaaagggttggggttggaggcgataccggattaaaaatggagcgccagtgttgggggaaatgcaagcccagatggatcttgtccacttctcggttggttcgcgaacaaaagttttaaaatctcagttttaaatccatacagtttgatggtttcacggattcacgcaccaccagcagctgcgtttttttgaaagggtgaatttgagttttggaatttgtctgggtttctttgtgttttgtagtagtgggtttttaaaagtggttgagtagtatgtgccatcgagctcaacaaccgaatgaatgattaaactagttaacactaccggcgtgtacaattgggacggcaaatggtcataccatttgtttaacgttttatggggagaaaaatatcttgcacttgttggacacaacatggttactaggagtgcacgtttgcttgttgcatatccaacactccatttatgttcgtggttgttacgcttaatttgttgtttaagccttcaaggtaagatttagtttatctgtggcttgaatataactaaatgcaggggggggggggtttatataatcgcattgtaattttgcgtagacatataatagcacattcaaattagctcactagtagatttcctcgcagaatgaatgtgtataaaaacgaatacgtacagcaggacaaacgaaacagtgtgacacttgaaaaaagagactccattagtgtgcatggtgcgctcgtattttaatagggcggggccgtggcagcttggtgagttcatgattagcagtggttaagttggctaatcgcagaggaaaaaaatcgtagtattataatcaagtagagcgatcccatcccttataacattgtccgcccagtagttttctccttttcctgacgtatgcgtagtgattagataaagaatcacctaattaagcctctgaaaatataattttgctatctacattttttttgtcattttcaaagtatgggagaaccgtacaaagtactactacaaacgtatacatacgacgagtaccctgtattttcgggggacctgtgcgttgagacgggcccatcagttcggaatttgagagtcgagattacttgggtgtactagtacggttgggtcgtccaaatcaacgaaaagcacgtggcctccagcctccttgcgggtcccaccaccaagggatccttttgacgtggccgcgacctcctctctgtatcgttttccgctgtgtgtgccgcacccatacatacgggcatactacctcctgccacaatatgggctccatacatgtacccacgtatagctctacatactaataacatacatgtaccccgtagctgttcgtgtatcaggggaatggatacatgccacgtgagcattaaatctcttgtaagaaatactatgtatgcaaattcggaatttcactattagaagtacaacaatattcccaccttttttaaaaatttggcccaagttgttttttttttaaccaaaaaaaatacaaaccaagaagccggcgagttaggttccttacggtgaaatttgtttagatggatttaagcactcgactttgtacgactatttatatttacggttagttatttttttaagtgatgtttgacatattagttgatagcgagacgcttgtatgaatatgagcatacgcgtgcttaccgtgttttgggaaaaaaaagtgaaaaatatatgccgtcgaaagagtgtttggtgatcgaagcctgtcatccactgctctagcacaacgcacggacaaagcgtccttgtcctgtaaactgtgtctaagcgaagagttttcagacagctctgcctccgctgctgctgtatagatgagcgaagttaaccggcagcaggaccaacggcctcaaccgacaggtatacaacttcccagcttcagcaacaccaccacggccggtgaaaccgaaacactagctagtgatcctgatccggacctaatttaaaggcagaaaaaatatcttagcagcaaatggaagagttaatcgagctttgcaactgaaaagctagtataacagtaatggggttaggggaaggcacgcagaggagacgtcccggagatcattgtaggggaccaataatgcacaaagcgtaatacaattatgccaccatcatcctggcctctccttcacagatgatggatggagctgcgtgatgtcgcgcctggccacatgcccggcgacgacgaccgatgattgtcgtgtgcgtgacccatgtggaggacctcgctacccccaatctctcttcagcctttcatcaccaaattaggctattagaatccggaataagcttagttaattattgattaggtagctagcttaatccaccatctggagtagtattattacaagtagtaggagtagacgagtagtacgaattgtgggattggtttgatgagcatatgtcgtcgtcgaggctggaggctggacgttacggtcgttgaaaggtaaagggcagttggtgtgcaggcaagtactggagaggttgcagtcagcattggagctaaaacgagtagtaggagcagaggaactgagcaaattttcagcttagctatagggtggcaagtgtcggtgcagggtacttgcggatagctgattttc

SEQ ID NO: 42673 - DNA, 969 bp, Oryza sativa
gctgatactgttgaatgtattactgatccaaacgtcctgacaagcttcaccaacaattccagtgaaacacctaagtgcctgtgtagatttagcttttgtaagaaatacttttaattgcaatttaaaataaataaatgcatggcatataagatgttaagccaatcagtgcagtacggtacatacatatgaataaattgtctctaaccatttctatatactcccccaacaggatcataataataacaaaagcagcggtaagttacctgtcagttttactctccagaaggtcagtaaggacgggcagaataacagtacataaatctagtgtgattgtttcacttttctccatcagaacacttgcaacatcagcagatacctgcacttgccagaaatcaggttgttataactatgttgtttagtgcactgcacacggaagagaaatgttcaaagtactgacggcatgatcagacatcttctccattgctgcaataatgccccgtatatcatttctttgccacatttgatgaacaatctgcaagtcacttaaaatagtcagatacagcattcgagcaattgcattttgaaagcctacagattttagtattgaaaattctgagaatgcaacagagcaatttagctaattcaacaggtcatatttcagtataaagtatacaagtatcaacagcctgtcgtacactagaacactgcaaaataggacacaacgtatgcctacctcttttttctccatatctctatatcttattaatcaactcaaataccattgagaagtttgagaataaagatactagaagtggggggggggggatcttaaagaaaatgcaaagtaccatactgacctgcaattttgtcaaccgagatcgagttgagcttagaaatagctcatgctgctccattagaacagatagaacatcctcatcacttgctatcgttggagtttcagcagcttga

SEQ ID NO: 42674 - DNA, 2323 bp, Oryza sativa
aatttttagctccaagcaagaagccacggacacaggataatctggatggcatatgactccgccaggcatgatatgactagggtcaatcccttgcaaaccaatagcgacattgtccccagctcttgttaaattgcaactagagaaattccgctcaatagttttcaccacagctaactccccaaaaggcatggcgaggatttgaaccaagagtcccatgaaatcaggaaactgcttgaacatcttacaggcaaaagcatagttatttaatcattgagcacaacattatttagacggaaaagtggtaggacaacgaaaacagtgcaaaagatatagttagaacacaagtgatgttcaaccatacataaatatctcgcactaaggcaatataagaaacaaagacaaatgtattgtagtatgtgcttagaataacagcagggtgataccttagaaccacttcgggttgctccaacctctactttaccaccaattgcaacttgccccagcttatgtgacgaaaagacatcacaaattggaaggcgcagtggctttgaaacatcacgagaaggaggcggtaatgtgtcaatggctttcaacaggcaatttccatcatacctgacaccatgcatcaattacgttggcgaacaaccaccaggttttaaggtcaagggatatgcaggtttaccatagggaatatctattaccatgatgatagtcgagtatctgaagctgttgtcattaagttctcattctccattgcactaattggaacccaggcaactgctgagtctttgtaaccgcatgaccgcagaaaagcaccaagctgtgattttgataaaattaaatcgctcttttgaatattccaccgagttcatcttggtaacaacaactatcaagttatccacgccaaagcttctaacaagctgcgagtgctcctttgtctgtccaatcccattgatgcccatacctgcttcaaatgatcctatagaagcgtcaataactaggatagctgcatcagattgtgttgctccagatatcatattaggaacaaaatctgtgtggccaggggagtccagcaaaacaacatggtaatctttggtgtcaaagtatgcaacaccgacagtcattgtaatgccacgctcctttcatcagcactctcatccattgcccaagcatatgcaaatgatcctttcccctggaagaagaaacgttatatatgaacagctcccaagatgcataaaaggcacatactgagataacatcaatcattaaaataagagaaccttttctttagcttccttctcatatttatgcatttgcttttttgaaatcctccccagggcatgtaacaaacgaccacatagagttgatttcccagaatcgacatggccaacctagcatgtttctggtttgagttattcataaagataggcagatagaaggcaaacaagtaataagcaaaatgatggatacatcaaatatatcgtgtatatatagatatgtagttgcttacaatagcaagatttaattgtctagggatgccttcatcttcatgctggagcatccatggttctggcttgtacagggatgaagaaactggctttttaatattggctttacttttttgtgacttcctctccaaactcaaatgctgtagctcatggtccaagcaaagtgtttcattttgactaccaacagaaacactctcactactttcaccgaattcattcgactttacaggcaaatttgagtctgcagttgtatccttctcaggtgtagaactatcattatccatcaccctcttttcagtgacatggggagcatctgtgtcaactgatgtgaatcaagttactatggaactatagcacgcactgcacaaccaaaattattcaagtgtggaaaagaaactttgtttagaaaactatcttagcataacctttcattggtaccaaccacataaattttgaaaataacaatatctataacaaggaacagttcaaatgttcaagtgtgttggcacacagtagttctctatctgaccagactaactcattcagcataaactctaatcaaactaattaactgaaaaggttccacaaagactcgcgcatagaaaagaaaataaaggtttcacatatagatgttaatgttaagttgttaagatgcatccttttcactagtctgagttagtctaactacatgggagtgggggaatgcaaagataataccttttctaaaacttctcgacgattttagtcctgtagcgaccacgtcatccggagatggtgtatcaaacttgaaaggcactgtgaacatgaagatatgc

SEQ ID NO: 42675 - DNA, 1567 bp, Oryza sativa
gaacattcataagtaggttaaaatttaacactgactatcttcatatttcaaagttcaggtaaaccaaattatataaaaccctgtaaactcccaagacctgtaagctacctcccacatatgtgcttcagtttgtttgtttgcagaaggaccatggcaggctagctaagcttatagttcagacagtcacttggttttgaaacaggaaaattttacacccaaaatggtagtcacaccagatgcacaatgaggcaattgagagttaagctatgcaaatgactagcatatatagaatcatacaacattaaatatctggtttatatatagcagcaagtacatataactacaagaatttggataatgccataaattaaacaaatcaaattaccaaaagcgcttgatgtacaaatgcagtgtacctatgttaatgtggcgttctttacgggtcatgtatgtcttatgcagcgcatccaacgtagctcgtgtacttcctgttgcatttctgctagctttaaagccaccagaaagaacaacgtcttttgacttggcactggatggtgagaaaagagttcttgccagtacagataccgcataatgcttgtctctccgtttagctggatgtcatgatagaaaaataaataaattaacaggctagaaaacataaatatatctaatcaaagccataagtcaacagtgcaacaaaaaactaaccataccagggaatggaacaacaaggaatacactatacctctgccatcaacttcaagggcattattgaaatacagcgagaaatatcgaagaacaccgcattgctcacatgattttttttttgcatcatttccgtgttcgcaaatggtgcattgccaaatgccaggatttcttgatggctcctgaggatcagaccggttatctaattcaggaataaactagagaggagttagtaccaagcaaaccctatctagatgttttcatgaaatacttgtgattctgagaaaaaaaaagtgagcaccaagtaaattccgtaaatccaaacacccatcaatgaaggcaaaggtagcaaaagcactctagtagtaactcaccatctcttatgatgagatcatcaactttactgtctctaggattgccaccagaccacacgcaccgtcagaatctgggttgatatcaaccatgttaaactctgcctgattatgcaacagaagccctaccataatatgcaattccatcattcaagcagtcaaaaacagatctgctattgctatatgagccagtcaatcagaactcagaactatgaattttctcaatatatatatagagaaggaaactccattgggcattaaccagcaggcaacattaaaagagtaatgggggcgcagatagcaagcactggaaactcccctacctataccattcaccaccaaacaagacaaaatactaatagggctcatgaagctcaacatggagaagaaaccaaattcagagcgtttctgaatcggaatcgcgataagaggactccgcccgagatcctccgccgccgctccttccccccgacctcctccgagcagcaagc

SEQ ID NO: 42676 - DNA, 59433 bp, Oryza sativa
  unsure (1)..(59433): unsure at all n locations
gaaatttgcaggcggcccccttccgccctccgggagggcgattttgcactgtgcggggggccgcctgcaaatgggcggcgagggggcatggaaatttgaagagggcccccttgccgccctccggaagggcgatttttgcctcccccctataaagcccagcccctcccctatgaaatttcattatattcactaaaaatccaaaaaaancgaaagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagttttgtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagtacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtaatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcaaaaatttctctcagtggattgagaatgagcctaaggagaagtgggctctattgttcgacaccgatggatctcggtatggcataatgacaaccaatttggcagaagtgtacaactgggtaatgcgaggagtccgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagtttagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcagacgcgcaaggccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaattattcggtgttgtatcataatgttatcgtgatgagtgttcggagtaaacacttttgtttgtttgtactcttgtttaatatgtgttagtaattcgcttagttcaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttatacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttctagcaggtgatgcgccttccacacctaggaccgaccaccacccttcctccgtactctacagtcgggcctagcaaggcttggttgctccagttcactgtaagtaaataagttgttattatcatacgtgcttatttgcgaccggatcagtgtttgtgactaacatttcattcttaactgtaggcggaccttctacaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctatggggttggtcgcagcgcgcagtggccagaggacggtcccacgatggggacttactggtgtcgacgtggggttagtgcaacttcgctgcgttataagtttatcagtcgtcttttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttcccggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgttggtaccttcctcgcactcgtgcgcgtgtgaccttcactccagacgccccagagccgcacgttgccgctgtcacggacgcgtatcccacgcaccgtgaccgagactacttcgtggcggtacatccaatttgtattacttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgccagctcttcctctcacggagcgtcgatccctcgcccacacggtactttactttttattaatactgttaaatacctatacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttataaaaaatatagagcacagtacaaaatcgcccttgcggagggcggcaagggggccgcctgcaaaattccatgccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccttcccaaagggcggtaggcgactacttccgtcaattttcaaaatagaaaattatttttgtaaaacttttaataaaaaaaattaaaaataaaaaaaattcccgctgcacgcctgcaactgcaacggcaaccgtgcgtgctcccatccacccatgacagcgtgcgtacgtgctcgtctcacaccgaacaactctccatgtactatgcgactaccgttcgagtaaacccccctcgtcctacttacatgcgcgaggccgttgcgaatcaatcaacactggcgtcaatcaacaccaaacaattcgttcgatttcttagtttagtttagtttctcgcttaatactctattctaaagcacaagggaagcagccaggaaatggattagtgatgaccaaacggacaatcaacagtaacgctgttggctgctgacgactattttagttgacatgtccatacataaatacacataatccagagagatggccagctccgtgaccagcaaagagacaaggctggggtctgataaaagaagccctacctgagcttgacctccctgtctcgagccccccatactgcatacctcatgccatactctaatcagtataatccaggcattaatgagatgcatcagctttataatacaaagctaatgacatgccaatacatgctgccaaccttgcattcctccagcctacatatgtgtccatcgaaagatacaccattttggaattgccttctctctgcatttaggcacgcaccaaatccttgtagccatgggccatcactcacctgccctgcttcatgttagctcagatttcagcctctcaggaccatttcttgtgatgcatatatactaacttgttgtctcatatagcactagttacatgttcatggatcatatgtaataaactgccatcatcaaggatcagcctgtatatgctcatctctatcaatgctagaagtctacgattactaacaaaattagcactgcaacactcactgacagacaacatcaaatcaagctcctactatctgacgacaccatgctgtccatgcagctaggatggaggagataagccaacattcagacaccatcaccatgcgtgatgccgtgatgagaagaaaagtttgagcagctagctagcatgggtcatcagatcatgctgttagagcagacagcattggtcaatagtcagaattttgggtgttttcttgggtgttgggtcctcatgaccttcacctttgtcagatttagcagggatctaatgagcaaaaaattagtaacaaagaagcctacagcaagtagccaaatgttgctgtcccctctgcccctacctaataagcacaactactgtacactccaaacatctgctcactcacatgcatgtgacgtttatggtccacaaactacacatgattatggcaatagtgccctatgtctcggcatgttttgcataatggagtatggatctcaatcatgctaatggctagcttagccttttgtgaactaacctccttgcaagtagtattattcaggatggggcctggtttgcaaatatgttagagtgcagacaccatggcccatttctgtcgctgcaaccttcgccaatttatatataaacctcgaggagacatgtagagggagcattcgcttcatcagttcatcttctctccatctccatttccagtagttagttgtcaccagtcatcagcacaaccatggttattgatcagaagctactctgcttagtgtttgtctcaggagtactcgtcctagcaaatcttgcagatgtctcttctgctgctgcttcttcactgagcaggcagcaagatcaagtggctcgagttcttggtcgcagaggcagagaactgataggagaaggcttgtcaggacaccaataccggcatgaaggcaagcacaaggagcaacatgaggtgagttcattattcatatgttcataaaatgcaaaactgaatttttatgtgttttcttgtgcctgcctctgctgcataatctttttttaatgtcagtgaatagcacattgtgcactaccatcttcagctagaaatgcagatgaaaaacaagaaataattgtcaagctcatggtgtgtccatgtccaggtagtggctatggaggcgacgacgaaggagactgcagagacgaaggcaggttgggtggatgatgatgagggcgcaagagaagggctgatcgacagcgctgattacagcggggtggcgatgcactctccgtctccacccaaacgcaagcacccaaagaaaccataggctgtcagcttctctgtttgtccgtgtataatcttcttgtctagcttagttagtaggagtactactagtactaagtactctcttggactgttaatttcgtcatgaaattacatgtacccttcttcgcaagagatcgatcgatgttctgctgctgcttcttctgtatgtgttgccattgctctgttcatgcattgctgttagctagctgcagagatgacacagccagggtttaagttttcgacgaaaaccaaccaaaaaccgcaaaatttagatgttttgacgagggatgaaactaagggtgcaagtggctacccgcgaaaacctatttataggctaaactaacccgcgaactcacttattttgacctataaatgggttcgtgggtgacccacttgcacccctagatgaaagaagattatgagtgaaatttcgaatggttttctagaattcaaatttgaaacagtaaaattcaaccaaaatttgatcgaaatttggtgaaaaatgtcattccgctacggattcaggtcaggcactcgatcagaaaggtgaaccctgaccacagctgagaactaacaccagtccatgatggtcgagtgtcaactgtcaaattatattctccaagtctccaatagtgacgttttcatcgcaactacaggtttagcccgggataaaaaacaaggaaacatttttatttcgagggaaggacgcaggactgaagaaacttaaaagtgtccctgatgtgtttcatcatccgttctgtcactcacaaatggactcaaaatacagacccagatcaagtgtggtgttcaaccaaaatgttaactggcgaatggaaggtggcgtggttttctagaaactgcagatttgtacagaccaatccccagacagaagaaatacaagatcaagactggtgggcagcaaacaaattttgctgggatttatttgccccgattcatcgtccaagttcttcataccttcagggccaacttcttagcagcaagaacctccgcttcgagggttggctcccaaagaattgtggtttcagccaatagcgctgtcacgacgtacgggtccatgtttgatgccgggcgacggtcttccaagtagcctatcagcaaggagatttagcattgtaagggcaagttaataagattgagttgaaaaatgcaaatactaagttgcacatttgtgaattgtgaaaacaacattacaagacatgcatttgctgatgttgtgttctttcatagtttcagaaaaaaaaatgtttgtattttcaactcaaacctgaaatatttggagcgtaacaacgaagtattgaattacggaagtacaaatgagcaataggggcagttactacatgatgtgcttatttgctataaaaactatgttactctggttttggagggctcaattggttgcttaatataccagtggatgttagtgttttctgaatcccaaacacaacaatttcaggggacatggaagaacatataccttttcccttcgcctcggtgtctcgccccacccgaatagagcatccacggtttgccacaccctttaatgaaatgtttcgttagtatagcttaaaaatagaaattaaaacataaagatataaaaaggccgctgaaaccatacccatgagaaattgtcaatgctagctgtctcgtgtaaacctgtcaacctcctttcatttccttcaccatatgcacttatatgcaagtcatggcgaagtgataggtttaggattgccttcttgatcacctcaaatcctccatcttcacgcatactcttggtgctacatttgcaagacaatcagtatatttcaattgtttgagaaacaaagaacattcattcagtcaatcgaagtgaatacaggcttattctggatttgtattcaataacaactagtatggtggcccgcgcaaactgcgcggctagctaccaatattccttatttctattccaaattttcatttttttttctaaattgtatttttatatagattgtaaactcttatttcaatattttttattttttatttttataaattaaggttataaattgtatttcaatatagactcaaacttctacttatattttctttttttaattccaaagtttagttagttctaaattgtatactgatatggagttttttctttcaatattcctttttttaatttcgaatttaagctatttaaaattgtatttctatatggactctattattatttttctctgattccgtatttcaattagttataaattgtacaccagtatgaactctagccttctcttccaatattcattattttttaattatctatgtaaattgtttttctatatggacttcgattaatatgagaatttctaggccatgagagcaaacgcggagtccaattttcttaggctgtgtttagatccaggggtgaaaatttttgccatgtcacatcggatatactgacatacatttgaagtattaaacgtagtctaataacaaaacaaattacagaatccgcctgtaaaatgcgagacgaatttattaagcctaaataatccgtcattagcaaatgtttactctagcaccacattgtcaaatcatgtagcaattaggcttaaaagattcgtctcgcaaattagtcgcaatctgtgcaattagttattttttcgcctatatttaatacttcataatatacttcatacaggtgttaaaacgttcgatgtgacagagtgaaataacttgtcagcggatctaaacatgcccttattacttaaataagttaatgcattagttcttaatccaattggttaaattagaaataaactttgtgcatgtggtttgtttgatcgtttccatctcaagttttttttactccgattcctatagttactttaagcttccgtaaaaaaaagatttatattagttgtataaccattatggccgtgtttagttgtttaggtgtaaaaattttgaagtatacggacacacatttgaagtactaaacgtagactaataacaaaacaaattactgaatccgcctgtaaactgcgagacgaatttattaagccttattaatctgtcattagcaaatgtttactatagcatcacattatcaaatcatggcataattaggctcaaaagattcgtctcgcaattgacatgcaaactgtgcaattggtttttttcgtccatatataatgctccatacatgtgtccaaacatttgatgtaacgtttttcgccaaaattttttggaatctaaacacaccctatattaaatctaaactgttataatctggatctactatgactcaatggttattttttttctctttttcttgattaacattggaatttctatttttcttgtctgttttcactttttctatctttcttgtccgtttctattttttcttttttgtccgtttccaactttttttttgtctgtttacaccacacccaatctttgtttttttgtccatttacacaaaacctaatcctaatacccttctatttttccttttttcttgtgcatgtggtttgtttggtcatttccatctcaagctttttttacttcgattcctatagttactttaagcttccgtaaaaaaagatttatattagttatataactattatggccgtgtttagttgtttaggtgtaaaaattttgaagtatatgaacacacatttgaaggaattaaacgtagtccaataataaaacaaattacagatgctgccaggaaactacgagacgaatttattaagcctaattaatctgttattagcaaatgtttactgtagcatcatattgtaaaatcatggcgtaattaggctcaaaagattcgtctcgcaatttgcatgcaaactgtgcaattggtttttttttcgttcacatttattgctccatacatgtgtccaaacatttgatgtgatgtttttagaaaaaaaattggaatccaaacacaccctatattaaatctaaactgttataatctggatctactatgacccaatggttattttttttctctttttcttgattaacattggaatttctttttttttgtcccttttcacttttttctctctttcttgtccgattggatttttttttgtccgtttccaactttttttttccgtttccaactttttttgtccgtttactctttgtttttttttccgttaacacaaaacctaatcctaatacccttctatttttctttttttcttattttctttcgattaacgggggattttctagaccgtgagagcaaacgtggaggcttctttttctattactttatagatataatagatttaacacctacgaacacttgatattcggtccgtatttggattggtattttaggtcttacacatatgttttctttcctatcaaattcccaaggaatttatttttgtctctgaataggcattagttcggtcaacaaagttgttctctcaaaggaaaaatgtcagcaaagctgtgttaagtgttctaagctttgttcttatgctgcaggatactttaacatcagaagaagataatgaaacctgtagtttgtgtggcacccagctccattccagtctccctgtcagtacattatatatgttcagtctcctttaacgtttgattcgctttaaagttggggacaatttactaggacatacctgaattggtttggggtcaagggtaagcactacaccagcctgctccgttattctctgattacagtgagcaaacgataattagaagtgcttttactgatgcagaaattgatataagcaaaagtatagccattcataggatgcaacattctgatgttttgaacaaaacaaagatgatggctttcaacaagcgatttgtaagaatgtcaaggtggatcacaaaatgtgcacatgtaaacgtcttggcaataatatgcatgcagcttgatttttaaaccatggtttgaaaattaagagagaaaaccaaaatttcattatgtagggaaatattttattattattatttgaaccaaaatttcattatgtagggaaatattttattattatttgaaatacctcaagaatatatcttgaaatccatatgtggtctccagcttcaataccgacactaggtccaacctggtactcccactgcatgaataaggattgtgaagtttcacttgttaaacactaggatttgttcttcatagaagttaaaacatatccactgattcagaaaactaattgacaaataacaacacacatacctgaccaggcatgacctctccatttgttccactaatgttaattccagcataaagacatgccttgtagtgagcatctgatatgtcacggccaaacgatttgtccgatcctacagcgcagtagtatggaccctgtaatatccagcatgatagtgttttattaagcatacacaacacatggacttaaaccatccttatctttattattatctgatcaacaaagctccattcttgttcagtataatacctggggcccagggtagcctccaacgggccagccaagaggccagtttacgtctctctggagcaaagtgtactcctgttctattccaaacctagaaaaatagtgcatagaaaatgtctcaacttcacatgtaaacaaaagtagatggaaaaaccatgttttctattgtaatttatagcacaaaagtgcttgatgtttagttaccatggcacttggctgacaacctttggatcactgaatacttgtgcagccctgttacgtttgttagtagggatgggttccccagctggtgtgtaggtatcacacataacctgaaacaacagattttgtatcagctagcatgcgatttttcacatgcgccactaaccattgcacagctaatcttttatgtgcaggttagtatgaaaagcacatttgaaaaggataaaacattaaggagaagggatggtaccaatatgttgttgccacctcgaaatgggtccttgaatatagcctgtgggctgaaatcaggggggacagcgcaagagaagagacagaattagaaatctagaatgctttactgaagaatcacatgtactgcaatattttttcttactataagatgacttcactatcttctcctggagcttgccctgtgcttgatccatcgtagttccattttggtagctccgaggggtcctccactggttttgatattgtctgaaatacaggcattcgatttttctttcaagggccaaagaggtagaaagtaaataacgaaaggaggcgctgtgtacactgctaatcccctaaaaacgcaacttctcttcctaaagacagcactggtatctttatccaagaacaagaacatttgtgataatgatgataccaagtgcatacccttgatttgcttctgaggtcaattccagttcctccaaccctgcagaatgtggcaaaaaggattgcagattcgttaatatattgctgctttcaccaggaaaacgcatcggggattcgcactcctgaagtattattattcaagtgtgggaactgaaaagcagctagtgtgagtcaccaccagccaccaccatgcttgagaaacttttatctattttaaggcaaaacttgtactctactaatgtttgctcacagctaatcctatgattcatatctcaaccatccaattccctaatcgaacggtgcagtgcaaaacctacaaactgtagcagtagtactaaattggtgctagtaaaaagtgcggatttggcttatctgaaatctgaaagtctgaaactgctgctactgctactgttgtgtgggtcaaaccaagaacagaagcgtcactgtgagatgcagcatttgcagtaccagatgtactcggcgatgatcttgtcggtgaagggggtggtgtccatgttgagcagctgctccatccgcgtcaccaccccggtggtctccgtgctcacggccatcaccctgaaccccgacgtgccgcgcccggtcctcctgactccccacaccctcccccccgccgccgccgcagccgccgccggcctcgcccgcacggccccgacctggcactgcatcgccggcaccaccgcctgcgccattttcaccccctacagataatcaccaactcactcaacctgcatcaaacaaacaacattgtcatcacaaaaacaaacaaacccaccaaaacacaaaatgcaggcattgcacggactcaccggaatgcagcgacgaggaggaggaggagaggaggcgacgtcgatggaatttttaatgcgaggaggtgcataaatatttttagtggcgggcgggaacagcagcatcttggcttttgctgaggggatagggctccccgcggtttgggtggacgagatttctggcccttgcgaccatcggaggcaaccagcacacaatccaagcgtccccaggataaaattttccccaaaattttttcttcttcgatttatcaaatcttttctcttctcctggatatggaagatgcggctctccttgtcacgtctacctccgatcgcagcagcgacccatttattgttgtttatgtgcagcgttcattgacctgcaaattgtacatttagtatttgtttgttatttataatcttgggggggggggggggggatgcagccagaaattcagaaaatacaagactgtcactgaggttatgactgaccctcagatggtgcaataattgggggaggagattagcggtttagaaacgtcatctctttgcaggtgcagcgccaacgggttgatttggggtccagaggtcatagattggattccatctggtcggtggcaacaaattgtgtttgtttgcttatcaacttgcagttttgtagcagtagatcaggtggtcatgtgagagtgtgagacttgagcagagagattctgtggagctttgcagcatgagcaagtgattcattttttatcattagtcatatcatgacaatagtgaactcaagttgtaactaatcagaactgtaagaccacaagacaaaagaccatgatagttgagttaaaatctaatcagaattgtggatgattgaggtggggcaaatgtttccagacagattttctagtcagggagaaatgatacacctagctgatcactgaactttatctgtcaggagggaattctccaaactccagaagttaaatttcatgcttcctgtgcaatgctagcattcccctcgtgtactgattcctagtcgttctatacatctgaagcaacatttcaaagctctcacacgcgtcttcgtacgctacgcacctacaaaatttcaacttgaagtctgtaaattcagttaaggattgctcaaggttgcagctgactgcctcaagaagctcttcaagggctcccaaaatgttgcagaaatcgacttggtcatttgtgcctccgtgttgcggcagatgccggagccaacacatccattggaagggctcatcgtttttctctctcactgcgagcccaatgcacatcaatgcctccttgaagttgcagctcctgtcgattttcttaattatctcatcaaaaaatgatctttggttgcttctgagagctttcgagtgagttgtcgtacatgaactagatggtggaagctttgctgcaaccatgcatgccttcctgaaggttgcatcatttttcgaaagcagcctgattgccacatgcaacaggagagcaaataacgaagttcgtgcctcctcttgggacttaacaaatggagagctccagtgtttctccgtccaacaatgaagggcaatatgcgtaaatccctcccacctgcaacaacagtaatagtgagatgctgaaacactagacatggaacactgagaattttacatagatatgaagagtacttactcgaagggtggctcaacctcaatagcaagggtcaaatggagtgagcaatcaacagttgagttcacttcaaatccaccaacatcaacatcagtgtgagcctcgtgaacaaagcctctaggaacatacattatgtctccttcaagcaaaatttccatcctcccaccacaatcatccaccaagtcatctaaaggttcaaaaggttcatatagtctaggcaaaagtaactttgtgtcaggccaaatcatccatttcttgcatccaagcagttgccaaacaagtacacagtgatcatcataatgccgggccaggccctgagctcttggaggggagaaatatatattagctcccacagaaggttgaccgaataaatcagctacagcagaagctatagcagcaatcttttcagaacggaactccataccacgcaaggcaactgagaaaccatttttaaatgcatccttacatttttcaacgaatgcatctgcatcctggaaggtcatcccatcatcaaagaaatgttcctccatcgcataacctattgaggtctgatcacattggtcatttattcttacaactctgatatcttgcctatacttcacagtggcacccaaggaaccttgaacctcacggagaaatgaactaatgtcaagttcatctgaagcaatagcggggcaagaaacaatcccatttacaagtgactggatgatagtatcaggtgttttcagatcaaattcattaagcagtgaagtgaatacactatccacatgcagattcttctgtttcctagtgaccaagtaagtcgacttctcccagtagtttaggagaaaattttcatagtcagataccgattgtccaaaaatgcttcgtctgacttcatcaggttccaggtgggctggacaggcaatattcattgaaagcctaaaaatagcttcagatatctcatgttctttcctttgaagttgattcttcgagttgatgcagtcagttgacgatcccagtttatcaacattcttccagattttatgcaacaaaggcagaacttttctaactacatcctgttgcagattatgcaaggtatcaacttgacaggaattcaccatgaataccaatgtgtcaaccatcaagtagaaggatttatttgctttagaagcactttttgagcactcagtgcttctgatatcaatgactccagaaataaattccacctgagaaaatagatatctacaggaagtgaattcaaccagtcgaagatattcatcatatttaaaaggcctggcaatgcttcccatctagttataaactatcaagccatcttcatcataacatattaacatgctaccagaggaagtttatcataataactgcagacttgccattgatctatacatgggcacattggttaagttgatcttgtgaacataagagtcaagcggttcttgacatttagtagtatatatcagtatagcacaagctactaaagccgaaatacatattgaatttgaaaaaacaatcagatcaatcagtaaatatgcttacaatatgctctgcagaacagcagagcccgcaagatgctccctgccagcagaagaagcagagagatccattatagcattacaggcagcctctgccactcgctggctcccacgccgcagcgcccgtgccaagcaatcggcaatggcggcatcggacgcaagcgtctcgctagcctccatggactggagcgccgctgcacccagcacctcgcagctcagcgcggccacagaagcagagctgcattgccaatttctgcacaagttaaagagaaaaaaaaagaaaaaagaaaaaaaaaacagaagggggaggaggataggagaggctctgtactgtacctggaggtgaggaggagggggaggatcgcgacgagggaggccgggagagggtgaagcgacgggcgggagcgcgagagcgcgcggcggaggaggcgggcgacggtcgagtcggagccgtgtggagtccgccggtgagtggatcgtgcggcggcggcgagcaggatggggaagacgctccggtcgaaggcggcggaggcgccaccgccgcgcctcttccgcttcttcatctcgacctcgcgaagttcgattcgtggcggagctccggcgaggccgccgccgtggagaggagagaaggagacggactcgcgaatacgtgagatgaatatccgtgtctcctatagcggttacgtattctcagaggtgactcaagcaaattacgcttttcttccgaagaacctgcctttgtactttacgccaactgcattcttggaaatgaattgaacatattccaaagtgaaattttatgatcaattttaccatataacatttgataccttgaggtaccaaattttacacacaaaattttttgatgcctcaaggtaccagattttacacacaaaattttgatacctcgaggtaccaaattttacaccagagagtatctcaagataccaaatgttggatggtaaaattgctcttaaattttactccctccgttccaaaaaaaagacaaaccctgggtttccgtgtccaacatttgatcgtccgtcttatttgaaaaaattataaaaaaattaaaaagacaagtcacgcataaagtattaatcatgttttatcatctaacaacaatgaaaatactaattataaaaaaatcatataagacgaacggtcaaacgttgaacacggaaacccagggtttgtcttttttttttggacggagggagtacatgatggatgatgttaacacaacaatagcaatttgaaaaaaaaaatacttcaaggtatctaatttttacaccaaaaaaaatacttcgaggtaccaaaatttacactatgtgtagtatctcccggcattttttttaagatgataaaattaccctattccaaaaggcaactaatactaagaaaattagtctcaacatgatggatgatgttaacacaacaacggcaatttgatctttcagaaccaattggcagaaatcacttagtagcaagagggaatactgtatgatatcgactttgagctttagcaatcatactgttaggttaggtgatggaatagttcgtgttctgcatgctctgattttaaactcttatctttgtaccaaaagtccaacacgattagctcacctaacgcaaatccgtaggcgccaagaaattaaaacccttctctcccttttgctgtttcctgctgataccagtgctatatataagaaggctaagctctgttcattaagcagggagtaataaatcacccatcctgcttaattaccatctattcatcattatcctctcctctcttatgtgctaggtttaattttgtgtttttttttcatgttttgagtctgagtttaatttctggcttgtaagtcgaattttcttcttttcttcgtatgttttcagagtttcagtggttcgttaatttgctgatttaagttggcgctatttgtgagcacggccatggaggacagtgatggaaacaacgaaggctcgctcgccgaacctaaacatggcatttgctcatatgcatgcccttgatgatcacaatcgtactgtgcactgagtcctccatgctcttaaatttgtgctgtttcgttttagttgcctgttttatctgatggttagataaaagaagtccaaaaattcagacattcagtgctgtcttccgagtttttctcccgacagtgtttctccgtcctttgtctcgttttgtttttagtgaggattctgttggggctccttgattttttttttcggttttgctagtatttcacttgcgacagatttttatatttctatcttttactttttcgttcataggatctttatattaagatttgtgttcttgtatatctaacttgtagttatactcatttacagtgcacttatactcagttacatagcacttgcatcctgttacaattcaccaaaactagatttttacaatagttcttttctctaaatttatgatttttgacatatttgtctctcttttttgttattttatttaaaactagctatatccattagttgaaaattctgtaagatttgaagacataaatttgtcgaagtatcaataggtagtccttttttcagttatggattaaaaaccaacggcctctacatcctccaggttgggcctccttgatatgccttggaataatatctaaaacttatggtcaccttaatctgtagactgttcagaatcagaatgaacagttagaaggacctcaagtcatcgactaaaccatttggcaaggcaaggcaaggattctgccttcaggggacaaggattcttcagaattgttccaaaaaaaaagttgtaaaaggaaaagcaagaattctgaccagcaactgtttacgaccatcttaacaaaccgatgtggcacattgtgattgaatcttggatcgaggctggacttcccttcatcagttcatccattttgtggaaatttcagaattcagattctggagtaatgatcgtgatccgtacgttgtgatgtgcatggaaacagattttgaaggaactacgttgcttcgagaaattttcacgatcgctgaggctatgttggctcttggctctggtacgagtggacaagcccggaaaaatcttggataggaaccccgccgccctcaccgattgtgcactgttcgtggccgccatcaaggtaacagttggagatggacgaaaggcaaaattttgggaatccaactggataggagatcagccgttgaaatatctagccccaaaccttttcaagcactccaaaaggaagaacaaatcgactcttgaggcaataaccaataatgcttggatcgaagatatccgcggaaggtgacaatacagttgcttcaggaatatatatgtgtatgggaagtgctccacaatgcaggagatgtgatccatgaaggggctgatgacacaatcctccggcggtggtcagccagcggcatgtatacggcgaaatcagcatatgccatgcagttcatgggcaaaacgattttcggaatcagccgagcttgtatggaagacttgggcaccgggtaaacacaaattcttcgtgtggttgctggcaaaaaatagaatatggacgacggattgattgcaatgcaggggctggccaaataattacttttgccaactctgtgttcagaaatcttgaaatagtacggcacctcttcatggagtgccccttcacgcagcaggtatggcgggacattggtcgcaagatcaggctgtcacgtttcctcaatatgaccatagacgatactctcctcaattggtggcgcgagcaaacagatgaggcagaaaagttgcaacagaaaaggctgcgttcagtattcttggccacgctttgggagatttggatagaaagaaacaattgcatttttagaggcactgagtctacgccgccggcacttgctagcaagatcatagatgagcttcatttgtgggaaatggcaggcgccaagggagtgcaatgtattatgttaagagagtaggcttctatttttctaaagcgtgtagacaggaatagtcccttttatacatttttgttttcttacttcttctataatataaaaccagctcgctaggttctttaaaaaaaaaaaggattctgaaggaactcgtgtattctgccaaggcccggtatgagctgacgacgttgttgtatgcttgagattatttctctcaaaaacattatataagatgctattatgcccaaatattttcatgggccttgtctcaaaaatgctccaatttccagcatctgcttatacatacgaacaagtacattttttctatacttgctttgccccaaaccgtttctggatctgggaacgtgtccgtgtgcacacactatacatatcaactagtaataaatatcaccaaagatttaaaaaaaataaataaactgtacatgcacttttagtactattatctatttataagatcttgtaacgccctgcaaataattagagaaaaaagaaaaagaaaaagaagagaagagaagaaggaaaaagagcaaagctagctagcaggccagcccatgcagcccagtagctagctggcccagcagcaaaaggcagcccacagtagcatgcaagcagcagcgcagcaagcagagcagagagagcagagcagcagcgatgtactgtagcaaaaaataatcccacctcgccaattcaacctgagagggagaccagcttataacgatgagcagcccgaaatttttcgttaaagtgtggtccaactgaataagataatccgatactattttttgtcctggctcatcttcaattttattatatgtatatgtattttttctataattttcggtaataattatttagtgagcaagatgcatagacaaaaaaaatatgccatggcttctcttccaaccttacaaaaaatgaaaaaatcagtcttactaatgtctacatcctccataaaaaactatttttgaatttaaatctcgacatagtttaccaatgtttttattatagagggagtagttgtctactctacagtgacaagattagaatagataaacaaaatcagacccttacacaggacacaacgcaatcactgtctcactggtatctacagtaacaatggctgcaaagtcaagttgctcaatggaagtggtggggcaagatactaataccgaccatactgagaactccctccgtttcagacgttttaactttggtcaaagttaattttttaaaattttaactaaatttatagacaagtaatatttataatactaaattagtttcatcaataaataattgaatatattttcacaataaatttatcttgacttaaaaatgttactccctttgtcccataatataaaaacctagtatgggacgtgacattttctagttctataaatctggacatgctgcctgtccagatttgtaatactagtaaatatttaatgtaatcataagttcttatattttgggacagagagagtattattttttttcaacaaacttagttttagttaaatttaaagtagttcttataagctgaaacagagtgaatggataagtaatgatgtccacgtagtgcattgaacgtagggaaagctatccagtttccggaacagtacactgtacagttcccttcctcaacggcggagcaggattatgcatgataggagaggggggccagtcaagaaacaataaaaacaaaacacacgtataatattaatcacaagcgatggcttgtatagaaaattgagatacggtgtcattatatattgaccatacttattacttaaaccattgcgttatcctctatgtacaagcaatcagatttcgtcaaaattgtcaggatcacctgaccccgacatgttcattgcttgtgctagctgttgaatgctgatgcttgcaagatggtctaaactctgaatttgttgatggtttttaactatcaatttgatatattatgtcacgttttgcaaaatatccacaagtactgactgggtttcggactttcggttaggtacttgacgagcaggcataggtatatttgttccattttagacccggtaagcttgttaagacgtattcctattccaccgagacaatccagttcgttgccatctctactttagaccacttagtaaaaccagatcatttagtatatagaggatatctatatgttagaaggatatccgtgtaggatcaccgttcattccgcatccaatggcagcactggttcctagcttctcttcagtcgttcggcctagctcagagccaaccagggggaaacgtacgccgctacaagaaaccccgtcgttttgccgcaggattctgggccaaattacgacggaggagagggtaggaaactatgaattgatgctgtcgttgaatgctgggtaaacaacgatccggcacagatatcccctttgatgtagaaatcctcttcatcagaagacctggttccgattgagtaaaaatgggctctcacggttaacctttgcatagaccatagaaacatagcccttgttaaagtgcccgttaaacctttgcacagaccatagaacgcaggcacgcagcccatgattcaaacaaaaaaagtagattaagtagagtaattaagtatatccttttgttctagtacatcggagacggtgttcagtttggtgactacaaattaattaaagtagagtaacgaaatatccactgaatgtgcgcctgtgcgagtgcgacgaatgtacctaacagtcaatgctgttcctctatagttcgtctgaaaccagcgaattaatccgactaggcaacattgaactagtgctatcaaagatcagcgcagctgccgtgcgtggttctctcattggctggatcgatgttgaaatcagaaccaacggttttgaccggtttcttaaacagttaaacccgtacataaaatcggcgccaattcagcttgttttgtggaactgtgtgtttagttatcggcaaatagcacacgccaaattgccaactagctagctatctcgacaaattagagcctcatccaaaacgataggttggcgatgcgtgtcgtccaaaactaccttagtacgttaccgtacctataaatatgcatgcaatgctcgacgctttgctgcacacacatcgatcgctaatccatcaacctatagcttaacgatcactgccattgcaatggcgcggtgcactttgctcgttctcctcgtggcggcggcggtggcggtcgtcccgctcgccgccggccagccgtgggctacctgcggcgacggcacgtacgagcaggggagcgcctacgagaacaacctcctgaacctggccctcaccctccgcgacggcgcctcctcccaggagatcctcttctccacgggctccaacggcgccgccccgaacaccgtctacggcctcctcctctgccgcggcgacatctcccgcgccgcctgctacgactgcggcaccagcgtgtggagggacgccgggagcgcgtgccgccgcgccaaggacgtcgccctcgtctacaacgagtgctacgcccgcctctccgacaaggacgacttcctcgccgacaaggtggggccggggcagctgacgaccctcatgagcagcaccaacatcagcagcggcgccgacgtcgccgcctacgaccgcgcggtgacgcggctgctggcggccaccgcggagtacgcggcgggggacatcgcgaggaagctgttcgcgacggggcagcgggtgggcgccgacccggggttccccaacctgtacgcgacggcgcagtgcgcgttcgacatcacgctggaggcgtgccgcggctgcctcgagggcctcgtcgccaggtggtgggacacgttcccggcgaacgtcgacggcgccaggatcgccgggccgaggtgcctcctcaggtcggaggtgtacccgttctacaccggcgccccgatggtggtgctgcgtgagtaggcgctggccatgcgtgaagctagaataaaatggcacaaattaagagtgttccaccagaataaatgtattgtatactgaataaacctgcatgcaggatatctatctaagctgtaaccggattatactattgtactatcaaataaaaaaaagtgtctatatgattatatatcatcgttaaaaattatagcatattcttacgctcatggagtcaggatcgatcgatatatatatatatatatatatatatatatatatatatatatatacacacacacacacacacacacacacacacacgcttgaccaagacgtaaatctcgagctattaatatcaactaggtatcataagtaataagtaattggatcccgattgttcaagccttttataaccaaggttcgttaaagagaaatgaccacaatgagtcagactaaatagaattggatccataaatggatccaagttcaatccttttataactaaggtttgttaaaagagaaatgaccacaatgagtcagactcaacagaattggatccattcctaattgcgataattaggatactcttgatccctctcacaccctctttgaaggagagatgtttagtttccgacttacttcatgtattttataaactagtaatatatctgtctaacattatagcgatatttgttaatgccaataaaaaaaatcaaaagaaccaaaatttctttcttttgaggtcaagctgaggtgcctgctgatacatccctgaatgtgtacaagcatgggctgaacaggcggcctggtaaaaagaaaaaaagagcccgattcagcacgggtgaatgaattggaccggcctgctaaataatgaagccaataaaaaaaatggaacaagtctattttacctccctcatctcttgcccctgatcaaatcgtcccccttaactgcaaaaccagttataccacctcatctatcaaaattggtgcaaaactgggtataacatctccggtttttaatgtttgacacacttgattttaggtgtcttggatatacattggaccatttgtcttatttaattttattgtaaaaatataattcatagtaagaatatgtttaataataaaaatcatagtaaaacaaaaaagcacgagatttttgaaggagtaaaatgtatgggcggcccctaaacttgtaaggctatgtcatctaggtccccaaacttagaaaatacagttttgggtctctaaactcgcttagccgtacatcacctgtccaaattgcatttgagccagtctactcgccgacgtggactgccagcgtggaggggcggggacagctagggtgtcaaatatgcaaagaacccccctattccctcatcctagaaatcatatcgaatcccctgtccccattttttccccaccatgctgagcaacgaaatccctagcaagctcttgttcgattcactatccccttctttgattccctagtgacgctgtgacgacgtcaagatcaactagagctgcgtgcgattcgtcatgtcctaccatggctacagcaccaacaacaactccgtcggtgtgtggccgtcatcggcaaggtttacaataccgctggtaaccgcgcggttacagcggttaccggccttaccgtgggggtacggtaataaaaataccacggtaacctccttaaattcaaataaattaaaaaataatttaaatttttgataaattttacatagtttcgtatggtttttcacgattaccgcggtaaccatgcttaccgccggggcgcggtaaccccgggcccggcggtttgggaaaccctggtcgtcggatccaccaggagctcgacgacgccaagctcggcactgtcgcctagcccgagcgcaactacatgtcctacaactactgcgcaaatggctggtgtggttacatggaatcccgttgattaattgctcttaatacagctgagaataaaggcatcatcttttacatcaggttatttcttctctcctgttgtagagcattggtgtcttgcaagcattttgagtttacatgtgcaagttttttcattgagatggaaatggatgtgagttttggtattgggaggatcaatataaggagtatttgacaaatacaggacatctggctcttgcagcttctggtatccatgcaaaatgtccagctcctgttgtgcatgtgcagagaaatgaattggttgagctgggttcagacttcatagggacatgaacatgctgcagagcaacttgttaggactgaaatgtgtagtagcttgttgtgtatttgttgtggtgaccaagatgtgtactaccttcaggctagttgaaaatgtgcaattatctgaaatgtactgaaaatgatatttggcgaatgaaatgatgagggaatagattttttttttcatatttcacaccctagctgtccctgcccctccacgctggcagtccatgtcggcgagcgactaggtcaaatactatttggacaggtaatgtacggctaagcgagtttagggacccaaaaatgtgtcttctgagtttggggacctagatgacatatgtctataagtttagggcccgcccatatattatactctctttttttaaataaaacgaacgagaagttaacggcgttcaagcattaaaactagagagtaattcacttgccagacctgagattagtctggatggacatggaccgacaaaagcctacttctaaagatggtagtactaattatgggccgaactcgagtccaatgtggagttggacgcggctgggccggcagctaatctgggctttgggtttcgcatcccaggctgacacagcttccgccgcatccctcgctcggcccggacctaagctcgagccgacgttgcacgcgtgggagccgagcggggtccggctcgagcccgagccgagccgagctgagccgagcagagcagcgcgtggctaaacctagtcgtcctctcctcctctcctctccccgacacgagcgattcccatcgccccccaaatccccatccgattccaagccctaaacctcccgaatcggtcgaggcggtgctcgatccggccgctgcatctccggattcgagcggggggcgttgccgcggtgcccggatccggaggaatcgcgccgcggcgggttttctagggttccacaccgtcgcgcgtcccggcgggtgttcatgaaggccatggggtacaataacccctacgattccagcggtgagttgcgtcgggttaggaggatttttgtgctggtaggtttgggcgcgcgcggttaagccctctccaggatttgtagtttgtatgttttttttttgtttccgtcagattggttgtctgctgcgtccctgcctcgtttcgataacatgtgtctttttttttccttcaaaattattgcttcagtaatatcggttgattaggtgcgtaggtattgtaagaaaaaaaatgttttgttggcaggttattggttattatgaatttgtaattgaggcggtcaatgcagtgaaagacatttatttcatagttttactatgcattttatgaaccatggcctaagactctgccactatggatgaaagcctttgagacgaggttggcaatagttgcttctgaagtggatctgcttactgtgttctaataaagatggaccttttttttttttatctttctgatattatgtgaagttttaaggaaaccactgtttctgtttatgcgttcctgatcaactagagaaagatcctgctgccaaacccttggtgcagactgatgacatgacgtcggccagctctagattctggcttatcttgccaaattgtgaagcccaattgttgtgggcagttattgaaccctgtagttcacaaaatatttatgtcttttttctcatatagtgaatttcatggtatagtgacttgtctgttcattctatcaaaatttcagggactgacgacgatctccctccaacacaaaatagaggattaagagtgcgatcttttagtgcgaatggcagggcatctgttatgccattttcttacattaggccgcacggtgatttggagagtgaaatacatcaggttgagcaagaggcgtacactggtgttcttagagcatttaaagtgcaatctgatgctatatcctgggtatgtatgtataaaaaaaagaatcttgtgctaacagttttagtagccattctttgcacatgccttttttgtgttgagaataaaaaatgtatattttttgtccaggaaaaagaaagtttgatcactgaactcaggaaagaattaagagtctctgatgatgaacacagggaactattaaacaaagttaatgaagatgtggccatccgcagaatgaggtcttcatacaatcattcaatttttgttcatgcacatgtttaaaccaaccattttattttttcgttagtaatttatttatccttcgcaatattttgcagggagtttagacagggaggtggatccctgagtgcacagcatcgtggcagcagaatttttcatgatacagaacctggcccagctgcaaagaggcaaaggacacccctttctattccttcacattctgctggcctccagtcccctgcgatgccttctccctcagttccttcatctacaaagtggggaccattttcaggaacaaagggcaagaagactaggacggtgtgttttgaatacgacaagtcatgtttgttgcattcccatagtagtaatatcatgagttctttttttatgcattacagaatacaccactcgctgtgccatccgcggatccaacttcattgattaaccggaaaatttatacaagatggccagatgacaataacttctatgaggccactataactgactataatcctgctacggtttgttgtttaatttcactattatttttgctacttgctgcagatttgcatttttgtcaagtaagcgaagcttatggacacccctgatacttttcagggtaaacatgctctcgtctatgacatgggcacagtagcccagacttgggagtcagtcagacttagtgatgtaagcagtattttcaaccattgccttgtttctatctgtagatgtttttttactaatccataataaagtttttctttcttgatctgtggccgtgggatattcatatttttatgttacatttgatttgttgcaatgacaaactagtgactgtctgctcgcgtgcccaataacatagaaattaaacaggaaacatttttctgttgctgcagatttattgtcataattacgttgatagtagttctgcaggaaattacaatagtttagatggcctaccaaaactatgtgataccttctaagtaactcccctggagcaacttggaatatgatcttagtatcttaccactgcagctgatgatgcggcaattattcaacaaattgagggtcatgggggttaagtagaagctagataagatttgggagagtaaaaactagataggactttggaattgagcagcatggctagtgcctgagtagtcatggaactggatgtaaaagagggtttttatgacaccttacacccattttgcgatgagtttgtattttttgttcgcggagtcattaccatgtgatgggccacattatttgccttggtggcaagaccaccgtcagggccgccttgaggagatgtttagatacgttatttttttcaagtatagtgggttttaatgttttgtcaggtgggacagttttagaagtcaaaatgtatttttttcctaaattttagaacctttggttatctaggtttctgaagctgaactgtagtgtaaccggtaggagtactaaaatttagttagttattagagtatagagtttgttgaatagcatgtcatctgttataaatttattaagttttacttgtttttagctagaacatgaaaattgttgaatcgtcctggctaattgccactgtttgtttaacatttaatcaaaagaagatgataaatcatttctcagttggcacctgaagatataatatgggaccttgatgatcaaggcatctcaaatcgagatggttggggtcctcatcctgggatgaggaggcacccaggcaacaacggtacaatggcaatggcaagtaggggaggaggaaggttttctcgaaatgagcctactaaggatagtgctcctccccaaaatggaattaacaggaatattggtcacattgatgtacctaacactcgaagtgttgtcatagaggtaaattatctcatgagatcagatattatgcattcagatattggttttttacctcactattgtatgttccaacccaggtggagagggttttgtccaatccaaatatgggtgagatcgaaaaggccaagaaacttttgcaagtgagttggcttgtctgttgttatgcaattttctacagaattatgtatgatggagaaaagctccttatagatatccttcgtctgagagttgtgaggtcaaatggttgtccttgtaggaccaggagcagtcattactcgatgctatagccagacttgacgatgcatcagatagtgaaagtggtaagttactggcagactctacttgcactgttaaatagtatctttgaagggtgatgagtattagccacattagtatatttggtttttttatacacaacccaataattagaaagagtgaaacctggaacttcaaattctgcccaaacattgagaaattttggatgtgactcagtatgttttgattgaaaatttgtcagtctttcaaatttgtttcagctacttctcttcagctattattctaactagtcattgtatattacagaagatatggccgtcggggcccaaatggtttctgctggtgatcacatgggcaggaacggcgttgcttgttagtaacaactggcaaagtgttggattttgaggattgtgtttgtgaaagcgcctgtgtagatcaccggtcaaaagaaatcatcgatggggcattggcatgccaaaaatggatgtactgaacatgtccctgagaagggcctcttcttaggctgcgaaaagttcaggtcacaaggcgcagggcgcctttccttcaatgataacggtggctgtatttgccctctaacatacttgaaggaactctaatcatctagaaatgattattaacattccaaaactgttaaaccctttgccaccatctccaatctgtctttgatgattaatcaaacgctccgatctgtcttcgatgatatcttgtgtggtgccggcttccctgccctcgacacgggcacgacacgccgcaattctcgtcggatctcgattctcaccgccggacggccggtcaggatggagagctccagggcgtccagcatcacacataaaaaacatgcagtttgagatgtggttgctctgccataaactctgcaatctgaatctggttcggccatgtagaacagcatggattctctacttctcttccaacccaccaaactgcagagatacataatgctgtcactgtctcactgatgtctacagtaataacaagaatggctacaaagtcaaacttagctcaccggaagtggaggatacaaacaaataaatagaggagtaatatccacgtacattgaacctagggaaacgatccagtctcccgtagcaatacaacacgaccatcaaatccagggtcaaaagcaacgaactatggtgatcggtcaccagcaaacttattgttaacctaaggcatactcacccttcagcttacttcagccatcagaatacacgtatcctactccgagtttctctccatttaaccccgtgagatttgaattaaaacatgtatacatggtggtacacaactacattgggtaacttttaccagttgttttttaagcatatccactactcccttgcccatgcaagaagcgcacgacaacacaagttatgttgtcactgctctccctcttgtaggcctcttgcaagagcttctttgcagcttcttctgggtcatgaatcgatctggtcatgtcgacagcctcctgcataagagcaaatgcaaaagggggctacatcaagcacaaggaatacgattaagatacataaaaatcttctcttttcattttcttgaatttacctcattggttactacatcccacagcccatcacttgcaagaatgaggaactcgagagagtgatcaataacttcctcctatgacccacaaaagcattactgaacaaggtcatcatttgtgaaaggtgaatataaaggatgattattctgaagcctaaaaaattaacaacatatattaggaaatggttcttcaggtcgactaagaagctggcagtagaacagatcagaagtgcagctgtaagacattgataacaaaaaggccaaaaatgaaacaatgctgaagacaaaatatgtccctggtcgtttatcataccgccctattagttttgctatggaatatctggaagtgcctcaacaacaaagttttcagcaactacgacaagacgctgtgcggaagacctccagtggtcccatcgcagcacaaatagttttagctggcaatgtatactagattgggggaacaaatttctcgcactttgtaatatataggaccctttagcttccactcaggccctcatcccccgtacctcttcacaatatgtatgtaacttggtacaaattttgatcaataaaatgttcaggctggtagaaagccatccttaatttttccttcgaaaatttatgccacaaatatcccctcaataagtatatcatgattaagatggcaactactatcaatatcactcttgacattcaatccaatgacacaagggaatcatgattccaaacgttcacctactgtcatggtgatacctacatatgcattttgagaggtaagtagacataacaaacattaaattggtcaggattgcatacccgaatctcaggatccacaactacatactgctttaagagtttgtcaccaaaagcgcgagaaacagcaagcacaccaccaacacgccatgttcctaaggaacaaaataccatcattaggaacacgatcatagtccattcatatacaaaataagataatgtagtgcttagcacctgcccacattacaaaacctccagcatcttcgatacgttgtcgctcatctgtctgatcaggcttgtgatcttttgaaacagctatagctgcaaaaaaccagcagagcttctatgtgaagaactgataaattatcacagataacctacagattatttctcatggcactcatttcatcaccaacaaatcttgattctcatgcctggtacaatgcagatgctcagtggtaaatacaacattctaacaaaacaagcaaaaatattcgtaccttaagagaggtctctattaataatagaatatgccaaacataatcggctctcttgaatttttaagcataccataaaaaagaaaaaaaataatgtgtcatgctatataaagtcagaaagtatcaagtaaatgcaaccaggaagctgaagagatggtacagtgaactgtcaattaccatttccccccctgcatatgatagccctagagtctccaacgtttgcaacaaagagacggtcaccaacaaggacagcggttgatgcagttgatccacactggttttgactgctgtcagattctaagaattcactgtcggtacttttataagcatcatctacagcaaacaatatcacgtggtagttctgtcaattctatacacaaaactcaacatctagtgaattatggaaagagaacaaaccaatacctattgccactttggtgtcactgatgaactttggatgccttagaagatgactgaagagattctgtttaacatactcagctactttagcaccaccatgacctataaaatgaactgtatgtttagcatttatttttcctaaaataagctcaagagcttggtatatccacacttctagttcaatttaaagcattgtgccctagtatgagtaatctttaaaactttctccatggacttctcaccgtcatactagctctaactgcggaaataagaaatgttacaaggcaaatgaattattttgagcttttttatactatacaagattagcaaaggaaacataaatggtatgttcttttggtacaaaagagaaaggtctaaaacttggaagagtgtaatcttagaaatgttcctttctaaaatgataaagaattatcaatgggtagagattatgcacgaatgtgacaaattcatacataccatcaaaaactccaaaaagaccaataatctgcccatcaacagagtcaattcttgtctcgtaaaagtcttccatggaagcccttttaccaggggagctcgcatacccatagctaaacttaccattctggctggcaaaaaaagaatgagaaatgttgagcaaataggagagcaacagtcctaataactgcatttacaccataaaatcaagctaccatgacaacgttgattaattggaaatagaatattattcataaagtcactactcctaaacttccagacgcagccagattgcaggcactacaattattacagttcactggttcaaaaagctagaaccggttgtgttgtgtggtgagctacaacaacatgacctattgtatatgctgttactgaaagaactaacatggcatgatgcaagatgtcatattcatagaaaatgcatttgagaaatgagggagacgaacttccagcttgcaactaacagtaccaaatgcccaaaccgtgcattactcattagtttccttgatctcaacccatagaatgtataagcacatctaaggtggcctcttaccttttgctatcatgcccattaggacgtgctacacttaataattctccaacgtaacatcacataagttcattttagtctgtattcagaataaccgtccaaatttattcgacgcaactgcttatgctcagatcaggtatgtagcatatgaatatcctacttaaacggacaacataactccaaactggatttatcttgtttatagtcccaccaaaaagtactaataaaacaaacaaaaatgggattgcatagcttatcccatactccagccttgcttttgagcttaaacagcgtgttcaaagcaaaggaaacccacgcgagcagttatacgaaattcgtgcgatgcagcaagcaacgtatcacacgcctggaccgtactgaattgattagaactaaacattcagccattatctactagttgccagattatccattatctaaaacaaaaactgctagtcgccagagctaagctagacaatcgaattgactagatggagtactccaaaaaaaaaacccagaattcgggtaaagcaaacacgaatcagacccaaaaaaaaaagcgcaaaaagaggacaggagaggcgtcccgagaatcaatcgctcccacctgaggccgccgccgctgaccggcgatccatccgtggggatcacggagctcaagtaccccatatcccccccctagatcacacgaacgcgaacgcgaccagctcgtccgaatcccagcagcagcagcagcagcagcagggggaagcgcgccccacgaatcgggcccctcgcgcgagtcaaatttggcggatttgggtttgggaggagcggaggaggggaagggggcgacgggattgggccattttctagtggaagcttctcttgcttcgtcgggggagggtgatgggtgtttttgcacccaggtccttggtgttccgcgtatttgcacccgatagagggtgagggagtgtttatatccatggatgtaaagttttggcgtgtcacatcgaatacacacgcacacaagtattaaatataaattaataacaaaataaattataaattccacatgtaaactgtaagacgaatttattaagtataattaatctgtcattaataatatttaagcaccatattaccaaatcatagaataattaggtttaaaagattcatctcataatttagacacaatatgtgtaattagttatttttttatatatttactaatattttattaaatatttgatgtgatttggtgaaaatttttgccagcgatgtatacgggccctgagatgccgtgccgtggcgtggctatgcgaaaagcgcgaggtcgagggggtgaggggcttttttttttttaagtgagctaacatggctcgtcgtggttttctgcgggatccttcgagaacatcgatgatggatcaccgtcctccccgtgtggtggcgccactggattcgtgcgttgcgtgcatgtccgctagttcatttatcccctgccgccccgtactagtgactagcgtaccgtattgtttaacttcgacatcgagttgcggaggctcacgctcagaaattcaacaatggtgtactcaatgatggggtattttcgatcatcatctgtatctggttaggaaaaagagcagatgatggagtactacgtaagctcttttggttgaagcctttgtcaaccttgtcaaaataattgataatgctcatgggttttgggttgagtaaatagaacatgtcgcaaatccaaaatctataacagatcaaagaacagtgcaataagtattatttggaaaaatagcatgtgtaaaatccttttgaatatagaagtagcggagaattagtacgtaatatatacaaaatccttttgaatatagaagtagcggagaattagtacgtaatatatacaaaatccttttgaatatagatatacaaacagtaatgcaaactgaaatgaaatactctctctagcaaacattcagactggccgtctcggtggattcgaagtgatggtctcaactctcatctctgctacgtgctactcctaccttcatcctagaatattgctatctaggatgagcaaaattcctagatagcaatactgctaactgctgtgtaaatgtaatactgaactgtattcacagacttgtttgaatgtttcttggcacgcgtctgtaggatcgagatatcgactagaggggggtgaataggcgatttaaaactaaataacacctaatcaaaactaacctaaattgctaggcttggtaagggtgaactctaactaagcaactaagttatgttttgtaaacctagggtgatagtggttcaattatatctcaaggaaagtaaatcacactcctatgtcaaagttttgcaatcctaggatgatatgatctcaagtatgtctctagaaaagtaaattgcacaaatgtaaatgcgacaatcaaataagacaaggagacaagagatttttcaccgaggttcggaaactcgccggtttcctactccccgttgagacgagcccaactccaccgctcaaccacgaagccaccgcacgcccccttcgtcaaggggtgggcaaggcgggagccggcccacggagaggactacccaagcctcgatcactcggggtagttcttccttcactccgaaggtggtgaactccaacccactcacaaaccggcgccgggcctcctccacaatcttctcggagaggtcatcgggcaactcctccacaagccgtctaggaggcggcaacctccaagagtaacaagcaatgacccggcgtggagatgatcaagtgccacactagctctacaatggaagcaaatgcacttgactcttggctaaacaatcctctaacacactagatggatgaacacaaagctcaagtgagtgtgagaaaggtgcatggggtgtatgcaattgaattgggtgccaagagagcccccttgctgctggtgggggagtatttatactcccacccaccaaaactagccgttgggggcgaaatcccctaactctgtgctctgccggtctgaccggaggtatgtggccggtcagaccgtgctactctgcaacggctagaaaactagccgttgtagccctgtcaaagggccccatcggcctggccggtcagaccgacatggggtagccggtcagaccggcctcggctcggtcagaccgccatcggctcggtctgaccgaatacggctccgtcggctctgtatcggccatcccgagcagcaccatcccggcctccagggggccggtctgaccgcgcatgtgccgccggtcagaccagccttacgcgtcggtcagaccgccttcttgcggccggtcagaccggccagggcacgccggtcagaccgccactaccctgtgaagtcccctactatgtggccggtctgaccgcccctggtcagcccgaacccagtgaagtgtgtatgtgtgtgaaatgtgagcacaagtctaaatgcataatgacctaatgtggcaattaaaattatctctttgctaggtcattacccctcttaatagtacggcgaaactaaaaataaactagcaaatttgatcgccctacacctcgatcaattctaaattaaagcgctagttttaccgtcttctttccctttgctttgcgacgtcaattttaatccatcgataatcatccatgcgcacattcgacgtggacctaacttaaaatgtatagctcaaagacaacggttagtccacaattagcgcttgtcattaattaccaaaattaacaccgggggcctagatgcttcagcgtcccacccgtactccctctgtcccaaaaaagacaaaccctgggtttctatatctaacgtttgaccgtccgtcttatttgaaaaaaatatgaaaaaaaataaaaagacaaatcacgcataaaataataattatgttttatcatctaacaacaatgaaaatactaattataaaaaaaattcatataagacggacagaaacgtaaattcaaggtttttttttattttttttatacggaaggaataggtgacacggcacgacaaactcgacgacgcagaaggccgtgagaaggggcggcatgcagcgccgtatacttgtttgtcagggtcaatatgccggacaccctgttgcgccgtaacgcttcaaggcgaaaaggagacgtatgcagccaagcaccgcctcgaattaaacgagccggccggccgacacgtacgtcgtaccgcgcgcgccacccccctagcttgggtcgtgatgatcctccaactccggccgaaaatcaacgccgccgatttcgctgtggcgacgcatgcaccaacgcgtgggtcgccgatggcggacgtcgttattacgtacaccgtcggctccgatcacgtacgccgaggtgacacgcaccggacgatgaggctgccgtgttgctcatatcatcagccggtgtctctctggccggtaatctggtggagctctcgctgtcggcgccatcaatcgtacgtgtggacagccgcgtgcagggggacaccggacacggtcacacggggttcgcggcttcgcgcacgaacactgaactagcttctcacatcagccttcgcactgttcacaaagctaagttcgttttcctggtaggctgatagaaaccttgtcgatgtcaagacgtacaccaattaatctgatgatgcgatacaaagcggttcacggtgccgagccgactcgttttcatgcctcacctcatgtacgttgtgcgcagtactccctccatttcaaattgatctacatatttcatagatacaccaagaccaaaaaaactaataactctctcataccatatttactctagcaacaaactcaatgtatacaccatccccactattttctagccaattgcaaatcaagatattgcatgtgggttataaatacttgtgtgcatggatagatgcatcaatgtccatttatttcaatgcacaaataacgaatagacttaataaataaattcaaatatgtaaatcatttaaaaataacctcaaaaatactatatgtagatcaatttgaaatggatggagtaataacaaaaaaaatatatatactacgtattacgtcaacgtgacaaaggttgtgcgcgacgtgggcaatgaacgtgacagagcctatgcagagaaagaaaaggagcccgttaattaatttctctatatgaaatctgatccgtatttatactaggaatatatatatcttactactatgtcttggcgacgtttccgcttttccgtttctgcatgcatgtaatgcacctttacgatctccatcaggctatttttcccttaccgatatcgaaacgatcgacgaccggccaggggcggctaaaaccctaattaacgcgactataccagcggcgagatgggttgctgcttctcggtgatcgacgacgacggctacgagcacgacgacgccgtgtcgggctcggtgaacgaggtgccgagggtgaccggcgtgcaccagttcacgatccggcagtacagcggcgtcaagggcaagggcgtcggcaattccgtcctctcccggaacttcaccgtcgccggccgcgagtggttcgtccgcttctaccccgacggctacaacagcgacacgtccgaccacgtcgccttcttcctccagtccctctaccggccatcgtgcggctccgtgtaccacgtcgagttctccttcgcgctgctcggcggcggcggcggcggcggcgccgtactccacgacgtgcggatcgatcgcccgtgcaggttcgacaaccgcaacaactcgtggggcatccgcaagtacatcgcccgggagcagctggagggcgccgccctgggcgccatccacgacgacgcgctgacggtgcgctgcaccatgcacgtcatccagcgccgccgcggcgccggccggcccgtcgtcaccggcgccggcggccccgtccgcgtgcccgtgccgccgtcgtgccacgccaggaacgccatggagttcctcctcagcggcgacgccccgttcgacctggagatccacgtcggcgacgcgacgttcggggcgcaccgcctcgcgctcgccggccagtcgctctacttccggaagctcctctacggccaggtcgggaacgaggcgagctcgccggcgatccgcctccgggagatgagcccggaggcgttcggcgccgtgctccactacgtctaccacgacagcctgccgccggaggcgaacaagggccggaacgcggctgccatggcgcgggaggtgttcgaggccgccgacatgtacgccatggagaggctgaagctgatgtgcgcgagcaacctgtgccgcttcatcggcgacgacaccgcgagcggcatcatggagttggcaaaagcgcactcgtgcgatccgctcaagaaagcgtgcgaaaattacatgaaacgcagaaggattccattcaaccctgatagctgaactaagcacccactagatagctcccattgccttggggaaagttttgcaggcaggttctggtctggtgccacgaactgattatcaagaagaaaaattgactctgtttaagcattgttctgtatatacctgtctttctttatttttccaccattgacagagtgattatatatgttctgttaccagtttatatgactagtaagctaaataggggaatctaaaattatatgattttgaatccagaatgaacaaaaatggtattgcagtcaacgagaaataccgggaggtatcactttttaatgtaaaatttagtaccctgatatgggaaactattaactcttaaggggttatcctttcgctagttgcatgttaatatgtgataaatcactccacaaacatgcaagctcaaatttaatttacatatgttacaacagattataaatttgagtgcgaatatatgttaagccatagtttaatttgttttttcgttgcaacctgtaaaagttaaattttaacttgcatgtttgttaagtgatttatcccatacctattaatctatcttgttaaattttttatagccatttggatgacatgcaaacaacgagggaatgtccaccgagccactattggtacctcaaattactaagaggtattaaaagttacaccataaatttttacattagaagatacggttttatatgtcaaaatatcaagaggtatcaacatttatatcagaatttcttacagtagaaaatatcgtacctttaggtactccatccatcccagaatataatgaattttggacagatgggacacttcctagtactacgaacgtgcaaaaggattgcacgtcaatatattaaaaacaaaagagtttttgttacacacacaaacggccagacatgcctatgtcatggggaaagaaaaggaaaaatcagagctgcaactggtgaaagaaagggaaactaccaaaaaaaaaagagagggcggtagcggagccacactacacttccaagaaaccctccaaaattagcaatgcctttagattcgtagtacttaaaaaaatgtgttttagatggaggaaatattttcttaaaaattgttaatttatctgtccaatatgtatgtcaggtttctctgtatagtatatagtgagcattttttctctagtttctttgcaataatgagcatgtcacaacataaatagcggatgtccagagaggagcatatcccgaattatcaaaaaccgtctacccctctgtcaaaaaaaaaagtccaatcctagttacgaatctcgtgcctaagctcatagctagagtttacctttttttaacagactagtatcacataattctcatgtaggcaccacatgtatcattgtaccatactatattttcacatatatcaaagaaccaatctatataggcaaataataataatctcgaggaaataaacaaagaaaaaggccgcaaatcactaccacgtagaagtaccaaccacctcatcgtcatcggaaaggagatttgctcccagcctgtttttatgcccagagatgtgaagacatcatatatgaacacaaaaaaagaaaccctgatcttctacaccgtggctttattcagccctcgtaacccgtatacagaaaaaagttgtcaaagcagctgacaagaagaggtgccgttgaccccacccgtaatccatgaaaacgagcccagtgacttgtaagcaagcaatgttcaattcatccacgaaaaaagcaacatgcgcattgaaaatgatccataaccgtgccgctaattcccagtcagtcactgtcaaaatgtttgtggtatattgtgcatcctttctaatcaacataaatttttggttggctaggtttggtattaaacctgtgactcgattataacataatactactacagtactactcccttcattttttaatagatgacaccgttaattttttctcacatgtttgaccattcatcttattcaaaaaatttacataattataatttattttgttatgagttgttttatcactcatagtcttttaagtgtggtttatatcttatatatttgtataaaattttttgaataagacgaatggtcaaacatgtaagaaaaagtcaacaacatcacctattaaaaaacggaggtagtactaatatgcagtttagaggccttggcaaactacaggcgctcctagaaaccgacaattttgacgtgtgttcttgtagtacatacaggctgtgctgcagttggatttgtcaggaggctactatacaatgattcaacgaacatgagcagcagcctcgtctgctcgtgccattttgtacttaaaacaaggcgcgattccggctgtcgatacggcagagttatcccccaagtttctttatccaaatcactcaccaatccagtgacaacgctagcttaattggttagtggactagtatatagtagtactgtatagctctcgcgtgttcactcctcagtcctccctgtagtccaacgagtcaaatttgaaggcttcactgagcctttgacaatggcgccgcagctgccgctcgaggtggcctctgctcccaagctcgacgacgacggccacccacaacgcaccggtacgctctctgtcgccgagatttgttcgatctgtttggttcatcgacgagaattcaggcatgccggcaagtagtaaggtgctcttgagctcttctcttctaattttccttgtcttcttcttcttcgatgaactttcagggaatctatggacgtgcgtagcgcacattatcaccgcggtgatcgggtgcggcgtgctggcgctgtcgtggagcgtcgcgcagctcggctgggtggccggccccatcgccatggtgtgcttcgccttcgtcacctacatctcggccttcctgctgtcgcactgctacaggtctcctggctcggagaagatgcagaggaactactcctacatggacgccgtcagagttcacttaggtaattaagtaccttgattaatcctacttcagctaagttagttagccaatcttttcctcaggaagtccaattggtcaaatatagataccacttttggattgtatattgggtagcagtaaattaatggtatggtttttgtggcaacttggcaatatgtttagggaggaagcacacttggttatgtgggttgctgcagtacctgaacttgtacgggataggaattgcttacacaatcactacggcaacttgtatgaggtgaattttacagtttttttttcatacagatcttcaagtagaagattaaactgttgtttgttcaacctgtgcttaattaacttgttcccgttgacagggcaattaagagggcgaactgctaccacagcgaaggccgtgacgctccctgcgactcgaacggtgaacacttctacatgctgctcttcggagcagcccagctgctgctgtccttcatacccaatttccacaagatggcgtggctgtccgtcgtcgcggcgatcatgtccttcgcctactccaccatcggcctcggcctcggcctcgccaagaccattggtatagtagcttgattgttccatttgattgatgccgatgtcacaattcagcagtgcttaattaattagccggaaactgtgtaaatcttggtgcatttgcttcgtgtcaggtgatggaactgtcaaagggaacattgccggtgttgcgatggccaccccaatgcagaaagtttggcgagtggctcaagcaattggcgacatcgcattcgcctacccgtacaccatcgttctcctggagatacaggtgcgcacggccaatttcagaacacgaaaagcagacatttttttggacactttttagctgaaattagtcaagattcatctgaactgagactgatggaccgaacaggacacgctgagatcgccaccgccggagagcgagacgatgcagaagggcaacgtgatcgcggtcctcgccaccaccttcttctacctctgcgtcggctgcttcggctactccgccttcggcaacgccgcgccgggcaacctcctcaccggcttcggcttctacgagccctactggctcatagacttcgccaatgcctgcatcgtgctccacctcctcggcggctaccaggtgaagctgcgactcaaacttctccaaaatcgcattgcttttctctgaaaaaactatcctgatcgaatcctgcatgaactcgatgcatcagatgtttagccagcagatattcacgttcgccgaccggtgcttcgcggcgagcttcccgaacagcgcgttcgtgaacaggtcgtactccgtcaagatcctcccgtggcggcgcggcggcggcggcggcggcgcggggaggtacgaggtgaacctgcagcgggtgtgcttcaggacggtgtacgtggcgagcacgacggggctggcgctggtgttcccctacttcaacgaggtgctgggcgtgctcggcgcgctcgtgttctggccgctcgccatctacctccccgtcgagatgtactgcgtgcagcggcggatctcgccgtggacgccgcggtgggccgcgctgcaggcgttcagcgtcgtctgcttcgtcgtcggcacgttcgcgttcgtcggctcggtggaaggcgtcatcagaaagaggcttggctagctagctagctagtagcgagtaatttagcctggtcatcgagaacgaaatgtaaagctagctcagtgtgccatttcatctgaagtaaaaaggcgcggtgaactgtacaatacatatgcagaaaaaatgataaacataagatgttggttattacttcctcggtttctaaatatttgacgccattgattttttaaacatgtttgaccattcgtcttattaaaaaaattaagtaattattaattcttttcatattatttgatttattgttaaacaaactttcatgtatacatatagttttacatatttcgcaatttttttaataagacgaacgatcaaatatgtgctatgtcaaacatttagaaacagatggggtgccaaagtatcagctactcagaaattctgacaaataatgatagctgtttgttactgtcccttccgtttatacccatttcatatttcatattgtaagtcgcttaattttttaagttatttttttaagtttgaccaaagtcaaagtattatctaccgctttgaaaatatgtaggggctaaattcgatcgatgtactcatgcacgcacgtggaaaacacacacaattatagttgtgaacgcctactctctctggtttttaacgtttgacgcgcttgatttttggtgtcttcgatatatgtcttattaattttattttaaaaatacaaaaatataagtcatggtaggagtatatttaacaataaaaaattatagtaaaacaaaaaaacatgaactttttaaaataaaaagaactagaggttaacggcgttcaagcattaaaactagagagtaacacttgccagacctgaggtggtactaatcatgggccgaactcgagtccaatgtggagttggactccgattatagacgtcgacgcggctgggccggcagctaatccggtctttggggccccatgtatataacgtcgtaacagaaagggagacagattccgtgtccggtttcacatcccatcccacgctgtcgacacagcttccgccgcatccctcccctcgccgtcgcaaaatcccccccgccgctcgcgccgccgccgccgagagcgagacccgcacgaggagccaagcatctctgcgttctacagctccgggccaccggcgatgaagctcgtctaccgcaacctcgcccgcaacggccccggctccgtcaaggtgtgaaccctcccctcccctccccatctcgctctccgtttgatcgcttgcactaggtctagtgttgtttgggtttgggggtacggtggtgatccccttttgtgggggttgtgtggttcgtgtgctgattggatgacttagatcgatttattgtgaaagcgcagctggtgccggaggaggaggacgacctgtggcatgcctacaaccttattgttccgggggataccctccagtccgtcactgtgaggtgagttcctccgttttatgtagtgattgtgtagtgttggttcagttagtaaccagagtaatttatttcggtttagcaattttgagctgttaatttcgaactatcctcgatgtcctagtcctaccctggtagaggaattagggcacttagatttaggccgagtttagttccaaactttttcttcaaacttccaacttttccgtcacatcgttccaatttcaaccaaacttccaattttggcgtaaacttagggaaggcatggttcactacgtgataaatagtttttggctcttggactgggacttaagaattgggattgcgggaagaaaaggaagtgctggaattagtgttactgtttcgtttactttaaacatccattttattaaaaaaactaaacctaacaatttctcaatgccattatgcttttatgtgattatagaaaaattagatatgtaaaattacttgaaaggctttgatcatactcatacttcaaccttggtggtaatgtagtttgtgttacttgaagattctgtcccctttattcttgtgaacttctatgtttctccatcaaaatatatctagatccttcagtgcacagtgagaactcataatccccttaaacatatttttatcctgttgattcccaggaaagttctgagagagatggcatctggaggacgtgatgctgagcgtgtgaggttaaagttggaaattgtagtcgaggtgatatatcatctgtcttccttctatctgcactgagtgcttatactagtgattacagtcagatgtaacctatgtggattgcaacctgtgaatttgagacttgagtggcactgtcattgtttgattatttgggaagagagcctagtttacctacacaatgcgtgaactggaaagagattgacaatctaacaaaccgcaaaggctgtacaatgggtgacctaaacataatattattggagtgaaattctgtactttttaaatgcaaaatttctgcctctgccttagaaaaataataatttagagttgcataatggagtaatgggaccccccaagtcaagcaacaagcatcgtcacttaagcatttgaattacttagagctaagtggcaccacagccgaagaggtcgagaaatctatttctccttgcatactaaaaaataatgctgtctttagttttttagccagtgatgctcttattagttttgttccttattgtttccaaatcaaaacttacctattttcttgatgataactgacatgctcctttgttttgcacatagtctgtagattatgataaggagggatctgtcttgcgtgtacgtggaaaaaatataactgagaacgatcatgtgaagattggacagtttcatactgtggagcttgagctgaagagacaatttactttgacgaaggtatgccctaaaatttgatcaaactgcctttacctgtttactaggggaccacattatagtcttcagctaatgatggataggattgtcttaaacactacactaatggttcaaaatttggatatgattctaaatggttaaaatatggcaccaatatccggcacattccaagctgatgtgggatttgttaagccttacctgaaaagtgtggttattcatcgatggtttaaggtgatttagcatgttaacccagcccagcccaaagaagtacggtttagatggtctggtttcacgggttaaactgtttcctcaacaagagaaagaagcagatcaagagtccttcgggcagaggagctagaaatggccatggcattcctttcctgtgaagcacagcagagcacacaaagattgtgacaggccactggacgcagccacgtccacgagttgctgttgaacatgcaagggacgccccgactacagaggtgcagccatcgagcgcgcgatgtatcgtcgcatgtgaggggaagtcgccttcgagtgtgagatgacgcggccacggtgaaggcccatcgaggggttggggtcatggccactattgggacttgtcaattgtgtggggatgtggccgtggctctggagaactcgtcgcttgtgggggacattgccatcggggacatcggtgggggacatggcctctgtgaaggtctttgccggtgggtggacacggccaccgcttgagattgcaaagatggctctgcctgcgtgcgaggacgaggtcctgaagaagatgaaggagtcatagtgtttgatggattgtggaggaaacccaacctacctatatatacaagagattaactggtttcagttggtttggtttggtatgttcatcggtttgagcccaacctgtgaacaggcctacctgagagtgctacaaacagggtgctttgagctagtagatttttaatagataaactttctatcccatttgcagcttgccctttttttaactgaacctataagtgaaataggatatgcaggcatctgtgcacatgcttttttatttactgtcatatatcttgaacaactaggttggccaaatttggttcatttcttttaatagcacttgacaatgggacctttccttagctttgcaatatttatattatacaaatacccctttgcaattaaacattactatggactcagttatataaaaaaacttggcactttcatcagactgctatccttttctttccctaattttcttaatgaatcttgcacttgcatatgagttttttttgtccctgcccatggaacttgtatcttttccagcctctggtaattcatagtgtctacgatgactacttaggagttggaaagcataacgattattgacataatatagtttccttctttcagtggctgatgataatgttccccaactattctcagatacatatcgttgttgaaaattttatcaccattgtttatttttgtaaattgtggtagtccatttagaatgtaccttcttttggtctgttgtagcttacctgaggagagattgctatttctacttttgcaggaactttgggattggttagctcttgataccatccaacaagcatgtggtatgtgagaactgaaatgttactatcttctaattctgtacattccatctgtcttttcctgtcttattgctcttatattctatgatggattgatctgaatggttacatggttatcacattaggaatgctacctgtacctcaaattttagcctgctaatgcttgatatgcccattcatctagattacttaagccactgggaaaaaaacatgtggttgttttttttcagtcctgatgaattatccaacaaagttggcactatgttgattgtacaatgatacttagttactcactgaaactcataatctgttttttttttctggagaatttgtgggaagaggcctaagcttacaaataggaccttaagtttagcaggaaagcccatccgggtcctgcctgttaggagggcctaaatatctcgaagtattaaccctaatttcaagctgtcttccaaccataataatcagtataaactgattgcacatatctccattttttctgccatcacctctgagatattttgattatcagagattttgaacatattgctccccttcttatgaatagattttaatgcagagaaactcactcataaatagagtatctcttttctttcaaacctgatgtgccattatgtccagtgtttatatattgtttgcgttccatcttctgctctgcaaaattattggtatggttgtaccgcggataccaggagtgcttgacaacctttgcaaacttgttactttgacctattaatgagaactattgataattaatcaatttatcatccatcatcttgaatatgcattgagacccctagtgatatctatcttgtgatttctattgagacataaacttctacttttgttttatcaacttatcatattttctgttattattctttcttgagaaatgcaatgttctaactgagtgcatctaaacctctattagacccaactgcaagtgctgatctagcagttattctcatgcaagaaggacttgcacatttgttcctcattggtagaaggtaagttgagtcattgactcattgtgccatggcacgaccaagataatttttattgtacttcccatgatagcatgctaattgtgatgatgaaagagtattatcttaatagtagccctgtttgattccctattcttttaaaggcttgagttacctcttgcggtgattgtatttgacttattagctatggttatctaaacagcataacagtaaccagagcacgtattgaaacatctattcctcggaagcatggccctgcgattgctggttatgagtcggtatggaaactggttctgatattgtgtaatctaattgttctatctattcccaactgactttgttttgctcttttgtaggccctcaagaagttctttgaacatgttttgcaagtaaatgaaaaatgtttcctcaaggaaatgataatattaatgaaaccaatttggactgatgcattacttaatttgcctacaggctttcctgaagcatattgattttgaagtagtccaatgtgctgtaattgcaagcccaggttttactaaggtaatcctcacgtacttacagttttggttttataagttggtttggtatccatgtgtcaagcacatgatgatacaattttatgaatttagtttttgtttatcgtttgcacatgtttctgattctaaacatgtgcatgttagtgagaaaaaaactacagtaaagcctggtatcctgttagtccatttgttgctgttggtactttcagaaccatgcttgtatgacaaacaaaaatatcaacttatgcaattctcttcttgtactttctcttcatatcttaacaggatcagttccgcgattatatgcatcttgaagctgcacggcgagacttaagattaataattgagaacaaacagcgcattgttcttgcacatgcaccttcaggttacaagtaagatattctatctttgttagacaattgttgccatctactcgacctattctctttcccccctacattttaggtacatcagaacctattctgaactgtgtaatatgtgccaatttatgttatgccttctagctttctggcttgttggaaacttgattacttggatcttctctgattcatgtgttccattttcctgtgaccaattgcatggtcctagtgaaaagatcttaatataatcctgtactgaacaccatttgatagatgacctaattatgatgtatcacaaaactacagatttaacactaaatttatcacagaagtacaaatataaggtggactatcgcaaaactacagatttagtaacaaagttatcacaaaactacaggttttatatcaatttaatcgcaaagcttggacattataactcaaacataacattaatgctagatatttcaaccccaatgtctatagttttgtgataattttataataaaaaatgtggttttgcaatacttagccttaaaactgtagttttgtgataaatttattgttaaatctgtagttttgtgatacatcaccttacatctgtagttttgtgataatttggccaaagtatatgtaattttgtgaaatttactctaattatatatctattcatttggttgcctatattcccccagctgtctcaatggtctctgttttttgtttgattggttatgtttgttaaaggcatagcctgaaggaagttttggatagcccaagtgtgatgacactaataaaagatacaaaggcggcgcaggaggtaagccatattcagaacaagatatatcactaaatgccctaatgtacacctatggtgctttctcaaacagttcccccatgttgatataatacgcactaaggcactaagcacattcaaaacaatttctaagtacagacagcttctcatatttgttttctgacgctcttatatttcctttctaatttgcaggtccaagctttgaaggacttcttcaacatgcttacaaatgtaaagcttcttgaagaaaaactaccttctaacagttggattgaaatatcctactccatccgtttcatattgtaagactttctagtattgcccatattcatatagatgttaataaatctagacacatatgtatgcctagattcgttaacatctatatgaatgtgggcaatgctagaaagttttgcattgtgaaacggatgaagtacttatgtgttactgcttagacccttttaatatgcatatacattatttgtatttcattttggaaggaaatattgtttttataatatttgtggttagagctactgattctgcttagttgaagaatataattaaacccctgtcgctctgttttttttttttttgataattgcaggattcagctcgagcttgttatggacctaagcatgttgagattgcaaatgaacgtcttgctatccaaactcttttaataacagataatttgtttcggtaagttgtgttaattaaagagaagtttacgagtcagctaatttacctctatagtcttgttattttcctactgctttgtttccttttttctgctgagttcttgaatttctagttttgtaacactcacagtaaactaacatctcatatcaaaactgttggtatgttcataaaattttagtggtgagaaataacattgattcttctatttctacctgcaggaactctgacattgcaacgaggcaaaattatgtgcgcttggttgaatcggtaaaaaaattcggtggcacagtgcacatcttttcttcaatgcatgtctctggtgaacgtaagtattcgtatccatttgtacttcactataactgctcatcaaaatgcaatagaccagttcataaataattgtcacattttcatattaacctttttgaacaaggaatttattaatttgtaatttgcattagtttgctgcattgtgttctctgtgtttaaggtggatttttttttttcatttgagcagagttggcgcagttgacaggaatcgcagctatacttcgatttcccttgccagatttagaggacattgagatgtgataattccaccgttcagaattggcaatatgctaacttgtaattcatgtgtaatcctattcagttgatttgatataggtaactcttaagaaatctgaaccacagtatatcctagctgtaaatggtttgcatgccatatttgttgattgtttttttacttaacaaagtgctactccctccattctttattttttcactaacgaactttcaaacatcgagggatgtaggtagtattaacagtgcaatgcatgctttaggccaagtagccggattagccatggctgaaagcctgaaactgacttaccaggatgttggcaaatgctaatcaaatcctttgaggctttaaactggatatgatttcaactaattctgtgggggtgttctcaacaggataaatatgtgattgcgaatgcctcctctctctctttttttttcaataggactccattttatgagttaacattaatggtcctgttcctttcttatgtaaggagtggattaaattttggatactcatggcatgcttttcaaactgttaaacgatgttaaacgatgcgtttcgtgagaaaattttctatatgaaagttgttctaaaatatcatattaatctatttttcaagtttgtaataactaaaactcaattaatcacatgctattactatctcgttttacgtgaaacacttaatttttatcttcataggatgcaaacaccaccattgaatcgcctttatgcaaccgtgctatgctggagctctcctggaatcgaatactcctagtcctagccaacctgtgactattctgtcatgcattatgcctttgatgcgctttctggtattgcttgattcttgtttcttttttttttcccgtcgtcatgcacgcatagcatcctggatgttatctatttgatttttttcctctcgattatttccagattacagtggatacaagatagtaaattttttttccttcaatgggcggca

SEQ ID NO: 42677 - DNA, 2244 bp, Oryza sativa
tagattatggatacgataggcttgtaactgttaacgtgtcaattagttagctgctgagtcctctcattacaactttgccggtttcaaacaatattccatctagaaaaaaacagagcctaaagctgatccaaattggtaaggagtccaacaatattctgccgttactttcttttcttcgtcatgctctatgaagtgacaaagcatgcaagagaaacttgtgtggcaattctttgattttgaaatatttaaatcaaaatgctacctaggctttagaaatggaacgaattgccggctgctagagtcaaatctagctaatcagaaagcattagctacctgggtaaagcaaagcagagcacactatagctgaagtaacccaagatgatattgttatcttgggttattttaagcagaccaaattggggcggcgatgccacaggccacctacgagtggactaacaccagactgtgaaaaatgcttactccaaccgggtgattaccaatgtcaaaccctagtgattagccaatctcctgacctcactcattgcgtgcttgattaatcatttaattaattaacctctctagttcaatttatcctagctttctgctccttgtggtcctctgaaagaccgaaaccttaacacagtttagaattcgaattcagtagttaaattaatgattgcttcctgcgaattcgatctcgcgtggccacggagatatcagatactgccgtggtttgcccggattttgagatcggcacgcggaaatcggccggaattttgcgttaattttgtattcgcgagccccgtcctgtttcgaaagcaacaaaccggcagccatcgccggagaccttaattagtctatccattttggcacacttacacctcacacaccaacgtccaaattgccctcctagcttcctccttaatttaatacaagcaaatcaaaagcaatttaggctttgctttcctgacacatcaggttgcagctagctaacaattaagcagctgatgagcaaaggctagcagctagctatacatcaatggctccaatcatcacatcaactgtaatttatccaacttgacacttgctaggccatccaatccattgcaccaccaacatcttaattgattgatttagttaacaaatcagttgtatcgttaatcgtacgtacctgaaaggaccaactaggcagtaaaaaagagaaaaatccattctgcttcaggcccagacttgcttaattaataaaatcgccaattaaagctttttctcatcagttctcatctcgccaagatcagctggccttcacgctcttatatatccattttgcttttcgagagcacaagcaagtttaagatatcattaggtagctagagatcaagctgatagattaactttaattaatttctcgcatgctttagctagccaccctcttggccattttgtagtattgtacatggtacactttatttagtaaaatacatatacatttaatctttatgtgtagctagcttatgatagtatgatcacagatcatatccttttcttgtgggacatgtacacttaattaataagctgccgtgcaaatgattagtattatgcatgtagagggcgacggccttctcaattcctaagtgtagtgagcttagcgcttcttacctaagatagctttgattttttaagacaaaaggagttaaattaaggtgatacaactacattaagagcatttaaaagcgtggtattgacagccactcggcctatccattttgcgtccaataactcaaaacggcgaatcacatcctcctcaactgtgagttcgctcgccaagtctgacaccggattctgtctctacctgactggtctgacctcactctgctccgtggctcctctcttcaggtctagtggcctacttctagggcctgcctgcctaagcattgtcataagtgcttcgactctttagtcctcctctcctcgcagctatgaaaggagcggaactccagagtgttcgattactctctctcgtcggtttcggtggttctgaagtccattctacatgaaggtttcccatggtcatttactggcgtcgcgtcttttggggatatattgggagtgtatagtagggctccggctccccctctctcgtataggagtagtgtccagttttagctccatttttttctctctttttttcagttttcttttctccttgccccccgacaattgtcctctgactggttgcgatgcata

SEQ ID NO: 42678 - DNA, 12135 bp, Oryza sativa
taattgaactttcctttttctagtatattaacgtgtaattcttttacacgttaaaaaaatgaagctttgatagaatgttatcatcacgccatcatcatcaccatcatcagagtgagcgcatgcagctgcaggctatctatagttaactagctaattaccattaacacctcacctacttagctagctaatcgcgttgctctttctcgtactataaattaagcttcctcactaagtcatcagtgagtgatacagctgcgaaagccaaacactgctcagctcagccgggagagtcagatcaccacatcagtgcgtgtgtgcacagtgttaagcatggcgaggttggcgtcgttggtggggtggaacggcggcggcgggtggagggagcggagggcgcggcagaggctgcggcggcggcagtactgcggcgggacggtgtggctggggcggcggcgcaggccggcgggccggtgcaggctggccgtgtcgcggctggtgcggtggcggctggtggcggagctgctgcggccgatcaggaaggcgctgatggagatggcggcggcggcggggcggcggcagctggtcgcgctgccgcagctcagcttccccttcgtcggcacgctcgcgctcccggccgccgtcgcctgactccggtccgatctcctaacgcgagctagcgccgccgcgtcctcatctcatcatgtgtaataacttttttttttgccttttcttttctttttttcgtgtatgatttcgagctttagctttcaggctttcagctggacgtctaattaattagcttaattaattaactagctttcgatctatgcgacgtcaggacatttcaatctcttctcgccgtgtttataatgtttataaaggcattaagcgcgcatggttttgattgaaagtgtggataaagtggaaaacaacttgaggatatctaaactagttagatcatagtaaacaaattaaaccacataactatggaaggaccgactatatctactaaaaaatcatggatattggatatatgatcagtcttcttgtactgttgtacaggaattaggaatttaatttacagctgcggtaaacagttaaattccatataaattagaaaaactcccgtataattttctacagaaggcggtgtaggtagaatgatgatagtgtatccacgtacttaagttcatgagttcagagctccgacgatatgcaaattaaacaacatagcatcgtctgatgatgtacggagttcaacttggtgttgcgcaagactaataattgatcgttttgacgatggaagtaggggaaaaaaaatcaatcaacagattgtggcaacaggcaacgatcatcgatggctgattaattcaccagttttctggtaaattaagtactgccagacattcatcgatgtaattaatgaattcttaccaggacggtagtctctatagctatgatttaagattttgacggactactcgtcaagattcaagaaattaaattgagagtgttcgtcaagatgcaagggaagaactaacagaacctgtacttatgatatgaccaggttggaattgaaccgacaaaatttgttaactaatcaataattctagagcaggggaagcttgcttagtagccatgcatttgcaccaattgaatcagtcacattatatgcataatacgtccatatggcatacaaggttacacgttaccatgaataatatataatctgtactgatcatgtccctgtaccatacactaaatacgtacaggaatacagctagctagagaggtgtacgtacgtacgcgcgtggtactcgcacctactagctagtagctatttaattaattattatatatatgcgtgtatatatatagctaagtcttctgaatatataatttccaaatatttcaggaaaacaacaacaatgtcatgcatgctttggacatggtcctaacttatgacgtattcgacatatctccgtagcgtcagtctgtacgtccttgtagttggagacaactgtacatatatttatgcaacgacgtcagtctgacgttgctactacttgctaagacagaaaaggttgttatttaattctgagtaattttctgctgcccctcgccataaatctcgtgttaatgttaattagaaacagataggatatatatgtactgcatcatctcgactattatgaataaatatccaattttttctataatttttcatgatatttattagttggtatgcacggaaagtttgtgtgcataggatatatgtttccctttactatatctatatcattaatcaaagattaattataattagctagctaaccactacacgcactccaattcatgtttgttgtcttgagcacttcactctagtgtatcgagaattttgtaggaaaaccaacattcaaattagtgggaatatttcgtataccaaagttcttacaaattctgcagctctcagtacaaataatggaatgggccttagacttcttctcgtttcttctatattgatgccagagtagattaatatatatgggctcaattaagcagcaggaaaggacagtaaaagggactaattaaaaaaatgaattttagggataggtgccatgtatccatcggccgcaatatatcctcgttagcttacacgcatacatggtgcatacacgaacagctttcccatgttataatcttacacacaatatatataattgcacaattaattaattgtatacaagcttaattatacacaatgaacaattctatacagacttacacacacacaatgagtcaaaatgacacaaaattaatttgtaccgtactgttccacgcatgctaagctcttatatatataccgatcgagtatattaattagagtaatacgctagctagccagctaggtttggtcgatctaattaaagcacaagcgctgtgtagcacgtaacattcatcaactataacttggttaaatctcaaaaagtatatatactttaaattaaagtcagcaggtgctgtataagtggtgtagtactgttggtagcgttcggttaattaattaaacacattgatcgctagatctacaaaaacattcaaacaacagagagtacgaggcgatacacatacaaaagtccctggaggcatatatacggatccatgcatatggatgcgtatacgtacgttagccacggtataaagaaagccatgtactgaattttctatatatctgcattccgtgcataagaatatatagctgatggcacaaaaatcaatttaatttgcacggcatatttatcccggatacatatatatgctgtatatataagagagaaattaaatgtgcatatttgatatgcaacagcactacttgttaaaataactagtacccccattaactagtacatccatctatctcgtgcacatggtttattaacaatatttttttcgattaccacaatactcacacggcctaaaatatgtcccacgcacggtctgttaataaagattaatttttccgatttcacaaagtactcttacgcgtgcggcacaccacacttactcatctctaaatatgttccctaacatatgctcaaagagatgaagctatagtagcgattgtaactcactagcttcactaaaatcttattaaaagcatatatactcgtgtatcgtaatattcatgggcgctatcgcactgtattttaatcatgatggataaaatatcatgcattaatttattattccatcgtatatcattgatgcttctcccgctaatagataaattataagcaagcatattaaaaattaagaagtatagtgagctttcagtgacataaaatggatgtgtccatgtggataagtcctaatacgaagatatgacaggtatatatagcggcaattattaactaatttcacatcctgctgaaataacgatcaattagcaatactgagaattatttcatgcacctatatatatcatcgtgtatttgacgaaataaaaaactgatatatcaaatcggcaaactcattaaattacttgaccatgctaactatatatatgtattttggaccaatctgaatcatcttttaatttctctgcattttgttcgaatggagcacaatttttagtgcattaacattgaaaacaaaattatatataagtctatatatgaactaatggcaaggctaaccagcagatgatcaaagatagtattctgaaaaatagaagtgacagaaagtcatatatgcagtaattaaacatgcatgatgttagaaaattccgatgtactgtcacaaatatgtgtctcgatgcatatatgatacgctacacaccgatccatgtttattttatttcaatatgtacattccaaggtatagtactatatagcatatatacatgcatgtctgttgaaggagatgattatagccagctgatcaaatgagtacagctaatcagtgggccaattatgattagctgttgattcaagtaccaaaaatgtttttagtgatgtgaaatggctccctaatatagctattttgtggcccaattgcgaattggatggtgatcttacatgattccaagcaaaatgcacacatgcatgtagctagctttgtcctgtcaataggtgtactaattttgtcatatatgacagctagctatggccaatgagcaaattcgatatctgaaccaaaaacgcccccctatcgaatatccaaatagaaaacagattaaaaccacacactacaatatcgtcttaagtggaaattatatctagctctgtgatcacaactaaaaacaatatatgcaagtacaaataaaaaaattaaaaaagcaaaagcagaaatttagggtattttatggatgcagcaggcagcaggctcttcttctctcaatataccacggtgcacaagacataatctgttagctagctagtgtgaaaacacacatatgtaaatacatatagttctactaagattctttgcatctgcttcgtctgtatctttttacctttttttttcagggacatgcaaaagacttaactatattattatatcagttaagtaaaagtaaagaatgtggtttcaaccatgcatgtcaaacttgcatggtaccagctagtctttttctacgtccagttgattaactactgtttgtgttgtacatatatatatgatcccgatgtaacataacacttaataggaagcttacaagcagaagaggctagcttcaaccctttcggattcttaccccataaaggaagcaacaaacgcatgtgtcaaagctagccaactgagagaaaaaaaaacacgacaaaagagccaagcagaaaaacttgccagcagcatcaagtacacaaagaatactcaatagagaaccggtggcacctaaaaaggaacagggataagttggtagagagagatgatggaagggcaacaagaagagagaagaaaaataatagcaaaaacacaaatacatatatgcttatttccaaagggaaaaacacaaggccctttaatcaaaagatgctaaccgcccatggagagaatgtcttttgtttggttcctttggccacaagttatgtgtgtcttctcatcaagctcaaagattagcaaccctatccctcatagattgtggctcccactttcccaaatttgagagaggagaaaagaaaaaacactctaccaaacaaccaattcaacataaccaccctcctagttagcaagctagcagtactctaatagtctaattagacaagctaggcaacaactagctaatggagcatcatctagctgtcaatccctagctaatacgagtagcggatgcatgggaacgatgatatagaggtagtacacacatatgcatcatgcatgtgcagctagctagcaaccaattaatacttaattctactagaacaaaacgaatctgcacacatgcagattatcatgcatgatatatatgcaacatccattcatctatgacctcattgttaagttctttgattaagtaattacctgtttcttccccaatcagatagaagacgtacctacagaagatgaaaaaatatatatataccaacatcgcagatacagctacaaaggtaggttagtaggatgcatgaatttttcacaattcacaaacacacatatacgcagatatatagatcgatttactgacaattgacaacaattaacactgcactaattcactatcatatagtatatgtaacttcatccttctctttatatgttacaattaattacccctctctctctctctctctataaagccttcttcttggtatatatgattcaattcattgtgctcccagccggtcggcctatacttctatacatggatgtatgtatccaacaatcttttcatcacctaccaataatcttaattaccaacaaaaacaaaaaacatgtatactaacactccacccaatctcctagatcctccccttaattaccccaataataatcccctatcttaaccaaccatcatatgcatcgatcgatcgatccacatgaacaagagatagatcgatatgatgtaggtagagaagtagaacagaagcagcaacagcagcatgtgatgcgtgcaagacgaacgaataaataattaaccatatgatgcatatgttaattactcgatggatggatcattggtaggagaagaggtcgacgaggccttgcatcagctgcacctgcgcgcgaagcgagcggaggtagtcggcggtctcctccaggaggctggagtactccatgccggcgccgccggggaccaggcgccggagcgcttcggccctcggcggctcgccctgctgccgcggaggcggcggaacagcccgagccgccgccgacgtctctccggcagcaataatcctgacgcctctggcggaggcgggagaaggcgcaggagcggctacgacgcgcctccgcaccagcacggcggcgcgcctcatcagcgtcctggacctccgcgcgcggacctggccgagcagcgcccggctccacgcgcggcgcgggctcgccgcccgcgccatggaggagtaggccgcccggcggatggtccgcgtgcgccgcgtcacgggtgtcgcccggtggatccgcgacagcgcgcgcaggaagtggaaggccagcatgtgcttcgtcgccgccgccgcttcccccctcccaaatccgccgccgtccgcggcggcgccgctgccaattacgctagggttagggttcggcggcgtcggcggcggcggcgtcctcttcgcgtccatcaaacggcgcccccaacctcacctcacctcctcaccttccaacgagagaagagaagaggagaggagagagatggagaagaagaagaagatttggctctgacacaaacggatcagaaggatttgtgggttgcgattttagagagagaaaaaaaggaaagggaagagagcgaggaacacggctctgacacaaatgtcctgagcaagatccggtgtcttataatacctagttgacaacgagagacaaaaacaatccaaattattcttttttattaaaaaaattagtctgctagtactgtagagaaagaaagtaagaaattgttggccaagatgaacatgagactcatctttggttagctcttgcttgcatgtgggctaatggatataaaagcaatctggtcggactttggtcggatcgatatattgattcagttactcgatcggtcacatacatctactcctacgcaatctgctgatttggttaattaacctgattgcattgacgaacatgaggaaacaacacatgctaaactactattaaccatgcatatccatgcatgtgctggatagatatatgagtacggtggtagtggtagttacaattggatgaaaaaaaagaggaaaaattaaggcaatgcttttttttttcatgcaaatcagcatcagcatcacgttgccgtccgcgtctgaaacattaactcgatttgttgttaaattgttcgtctgcgtggaagcaacgtaaaacgagtaaaccggcctgggatttggggtttgacacgttcgtcaaaccatcgccatgcaatgttaattaagtttctatagtagcaatcgcctaatcggcgtgcaaaagcacatattacgcgcaaatgtgtgtgtatattgcacagctggagaaaaattaaaataattaatccagcagagagattataaagatgttgctggagccaggcaacaacttgatctcgatcaaatatcgaccaattgatcgtaatcttgggcaacacatgccacacgctttgcagaaaggtaacatgcgcctccatgccgattcgttccgttcccgttagggcgttttgagatagatacagtacaggcccctagctagctaatcccctagagagataaacaaggcagtggctaattctgtagctacctgatccgttcaaattttaagagattttaggttaattggcaagctttaaaattgaggtaaaaagaaaaaaaaaatattccaatgcctctaggagcatataatattaccacagtgagtaataaatatagcggtgttggatagatcgaagaaattgtaggagagatcaatttatggataaactttaaaccctagctaagctacatcatttgctttttagctttgttagtcgtaactgaaatttaaattttaaatcttaattttagattttttttgatgttttttttagtttatttctcaacattaagttttaaattactaacaacaaatatatataagttttatttataaactatttttgaagtgttacacagttgtttttcgcgaacgcaagtgttacagcttctccctccttcatggggtagttcgagtcacaagggcgccaatacaattacagtttataataagttataattaaataataaagatcgtgaaatttcttatatagtataatatgccctctgctttgtaacaggtttgacctaggtaaattactggatcatactatggttatgcatatatgagaagaacgaaccgaggacactatgtttttaaagttgtagagattataaaagagaaatgaggaagagggtgacggccgtgtacgcattgttgggggtactacaggttagtgagtggtgggttggagaggaggagaaagagagagaaagtctagagagagagagagagaaagtggtggtggggccaagcgttgcaaaccaccacatgagcgcacatggctgccctggcccacctacctcctccgacggatggacggacgatggattcggtagagagagactagctgctatattagctagctagagagagaaactacaaagccgctcgattgcattgcatatattgcaccgatccatccaagcgtactacgcagctacgtacgcatcaagtatgtacttttcttcttcctttttcctttttttccttcttaacgaaattaattaatttcacgaaatgagcggagcaggtttaggttcaaatcttaaatttgatatgggtgttcacatttacggttaattattcgttcagtagtggacgacgtacccgtcgacaacgaaacgtcaatatgcccagtcttctaaaaatgctcatataggtgagtgtcacacgcgagaacgtttgtgtttataccgtgtttcttaaaaatataaattaattaatttctgagtacgttatgtagcagatcgagctacctgctcaatcgtgatcgatcgtgctcataaaatctgatccttaattcgctctcgatcgatcccccggcctgccgggtcaactgaaaacgatttttaattataatactagttcgattgattttaatgtattgattagcgtataaaagtgtatgtatacggagtgcattattgtatgcatttttcaggcttaatcaaattagagggagatcgaagggggcctaattaattagctgctaattaatctggtcgtggtttggtcgcacgtctaaacccaacgacttatcagttgtcgccgatggttaagacttgctaatcacatatgagcacaaatcaacagggaggtagctagaaagctaattaaggagagagaatcaaattaataattaagctatatatatacaggggaaattaacctgataatcgatcatcgatcgtgtgttgcctccgtgaccgctgacttgttgccatcaacgggatgattaattaggcgtgcaaggcgacgattaaactctaattattggagcaaagccggccgaccgatcgaccatatgcaagaggctaagctagtcatggatccatattccatacatatgcatcgatcataccatatcatgcacgcatgtgcatggtatctatgtctatatgttgccaattaagaacggacttgtaatgttcctataattaatcacatcatgtgaattgacatgcaatatttgaagagtcgagatatatacttccccatttaattaccaggctaaacatatgagcatattcacaccaatcatcaattgttggcttattaatattgttagtgcctgcagctaatgtaaaaattttataagtacatgtccttggcgttcttaattaattttgtagtggttatgctcataatgctgtcactagaaagctaccaaattttcatcagattggttcgagcccaataatgatgcttaaacaacgagataaatactctgcccaacctctaatgatatatccatgctgcgcctgatctccggcatttcctaaccatgggccaccaatgcatggatcatgttcttagagctgtcgggtttatatgtagcaattgtttttaattataacgaattgacaaatcgaccacatacaggtaactcgtgtgtcatttttttttatatactactaattagttggagaaattaaagacattccattaattgtaaattaattaaataaagagaactccgttcaaaaaggtgtggcattttttctcatattcccatgtgtttggaatggatgattttctttgagaagttttgcaggaattgaaccgatttaattatgtgaaatcctgtaaaattcttgccttacaaagtaacactaatagattttatttctttggactttatgcatttcattaattttcaaataggctagctatacattgacatgaatatatatataggtggtggcatgggttctagcttacaaatcgagcataaacatccaagaaacctttagagagtattatatagtactccctccgtcccaaaatgtaagtatttttggatctcgacacggtctccaagacaatatctacaaaagtaaaatattttaaataaaaagagttgcatattatgatagttcgtttaatgataaatatagtaacatcaagtttacatgattaatatttcttaatttatcgctattaatagtcaaaatttaaaaagtttgacttgacactattctaaaaatgtttacattttgggacggagggagtagatggcaaatttaaatactcctatataattcataaaattggactaattgtcaaaattttaaatttcattaggaagttgaattgataagtgttgatgtaaaattcgtcacatacacaaaggcataagagatttgtttagatctagtgcaagtcctatcaatcgggttcagggcatgccagttagtttgatcttagaattaacaagatagacaacgaaaagattagattgtggagtcaattggtcatagggccgatattgtatcgtgtgcccatccgatgccgatgaaattttggatcgattggctgtaaccgatggatataaatatttaggatcaaagtgacatcgaccaaaatctacataatatatatttgcaaaatcttctaactttattataaccaatcttgatagatcaaatcaaactgagacaatataagattgaaagtagtaaagatatcaacttaacaattatatatattcctagatgtaggccaatgcactaaaatattaattgaagcttatcatcattcgcaaagtaaagaaaaaaacaacatcagctataacaagttaaagtataatcattaacaacctatgattattaaccacaatcttgatagatcggatcaaatcgagacagtatatgtcggtgacatggggccgggggtatcgtgactagaggcttgggt

SEQ ID NO: 42679 - DNA, 5204 bp, Oryza sativa
tgagagcttcctagctctcgtccctagccggagccggcgtgctaactcctggagttggtatgtcagtcccggtcaaatccattccaggcttcagcgcaagtatggtaaggaagtcgctggccattaaatgaaggttgaaatgggcgtccaccgggaaagcaggagcggggcaggagacgtgtgctctgcttgtcagaggtcacttccggctgtagactagccctcattgtaaaaagcatgtttcccttcttaggcagctagaggcccatgtggtgacccctgaccagataaaaaggaggcccaggcctaggagaaaaaagggaggagaggggagaaggggactgggactctggggaatgggttctagagcctgaactctctctcgctctccggctctctgtattccttcacgcatagatccaccagaacacaggagtagggtgttacgcttctcagcggcccggacctgtctacatcgcccgtgtcttgtgcatttcctctctcgctgacgttcctcagatcgagggcgaagaacctcacttagcgcccccggctgaactggcaaaggggggcctgcgcggtctcccggtgaggagccccacgctccgtcagtataagattgaagataacaaaaatagcagttaaccgattatgctaaatcttgtaactcaaacgatgtagcaaattaatttataataaacacataactcatcggttaagactccaatgaaacaattgtttaaacctattgacttgaataaatttatctagcaaattataattttagtagattggacataaccaagataattcaagattaatggtaagtttgatagatttaaactagccgattggtaaaattcaaagtgatttgatataataccctaactatgagagcaaaacaatcaaagatagatctgatacattagataggcaacgcatgcaaagatcaaattaatatatcagacttaattgagaaagtacagcccaaccaatacaagtgaagttgacggggcttactttcttgctggagatcgaaatcgatgcagcacaaactcgaacaagaaccagttgaagctaaactagggtggcgatgcgtcgaaaaagtgattattgaactgttggtgtttacaaaggccctgggtgcacatatttatgcccataggctatactaagggcctgttcactttgatgccattttcaaccataccatttttttttgacaaagttaccaaaaatatgtctacgtttagtttattgccaaatttggtcaatacataagaaatcctgccaaaatttttgcaatattaccatcctgccaaaattttggcattgccaaaacttggtaaggtttattttagctacaatctgaacatgccttaagtccgattctactacaatcggattgatataggactctatctctaaaaaaaaattatcattacaactttgactctgacacaacttttgatcggctgatcaaaagagaaaactcacctaaggccgagtttagttccaaactttttcttcgaatttccaactttttcatcacatcaaaacttttctacacacataaactttcaacttttccgttacatcgttccaatttcaaccaaacttccaattttagcgtgaactaaacacaccctaagtctgatcccaacacaactcatcgattcaggactctatttatatatataaaaaaactaagatacacatttcctattgcagaaggttaataccaaatctggatcagcttgcctaactgaatcttctatactcacagcgtgaattccttctttgacccgatcttaactaacgaaaatttctaaatttcaccgtttacaataagtacttctaaaatatcattaaaaccaagtttggttatctccacaaacgtctcagaatgtccaaaatatacgtgttaagatacataattaaagttcctgtcagaaacataccccctaccttctaatgtcattatcatgtttaaatgtccagttcgtcatatgtggccgaagagcataaatacagatttaaacaattactgtatataaaaaacgtatgcaccaaaaatatcacagtccaattaattgaagtgaatgtgtatagtttgtctgcatacatgcaagttcagtcagaatattaattctcctagctcctaaacaaattactgaattatatataactgtacattaaattcatacgtgagaattaatacagtatgcactttaacaattgagttgcaataaaactttatagatatgtacgtgtgaatgaaagaatctgccagtgcatacatgcatgctttttttccctacatcaacagtggtcctaactaattaagctatagccccgcaaaaaaaaaaaagctataggatcgcatgacctatatatgctatgtatatatagctgctgaaaaatattttcaaatcgcagattgatcatgcattctgatcttaagtgcagaataaactatatgagtatgatatgtagtttaagatagtatacatcgccggacgcttgatgagaagtataggaaatcctggagaaattaagaatttaacatttctcaaaatcagatgacctaattaattaacaatataatgctttcactttcatcttttgaagtagccgccgctcttttaatggcattgttcatgttgagctcgtgcactatggtacgaaaggtagcggttgccaagccgaagagtaaagctagctcatccaactgcattcaactaacgctactacgacacatccttccaaaaccacacacccatgtctccaactaaagtagagtctgtactacctctgtaattaatcgatgtcagtacatgtttgagactcacaactagttaaaaaaacgagagattaatcacatataaataaataattaaatggctctagagatagccaatgaggaagcaacaagttacaagtgtatatgatatgatagagtgctttgacgaatgtgataatatgcgtgcatgttcccttatctatgcaggacatgatggatagattccgttgttttatgatccgctagcagcagattataattaaagaaggttccaagaagtaggactaggagatgggggatcccacttactttcggagattacaatagggccactttgtatacatcttattgatttggtcccctaaagaggccttagcccacatgcatgcaacaagtagtaaacaagacgattcatccatatcggcgccaaacatgcaaaagtcatgctgagcaacgggggtggcagcagcattatattatattatatagattgttcatgctagatttttacagtactattaatttttcgagtccatcgattaagatgttattttttttaacggccaaacagattggttagcgttatattaatagaagggattaagttacatagccgaatgcaagaaaaaaaatataattctgactgcaaacaagcttgcatttttcagacatttctactactctaattaattaagatgttatgccagctacgctaatcgaatagtagtactcatgtagttccagataatatatatgcaggctacaagctaagccaagcagtttaagcaatctgcagcctgcagggccggccgggcatgctcaatttgggaggttagacctgatgatctatgcaagaactttgccaaatgtatttaaatcgtgatgcttccatgtagcatgccttacaagacactccacctctttttcatgaaaggaacaagcctctgcatgcatgccgcgcgcgctatgtctaatatccgtatatacaaacggccggacaccactatgagtatatcacagctaggaggagtatctgttaatttccccttaaatttggttcgtcttattacccaagccagctaagaatcaatcagcacaggtactgttttaattacataatgctgcaccttaatttcccattaattggcatggttagacgtccattagttgctagctaatcagagggggaccaatacatgtatatatgcaatcgtttcgtgtttgtgtcgtcgagccgagatcttaatttgctgcaacatttgcaggggagagtgtcatggtcatcgtggagctgtagccaacaaggcgacccggccggccggccggctcttgtcttggaggtttaagaattttgatgtcttctgcatgttgctgctgtgcagtagtgcaactgtttcatccactagagctctatgctgatgcacagaatcaagggttgctgccggccgggtcctctcatttggtcaacagtgcttatcattatggctagctctcgatcgctaacttggcatgttgatcgacatgcatgcatgatgaggtgatcgaattgatcggtcgatcgatgcgtacgtacgtgtgcgtttgcgttctggccggtactatctccagatcgtcagtatgtaatccctccgtccaaaaaaaaaataaatctaaaacgaaacataacactttataatacaacgaatacgaaacagaggtatgtttatatttataaaataggatgtgtcacatttagttataggttggtttttcatgagacggagtgagtagtcgcttgctgctggctggagcaggaaccagttagcacgaaagtacgacatctgacgagtggatcaagattacccgctcgtgcaatcgttcatgattggttctttaatttgttcaactgccgctaacagtagaagagtaatgcggaatagaggccgctccgttgatatgatgttgcagcagaaaagaaaaggtttaaaactagaaggaaaaaccttcaatccagcgtgaccgccaccgttttctcctcggacgcgcggggcgggcgtgcgtgcggtgaaattattggtcatgggctcatatgacaaaccaggtgagcaggtgagccgtgcggggcggtggttcgcctacgggctacggcccgtatggcgccacgatatgcctatatcaatcacgactcaccgcggggatcgcgcgtacacagcacggcacgcgggtatactgtcgtgcatgagtggctctataatcggcgagacgttctacgctagtagtgtaacgatgatttgattatgtatgtagctatagttgtggtttaattagccggaggagggtagcacgcagggatgggtacggtcgtcgagtcggagagatcgatcgatcgatggatggaggtgtacacatgtgcgtgcggttg

SEQ ID NO: 42680 - DNA, 9516 bp, Oryza sativa
  unsure (1)..(9516): unsure at all n locations
gagtcggagagatcgatcgatcgatggatggaggtgtacacatgtgcgtgcggttgcagtacacacttgcatactagtgtgtgtgtttgcatggtgcggtcgttgtcgcgggaggacgtacgacacggctaacggcacgacaaggcagggggatggatcgaatcgagtcgagtcgatggatggatggatggatcgaggcgggcggncncncgcgggtcccggaaaggtgcgtgcgcgcgcgtccccgtcccgcatgtggctgacacaactcccgcgcgacacggcaccaaccaccaatccatccatacaacacccccaaccccaaccccgcccgagcacaatcccggcgtgcatgcggggccgcactgccgactgcctcgcccgcccgcccgcccatcattactgcgctcactctcctcgcccaaccgcacgctagccgactactactcgagtactactagcgtactgtgctactgttccattatccggccccctcacgaatggatatatcgtgcacacgggccacggcagtgcgtgcatgcaaaaccggccgggcggccgccatatgtggcacaataataattccgtatgtgcagagattaatcaatacggtggtggagccacgcgtacgtgcagggagatacgcatgaccggggccggtactcaattcatgaagccgatcgagctgctgctaatcagatttcttgttctttttattcggtgctaatcaaatatcatgctctaatcaaacggacgcaccatcgtgcgtacgccctgcaggcgatcgacctcacgtacggtggttgcactgtacgtaccggtcgaggcgcgattggaacgggggctaatgctagctttcccagcagatctggtgacgtcgtctatcgtacaagttagctaatgataataaccaaatcgatcctccttttgagccgcgaggcgaggctttttaactagtacaaggtcgatcgggacgacgtacgtatgatcgatgatgcgtcgtcgatcgatcgttccacgggagtaaaccccaactcgtgatgattgcttgccgcgcgcgcgggcgtttctgctggggaacaggggaaaaaaaggggcgggcgattcgcgcggcgcggacggacgtggcggcggccgagctggagacgcgcatctgcacatgggtgggggcctcgcgcgcgcggccggccgcgcctaccgatggacgtacgtacgcgtgcgcgggataacgagaggcaagggggcgtgggccgaagagcgaccgatggatggatggatgaccgatcgatcgctagccgcagcagctgctcgtgcgatcgtgcgtgcgtgcgtgtgcgtgcgtttgctgccttgttgcctcctaccgcgacccgccaccaacgggccatgggtgtgtttagttgggaaaaagaaaatttttggatgtcacatcgaacgtttgaacagatgttagaaggagttttcggacacgaataaaaaaactaatttcaaaactcgtctggaaaccgcgtgacgaatcttttgagactaattaagccgtcattagcacatgtgggtacggtagcacttatggctaatcacggactaattaggcttagaagattcgtctcgcgattttccccataactgtacaattagtttttctttttatctatatttaatgctttatgcatgtacctaaagattcgatgtgatgtttttgggaaaaaaatttggaaactaaccgggccctatatacaatacacgggcccaatccatgtctccgattttgtcctcctctttgaccctccttcaagctccaggtcctactactagtactacgcctaccctgccgccgtatacgtcagacagcacagcaattaagacaccgtattcttccgtttcctgtgtgtgctcgtctggaatacatacagatacgggcattgatcgggtatgcgtacgtacctggtcaagctagctggtccgaaaagttctccgatttgatacgacagaaacggggaaagcaacccggaacttctcgcatgttcaaccgatcaaactcgccgggatcacacatttgcgcgccgcttaattctctgctcgatcctttgggttgggcgcaatgattcgggatagggtttgacatgatccttggccatcctgcttgtgacgcagaattggtcaacggatgagaggggcacatcgtggttaaggatcgatgggtgatcgcccctgctcccgcgctcggcttgtgccatcggtgttaatgtgcacgggtagacagctactccggccacagccacacaggtcaggttttatcagaaactcagtaccctgttcgtatcttgaaaaaaaatagtgatgttcttcaaccagtcgtctcaagactcaaaaagagtcaagtctcacctagtcaccttgtaggtaaaaaatgaaaactctttcgttgaatgttgccttagtccctatctcgtacctctgtgaagatatgaatgtatctttgttatttttcttcctttcttcttttcacagttgggaaaaatatataaatatactctttggttgtgtttagttcacactgaagtttgaaactttgtttgaaattggtacgatgtgatagaaaagttgtgtgtgtatgaaatgtttgatgtgatgaaaagttggaggtttagaaaaaaaaactttgaaactaaacagggccttttcctacttaatataataccagcaagtctgccttcggtttcaagagacaaaaaaaaaaaaactcttttgttaacatgtccgaagtatatggccactacttttcgtcatctgcagtaatatggcagaaagcaccaactaagagtaggttaccaacagatgtctcgaagataagaaaattccatcatggtttaccttttagataaaattcggttggttttcacgaaaaccagacatcctgaacctagctcgaaagaatattccattggaaaattcgatgcatttcggtccaattcaaatttgatctgaagaaaaatgaaagcgattttaaaattcctaaaagtactatgatattcatataactcattaatggcatgctttaaaaaaatatgaattttcgtgtgttcttttaacggcacacaataatagaaaagtagtatatattaaaaggaaaatgaccttcatgggccaaaaggcaatgacaaatagggtcaaccagcccattttaggaaaaagatgaaaggattcgggcggcaacgacgttcctccgccggatacagtgatcgttccctaccactgcggtagtttgctgctcgccgggtgtcgatttccatccgggaccacacagaaaccgagcgaccacagccggatttggcctatgtttggtgatgcatattgaattatcaattgcctgtgctttaaaattgttttcatgagagtgtattgcaatcgtgtgtttctcaatggagagaactacaatgtaggaaagctcatgtcagcatttttatataagttctctcatttcctacacatttccttaattttccctattcccccattttcataaaacaaaattaattctgcagtaatcttcagcttttcaacaaaaccgggtgtttttcttggacatagatcgatttgattctagttcgtgtagcgaaattttgttattcccaatcaacatttcagtgaaaccgaccagtttttgtcatgtgatcaactgaacctgagaatttggattcaaatttatgttttttaaaagaaatgtttaaaaattgttggttttcatgaaaaccgagctaccgctaagttaccaggatcagagcacccaacagaaaggtagaccctgaattccatatatggcacagttttttttttttactacaagagaagtcccaacagaaaaccttttttcaaaaaaaaagagaaagaaatagaactccaggttcactaatcactatacctgcaaaggaccagcaaagaaaaaagaacaagaatgggcattgcattcaagtattcaacttgtaaattgccgcggacgtataaaaggaggaatttggctagtattttgtatcaacataagacaggaatttgaaacgcagaagcaacctggaaataaactctatgcctgcttaccagcaaacatttgtacagttaagtcttctgcattccaaacaaatgcgaaagcactcagttatatgggcaatccatgaattttgtcaggcatgacgtaggttttttttggaacagttagctgtatctgtgtatacaataaaaaacctcttgttcactgacacctctcgagttacaaaaagatcatcagcgaaggccttttgctacatcttctaagagctattaacagaaatttcatggaggagaacgcatcctttggcctgcagagtgcataagcagataatcccagggtattgtgggtccagagcacacttctctggtagcttgaaaaaatgctgcaattattaattagacatggccgtttaagcagcactggccaagatgggtacaaaactgtggaatttaaaagtaaacaggaaaaagaaactagatgtactggtgcgaaggagcatcctccaatatctcatcaactgcgcaaaaaaggggtcaaaattttttagtggattccaatgcatccctaaggtgccataagcccttcgattgtgtactgaagagacttggcccagtcttccttaaaaagtaaagtttgtaatgttttcataacattgtaatctggatccaacttgcgctgccagccctgtaaaataaaaaacaaactcaaggatctgtaatggagcaataagcaataggctatagatagtatgagagaatgagaaagaaacaaaagttcatgacaattatttcccttttaacaaaaggaaactaacgcagaagcagaaataggtaggaacacaaagcagtacagaggcacatgtactttgaattacagagccagatttccagaacactgactaaaagtaagctataagagtcatatatatgatatttcatgaggttccgctatggtagtttggttatttacaccatttctccagttttaaatatgttgctaaagatgttctgctataaagcaccttttcccactactttttttgaaaacaattctgcaaccaacaaagaatcactttaactgtgacctactatgtcaagacacttttatccttaggcaactagtaggcattatcaacgaatccgaagctcttgagaccattcaatgaagatgaaaattctcatattcatgcatttccatcaaggtctaaggtcagggtacaaatatgcataaacctaatacccctgaagtcttttgtcatattgtgacatctagggagtgcatgttcagtcatctgactatgccattagaaaacgttgtgactgaattctaggggtcgagttctcctaactcctaggtcctaaatacatctccatatacctttctcgttggcaatacagcacatactataatcttgagaaacagctcatcgtgatctattggacatatgacagagacatctaaggccctgtttgattcagcttaggattattataatctggattattaggagtaagctgaaacaaacatataacttattatgatagataatactgtattacaatctataaaccagattactataatctggtaatccactctaaaggtgcttttttagattattgggcggctaacaactaataatccagagaaacaaacagctaacagcttattctatgccggcttattataatccagcttatagtaatctggttcaataatctagattacaataatcttaagttgaaacaaacagggcctaagttacaccataataagtgactgactggagcatgagacaagcagttgaagcatacctcaagaactaatgtagtgaccataacagtacaaacgttcccatcaatgtttactttatggcgccgtacttgctcaagcaactggtgcatacactcagctgggtggacagcatcaccttcagaggttccccaaaaggaaaacgaccgttcaacttcctgttgacaaaaacaagacatgtaggacttgtcgtaatttgtaactatcaaatatataaaaaggcattgtaccaacacaacattgttttaattaatttgtagctaaatgcatttacataaaatgtgacattgtgaacttgtgatagattagttcatgttgatgagttgaggcaaatattcaagtgcaccgaaagtttggacctagaaatgcatgcatctaaaatgtatactttactaacaccaaatataaggtaactatatttcatgttagtatcaaaccaccaaatagttgaccaaaaactcacaggactcacattaaatataagcacaaacccataatgcatcagcaaattaattaatatcaggtattataacaattcaatttaatgtagtggcgcaatttgtcaacaagagagtaaagagaacacctaagatttaagagtaaatttcataaaatcccacataatattgtccaagttgcacaaaaccacagtgattttggcacgtggcatgtaaccccaggtattatggtcctaaagtttcacaaaaccacacttgatggggttatacaatcacatctcaaatttatgagttttttaatccatcgtataactgttatatccggtttttaaaattttgatataggagtatgccaaaatggttaacggtgtggttttgtgaaactttagtacctacacgaggttatgtgccacttgtcaaaagcactatagttttctgcatcttggaccatatagatggggttttatgaaatttactcaaaatttaaacatcccaggtgctttccagcaaggtacagtgcccaaatacatcttgccatcaattcatatcttaaagatgcatataccacctattatagcagcaatataattatcttgactaaagggtgcaccgaggacctcaacaaggaaaagcagaggtgttactgccaagaaacagaccagtgacaagaaataataattacctcaatgaaggcttttggatttgggcagttttgctgttttgataacctcagtgtacgttctgcagctgtacgaccatctcggcgtgcaacagccttgaaaaattccagtaaattcacacgatcattacttgaaagttcagcagtcattcctacatcaaggaatactacatgtggcctagacttcaaaagggtgttatttgaattccttggttgtataacacggaccaaaatatttccagggtgcatatccgcatgaacaaagttatcaacctgcaaaaggtggatgttaacaatgctgcaacgtggtgaaaactaaccataattaaaagccctaaaatgttaagtgcctatgtgtaactagcaaatagaatgtactaaagagagatggtcaaggtccagtgaggttcatcaatttggaccaaaataataataaaaataatgatcttttaatattgtgttgaattgcatacacaatagttctgtaagaaactaagaacgaaggagctaaagtgatattatatgcataaaacaaaatattgaaaccctttatctttccaaaatatgtcacattttgcatattttcaaatccttggtttcaaacttgtgtaaagatatatttggattagttttgtctagagaagtgaagtgacagttgtgctgaatgtctttgctaacctatatcaatatgaaccagagatgtttctaaacaagcactgaacttttataaacaggcagttcaatttagaggttaaatgcaacaatgctcaattgaactcacgggctcacagcataaacagtaacccagaaatagaccataagacacaagagtcatcattcatcaaaagggtatgctataacatttcattgtttcactcaaatgaaatacatgctctcatctccaaacgcaaaacaataatgacaattctaagagatggctgaaagcattaccagaagcattttcaggagagcatgagtgccaatatgtgcaagggcgcttttaattcgatcatgtccatcgaggtcatcgacatagtgtgcaacactctcaccttgctcataagtttcaaccaatacagcaggatgaacaagtgggtaaagaggttttggaaaagacacatccttccaccttcggaagttgtagataaaccggctcaaatgagcagcttcccttgcaaggtcaacttgagacatcataaagacagcaaactgttgcacactctcatccagccgcaaccaattcaatgtaggaatatatctagaaattttagctactgcattaatgatagtgaaatccctccgtattgattctcctacgccaggatgtcttacttttacagcaactgttacacgctttatatgctggccaggataccggaatctcaaaccagctcggtgcacttgagcaacacttccagaagcaacaggctcttcttcaaaattctcaaaaagatcagatagctttcgaccaaaagctttctcaacagtcttcttggtataagcaaagctgtgagcaggtgcttttgtgtgtagttttgacaattcagcacagaggtcactttcaaataaatcagggcgagtagcagcccattggccccatttaataaatgcaggacctgctttctccagggtacgatgcacaagacggagccatgttttcctgtacttactgccaagagtatctgcaaatggggccatgagtatacttggagtgaacaacaatgccaaatatattgatctgaagattatgatgaccagctctactgctgaaaatatcaaggaggtgacatagatacgaccatcttgagcacgcgtgtaaagactatcacgaattggtaagtactctccgtctgcactggtcttctgagctagcattatctccccagcaacgaaagcaaagaggtaaggaactaaattagatctagtggcagccaagctaatggcacaagcaaccctacttaaaatcggagatgcctttggtacatgagaaccgattgtcatgagttgcttccaagcaagttgaccatgaaatgcattctggctacatgttgagagaactgaaaagtttcttgcagctggattccggtataaactctcctttgctcttccaagcatggatgacgtgcccggtccatgcggaaccttcccgtgcaaacaggccctgcctgtatgtgccaaaccgaacgcaaagttggatccaatgttatgtgcagtgaaactattgggtttcgagttaaccaatacatcatgaactagttttctgctcttccctatttgcataaacctggaagcaacaggaaaaccatttacacttctacattgcaccaaattaagcaccaataagctcagtagattttgagctgcggagctgacctcgacatcatggtgttcccggacagcgggcgcgtcaatgaaggcgggatccaggctcgggcgaatcgtacaaagctggagagacactcacattagaggttcggatttagcaacgcgattgggctccgcgcatccgcgagcgaggggcg

SEQ ID NO: 42681 - DNA, 9511 bp, Oryza sativa
gcggacagcggaggcgagaagacgacggctgtgctttccttctgttccggcctccgtggaccgggcctgtactcttgggcacgcacgcgggcctgcttgcgctgcgccgtctttccaaacttttctgggtttaccaatacttttaagtaaattttactttaggttatttcgctttaaaccatcttttcttaatagtactttgaatcagatttttttattttttttaagtactctagaccatatttaacttttttattcatctacattcaacttattataaaccaaagaaatagtcttacgtatacatgtgtgaaagttcattgataaataagagccaacataatcaagattgttcatatacctgagaaaagagtctgatgtttcaaagtgaaacatagataagtctactccgtctaattaaaataatattagttaaaggacgatctaaaataaaatattgataataaaaggtggctcctttctttttggcaaaaattgaatccatttccagcaatccctgctgttttagaaaagctgtccatgcttaactcgttcgttaatagctttgttaatctactccaccggttcgacagaaatgtcggtagatggtatgaatgctcgaggaaattcagcgtccttttgtcgataagtcacgatcatcaactgagagcattcacacgtgtatattcgtgtactagtaggctctgcatcagcttcgattatttgtgcttaaaaggaaaatatctacgaagttctaccgtaacgtggcacccagcagataatgggtaattcaaatgaccaatccgaatagcaactgtcaaggtaacatttcttccgttctaaaacaaacaaacataaaataaaatgctgaatagttatatatctatattcttatcataagtttatttatttttgaacgaaaaaatagttattataactagtcctaaaataaataaattataatatagcacatactaatactataacttttatctagatttttttagtattatagtattcccattttctatagtaggcgaagaatgcagacatgacacggacccatcgacgcgggacggcctggtgagatcatcctaggccccatccatcaatccatcacgctgggccgtctgtgggctgtctgtcggtgaccacgcccacgcagcccgcgacccagcgctcgtacggttacaggaagtggaggacggtggaaaaattccacaagagttgggggggccaaaaaggacaagggaaggaaaaaaaaaaagtcgccgatccgtttcctcctcgattgccggcaagcggaagagggagagcggaagcgaggaggaggaggatcgaggcagcgggcgcaacgtggcgcgcgctttgcttgcaacggaagcgtggggattataaaagagggggcgcgagatccagatctggcgccgatgcgccccccctccctgctctccctcaccctcgactccgcgctcctccgcatcgcccacctccacgacctctcccgcctccccgaccacctcctcatcgacctcttccgtgtaggtacccccacaccatcgctcgctcgattgatcccccctttgcccctctcgtcccgatgctcggatgcagtgttgtgttgtggtatttcctattattgtttatgttggttggtttggctgatctgtggcaattggctgcttagattgatgagattaatgagactaggttatatatgtggtacatcgtgcgcgcaattagtggaacttatcggattgggaaatgggaagaggtgatttgcaccacctgttttgtgtttagatttagatcatatcacacgaggtgcccaatgcggcccatgtttgattaccaagtggtctgatgatgctacgttgaacctgtcaattttgctgagaggatggatgggggtttatgaacatttggccatgagctggggtttagactcgtagttgtgatcctactcacttttttttttattattatgatagatcaaactgaaagtaatagttttgctattatattttgttaatctctgaaggcatctttgttggcagagaactatagctgccggtaagctgacagaaaaagtcctgaagttgtttctggcaacggattgcgaggaaatcgccttgcttgttcagttgctcaacattaagcagccgcttgtaccggtccttcccacgagtatgttattcatcagcttatctctgtctatttgattgtcatgtgatttatgtcaaaagatcttggtttttgacacgctatcctcttggctgtagggtgctctgagaagttctagaagtgacactgattaggtcagtcttggttacctgagaaaagatgtctttggaaattcaggacagtgaggtcgacattgtgattgcagcactccagcccaacctgactactttctttgaggcatggaggccatttttctctcggttccacatcattgttgtcaaagatccagatatggctgaggagcttcaaatccctacaggttttgatctcaaggtttatacgaagtcagatatgggagtgcttggagccacatccatcgacttctctggtcactcatgccgttactttgggtaccttgtctcacgcaagaagtatgtcatctcaattgatgacaattgcctcccagcgaaggacaatggtgggttgactgttgatgcagttgcacagcatatgtccaatctgaagacacctgctacacctttctttttcaacacattgtatgatccattccgcaaaggggctgactttgtccgtggatacccatttagtctgcgcgagggggttgagtgcatgctctcttgtgggctgtggcttcacaatgcagactatgacccaatgactcatgttgtgaagagaaatcaacgcaacacaacgtatgtggatgctgtgatgacagttccacttggtgcgatgatgcctgtgagcgggataaatgttgcattcaaccgtgaggtgctgggacctgtaatgttccctgctctgcggctgcgcaaggaaggaaagcacagatgggatacacttgaagacgtttggaatggcttgtgtgctaaagtggtgtgtgatcgcttacggtatggcgtgaagacaggtcttccttatgtgatgagaagtgatgcagaagcaggtaaggctctcgagagcttgaaagaatgggaaggggtgaaagtcatggacgtcgttcttcccttcttcgaatctctgaagctatcgagtacttcagttactgttgaagactgtgttaaggaactaaccagcattgtcaaggagaaactgggaccgcaaaatgcaatcttcgctaaagctgctgatgcaatggaggaatggaccaaactctggaaatctcacggagctcaaagcgcttaggctgaaatttggttatctgttatgagcatatctgatttcgatacccactgttatgaaactgaataaaccgcattcctgtatgctgggaattttctcgttagtgtacgctccaatactcgtgccgttttcaaagacaagcagtgatatgcaaagcaatgctgtgtatcttgtgtgttacatcaggagttctttttaatggtgatttcgttcatagttttcagacatctgtttccgtcacacgttcgtgggaatgacttttttcatatgaaatgcgcccatggctgcgcctgaaataattttacttgtcccgtttgggatgaatgaattcttttcctgttcgttgttcagtaattcacacagagtcataaacataccggtggaaacatgctcacaaagaaagaaacatcatgaagtcaggctaaggataagaatagccagcacacctagagcaaaattttactaacatcagatgcaagaaagtctacatgagttctaaaaaggaaactggggaaaactaatttacaccaattatcactaatagtacactaaatataaacgaccaagaagggctctaggaacccattttgtatctagcacccgaacgttgaacctttctcccgataaaagagggatcaggcgtgcaacagactggctctcacgccagggaaaccacaggtacaaaagaggcagcgaaagaagaaacaaaacttttcctccggggcgaacatatacaacttgagaggaaaaatacacaatggccgagagacaaatcacagtactgtattgatgtgcagtgctttcaacaacgaggtggccatttgtttcaccaatacctgttgaccgccacgttgcccatcccttcgttcttcgatcaggttttgtagcttttgaggaagatcattctcaactatgagctgctttggtcgaggatgatgctcatagacaacctgaaagcaattccaaacaatcgaacgttaaatcatggagttcaaactttacaaaggtacattaaacatatcgttgatattgagtaaaatgaaattctagacttatttgatcactgctagtagaaggttgatatattaaaaccatgtaaccagaaatttaaagcgaggaatgcaaacctttattaattttagcagtgtcaaacgggcaatagcttctcggtggtcaagccttgcaataagcagtgtcgttaaaccattggtagccattgctgtatttatccgagaagatttcctgtagtcaagtcaatgcaattgcatgtctcaatattctgtatcctgtcatgttcatattatataatgtcatcaaaaaggaaggtaactctttggtcttacgtgattatcttcaaaaaagcatccaatatatgaacaaaatattgttcagggcagtcttgaaaaaacttcactaatttctgaatggcatctttcttcaacaaggcttgttccacttttctgtgatcattgtcatgggacaagcaaacagcaattgaatctaacgcagtacacgcccatgcatcatcctccaataagttcaagtacacatccaatcctccatgagccctcaactgctctctagagttgcgagaagcgtgagccatatcacacagcagaggtaaagcatattgcctgagaggtgagtctgacatgacaaaattcattaagtgagggatgatcccattttcagctgcttgttcctgtcttcttttattgatcttgcaaagattgaacagagcattgaggacctaaaacagcaaaaaattgcatagagttataatgtgctgagaaatcgtgcagacctatttcaaattctgaatagccaactgtcttgacatttgtccctaacacaaagtttgcgaattccagaaaaagtgcagttgcacaagccattgtaattttgcgatgtcaccattcgtttttctactcctacgatcccaatgtaagttgtttgagccttctcaactctttcctacacataagctgttttagaacttctatgcaatttttcatctgttcttacatgtttgtcattgttaaataaatgctactacccgttttacaaacaaatgattcatcttttccaatgtataaatgaagggcatcaaagtcattttgagttcttttcttaattcttgtgcagaagtctaaaatcactgacatttggaatcagagggagtaccatatttactttataatatcatggttttgtctatttgattccagtacactgtacctaatgaataatgatatggttgaataaaatgcaagcataagttcactagtttgctcatctagactctgtttgtctgccagagataacataaactcttctttaaaaagcaacagaaattttactattcaaaagagggagaaaaccaggataaaaaacatttttttttaaaaaaaagaaaacgagtaagcatctaaaaattcatccaaagcaacaggatataatcacatgtgcagccaactccgtatgtttaaagcacatagcataagaaaagcctttaaaaagaaactacccacctcactatgtatttgataaactagagggccatcatgaagttcaagaatcggtatcagatgcttgattgcatctgtgcgctggagtgtctcgagacaattaggatcacccgacaaatgattaatgcacctaagaatctgcagaaaaggaaagatggttcaagaacagaaacagaaacacaaacaaatcagtcacaaagtagcaacactaagtcactaaaatgcttgaagttttaccttaagaagaataggcggttctatcttgttaaacatctggaaaagccgtgcaagaaggctttggctagacatgagagattttacgacagtgtctgcttgtgcaaactccaaaagaagatcagcaactttctcaaggtactcacgtgccacgtcagcactcatagataccatctgagctaataggccagatgatgttgtacttcccggtcttgcatttaacacccctgatccagataacacaccagatgctgtctgtgatgcagctccagatgttgatgctccctcattagaagttgttggacctgatgatggtgcatatttcatgcttggaaccctatttgaagtttttatgttggaatcaaggttaccattttctcttccctgtctagagacctctgcatgaaatagaaagaacaataagtgcataaagaaaggttgttccctcgtacctaaccacctcgcactaactacacacagtattctatagtcctaaatactgctatacgaattctacaaacagagtttagaacagtcaaaacaaaaactgtgtatattgggttcataaaaggcagatgaataaatagcccacatgacccaagacatggtaatcataactgctgagtgatgaagagagaggaattaagcataccagcaaattctgccattaacaagtcaagttcgccgttagttttcctctctgttgaagcatgcagtaatggcaaaatactttcatgcctttctagaccagataagtggcgaacataatcaagttgtccagatacatgccgagagggtggttctttctccaacaggctcagtaggggacgaatttgatcattttgaccactactatgcccatttgatactagctctatatgctttggtgatctatctgttgatgtccttcctgcagaaacactaagccgttgtggcctaatgggatcattatcatttctctccatgtgaccagcagccgccatatcggtgaatctaggcgatgctgaaggatccattatgatatgatgcctatctgcatctgcttgtaaagattgcagtgaaccagatgaatggtgatgatccagcctcgttttggaaatttctagcattggcggatctaattgaccagaccttcgcctgggggtggagccattctgtgttactgaagcaccagacccggagatggaagcaaaccttgttgcttcattcaagctatgaagagtattgaccagcctaagaagtatcccgttttttgccgctatgcgacagaagtcatttcttggagtcgaatgctggagtttgaagacctgccatatgccatcgattgcaagatgaaccatttccctgctaatttaaaatatatggaatacactaattagatataatcattaaattacaccacaaaattccaaagggagtgttaagagaagagtggactcacctgtattttgcataatcaggctccagaaaactcaccaatacagggatcccttggcatgcaatgaacatttgcaatgtcaaggtgctgaggatgcaaatttgaaaattagcccacaacgtttaattccttttatttgtatctaaatatagttagacactaacaattaagtcaaagaacaaacctggcttgacaaagctgctgaaggaacctagatgcttgcacccgaacttcctttgcacgatctggcacggcaaaattcataaccaccggaatctgcaaataaattttaaacagcacatatcaattccacgtcaacagaatttataagtcgtaaatagttatctgaataaatggtcttacaaggccaacaaggcaagcattttctaggaaggtcgtattatcttttactatttggttgatgagttgcagaacagaagtaataatctgcagggaaaacaatcaacttttcagcgtgaagatccagtaaaaaggttctctcaaacaaaagttaaacttcatacacggtttttgggaagttcaagaagctccatcagcggaaggaaaccattttgtgacacataaatctgtttttgctcaggccgttgattgaagattgacacaagcttttggcaagctgataatatcacgtcctcactttccccaggtttcagctgtgctactattttgctgtattccacagactacaaaaaaaaaaacagacaaggaaaaatacttcatgatcaagacatgataactataaatgtatcaaaacctaagcagcaaatattactgcaatttcaaacatacacaataattatgattgttttggggaaggaaaatacaaaaaacctttccatacattttaggcacagaaaacctgctttcaaaaaagatgaataaagtgttaactagcacaatctatcctcctacgtagacagtttgccagcagatgcagttggattctaaaacttctgcagtactctggatgcttctgctggaccttggtgctagcatgcacatgaaatgacacctaatgcaatatttgaatacatgagaaggcaaatgagtgctgccaaagtccatggcaaatgtcacttcttggttgcgtagctggacacttgatccatatataagacaaatacatactcaaacttaaaaagaaaaggttaagcaagagcattgctacattatgataaaggtacacatcagtcacagaaacatcagagctttagggcatcgcatacctgcaaaggaaaaagactctctccaggaatagtctcatcaaatgcctgaaatcatcagagttgtgtcacttattttatattctcaaaggtacaggcaaaataaaatacatagtactataactatattagtgaaagcaataccgttccatcaatatcttcttccctcaaacgcatgacatattcaagaagttttccaccattcatgtgctcagtatcattttccttctgcttctgagccatcctagtcttgagttccttcgcgagatcattttgtgcaccattgtattgaagctcttcaccagtagtggatgttgaagcttcagccccatgatctcctcgcttcttaggtgggaataaatcatcaaaggaggcatctccaggtgtgtcactgaatctacttagctcgttagccatctcaactgaagttttagcttcctgtcaagacatgaaacattcaacggcaattaattagctaaaaacagctacaaatgagaatatgcagaggtcacagatatgctcaaggctttgacagtgaagcctttgggggggaaaggcgataactgacaagctgcagatcaaaaatatgatctatcatacattggataaaaaatgttctcatagaaacattgcgccactctagtcatgcatgtcttaatactccctctgtttcacaatgtaag

SEQ ID NO: 42682 - DNA, 20957 bp, Oryza sativa
atatttaccatcactctttcttgattcttggccgctgctagttaacttgtttggtggaccatcttgtgatacctcatgagttagtttaccatttaaatcagttgcgcctagtgaagattccaatgatagcttctcatggaaaactaatgtaggatctttattaagaaccacgttatctttcataagttccacatcattcgaactactactcccagtagtttttaacattccatcatgaaactcatcaggtatatcttgcctggcagattcagaaaccaaatcttttcttccatcctcctaaagcaatgttaataaaaaagttcacattatgatagcgtaataatcttgtgagtccacaattttggactaatttcaaaatatgagtagaatatggcatgccaagaaccctgaaaggcatatatacctgttcaaggccagaagcagtaggtgtttgtgtatctcgtggtgggccagaaaatccagagtgattgtcaccacttgatccttcatcgtcctcatcaatatccctgacagtactaacaaaccaggaacttagcaatggcttatcaaggtcactttcgaaagacggttcaaaataattttggtgccagctatttgagagatcaattttgctgagattttaaactatgattttgttgggcaattactatgcagttgtaattcctggtagactacaatacaaggctatgcaaaatccatgtgaacaaccaacaaccaaaatcagcaacagaccgagatatgccgcctatgtcaaataaaataacactacttaaaaagttaaaagatgcaagtggcaaaatgctacttagctaaccacaaaatttaaacaggcacataaagaaaaaaatgggattatacgtatatgtactatgtaaaagcagagagagtaaaactataagaaattccagtggcaaacctccagaaggaacatctctcacaggaagttgcatctataactaacttaaacccactagtactgcaattaacccctggacatgtgtagttgtgtacacatcctacttgctaaacgaataactctagcaatgcttgaataaaattgaccagtacaggtttaatatgcagaatatacaaccattattatagacttatagtgatcaggtgactgaaaaatgacaagctatggagctatatttttctgttttccgtcctgtttgtatctttatggctattattgttggtttatcatttacaatgaatagcaattgaaaagaaggaggcagtaaatgtgagctaccttggtgattgaacaggttgtcgaagagatggcaaagctcgccttgagttttgcaaccatgggtgcatcaataatgtctttgcatcaggtctttgtattgaatcctacaggtgcttcttgaagtcagaacagcaaacaatttgataaaataatcattaaattctcaaagatatagccagaaacgacacagaaccttttgaaaacattgtcgaagaaaatcagtaatctcaggagataagccttctggtattggtggatgcacatcctattgtccatagataaaaactttctatgtaatcatagtctcatgtgtgaatggatattgtgacttttgaaaatgtaggggaagtaaacagctgcaagtaatcaacctgaacaatgcgaaacagcgcaggcatgggctgaaggtcataatatggtggggcacaggtgagtagctcaataacagtacaaccaacactccagatatctgatgcagcacaaacacctgacatttcgatgacctaatgcacaatataaataatgaacaaatacattagcatctcgcaagaaaaagtatgtttcagaatcacaagatgcaaataattttggttgataacgcttggtgtaatgctggcatggaaaatagcaataagttctatcctgttggcagtagtaattagcttttatgttgatagtactagtagaattaggagttaaacctaatcgattgattcattgaaacagcataagtgaagataattagcaaacctcaggggccatccagtatggagttccaaccactgaatgtgtgttgatatcagcttcagttaatttagtagcaactccaaaatcagcaagtttgacaaggccctaaacaagagattgtacattaatgagaacatgtagacaaatttggtacataactgcctatgaggtattcattccagcagttctctgtatccataatttctgctagattgctatatatgtgaatgagctcatctcagtgtaccctttcctaactcctgcatagtatttaatttgtgttctcatgttaacagaagtgcatgaagacgacagcttacaaggatgttattcaaaacatttttccaaaatttgtatacttaagatattccctttgcaattatctcaagtcatcacaaaaggggtaaatatggatgtgatgcagcaataaacctctttggtagtcaatatatttgcgcccttgatatctctatgtatgacaccttgctcgtgaagataaacaagtccttccagcacctggttcgatatgtaaaaaaattaataccggacatagcaaaaacaggaaagttgcaggtaatcatcatattcacctgagcaatgtagacggccaccaatgattcagggaatggcccaaatttgtttggcttgataatattggcaagtgatccattctccacatacctgcaatcatcccatgaggattaaaacttccaagctaaaaaaaaaaaaaaactaatagcctaataggtataatcatatcaagaaactgtcatgaggattgtgaactgcttactctagaatgatatggaggtgactccttgtcttcaatgatccaagatacttcacaatatttttgtgattcagattctgcgtaaagtggcagaacttagaattcgcagcaatacaattttcttgcgaacgtatatacatttcagatatcaagaaccatttaatttcaagtacaatagattatagacatgaccactaaccacagaagaaggaacggtatcatttttcattaaattttgggcatcagggcatccataggaacatgtagctaaacatttaaatagaagcttgttgggtgtataaaaataagtatacattgatggaactccaaaattttcttcataaatttgttcatgtaaggctatagctatagaagcataatgataacagcaacacttacatccaaagataaaggggaacagatgcaacaaaaacaaggataggcggggataagagattatttaaccagtaagatgtgttatttagttttttgtcaagtacaaatatgataagtaaataatgtgaaagaaaatgaagacttactttcaagagatcaatttcttgctgaatcagccacagcagcataccatgaacggaaaagtcacaataaaaaacaatttattagaacagcagactacagcaatacaatagaaattataaaatggtgatattcaaataaaatcttgacaatgaaagcactgaataagatagcacaatatggtggtaggataaaaaaagtataggatttatcaggttgtgctaaatgtcaactccaagcactaaaccatgcatgcaccaaatgacaaaaataaacaatagctcgtgcaattagttcactttagcaaaaagtaacaccaacagattaaacttctaaaattttttggtttggactcctttatgaacctcaacaccaacagctcctttgtaaattttagcttagcacatgttggcacaaataaacattaatcatgtagatttttcactgactttttcaagtttctttcctaagtcaaatagtgtttcaatattttcaccaaaatgtgtatctgtagttgaacctaccgtggccagattttggttcatggttcaagttgacaattcgatgattcacatttagggttccagcagagtgaataccactctagctaagaaatcagaaatggggtccgtgaacccaacatcgacacccaactctagtacaaaatgttgtataaaaaggtcaagctgtattacagctttccgtgggttaatgataaaaaggagaaaagggaaatgaatagttattgcctcctacccttcaaacccaaggcagtcatctccctctgtccttacctgcccactgaaaattcttctctctgtccaccacatgaaggtagactgataaacaagagaagtcacaaaaaaaaactgaagtagacattggtgagtgtagcaatggcgatggcttcagcaagcagcaagccagctgcgacaatgtgtgcgggaataaaaaattaaaaaggaacaagggtgacaacttcactgggcagcaaaatggatgagtgacagcagtggtcatagcaatgaaggggagaaacagaggtggctatggagaccaaaagcccccatgaacacaggaccggaggacaacagcaaggataaggtgtcagtgtgagcgttgatgggttcacaaccagatagtgaatcatactaagttttggcctgaatcacttcactgcagggttatcgtggctcacagtcattgccgcaaatctggtaattatgatctggacacaaacggaagtaactagaacatgagctccatactattgcattcgataaacatataacctaccacacaattaaaccagctattttatacttcctccgtttcatattataagactttctagcattgcctacattcatatatatgttaatgaatctaaacatatatatgtgcctagattcattaacatctatatgaatgtgggcaatgctagaaagtcttataacctgaatcagaggtagtatcaccctagcgtatctggccatgtgttcaggacttctattacatgcctggataggcttaggaagctgactagtgaataactgagctaacagaactccactctatgatttagttccacgtcacgctaccgaacaaatcgatatagcaaacaacaagcagtatttccccaatttccagacgcacttatccctgttgaggtcgctgctgcccgtttatcaactcccgacagccacatttcacgtaatcgcatacatcatcttttttcctttggcacacgttatgcatcataagaaaggcccaaaaagaaaacctcaccatgatgatgttgagatcctcctgcgggatgttctccaacgatacttgcttgatggccacgaagtctccattttccaggtcaagccccttgtacactcgcccatatgctcccttccctatttcatctccgagcatctgcaccggcccccacacccccccccccccccaccatgcacacagtcagtgagcgaaaccaaacccaaaattaacaccaccagaacacgaattccacccggatccgaggcggtaggctccggaacactcacatatttgttgtcgagcgtcttgttcttgtggaactgcgcattgtgctgccgcgacgccatctcgccccgccccccacacacacccaccccgagatcgggccccggacgccgccgtccgcggcgggggcgggcggatcgggggtcactggcggcacgggaacggctccggcgagcccgccgcgagggccatttaggttttagggtttgggtgggaagggaattggaggtcgaggcggaagcaggaggaagaagaagaagacggaggcgatggaagagagagagaaggggaggagagatggggggcttttccgtaattattttgttttcggggggcgtgggaatctaacggaatgagagggcggcttttatactcgggggtgtacttttgaagtgggcggaagccaacgaggatattgagagataagcggaggaaaccactgtcaattagctgtcctcaactagcatccgcgattttgtagcacatcatccggggccccctcgatttttctttccaaaggaaaaaatagaccatttttgtccgctgcttgcgtcatttcttccatggctttcttttccggtcattctctagtggcgtgtaaggagatttttatatttatttggttctactaggctggtttctgtcgtcggcgttgcaacagtgtccttgtgcacaagaacaaccttaaggaccacaaagactatagaataattattaaaataatagataatgattaatatatatatatggtcgactgataaaaagatggtgagtagttgtgtactatatagaatcattgttaataaagcattattagataagtagctggtaactctctttatttgttttccgcatcctagctcattctctccatatctaagcttccaacaataaaatgatgttggttgctttcacaatcatctctgcctcgaaattcaaaataaatggcatttttattaattatgtgactcaataaagaaaatttacatgtctatagtttggaagaaatcaactaaaaattaacggagtgttcaacttccatgataacctataggcaacaatatatatttatcatcacaccaaatcaccaatgtaacaataatggcagcatagagcttaagaaataatctggacgattttacaattggatgatgttggtaggaaatgaaggcagggaggggaagcaccaatgatacagcgatagagacacggcgcactcatgggtatgctttcgattggattttagtaagattatagagttgccgctaatttcgtctttttgataggattttagcaagatcatagttcagttgttgatctttgtctctttaagcgtattttggaagatttcttgcgggtacatgtgagcagttaatatgtgagcttctaataactataatttatcctagaatagattatcatcagattataagaaactatagttgtataattcataagctaggtttaatcataagctctatttagcagcttctctagactctcataaactgacgaccaaacaacatattcgcttgtgtagcaaaacctttcactcagcaagcagcttcttctctttttctcagcaacgcggtggaacacccatcatggcactgccgactacgtgtcggcgcgcgccaacagctaccataccataccatcacagcacgctaattgtacgatagaagtaaccctaatcatggatacgaatatacgacgcagtcaggtcagttggttgccacccacaatgtggctgccacttgaacatgttattcttgtccttgtgagtgaacttgaacattttatagagaattggctatttttcttcaatattgatggcaatgcagtttgcaacttaaagacatgcacaaagattcaagaacatacgtacactgacaagaaacattcaagaaagtacttttgctctctagagctggaagcagaaatttatcttgggtaaactttggaagtttgaatggacaaggtcattgatccgattattgtgtatataatataattgcatacactaatcacagtgggcatcctctagtgtctagaggaagtgttccaaaatctcacaacaattctttatttcagtcgtgccaaaatgaatagaaatcctcaactaaatagtgatacagcatgagcagacttcaaattgtaacacagctcactcgccgcttaggatagggttgatcagtggcttcagctgcgcaagatagacgattgcccacctgcagataagcattaacaaattactaccagaaaaattggcatccggattgtcacacccagtatggagcttatcaagcaaaagagggaagatcaatgatggaaccatcatgtaagcaaggcggcaatacaacgacaatcagatatcaaatcttaaaaaagaagccataagaaatatgagtgacattactccttcaataaactatccaggatatctggctctcatggacccacaaccaaagaataaacagacttatattgagcacatgcaggttacaagaaccaatggagtgaaactataagtcagaatcagattgagtttcagcgtacaactaataccacctgttctactttaacaagagttaatcatcagttcatattgctcctagaaatttagaccttgcaagattacctactagtcaataaaataatgtcaccattgtgcgattcaaagtagactacatgtagaccataagatgccaagttttgctggtagtgtgcttttcatgtttgccagcaatacttttgggtttcaattaatcaatcagcctactgttaaaatcatattttctgagcaatccagtttggatagacaaaccagaaagtgtaagtgaacaaatggatcagaacttacatcatccaacagcaaaccgttgctgtaataaccaaggtcaaatggaatctgcacaaattaaacataagttaatttaataggttagcaaaataaccacatgcatgtagacaaagctcaacagctaactgccatatttcaaacatcccagtattttctcaagacaaggtaatgataagaagacggtagtaatatgatagaaacacagccacacaatttagatagagtcaccatgctttgagaagaatattaataaaagaaagtgtgtgatacagtaccaataatggatatgaacgatgacgatattcgtcacatgaacatagtaggctagagatacaaatactcttagtcacgatcaaataattaagaacacaggctagagatacaaatactcttagtcacgatacaataattaaaaaaacacagtagtatattcggactcttttcttgaaccaatccttgaagacttgaaagacaggataacaaatcagcacaaactttatactaacccacagaaattgaggcaggactataccatgacattatgccatagttctcccaagatcagttataaatcgttcagtctacatatattaccctaaattgtagttctatgcatcgtattgaccctctacaatattcaatgtcatttatgccccttttttcttttctatgcattatacatagctattgaaaagtccatactcagaagtcaaaagggcaaagtaacgtcttcctgttctctcattcacaatgaaaataagtccatactaaaaagaggccattcttaatgcatctgactttaaactggcattgtagtttccagtcgaaaataatgcgtgagtgtgactgtgtgatctaatgacccatgttttcccggctccggtaattttgtccattagaacctcgtaatatgcactgaaacaatatcatcctacggcagcatgtgtcagaatctttttgaagaaaaatctaattggcatattattagagtaattgaaccactcgaattagctctgaaaagccaaacctggttacagcctaccaatttcatcttaagagaggaacatagggtaaagattgaacaaatttgggggttttcgcacgaagtcacttcttttactgaacatgggctaagatcagccgctacccccatcgatccaaccgtttcaaccgttatccgatcgaaaagacgacgcaatctcaacgagaaatctaccaatagaggaaatccttagccctacacaatacgcccaaatctagatcaaaaccaccatccggcgggtcaaatccgcccgaatcgcgcccgccccgatccgaaagctccaggcggcatacaggcgatcccaatcacaccacaccagatcagcagctatctgaagagaatcagcgggggggaagagcgtacaggttggtcgacggcccgcggttgcagcagagcagcgagaagagggaggcgacgaagccggcgaggaggaagatgagcgtggtcacccagaaccccatggccggcggaaagctctccgatcctctcccttcccttccctctcgatctctttcttccctcgggatcgctcgctgggtctcgtcgtctcggggcggaggtggggtggggagagacggagcgaagaggaacaggggtcagacgtgtagtcggtttaggggtagagaagacgacacgatgaattgggcccgggctccttatctgggccttggcctgttaataagtttgggcccacaaaactgtaaagaacaagtgggcccatgtgatggggtgcgcaccggtgttgtacggaataagtttagtttaggtctctcatgttgagatcgagtagctctgcttcgctccgggcgccgacttgccgatgaaggacgatgaaaaggaggtgcctttggctttggacatcaccatgcgtccatgcccgtcgagaagaagttggtcgtgatcgctccggccgccaccattccggctgtgagcgagaagaaaatggctgctgtggacaccgacatgccgagcagagtggctcctcaagccaccgacacacaagccgtggctcctccggctgccgccatggacaagcagaaagttgctcatttggatgtcattacgccaaagatgatcacttaggacaacgccatgtgaacaagcacatttgggggagtcaggataagctagatttaggttaacgagggtttattgtgtacaatagttagctattttggctgtgtttagttcgtgtgctaaattttttttaaatatacggacatacatttaaagtattaaacgtagactaataacaaaacaaattacagattccacctataaactgcgagataaatctattaagcctaattatttcatcattattaaatgtttactgtagcaccacattgttaaatcatgacgtaattaggctcaaaagatttgtcttgcaatttacatgcaaactgtgcaattggatttttttcgtccacatttaatgctccatgcatatgtctaaatatttgatgtgacgaaaaagttgaaagtttgaagaaaaaaagtttaaatctaaacacggcctacatcatctacccacagatttaaatgcttttttttatcttcttcttctaattttctgcctctttcttcatgtccactcgttttcataagaaagcaactagtctgacctcacgtggaccccacaatcatgttgacgaggctgcgttcgagcgcaggagaaagagagaaagatagttttgttttccacacgcacgctttccgaactactaaacggtgtgttttttgtaaaaaatttctataaaaaagttgctttaaaaaatcatattaatccatttttaaagtttaaaataattaatacttaattaatcatgtactaatagctcacctcattttacgcatcttctcagtctcctcaatcccgtccttctcgaacactcaattaatcatgtgctgcctcttacgcctgggagggagtgtgtcgtcgactatttagccacctgctccctccctctctccactcattttcctgccacctcactacttttgccactataggcacactacggtcggctaaactttcttactacgtattatacttgctctcatacagcggcgtggtgatttgctgcccatctacacgaaattccttttccagccgcaccgcatccgtgtcggagtcgatgcggttcccagccgtgtcggattcgatatatccggctcccggcccgtcaatgtatactaggcgaacttggaggacgtactgtactgactggtgttattatgactgatctgcagggaggagaaaagacaatggagtttgatgcaagctgcggagcaatgcgtgggaaactgacgtgttccgtcgtcttgacagtcatctccctctctctgggcatcttgtgtgcgctcctcagtttcctctggcccagcatatcagtggatcaccggaccttgggattgttgttctcggtcattttcctgatcggagccgtggttccagcttgggatcattacagaaaatttggatggtctgtctgcgtctcccagatcgaggagccttaccaaccgaagacgatgcaggcggcggcggcagcgccggattctgatcgtgatcgtgcggaggtcatcgcaaagtatatggcgttcgaggattccgtcgtcttcgtaggcaccacgctctcccaggggatcgtgtgtgcgctcctcagcatcctctcgcccggcgtatcatgggagtacagggccttcggtgtgcagctttcggggattttcttggtaggcgccgcgtttggaatttgggagcatcacaagaaattcggatggtctgttccacgggtcgaggagcctaaccaacaagaagtgaccggtgatgaattatgctgatgaagtattctctcggtgtggggttgaattgttgctcatttttggcatcaaattcactactccatttgtttcatattatataaaataataataatatttttaaaccaagacaaatatattcaactacagatttaatgaagctaattggatattgtaaataatacaatatttgtctacaaacttaatcgaacttgaaatagtttaatttcaaaaaaaatcaaaaagatttataatctgaaagggagtaccaaatacgagaaagtgcatcagttcgtgcgtgtgtgcatgcacaccaattttgtaaaagaccggttgtgatcacggttgcgaccatagctattctgtttggtgtagcttcatattttaaatccacagttgatttgaaatttatgtgttaaattatagtgttttaaaattttatatttcatcatgaaaataagatgattcatttaaatgatattaatgaaattaaacatccagatttataggtttgtggagctagaacattcaactccacaaaatctcatagaggtaattacaattgatcgacctgtactaccatctagaaaccagaatctgattttttccgttaagttagatcattctttctccttattaccatccagtcgcggtggctctgcgcacggactacactggacttcctgcttcgatcgggcgacacgcaagaaaaaacgccgatctctgcatgcgcttgctgttcctaaacgtttttgcgcgatggatgacttcgtgacatgctaagacgactaagcattgacgttaattcgttgcgctgttctaatatacacgttttccttgatgatctcagttgaatattattctgaccgttaagcataagatcgagcttaatttgttacgtacgtcaaagaaagataagaactttggggttaatttggtctttcaaaaacacttttgaaacccttaagatatcaagcagttatatatatatatatatatatatatatatatatatatactttctctatctcaaaataactcaaattatgatatgacgtgagttgttttattgttagaatccctatgttgttaaaaatgatgacaatatgaattaatatataatatatcacttcacctctacaagttgtatatacggtttgtgttaatttgttatgtttgttataatttatagaagttgaatttgagcctacatatttgtaaagtgatatattatatattaatcatcttgtaaaatatttttaatatttttttataatcctttaattaacatagaataatcaaataaacatttactcgattgattataacagtttccccattagggaggcaaagaggcggcgaagaagggggtctgtgtgtaggcggcgagctgcaggttagagccgaagaggagaagaaggaggttcggaagggagggatggcaaggaggaaagatgattacaatgggtgcagcaacaaagattgggggcaaagaggtagcttcagggaggaggaggaggaaggttttggaacaggctttcagggaagtcgcatggggtttgatccgggctatggttttgggcagcagggtagcttcggtcagaggtggtagaggcatggttaccgcctgagaggggctcgtggttttggcccaaggcgcagcagttttgcaggaagaccagggagagggtcagcaagaggattcaggtcacaacgtccagcttttgataggaaaatggatgatatgggaagaaagggagaggagaaggggggagctgctagctcggagaggaatggtggtgcaggccgggtgaaagtgggggaggtggaggtcccccattttaaagaagagagtgattctcactaaggacaatctagcaaaaagaaattggaagggcaacactaagtgttgtttttgtaaccacaatgaaacgatacaacatctcttctttgattgtcatgttgctagatttgtttggagtaccctttttataacatttgggataaatccgcctaacaatgttgctaatatgtttgggatttggttaaagggtttgcaatataggctaaagcaccaaatttttatagggattgcggcgttgttgtgggtaatgtggatttgtagaaatgatgtggtcttcaatggctccaattttaactcttacttgcaggttattttcagggggacgtattgggctcgacaatggtccttgctgcttaaagaagattagcgcgatgtgatgaaagaaggatgcaaactgttagagacatctatcatgcacttctttggtaaagatggatggaacatgagaaagcggttaaaggagtaatgtggtcgttagtttgtttggaaggtcttttcactttgaaaggcgttggaagtctttgtgctcttttagttttatgtaaggtgcttgagcctttgtgatccttttgtttgtgaacatgtgtgtatgaactgagcttgtttggtcagattttctgtggctgtatacacccccgttggtgtagaagccgggttttataaattcccattatctaaaaaaaattagcgaccccagcggattcgggcaagcgctagtagatcaagcctctagtctaagggtgcatttctcgttttttattttcagtttttctttttgttttttcctggtttttccccttatttctttcgatttttaacatatacatatatataaattttgtattcatgcgtatacaaagtttgtatacatacgaataaaaaaattgtatacgtggtgtttttttcttggttttcggttttttaaatatgtatgtatttatatatataaactttgtatacgtgtatacaacaaactttatatacacgtggtgttttttttttgttttcggttttttaaatatgcatactttacatacgtaccacctattactactaggactgcctactacctctactactacttttatactactagtagtagtactactacaactatactgttactagtagtaatactacactgttgtacataaaatttaatttatgtacatgtatgtaaaatttgtgtaaaatagggtagtagtactactagtaattatagtagtagtaggtggtactagtactgtactataggaggagaccgcgggggcggctgggcgcgcccattagcagtggctgcgcggctctctgcactcactgttcttcctgcagtcctgcttcgggggatcactgatttcacatgacatggttcacatcttcttcttattttttgaaacttaagcaattttattaaataaagacagataaggaggatatggttcacatctcacattaacaaaatgcgccgcttgctgtcacattccagtagttcccaggaccaagcagcttttcggctttcgctagatgatgatcgtgaattcgtgactcctgaacgcgcggccggcgaaaccgtcgtgcgcaaggcgtgtttcttcggagttcggatcacacgttcacacgcgaagaagagagaagacaaaagcattgacgtttgttgctccgttcacagatacgtcttccctgatgtatcatcccatttgaatatagaccggctcgttagggacgtgatatttgggggtttaaaattgatcccgctggactttacagtgcatacgcactcacaagtcacaagtacgtttatacatatccattccgaacacgttccagaagacgaatggtaatatgggattcgtgttaataattaccaagactcgttctatgtatctgagtgaacgtacgttagttcctcgaaggagatggggctgcttctagttcctatacttaattacatgacatgtcctaacagaattcttcaggttgaaggctaacttaaaccttcatattatactgctaacagccttcttccgggaaaaaaggtacacatccacatgccgcaaaaggaaagatagtttattcagctgttttccgatcaataaaaggaaaaaaaaatcattcatgcacaactgcatgcaacagtaccaaccaagtgaaatttgacgacatttgactctttcacaaagtcacccggctcatttttctgtcaacgaaacagaggattacacgagacagtgccgatctagcccaggagaaacaagggaaaaccacacctgattactttttctcgcggctcgcgggtacaaatactgggatcagcgcccgctgtatctgtccatctctcaattcaaatcacccacgtcaacagaagtaatcagccacattggcaactggaaatgtgtgagggcggaagggcagcagcatccatggctcgcacggcgagcgcgtcccggcgacagccggagacgaccagcctcgccgtggatgaggccggaggcagggcgtcgcggaggccgagaggatggaaagccgtcgggttcatgatcggtctctctctccttcctgtctgctcatgaattcgtactccctccatctcgaaaaaacccacctagtattgaacgagatattttctattgcaataaatctgaatataaaaaatgtttcattcaatactaaattgtttttttacagaggtagtactacagttcatgataagttcaaaatttgagccactgttttgttttttaaaaaagcaagaacaatttaagagtgctgctttgtgagctaatgaccaaatgctttttggtgtgcgtggaagcagggctctacctggcaatcgccatggcgttgaacgcgttcgcccagcccgtcaccaactacctcatcaaacgttacaacatgaagccgaatgccgcaacaaacgtggccaacgtcttcagtggcacctacagcttctcgccggtggtcggagccttcgtcgccgatgcgttctgcggcaggttctggaccctcttgttcggagccgtcgccgcctttgttgtaagtgatcagcattgcatccatgacccatcagaaaactatttaaaaattctcgaaagatatatcttgttatttatacatgtcattcaaataattatgattttttaaataaacaagataaatttatttagaaacatataaaatttaatttaatttaaatataagatgcaatgaatataggttaatttgtcataatcaattttattgatttttttaaaaatattttcataactattcggataatatgcgaataattaacgagggaatgttctggagagtttggagtcccctctcatcatccatctctcgcttatcaggttaagagacgaaattaatggctgcttatccgtgatctcctctcgcccatgcaggcaatggtggtcatcacgctatcggcgacgatccgtcagctcaagccaccgtcgtgcagcgacgtggcacggcaagccggcacgtgcgcggggccgtcgggcctccaccgcgccgtgctctacatcggcatggcgctgctcgtcgtggccacgggcggcgcgaacccgaccagcctgccgttcggcgcggaccagttcgaccacgacgacgcgagcagcggcagcagcagcaacgaagccgacgagcgacgacggcgcgccgaggagcccgcggggctcaagcgcttctacaactggtactacgtggtcaccatgatggcctcgttcatggcgctcaccttcatcgcgtacatccaggacaaggtgagctggggcctcggcttcggcatccccacggcgctcgtggccgccaccttcgccgtgttcctcgccggcacgccgctgtacgtccgcgtgccggccgagggcagcatcttctcgagcgtcgcgcgggtggtcgtcgcgtcgtgccggaagcggaggctcacgctgcctcacccgcgcgacgcgcggcagcaggaggccgttctgtacaatcctcccgtcgtcgtcgcagctggaacgggaaccagccgcgtcttcaagctcccactcacgttgcagctgagctttctgaacaaggcggccattgtaaccgccgacgccgacgagatacggccggacggatctccggcgaggccgtggagcctgtgcagcgtgcagcaggtggaggaggtgaagtgcctcgtcaagatcgtccccgtgtggatctccggcgtgatgtggttcatctcggtggcggagctgaccaactacacgttcctgcaggccctgaccatggacctccacatgggcaggagcttcaccatcccgcccgtgtcgatcgccgccatattcaacctcgccatcgtgctcttcgtgccggtctacgatctgctcgtcgcccgcgcagcgcagcgcgtcaccggggtggagggcggcatcacggtgctgcagaggcagggcgtcggcgtggcgatcagcggcctggcgctcgtggtcgcggccgtcgtcgagcgcaggcgccgggcctccgccttggacaacggcgggacgtcgccgatgtcggtgttcgtgctcgcgccgcagctcgccgtgatgggcgtctcggcggcgttcaacatgatcgggcagatggagttctacaacacggagttcccggaccagatgcgcacgctcgccaacgcggcgttctactgcgcgcagggggcgagcagctacctggccacggcggttgtgaacgtcgtgaacgcgaggacgaggcggcgcggcggcgggcagggctgggtcgccgaggacatcaacgccgggaagctggaccacttctactacgccatggccgtgttcgcggcgatcaacttcgtctacttcctcgtctgctcctacttctaccgctacaagggcgagccagaggtggcggccgaggactcgccaccggccactccagaggccgtcctcctgaagcactagccagtagctagcaagattggttacggtagatcactctatgatcaattaattcgatttattattggtgtgattaataataaagttgccactactggacgcatcgcgtttacggcccatataaaaaaaagcccatacaacctgtcacgtgcctgacatggctacccagtagtcccagtacccacaaatggaccgcttatatgagccgcaaaggccgtgatcgaacggctatcagatgccttgtatgatgatactatgatctgatgagtacttcgtagtctgctgtacgatggaggcatggagctgaaggggatcgacttcctgtgttcgatctgggacgcataagcttgatcgaaccgtagccatatatcccaagagggttcggagatttactctccgaatcctcaaaccagcaataatatcgtgactgaccgagccggaggctgtggccctgaataattttccgtttatctgggccgcaaatggcatgatccaacggctgtcagatgtcccaaggagggtcggagtttgaaacgatgaccccaagaacaccatctgaaaaacgacagatgcaaggacttcactggtgagtaatgaggatgcatgcgagatttacttcacatcataaatggcatgcatgatctgaatatctctgatgataagatgatgatcgagtacgggtcagctcgttggatggcggatggcctcgccggcgccgaccacgaagggacatcgtggacgtgcacgatggccgccggcggcatctcttgctgctccgccggcgtggacggcgccgacgccgattggttgcagtctgcagtcgtccgcgtccgcggtgattaagtttagtaatgaagatgctcttgcaagatcgatcagaatgatgagagctggccgcatcccggccgtccatgctgaggtacggtgcacccaacggcgtctgggtcgatgtcaccggctccattcgtctccagcgccggcctgtcagagtgagatgccagctgcaggaggccgtccgtcctcctgaagcactatctagcaagatggcttcatgctcttgaatcttgatcatgatataattaattaatttctaaatttccagtagatgtgatcgacataagaagctatcactaatgaggatacacacgagatcgatctagttacatgatgaaacgatgagtatatagttatttagttagttacatgatggagcaagctggagggggatcctgctggtggtagactacgctctggtcgtactcgtaggatggccacgccggagccgaccacgtcgaggcggggatgtagtggacgtacacggtggccggcggctcaggcgccctcttctccgcggccgccgtgtacaccttctcctcggccgccggcgcctgcttcttgatctgctgctgctccgtcgacgggttggacgacgacgacgacgacgacgccggcggcggcccgatggtcacgacttccgcgcgcttcccggccttcctcgtccgctcgatcacgtccaccgggtccgcgctgccggtcaccgtcatcgttcccttctccgagtcgatatcgatcttgtcaacacctgatcaacatggacacatgtcacactatgcttcacattctttttgcactttgtaatttagaatcaacagttcatttgcttgtttcttcgatctgttaatgcttcatattagtatatttgtttaaaaatatatatatgatatcgttgacttatcacataatatttgactactcgtcatatttaaagaataatataaatacaattagatataagttaaaattatagtattttctttgatgataaaaaagtaccttggaggccggaaacggtttgcaggatcttgcgcttgcatttgtcgcaggaggtgtccaccctgagcaccgtacttattcgacatggacggactggtgcgagagagctcagctctcccctagctgctacgtatccgtgtagatcgagtcttccacgacggcagagccgtgcatgccggtgtagcgggtgtctgctgccgcggtc

SEQ ID NO: 42683 - DNA, 3928 bp, Oryza sativa
gcattcggatgacctcattttagacatttagcgcaacaaatcacaatacgcctacactgaaaatactccggaaaagaaagtacagaaacgactaacttgccaggccgcactaggatgtcagaactcagatcacagattcacagcaagctgagtatacggtaatttatcatagatttccaaggcaaacgtggatgcctcagtctacagtttattaactcttcttaatgtttgtctactgaaaattcggcctactgctgaggcaaaccacacggtatacaggatgtactacaacaactaccactctcttacacgttttccctaaaagggaggagaacctgcacattggacatgcacacttgtagaaacacaacaatcaccaagatacaacagacacttgtcctatgccctttatatttcaaggtcgtcaatgttggagctgaacctttggagctgaacctttgtgtcacctagggccacatccctttggaggatcacgtggatctcccccaacttctccatttctagtgtagaaattgactatcttttgatccaatttaaagtaatgtaccatcttatccaagggtttcacatccagatcaataaaatatgcctgcaacaacaaatgtgcaaatcaatgggttggtgggaaagaaacattaataaaaagagtttttagaaagaaaaaaacaattgttccacaaggaactagatgacttatcgaacttctcaaacaagaaacatatcacatcaataccttgtaatcatagctttggttcactgaatcaagaaatacagaatcgtactcagaatctgttgttccactctgtcttggtcgaaagctgatcattaggctacaatcttttgcagtagcagagataagaaagtccctgacaatcttctcactcttgtccaatggaagagaatgcaaggtggagtacttgcgcagaagttctgtatcagttatacttttgcataccaaacaaggctgagaaatgatgttatagtacagatgaatcgccccttcgatgtcatgatcatccagtttttgagtggctaaaagtttacccaacactccagacttaaagattgcctctgacaggagctcaataaagtcagatagttgtaagccagtaaccttgctcagatcttcaagacatttctctgtttcattaggatgaacactatctgcgccacctcccatgccaccaaaaactaaagaaccatccacaaaaattctaaagttgttctgaggagttgaaaaaaatgacttgatagccatatgtattctttcttttgatccagaaaataaatctaggggatcgtattcacttgtcttcgatatctgaaatgtgtttaaaaatatgtttagaaccaagctgatttgaaaagcaaaagggatgatatagcattgcaacttccaagagtgacagaatgaatatgaagcatctattaatatctgtttcagctagaagagtagtttgttgtctttcagtgagcaaaagagtagtgtgctattatatatttagtactcaaaattatggctgcggtgaaatcaaaatctggtacccaaaaccaacatacctctcccagatgaaattttaggtgctgatgcatcttataccgtgttacttgtttcttgatagaattctccttcgatatgtattcagatgacggaagaaatccacattttgcctggaaggcaaagcatgttaaaagaaatgtgtacaaaagatgaacagtgaagaaataaataaagctcaaaatgtacctttatctccactgctatgcaactgcttcctctaggattacctgaggtttagaaaaattaccaaaaacaaacatagtgttaaaaaacaaaatctagcagcgagttacgaataataatttagcaatggcgcaatgtaaaaaactaccgaatcatctttaatcattcaaactaatcaattttggaccaactaccaattttaggacggaaacaagctcttgcggatggaacagatcagagttaagctagaaattcgaaaaaacaagcaggttctttcattctttccatgtttcagaataatggagaatcttgagaaatataaattgtatgaatccttccaaacatatcccaagtttcacaagtgtcatggagaaagttgggcttaccaatcttgatcctatctatttggttgtagactagaaaaccataaattacaaacttgccactcttaacaaacaaataaggttaaagcatgtgatgcaaatagaaataataaactgagtaacagtgttgctgcaaatgttatatcataaagagttaatagatcaccagacctaactgatatttgctctttcttagtacaaacaagagtcacattatactcaaaagggaaagagatgaagcgttcaaataacattgaaacgccaagactttaccggaaaataatgtgtggtcagaaattagaagagcagaatcagctccagcatcaattgcactagcattcactctccatgcaggacggttgtcaagcacattctttccagcaagctcgaaaaagttcttagacacacgtacacggacctgaacatgaaaaagagaccacgtttattcattttagtcaagtggatccaattatctaatcaaggatgtattttcaaataacccgaattttccattaattatagagcaaaagaattttaaattggaaaacgttggttgatttatttctaataaatatcaccgtaacaacattaaataattggatttaaaacataccccgccatcaacatgattggcacccaaatgttggctcataacaattgtagcataagctttgtggcaagcaatcatttttaacagatttcaaacaatcttggaatctttcccaaaaattttcctctgacttggaagaatttccggttggggccgggtggcccttgtctttaaaaatcttttgactcccaaaactttgccacctgttcaaaaaacatcatcaaacatttttcctgtaaacatatcatacgaggaaacataatactttggtcacaaactaaaaattttagtcaaccaagtcaagataagattattttctctttttcctctcttcttttaaaaaacagaagaaccttgctctccctctttccattacaggaaacaacaatgttgtagcaatacagcaaaaggaattgaacaaaaaaacaaaactagaccgggcaggcagatcacacaactaagatggcgccgccaccaccccttctttttgtgtgatcacacaactaagattattttcttttgaattatataatattaaagtgaaactatttgactacatgaaagctgtatgggattttctaatttacatatacaaacatttgccatttcaagagtgcagctctggccataggacatgcatccctgggcgttgcatcaaagttggtaaaacatctttttggggggaaatcaggcattcattaaaccggctttgtgaggaaagccaaacaaacagagtcttataggaaaataaaaacagctagctaaactaggacagaaacgactagacaccaactgctgggtcctagctagatcaagcacaaggctacatctccagatcacctcataaaacaccatccaaaacatctcatgaaaagagcttgaactactgtcgcctcccagacacccaaacattcatagctataatcatcagaacatcaaaagtaaaacatccttcttgaagcacatgcatcaaattcgccgatttacgggagactataggtcagtaaccaataatgacacaagcagaacctattcgatgcataccatagaaggtgacgagccagtgtagctgaggattagattcgctgcaccttctcctttgtaaacccaatctttggcatccccctcatgcagaaccacctccatccccacacagaatctgcaggcttt

SEQ ID NO: 42684 - DNA, 15565 bp, Oryza sativa
  unsure (1)..(15565): unsure at all n locations
attgctgcttacgccgagtaacacagcaaactcgagtccaagtgcaggtgcattcatttactcatctaccaaagagaagatcaagcgagaaagaagcaacacttggttcctggtcggtgcggcattccgtcgagcagatagcgagctttagttgcttaccagataacaacagctgctgcggccgtggggatcccctgcagccctgctccggcgatcgccgcagcagcagggcgggcgggatgatgcagcgcgctccaagcctccagctgccaatttcctcctcgtcctcgaggaggaggaagaggaagtggaagtggagccgacgatgaggaaagcggcagattcccctcccctgcaaggaaggattagcaaggggcaggaggagacgtggagggaaagtggaagccacgtggacgcggtgcgggcccacgtggctcgccagctcacgacgcgtatcggctacgccaccacacgcttcgatcctcgccgtcgatctgttcgagcaacgaacggcgatgggcgcatccccgcttgaacccggggcggcgcgtcgccgccccgccgcccgccgccgcgacgacgcggcgatgcgccacccagtgcatgtcgccggggctcctggtggctcgcgcgcgcggcccgatgcgccgccgagacctgcggggccggccacccggtgcgccgcggcgagaccggcttctagccccgcccgacgccgcgacgccacgcgccgctccaccgcgcggggccggcccaatgcgccgcgagaccggctgctagacaccgcccgacgcctcgacgcgacgcgccgctccaccgcggggccacgcccgacgctcagcctcgccgccggccgcccatcccggccaggccaggcccttccgcgccgacgagtcaagaggaagatttggggatttgggggagagagtaacggtggtggtggtgatggtatcggccgaatgttgatgggcctgtagcttgctaacttgggtttcaccggcccattcggctcaaccctggcaaattctaagtttctacttggatgagaaagctttatctctctgataataatcataatcataaaatcatgcgatttcaacgccaaaccaacatcgaacgaaaaaaacgccggaacctacactgccgagtcagattcaacattttacgtggactaattgatccccttacataggaatatttgaaaagacactcgaatgtaacatttcaaaagaacaatgcaaacattatctgaaaaaaaaaagaacaatgaagttagacgaggggaggcgaggtcgaagctgaggaagatcggtgctcgacaggccacggatactacaaacagcaatatagcatgtcaagcaagaccagttaagacaaaatcaaggggtttgcacccaagcaaccttcacaggacggtgaaaggaatcagcatttttcctaaaccaattgttttgctcttacaagatgtacggcctgatggttacataatctattcccagaatgttacacgacgcacaacaaaaaagaatgccgaaggaagcgatactctaaggaatggcaggatctgacgaaaactgcagtacagagttaaggtgcaacaagttttcaccccgggtctataagagacccaatttgaagatgtcgccaggaatctctcccacggctttcaaaatttcggtgtcagctctccaagttggatagctcatttcaagataggatgcaattacatcagatgatgtgcatgcctgtaatatctattgatgtactttgcctgcaatacagtagatacaggagttaaagccaagacaactatatgcataatcaactgttccaagatacacctgagctgcaatgtcacatacctttacgttgcttacatcaggggtgtctggagtttttacaggataaaatttgtaaaatttgatattttcaaatgcctctttgaccttagggtccatatcatcaatagctttctttcttgcttccttagcctgcataagatttggagaaacagttagtacttgaatgcattaaagtatctggtgaaggcaattaacatttcgtttgactatgacctgttttagctctcttttcctttctctaaccctctcctttatgaattcctgttaaaagaaatgtgtcagcagttaggaaggagtactcagtgaggtaattattatagactgactattcttctgacagcttaagcaaaaaataagatgcaccttaaatttttctttctcatcctctggtagcacctcatctttaactttctcatcagcaaagtcctgcattgcaacagaatgactcaatgcaggtgcctttcataggaagcatcaagcaaaacaaccaaattagtacaaacctcgtaatcatccatctcccagtcgaagtcacatactatctgcaataagcagtacaatgtgaatacaaaataatttgatgactgctacgttatcaacattggaggcatctaggtgaacataagcaatacaagtaaatctaataaatatcaacattggaggcatctacgtgaacataataacttcagtgtttatatcagctaagaaccaagtgactcaggctacattatcgcttcagaacaatgaaatgtttgtatcaatagcaggaaataaacactgcaactaagcttccatccagtgactcaatagtgatcctgtttggttcgaggaatgaaatgggtttgtccatcacctcattcctcaaaagcaaatgctaagctattggatgaggaatggagccattcctcagattttgtgggatgatcctatgatggatcgtcctgtccaagatggttttcatgtggtgattcctcaaaccaaaacaacctgtaagtgaccagcctgaaagatcaagactgacatgattgcacaactgcctaccggtcaaacttgagtgtaggtggcatgaaaacaccacatgtacacctatgcaattatgctgacagactaagcaatgccataacgccagcccagcaagcagcaattattcgatttagagggaaacaatcagtacgtctatgcaacagcaattaagagggaatttataagcatgtggcagcagttaggaaataatcatcctggagcagcaatcgtagaggaaaacaatcagcacacagaagcaattaaagatgaaaatagtccgcatgcagaggcaactagaagcacacataaataaaccaaaataggaaatattttttcagattaatgaagcataaagaagtacacatctcctgactcaacagacacaagacaccaaacttcagaagcatccaactgaaaatagtgagggtgacaacaatacaacattgcaggagtgctagtgcgagaaatgacagcagcaaaagtcacgatttcatagaagtaggcaaggggaaccagcagcatgtgggttggttttgacctcacaagctaaggcaaatgaagcaccacagacaaaagaacacaaattcataactggcaatcatgacatggatgcaagcagcctagagatgcatacaaataagagaagatcaattcttagctgcaggaaacagtgaaacacgataaattttatcttctcacataggccaggtgcccaggttaacaatgcagtttatagcagtggagaagatacagctgcatctgggctcttccctaaaatgactagctgacttaatgaatcccaaatataggcctaattaagatcacaatccaagaaatttattttagttttgcccattacacataatattttaggtttgcactaataagatacctccataaaataaactaatagcttatgttgaggaaaatttattaggcaatactggaataacaaaaaacactaagagaagattaccgggggttctaggggatatatgatgttgacaactgtatcatcttcgtcttcgggagggttcagtggcatataatctgcaacaacattaaacgagattcatttgcagactacatcactctcagccattttcataaaacactctgcatcatataagtgtaacaatgtaaataaaatgatctgatcaaccagttgagcatgattgttgaccttgcgccatgctcacacactttataacaagacttacacagtgtgcctatgtttgtgccacaattgctacattaaaggaacaaacaacactgaaaactggctcactacagacaatgttacatagctggaaagaagtgccttcctaagttaacacaggatatgtaaatggcatcaaattattatattaaaattaagtactaaccatccaacgcaggcaaataagccagctaaaaagcttatcaaagtcaaaaggcatggcagcaatagcatgtaaatatatctagcgttcacccattccaatgaaattaacaaattgtcatacagaaacagaatggaaatgaattaaagaatgactagtaaaaagcttcttatcccatggcatactgacattgcaaccatttaactaagacatcatcgatgtcttgcaggatattttgcaattggactggaccaagccaaggaaccacactcaagttaacaggcactcaaagaatcctatgaaaacagatatttgtacacacaaaacaggccaacagaaataatcccaagtcagcttacatggcatgcagtagtcaaacaatttgactctctcagttttgaggtgcctcagcgcagacctgcaaaacatacaaatgaggatactctagaattagtcagaaaaaaatctagggaaagatgttaacagtgaatttatgttgcatgcttctggatgataacgttccaacaaacaaacaaaaataaaatagaaccagaaatgccataaagcattaatcgcgagtaaggagggaaaaagcatgaattactaacctccgctgggtgcagccaagagtaaatatttttgttttcaaactgtcaatcctactaagcctgtagaccaacaaaaaagaatgagtaaaacacaaagctgcatatgatgattggtaaaaacagaagccattaatgagggagcaaggtaaggatacaggttctcaaaagaaatggtaagaaatattgttcagaattaatagtatgggagtaccgatcctccagcggaacataaggcacccaggccatcttcatggccttcattggcactatctcttcattttccctttggacagaatttatgccaattttgtctgagggaggaaaagggcagtcaacctgcagcacagaaaaggtagcaagtgctaaatgagattcaacatgaggcaagtaaatagtaaaatcagtaatatataaacaagtcaactgccaatgacgttgtaaccataaagtatccaaacaatgttttccaaattgcactgtatactcaattttaaagaggttagggttaaagagcaaacaaacaaattccagagtaaaatagtgtgataaaaaaaaaagggggcattgggtaggccattactgcagtgttctaggctatgctgtgctgccctgcccagccctgcggcacagcgtatttggctgctgcaggaagcagccgcttactgctggcaggctgcagcacctgtagctgctggctggctagctgcagctagctcttccaaacagcgccaaggaaattagtcccattggcttttatgaaactaaggtgactatgtttgtactggcatctttcaaaaatgacagaggtaggaagtacaaacatagtcaccttagtaaaatcaacttgttagcgatggtgcataaacgggataagatgttgagttggcataagcatgagataaatgttcagatttaagagtatttgctaaagtggactgtttcctcatgcaaatttccatatcaagagaatggaagcgaacttacagcaacaactataggaataagcactatctttgattcaccattaacctccaatagttgagctgcatgtcagcaaaaacaatttaatcagataaactgtatcgatgattattaaacaatctggcacatcccaagaacaaatgaaaatatcagagacaagaaaacatttttccacgacaacacccaacatatctaaagtgcacatggtaaaacaaataaatgctgataccaatcaacttaggaaaggcagtagcaactcgaacattgacatggaaaaacagcataagaaataaatagaagtatggtcctaaaggggacaatttcattgttggaaatgtccagagaatctttcagtaatgacaaaaacatgcaagtgtatatctacaacaatgtgcatctaagttcagagaaatatataattttctcagggtgctactgcagtcataattagtgaatttcaggggaacaaacaaactgatagatttgatatttaggcctgtcaggaacgtcaaaaaagaaaaataacatggttcttgtgggaataactatttctgtgaaattaaaccattcaaaacaggccttcaagttatatgtcataaagtacacaaaaaaacaagctaatataatcagtttagttcagttactaaatgctagcaagccagtaggagaatatatgtatcacgaactggagatttaattttaaaactagcacgagtatgaaaacttacgctccgtgcttccaaacaagtaaactgttttcccataaagctcccctccttcttctagtgctttctgctcaccaacaggaaaccttatgtcatgctgaaagcaagtgtgataataaaaaaagagtagtattggaatactatctgcccatcgtacctccaaattttcaaagttccagttgaactcctttatcttatcaatgttttcccactgcagatgagaggcccggatatggataatagttagcggagcaaatatccatagtacacagttgaaagtatgtcaaaacatgcatcactaattgactcagccataaataaaaaagaaagaaatagataggcccatagaaagtaacaaacctcggtcccaaccggaaatgctgatagccaaagatcctcctgaacacagtaacacaatattagccataaaactataagtaatcattttgcctgtttgcaaagacaaactgattatgctcaaacgttccttttatatccatcaaacacatttccaaacaattaattgccctagaactgcttaaataaacccatgtgagttttcattgttccaataatagctcaaacttcacgataacaaattcaagtaatcgtttcatatagcaaagcacttcacaataaaaaaactattcctaacactgacttagaagaacataaactgtacaattcagtcccacgcagatgtggctcaaactctacaacataacattcaacacaaaaactattcctaatgaaatggggagcccctatagtccagccaaatccagtcacatattaaccattcgtatttcaacatcaaccaccattaccatcatttggactaatccgaccactacgaatctcgccgcagaagcagcaaccaaatacaccacgcggtccacaacgccaaaacgaatccagaccaatcaaaccccccaacctaatcggggcataacgaagcgaagcgaagcacgcatccgagacaggtaatcggggaagcctcctcctcaccagattccgcttctcggggaagtactccgtctccggcttgggcttgggtgacgccttggcacgcttcccccgcccccgcgcggccggcttcttcgcctctgcagcctccggcttgctggagtcctcctccgccaccgccgccgccgccgccgcacgcttcctgcctctcggacgcgccatcttctccctctctctcgattgctagggctagggtttcagcagccgtttcgattggggatcagtatttatgcgttcgaggggtgggggtgtgtgcgatttgggggaatcggcgcgtgaaatcgacgcgatccaaatttgaagcggggttggagaaggggactgcgtggggtgggggcgggggaggaggaaaatggtgggcggcgcgggccgcgtgcgtggctgtcttgagggcttcgaggaccgtccgatccgttttggaagatggttctgagccgtcggatttcagggtaggtgtgatggtccagagagggcgagatggtcgacgaccagtgtgggccccgtggggaagtggaaagcaaaacaaaattgctagtgccatgacatgtgggaccaccaggctcgttcaaaacgtggatgcctccatgggccgtgttgggctgtcgggcctctgcatgaactactgcacattatattatgagagtacctatacatctttcgaaagatttttataatcgtatcacacagatttttaatctttgtattaaaatccgatagatataataaaaagaaaaaagcaattaagaaacaccataatgaacattaaattaccatatcctcaagaaaaagaccaaatcaaatacaaaatttaaaatttacatgtgaagattcaaaaattacagtgtaacttacaaaagttacagtgtaagtttcataaattacactgtaacttacaagaaaatacactgtaaatttgagtgagaaaatcgagtgagagataagaaaaaatctttcaaatgagatatagcaaaatcgttatattattacttttgggcttacagtaatacagtactaactactagtagcagtttatatctaaaaggaaaaagtacactttgactccctcaactatcgcctgagtatcattcataacctccaaccacaaaaccgggaatatcgaatcctccaactatcgaaaccggtgcaaacaatgtccctcggtggttttagaggtggttttgtctgacgtgacgcccacgtggcagtcttgaccgattctttgtcctatgtggcgcttacgtggcattagaataaaaacaaaataaaaaaaatatgtgggacccatatatcattcacacaaaaaaaaagtgttgtgggaccactaacatgtgggacccacatgtcatcctccctctccttcctttcttcctctcccctctctctcccttatttctctctcctctcggcctttctcttggccggagcggcggcatggacggcgatggggagcggcagcggcggcggtgggaacggcggcggcggcggtcggaatacgcccagaacctgttccccatgagtccacgacggtagaccacgcatatgcatcgctgggctatataaaggaccttagctagctcaccaactcgaacctggtgttagctttggttagttcgtttcgttcgtgtaggaggagagaatatcttcaagggcttctcgtctcgtctcgtgaaatcctcatggaggtacagtgcagccccatgtttctcttccccatctccatgctggctctccccgccggagcgctcgtcggcgtccccggtgccacgttcgtcgccatggtggcgccgggcggtggtgcttgtgcgatgacgacgaccgcgaggcgcatggtgctggccgcggcgcccagcgtcgcgctgcaccagggcggtggtggggggccggccggcgcatgccttcgccgcggcatcgtctgcttcaaggcgggcgacactccgtcatctggagacgacgaggctaagttatatatccaatccaccggccaccgcgctctttgtctttttcttttgcgcgatcaatgtcatcgacgatgtgtggggtgtgcgttcttggattgttcggcgcctagccaagaatttttctgccttggcgagggcgaaggtggacggctcggggctaaagccggtgcggcggtaggcgaagcggaagaactagagggcgaggtcggcgcagccggcggcggctgccccggagatgacgccatggacgagcggcgcggcgagcatcgaggagagcaggcggatggagttctcgaggcggcaagcctcgtccccaccgcaatcgccgccgctcacgaccaccgccccgtcgctccccaccgccgtcgtcccgaccgctccccgtcgccaccaccaccggctccgccgccgccgctccccaccacctcgtcccgaccaccgccgctgccacttcgtgccacccccgccgccgcgctagccagtcgtcggcgactccgacccccccaccggggcggctcccctctcgtacccctccctccctcccgacggccgcgggctatagccgtcacctccaccgtgcgttccccaccgtcactgccgccaccgccgccgctcctgaagtgagagagataagggagggagagagagggaggatgacatgtgggtcccacatgaatagtgggtcccacttttttttaatgacatatgggtcctacatattttttatttttgtttttattctaatgccacgtaagcgccacgtaggacaaaaactcggtcaagactgccacgtgggcgccacgtcagccaaaaccactgagggacattgtttgcaccgtttttgatagttggaggagtcgatatacccggttttatggtttgaggttatgaatcatactcggacgatagttgagggagtcaaagtatactttttcctatctaaaaatgttgagtaagacttcgggcctattcagattgatggcattttcaaccataccattatttagtaaaattgataattatgtggctatgtttagtttgttaccaaatattggtaatgcatatagaattttggcaacattattaagccaatcctacaaaaaatttggcaatgttgccaattcgccaaaatttggtaaggttcattttagcatcaatccgaatagccacttcatatctacaccattagcagtttaaaagccaatagccaatgctaaaagtgcactatgataaaaagaaccaaaatcaaatcaaaaattaacttttgaaatctaaattttggctaatgagacatggaagcaccaatagatattgaaagaaaaactattgatcggtattattgctgtagttatttgttcctttcgtcgatgaaagtacaaccacccattttccacactttttcatattgacttaagtcagcgaattactcgcggcgaggaggagtttagctttgagagttggaaaggaaatagggcggtgggtaaggcctatttcaaaattttattggtgggtggtactatatgtgtgactgaggtccatcaaaactgtaggtgcattcgtctaaagggtagacccttgaattcactttgcctgctttcggcaattgcattcaactttacctgtctgtggggctttgactatggtgactcctcctttgactctaacatccgctgggtactttactttactttgcaggggaagatcatatagatatcaactcatcgacgaagtcctaggggctccctggccggggaggtaaaggggattgctatcatacatgataagctaaaatcgattatgttttgcttatcatatgatatgatatgagaggctaatattgattatgttttgctaagcatgtctaaagttagagttgttgttgtaatgtacatgcatctggtcatttttatttgatgcaactaaacttaactactcaactcttttgacgtaaggtaaagaataccaggaggaagtatttttgaaacactatctttcaaagcacaatgttgttgcccctcccttggaacattttgaatttaaagatgtgtgcaagctgaaaactaggtggataggaaaatgatattatcacaacaaatcaaaataattgcctgggtaggttagtcacctgaataacttgaagggtgtcaacgtttagctacacattgtccatgttgttctacgggtaccaattggttagtaaaaaaaactttaaataaatgactctaagatgaataaataaataacgtgaacttgcaaccaattatcaaaagtgggagttgggctagtaatcaatactttcactacacgtactttttacaagcataaacaaaaagcgcaaaaataagatatatccaaatttctaaccttcgatccgcaacgaagttttattctaaaaaagcgcggggacttcaacaatgatcctagctacttcaaggcgagcatcttctctcaagcaccatggtttgtatttaggtttagatctagagtcactctatctcgatactattagaagacctcacttttttgggaggaagggtggttggtggaggaccggcgatgagtggcggtgctttgcccatagagtcgagggatggaagcaagggcaacacgagcaagagatctagaaggaggcaggaaacaacaacggatctagtagtggcaaccatcatatacaaggaaggagagcaagacaagctctaggcggcgggttcgggacaaggaagggaatagctagggtttggaagggaagtgattatatatgagttatatgcggcacaagatccattagagccttatttggtgggcctcaatcccagcccattcacaccgcggactaaaaattttagcatccaagtagcccaaatgagatatcataatatttattttgtaaagctagcatttaaaagatgggtacacaagcccgattaaaaaaattagtctactataatgttggggaattggaaggttcaataagaaaaagaaaacttaaacaaagaatactctattggaaggatcaacatccaaataaaatgaaatgaatcattgagtttgcttgaagtgcttctaagagaaaacatggatattagtcgccatataaaggtgtactgtgatccttcacaaacacataactattacaagaaaagccccattggcctctgccttatcatagttggtctaggtcagggtcaatccttgcgcacatgactttcccaacaaagctagaacattgacaaccaatcatcaatttttttactcactaacatgtaaaaatagaatataacacattgataatgttgctaaaagcaatcaacaattaagtatgaggatacatgttaatccacataatctcaaccttagatggaagagcaagagaagaagatagaggaacggggaggggtgtgtggggaaggaggtacttcatctatcgtcgggtggtagcaaaaaaaaagtgagaccctacatcccactttgttgacatgccaatggcaacctacgaggattgttggatccatgctactgccaatgttgaaatatcacaaaactatggtggtttcgggaaagttggactataaaaaatcctatacatagctaatttaataacgtgttattgcactcgatatcttcgactaatttgctatacatatgacgtggatattttttgatctgactaccggtgctactagtattgctctaaacccgcttcacgcagcctttgaattaaaagagtgtacagaacttgggttatgccaataacatgtttttttaacacgcaggagatctgcgtatcattccactaagacatagaagaaaatgtatatggtgttagagaaagactcgacactcgcccactaaggatacaacagaacaccacacaaccaatggaaaaaaaataaactattgcattagcagcacagtcatagtaaagataccacggagcctagcagctcttactagacaccgaagagcgtcctcgttagcgatggtggctcaatgtacattggccaagcatgaggtacgtcgataacatattttaaaactactgtaataagtattggactctatgttatatgaacatggttaatgatggaaaaatttcctatactatttttactagtaatatgcccgtgctaaatgctacggtgcaattcgatttgtctttaataattgttaaaatttcatgttagcggaaatttttttgtatgatatgtgcatttgaactttaattcaattcatgtcgtacattaaatatatttatttaacgtaaaatataataatatgatactgcatgggcacaataaatctttacaagaattaagtatatataatcacttcagtatatagtacgctattatgttaaaaaagtgagttatttcattatttgttgcgggaacaaaataaagcattatttgcgatctggaggaggtgcaggagagaggctgcagtggttggcgatttgacggaggggaaaggaaaccgatcggtgaccgcgtgtgcgattatttgtgatccctaatacattgcaggggaaatctgttctgtgctgcctactcaaaggcagaattttctaagccaatctcattgtcatccaaagtactactgccaatgaactgacaaaagaattgacaaaagaattgatgaaccaaagcagtgacatacttctagacaaacaacttgggcaaactgagagagctcccatggttatagcatatggaaactgatcctacaataaagaaaataatttacactataatataagaaaccaacttttctgctacttgaagtttagaaactgaacttgaggtgatgtgtttagaaactgaacttgaaaccacggttcttgtttgatccacctgaacatctcacggttatccataagtacaaggcaaatatgagtagatggctaattcgctatggagcaaaataatactggaagactggaggttaccttctgttgtttgtatgtaatgaaatatgtgacacagaagacctcaagaaaagtttctatgtacggataagggctatggcttataaacatgttcatgttttttttccggtttgtaaattggtattctaacctggaccaggaacctaccatgagttttaatattaacataattgttttgcattggaataatgaatgttatgcaaacattatgcagtctcctgaaatgaatcatccgataataccaaagtaaatgaagcagcaccgcatttatagagaaaaaaaatgttttccctaagtagtcctacacttccagttgtaagaaggattcaaacttcagaaaaatcacccttccatttgtattcatgctttaaaattgtaaaattttatcttatattcttttctttttaccaatgctttcatacacttcggggatagacggcggagatgagacgaacatgggtagatgcatggcaacctacggagtggcggcagttagggttgggagatgccgccgtgatgtggtggtggcggtgcgtgtggcagcgccggttggtagtggccacggaggagatcggcgtggtgtcactggtgttgtcctcgatggtcggtggcggcacggagatgtcgagggtaggcttcagcggcgccggtgtggtcccccgaggtggatgttgccggatgttgtatcaataatccctaatcctatacagcaaaataagaaaatcaggaggaagattacggtggtgcaatgtttcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42685 - DNA, 1024 bp, Oryza sativa
ggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggtt

SEQ ID NO: 42686 - DNA, 708 bp, Oryza sativa
aactaactagaaaattcccagcatacaggaatgcggtttattccttttcataacagtgggtatgggaaaggagatatgctcataacagataaccaaatttcagcctaagcgctttgagctccgtgagatttccagagtttggtccattcctccattgcatcagcagctttagcgaagattgcattctgcggtcccagtttctccttgacaatgctggttagttccttaacacagtcttcaacagtaactgaagtactcgatagcttcagagattcgaagaagggaagaacgacgtccatgactttcaccccttcccattctttcaagctctcgagagccttacctgcttctgcatcacttctcatcacataaggaagacctgtcttcacgccataccgtaagcgatcacacaccactttagcacacaagccattccaaacgtcttcaagtgtatcccatctgtgctttccttccttgcgcagccgcagagcagggaacattacaggtcccagcacctcacggttgaatgcaacatttatcccgctcacaggcatcatcgcaccaagtggaactgtcatcacagcatccacatacgttgtgttgcgttgatttctcttcacaacatgagtcattgggtcatatctgcattgtgaagccacagcccacaagagagcatgcactcaacccccttgcgcagactaaatgggt

SEQ ID NO: 42687 - DNA, 1531 bp, Oryza sativa
ttttggattgataccaaaatatgccctaccaatttattagtaccttaaatagtaatcatataggtttggattgaagccaaattgttagtcatacctatgattaatttgtcactaatctagaaccttcttctctatatcatcaatacttgtcatcatattggtagcaatccaaacatatataatgaatctctacccaaccaaaaaattgatagtaccaaaacatgtcaagaatttggcactaccaatgatttggtaaggtagagatctaaacagcctcttaaagtcgtgtgactttatcgctgatatgtgaacctaataaatactacatccgttttttaatagatgacgccgttgatttttctcacatgtttgaccattcgtcttattaaaaaattttatgcaaatgtataagatataaatcacacttaaagtactatgagtgataaaagaactcataacaaaataaattataattacgtaaatttttttgaataagacgaatgatcaaacatgtgagaaaaagtcaacagcgttatctattaaaaaatggagagagtattggattcatatgtcagtgacttgtgactttgaaggtggggtatcttgatcaatccccacctcaccaactgcagggcgggcaagcaggttgaaaaagaaaaatacaaagagaacccaagtaatcaagtggtaatataaccgtggtctgagtcctctgataggtaattaggtagatatctgatgctaccggaaatcaatctgcaatctggcatgcggagcggacctcatcattttctcagttaagtggctaattaacgcctgatcttttccgggcatttttatctgaatccgatcgataatacgcacgatgcaattttcacaggtactccacagtgtccgtcgatcggcatgcacgtacgcatgaatcaacacggcagcttttcgatgggtagcatgttaattaccaccatggccaaccgacgttaatttgcatcaaaaggggttaattagctgccagagtgacacgtcgaccactgaagctgtgaagactgaagaatcatcccgctccatgatttgccgcgcccatcgaagcttttaaacgtacgatcgacaaggctttgctttttttttgggtagcgatacttcaacgagagagaacaatacttccatcgttttgttttcccacatgatgatgttttgcacaggtattcagaaatgatgcagagcaagtgcagaatatacaatataatgcactcttggatactttggtgggtgtagccttgtatatatatgttcagaaaataatggttgatacttacctccaggcataatcaggaccatgggttaaactattcctagggcttggtaaacaaaaccatgacagatgtacgggttagaagagatgtctttaggccttgctttgacagtttgactgcatatcaagttatgaaccctatagctaagctagctagctaaacctgcaatgcatttgcactgtatatcttcttctataaaaggcctacaacccccaaca

SEQ ID NO: 42688 - DNA, 1750 bp, Oryza sativa
gttttccataagccatagttctctcctgatcccatgcatgctacatatcatacacatctcatgtcatgctgacattttctttcagataaatctcgagcacaggatagcatggatggaacctccaggaaacagctagctgacagtcgcctgatgatcatatcaactagcaagatgcaaattcagattgcgttacaagcctcggttgaaatgagcggcaagtgttcactgcgcagcctgggatgcagactcgacaaagacaatacgccccaaaggttttctcccttcgccttttgtgatgcaacagcacatctgccaattatgggtatgaacaatctcaccttcaacgggagatggatagcagcatcatgcttagggactaagcatgtacgtacggactactaaaacagcgtaagtaaaggtgaggatatacatatgtctaatttcagatcgatgattattggcaaaacctgttctgcaattgggcttgttaatttattttaatttaacaaaacgatcgattcttgtgcatgctaaaagtagtagtagtattatttgcacagcttcgtatagtcacttcgtttgtaaagcccaagaaaacaaagctgcccttttcttttccttttcaaaactcttgcccacagttggtcactacttgccaactactttgggggcagaaaaaggaaaacctgaaacaagagaatagtacagcatactagccttgattttttttttcgctattaccttcagctgttcagctggtatctactcctacgtaccgagttagattcatcaatagcctccttctattgggctattggctacagattttgtgaagttattatcggcttgtgccatatacaaattttgaccaaatatttgttgttcctcaaagcacggttaccttgtacacaggaacctacaccgaagttcgtcgttccgattataatttttttctaagaaccaattaaaatttttgaacatagtaacgggatcagggcatggagcagttcatgcttgagatatcctgcttttgataccaatgtgatgataagccagaaatgtttaatttatactgggtaaacaatgagaaatgctagctgatgaaaggtatccactaatccacacctttaattgactgctcttattgaaagtggagcaagctaaccttgcatggctcatatgtggggcagcatatatagtgcaccaaagtaccaaacataatgtcagtgtatatacatacatgattaattccttcgatgtaagccaaatgagaggggtgacttagttatgtgcatataattaatacgatctacataattgtgaaaaaaatataatttattttgacaatacagattattctttaatttatcactgcaaaaatgaatggctaaactcaatcgacacatgcaagggaaagataaatcaaatccagctttttagaattctccaatatacgcaaccaaaaattaacttggttagatgaatttggccttacatgcatgtttgtagagttacaccattacatacttttctgcaggcatgcacctctaacattttctaaccatttggatgtatgcataaaattaaggaggacacatacatgccactaagttgtaaaatgattttcccttcctaaatcgtaatatattttaattaactactttataacaggaaaacaattttctaaaagaggtcttacccgttatacacaattaacagagtgtttttaccgtgataaagaagatatcat

SEQ ID NO: 42689 - DNA, 1310 bp, Oryza sativa
aataggttattgtcacggattatttcctcaacatctttagaaatgtggttttgtgttaaacaaatgtcttctacaattctactactacattgcttaagcacttgttttaagctattcatttttatatttctaaaaattatataatttatttctataattaaatacttccttcgtctgtccagatcgatccgttgtcctagtaaaggtcaaaatcccattgtaggtgacaatattttgagacgaagaaaatagataaaccataccaataacctaaagaaaaatttgttctgtacagcgtggagtcgctgagagaggaatggactgagcgtactgtggaggcacatgagagatgatgagatgctgtgtggttaaagttgcgtgaagcaacaacccccccgtgttgtgtgcgtgcttgcagttgcaggtgaggtcggtacggtgctagcttggcctctccgtgtttttctttcttttttcttttttttttctggcagcgtggcgcatgccgaattccccgagaggaggcaggttgggtttgggcgtttggctaagggattacctattcatttatcgataaatcttctcttaaaacggttcaaaaatcaacaaattccgaggaagaaatttgccaacagatttatagcaaaatagtttgggcaaaatatgacgatcaccaaccgagcgcaaagagtgtttatgggcgaaaaaaggtttgtaagcgagcttagaagcttactctatctgttcacgtagtattaaaatatggccctgtttggatcctatcttaaaattttttatccgtcacatcgaatgtttgaacatctgcatgaagtattaaatataggcttaaaaaaataactaattgcacagattgcaactaatttgcgagacgaatcttttaagcctaattgcttcatgatttgataatgtggtgctatagtaaacatttgctaacgacggattaattaggcttaataaattcgtctcgtggtttaccaacggattttataattagttttttcattagtacccgaacaccccatgcaatactctatataatacctgatgtgaatgggggtgttattataccctatataacacccccatatatcacatctcgtattaatttttttttgttttgtgatggaaggagcacacgagccaaggtaggcgccgacagtaaacactttacagcacaggtacgtgtctgtaggtagccaggtgggtacaccggtacaacctattccctccgtcctaaaataatacaaaccctgtgtttccgtgtacaacgtttgaccgtccgtcttatt

SEQ ID NO: 42690 - DNA, 787 bp, Oryza sativa
gcaagtccgccggcaccgtccgcctcctcaagtacaccgaaggtaatatgcacttaaaaaatctcgtgtttaattctcaacacgttcatattgttttttaaaaaaaatgtttagagtgacgtctctccggccaactctcatttttacgaatgatgcctccgatcgatgtatgaactttattgaaggggtgccgatggtgacgttcgcgaaggagaaggtggaggtggcggacgacgagaagaaggtggtgtcgtacagcgtggtggacggcgagctggtcagcttctacaagaacttcagggtgacgctgcaggtgacccccaagggcggcgccgccgcccccgccgccgacggcgcggtggtgagctggaccatggacttcgacaaggccagcgaggaggtgcccgacccggacgtcatcaaggagaccgccgccaagaccttccacgacctcgacgactacctcctcaagaactagccagacagccagatcgagcgccgccgtgcgggtgcgtggcttatgtgttagagtccactatagcgtcctcgccgtcagtcgtcgtcgcacacggtcgcagtatcggggtgttgcatttgctagctctccggctagccactgtctcccacgaattagtgtacgtatcggtgcatgagtgaataataaagtgttcaggttaaaccgtttatcgtctctccggctctccgtttactgtttccttgtattgattttcggtctatccgactctctcactctcctttggttaggcctaaacatgtttaggttgag

SEQ ID NO: 42691 - DNA, 1446 bp, Oryza sativa
ttacagcctgattggtaacgattgatcaatttatctcctgtcatacaacagaagggtagaaatgtcatggtgactgtccttttatttactttaagggattggaatcgatcatttcaaactttacacacacatattagctgtgcgctcgctgaaatgttgcagaatagtcattgtctttatgttgaataacatatatttataatggtcatagctctatggcattccccctgataccgacttatctcaatcttcaagcaacaaatttttactatgttacatagaatttcatgatgccttccttttatcttttagttgtgtacttatggcactaccactttaattgcgtaactaccagttagtgatatcttcatttgttgacattctgaataaagattcatgcttttgtcttaaagaaacaacttggttacttttcatgtgtaagaagaaaatgcacctaaatagctaactgatgtttgtgggggacaaacaggttcagatcgcccaaacatatgagaaaaatggagcagcatgcttaagtgttctcacagatgcaaaatactttcaggtcagtaatcttttcccttttgacaatttggctactcctctgatgcattacgaaattatgcatgctgaatttgtttccgtttgttatgtaatcagggaagttttgactatttggatgctatacgcaatgctggagtacaggtctgtaaatttgctcatatgttgtacttccacttacagcagtcaaggaaattcagttgtgtggttcgaatgtatggaaaggctcattctcttgaatttctaaatgcagtgtcctctgctgtgcaaagagttcattgttgatgcctggcaactttactatgcgcgtttgaagggagcagatgctgttcttctgattgctgctgtcttacctgatcttgatatcaagtatatgttgaaaatatgcaaaatacttggcatggctgctttagttgaggttagctgagttatttgtgatatgttttacatgtcaaagcacttccaactctcttatgttagctgctttggagtcattctactagtgttgcaacttccaattcattttcttcttccaagtaaatcaaatgcaacctcaatattcaaattttgatttaataaacaagctaaatgtgttctgaaggtgcatgatgaaagggaaatggaccgtgtgttagggatagatggtgtccagctcatcggcatcaataaccgtaacctcggtatgttattcttgtttcacatgtttagacaagttactttggcacatatattatataacaatgtatggattcaactgccagtgtgaccacacaattctttgtcagatttgttccctataagtcactgtggctaagctatcatggtgccacctgaaaacctgttggctcatattgaactagtggcttgtgcattttcatctatcgc

SEQ ID NO: 42692 - DNA, 13648 bp, Oryza sativa
  unsure (1)..(13648): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagaagaagtcttaggtggagtcctggcttataccccagttgagcgcctgtgaagatggagccgtaggcccgctttttcgctgctgtttatttttgattgtcaggccttaagtgcctttgtaataatgtaaatattatcgatataataaagatgtgtcttttatatcatgtttgtgtagtgtaccccggcttttcctgggacggggattaatacactagctttcgggaaaatgtatttttctcggtcgcgacaggagaggtcctggtacgcgatctggagagtgggcctggccacagtgaagtggtgtgggcgaaggccagctccgtgtatacctccacgagggtaaaggtacacagagagctcacagcgagggggaacacggtccacggagtaccccgtgtactcgggacacgaaaagccaaggaagcgggcgaggtcacgaagctgagcgacgtggtgaccctcaccaaaaccgtgggaactgaagctggcgttcactgccatctacaattttgaaggagggagaaaagatcagtaaccattttagaaacaaactattgaaaataaagaaaccaaaagaagccttagcttttcgcaagtagttttgaacttagtatccttagggtcgtcctaaatgtcgggtttcgccctagggccaagcctgtgctctgataccatctcttgtcacgccccgaactagtcccgaccggaactagcccgtgacgctccaaattaacctgttaatcgataacagtcccaggaaacagtgctggtatcacaggaagacagaatatcacagcaacagaggtctctttattatagagtaggagtacagtcatgttgggctgcggacagatcccgagcttacaactgcattacaaaagggaagcggaagccaagacttggaccaaacatcacaggcgcgacttgggaactaggctgaaaccctaaaactcatcgtagccggcttgctcctggaagaactcctcgtcagcgggatccgcttcatcttcttcagcaactgggggggattatttatatagagcaagggtgagtacgggagtactcagcaagccatgggaaataagtgtttaatgcaggcttcaaggaaaggctgttgtttttgcaattgattttatttgaactcttttctgaaatcaactaagtgagtgcttctcaaacgacacggatgagacagtgcgtctcgtccggtcggagtatgtgcaatgtatcagtttttcgaattgaaatcaaggttggcacccggccaacaactttcaaacggccacccgggcctagctgatcccatcagctgcagattttccaaacatcaatcccctttccacaacagcaatttcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggtgaatccacatgtctctcggcatcaaggctcccctgataagctagttactcagccaggggtgtcccattccacccatgtggtcgtacttgtcttatgttcggatgaaattccaaggaaacggtccttaagtgcaagagcgggaaaccgtacacctggtacgttccccggtccgcggttttggaaattcatttagttcacaagcaccaacccaggtgtcgggttttccaagtcttttgtaaaacccaagttttacccaagaagttactcagattttaagtttgaaggcgaccgttgatactagtgcagagtgcacgatttccgaggcgcgactaggtggttacaaggaaacatggtataacaattaacagaggaaggatcaaatgcaacaaataggtaggtccgccaatctgccttgcagacgggacaagcagattaagtgtgatcctatcaatgcataatatttttcaagcaacataattaagttcaaatataggctcaagatgttcaaaggtggcttgccttgctcgagatcttgagcttgatcctcgaaatcctcgcactgcgggtcttcgggctccgaaactacacgcaaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaaggatttatttaaacccttttggaaaaagaaaaggaagagggaggggaagtagacttccctcgggcggctagggcgcggcccgagagaaaaggggcggctcggccgagctaaatgggccggtcggcccaagaaggcggcccagagcgcgcgcgcgggaggggaggagagagggagccggtggactgggctcacctcgcgtggtcccgagtgggacccgcttgtcggtgacacggttcaccgtgcggaacgcgcacgcggcgcgcgccagggtttgggggagggacgcggtgcacgcgcgcggttcgcggaggacgcggatgcggcgggcccacgcgcagcctcacagctcgcggtggaccgcgcgcgcgagggaggggaaacggagggagcggctggccgggtcagctgatccggtcacggtcgaggtggcgccgacgtggcgcctacgtggcagccacgcgggccggcgggaggttgaagaagacgccggccggaacggacggcggacggcggtggcaagcggcgaagcgaaacacggcgatctaggcgaaagcgagcacaccgggaagttgcgcgggacgaggggagtcgagccaactactcggatttgccgggggatgctcgacggcggcggattgcggcggcggcaaccggcggcggaagaagggggaaacagcgacgaggtcacgaggggccgattcccggcggcgagagcatctacgcggctacgggaatccgatgctagcgttggattgggtggaaacgcatcgagggaggccagcgacgagaggcgcttccgagctcgggcggcgacggcggcgagcacacggcgagcgacggcagcagtcggggcggcgccggctagctacggggaggctactcgtgctactacctgagtctaaggggaggagatggaacgaggagggagaacggggagatgcgctaccgtgcgggcggggcgcagtgacgatgggccgatggcacgggagtgatctctccggcctcgggccggggaagaggaagaagagggcacgcccggagtccccttccgcgtccttgctcgtgccggctccttcgacacgcgcaacgacgaacggcgacggcgaacagagcacgggaggcggcgacaatggagtggaggcgatgggacaacgagaggagaagagagggagggcgcctgggctttataggatggcaatgtcggtttgggagaggggaaccgactttggacggtcaagccagcgagctggcgctccggctagcggccaaatcggcgacagggcggagggaggatgacgccggcgggaggaaaaagggggaaaaggagggaaagaaagggggcttgccccttgcctctttgggaaaaggaggcggggagcgggggcgacgcggcagagggaggaggggctctgcctccgtcccttggcagcttgcgcgcggtgtggtggggccgagtcgatgacgacggcgatgacggcggggcggtgtggagcggagcggcgacacggacggcaggcgcagacaggcgcggcagaggctgacggcggcggcgaccaggcggtcagccactacggcacgcgcgcgcgggaagcaacgggcggcgcggcgatttgagcggcacggctcgggcacgcgtgctgactcgcggcgcagacggcgcaggcgtggcacgggcggcgaccgcgcgggcgcgcgcatgcgaacaacggcgcgcgggaagcggcagcgagggagcgaagagggagggctcggctcggcgcggctcacgcgcacgtgcgcgcggcgcgcgggcagagcggagaagagggagagagagagcgagagagagagagagagagagagagagagagagagatagccgggggggaggggaagatgggccgagagggattcggcccatcgaacccgggggaggcaaaatagacttttgcggagggatttgatttgggaaggatttggattcgggattgaacttgacaatagatcggggattgagatctgagatggcacggacactagacaacaagcaaagaaatggatttcgcaaatagggtttttaagagataatttttccgctaggcgccacgacggaacgggcgctacagtgggtcaaattgatcagctacaatccatgtcacttcatagcttattagaaccttctcctagtactggaccgcccacagtggccatcatccaccagtgcataagcagtcgatccaatcactgatgtactccaggctaggcatgagccaattaatcgttgttcttccaatttggtaactacatgtccccaactccaaacccgtgattggtaatcttcattgcttgttgcttcattgattggtaaccttcatcgtgctagtaagtataccagttgtcaccgccattctgtgtgtgccgacacggtgccgttcacgtggccacatctttgccaatatgtcctgtggtatgtgaagtggtgcttgcctgcccgattctcttcagtagcacaatataaacttagtaatggtatgtgttgcgtttggttatctttatcgaacatctccaccaatatttattttatagccacgtctgtcaatgtgcactaagtataccaccacacatatcttgggcttttgaaagctgtatgcagagttgcagatatattttttgagtaaattagacacatgaaaagcatatatggttctaaatttatcaaatggttcagaaatgtgactgtgcataagcataaaagaataaaccatctcagagacagacatttttctcaagttcttttcaggtgcttttacacgggaagtcactctgccaaacttaccaatcgtcagtgccatctaccatgcatgctcctgtcaactgatgactcctttcagctgtagcatgagtaccaaggaggcaaggagacgttaaaatcaagcacgaagacatgtacaggggtaaatgcatgcatatgttcagatgcattgtactgatagacccatctagctaccattagcttttgcctttcgatggttgtgtcacacccttttttatcttccttttttttttgcctgtacttgggacgcacgaggagaaaaaagctgggttcgactagactatcacgcgtacaactgaactactccaataacatttgagctttcacaatgttgtcaaacatatgtaactacatgctttctcttcttataagatatatgctctcttgtatgatcctaattaagtgatttgccactctcacctaaggattggtatcctgtcccaaatccaaaagatctgcactttgggtattttggaactcaactgagtgactagcaaatcctggattgagtcctaattaaaatgcaaaccaagacataccttgaggcgaatcagatcgatgacaggccagggatatattacacgaatccgagaattgcaacatcggtcagatatggtgaggaccagacaggccgtgcaaatcccaaacagagaattaaaaacttcaaaccgatcatcatgttgcacaaacaaacaaacagagccaggcatcagagtgcgtcaccattgccgactgatcaaaaagctctctctctctctctttctcactctctctcgttagtcgtcacagctaagtagtagagtataaccgatggaggggtatggataggtgcgcacaacggaagtggcggatgacctgcgctccgattcagattataattagttaatttcaggcgaggagaaagatcgaatggcaacttggctttatcggcgatgcttctgatagctcctctttacgagtgatcgtacacatcgagcagcattcgatcagtgagataatcgactcgatcgggagctaatgacgatgctatcatgtcaatcggtcgctttaatcagttggctgtccaatcatcagtgacattcatgtactgctgccatgcatcaaggcagggtcgatctggcaaatgctccgggggtctaatcatgtgctctggcgtaagtaagagaagcagagggagacaagaggctaaggatgtctaagctacgcgtgatgcgccacgcactgacgcactcatgcatttgggggtacagatgccgattatgtttatctgatgactaagagcaagtttaatagtatagccaactactagctccaattcatctatagccaatctaatagcttattcatacaatagttacatactacactattaatacttgatcccacctatcatacacacattgtgtcttagagttcgtgctacagctggctataaatctgtagctcgctgtttttccctctcctcatttatcttcttaaaatatgtttgtagctggcttatagcctgttattgtacctgctctaatagcagattgatttcgtgattctggaatcttggatcggttcgtatcatccacgacacttagaaaagcacatccaaatccactgcttaattactggttagtaagagggtgatgaacaacttggcgatcgtggtgaaaaataacgaactcaatttaccttggcggccgagctcggaggagaagccagtgatggtgatgaacagcgagcagcagaactactccgccggcgacgatgcgcctggacgggagcggcgccagcgtcagaaacagatccaacaatccagcccatcaaagaccaattagagcccatctcactctccttgatttacgaggcagtgcggcccgtgcagtttttacaagtcagttatactagccacttagtcatgcgttgcacgactttagatacctgtataaaaagttatatatttgggttataataagcaattatacttttagtttcaaattttgcgaaaggacttgataagacttgagcatacaaccggggaatgaaactgtgagctgctgttgcaagatttaaaatgagggcttgtgcttagcagttctacgaatagacggagaatttaagctctgcttcatcaagtgaaagagaacaactaccacgtcaagaactcaactgaatcaactaaacaactcatgtcaggaatttaaggatactgaacatgtaccatgccttaatgccttgttagccggacagaattagaccaccacagactgcgcaaagagggcataatctggtttacacacaccactataaaacctaatcaaataaaccttttccaaatatggcaacacaatctatttaacatattatcatatatttgtttaaaacagcgaaaagatcagaataaagttgaagcacaacctagactccaaagagttattgagaaccacaattttccctagctattaatcagcttggctgctcaaggcttgctatcatatccaatatatcctatacccttcgccttctttcagtaatggactaatttgatcagcaatatctccaggaatctgagcagaaagaagaaggcatttgagcagaccaaatatcttcaggaatctgagcagctccagcatgctgcataattatttttttatagaccaaatatatataatagatggatagcagtagcttgcttcatatagccgaaatattaatgtgttgttggaacaaaatattttaacatcaaattatttttatgtattgttcatcattctatttaatatttgttctaggccttttgggttgcacaacagttagggggtgaactgtaagagagtactaaacagcagtatatgatagcaatatactacgtatgatgttaactgatcaactcaatctttcttgggtcattataattggtggttccttttgtattctaccaaattctgatatgctattgtttgaattacataaatatgtctgctccatatgatcagggtaatgatacgaaatttccaatttctattgttatgcatgttttgaagttgacagcatttcggaagtaaatttcaagctttagtcagcaagctgtgattatttatatagtatttcccaaaaaaaaaggttaatgttgagaaatgtttcagcatcctgaacagttaagtgctgttgaactgcacgatcagattcagtagtttatccacataatcattattttttattgagcaaatggataggaacaaaaaaaaagtcatatgtattacctttccttgaaacttttcatcgatctactgaccagaacctatgaaatgtaaagactggagactgccaagtatgaaaaagttattacctcagctttcataggacagaatcaccattgtgaacagcctaaatcttttcattgtggaacagccgctacacctacagcctagtaaatctgttcaatctgcacaaatatctctatccgacaataactaatatcaacacactatcctgcgtaaaaatttgtaaaatctgtaacatagtatggctgtatgattttgctatgtgcgtggagcatgaactgaaagggcaagaaggcattgcagtagaatctgtcctatacccaatgaagaccatgcaagggcagtgtgtcaaagttggcctcgtcctccaagaagccttgaggtcagcagcacgatgtcatgcatcctagaggctagagtacgatgctggtggtgccgctggacaccgtaatggccttgcatcctcatccttgggttcctgctggtaaccaggcagccctcgctcttgctggtggccattcgtcgagcaggagcggccagacgaagcccactggacaccagcggcagttcgcagcagtgcacgctcgatccggcgatgacgctctcataggaggacctagagtgaacgatccgacgcgacagggcctgatccggcgagacgcaaatgagtgggggatggacaggagggaggaggaggcaggggattaggagagactgaggccagggtaggagcttgtggggatgggaagaatggaagatgcggcggaggaggatgaagccgcggcggcagcttttctttttttcttttttttttaacgcgtggatgctgcctattcgcctacctctctcgactctgatcgaagactcctgaaatctcgtcttcaccttttgactaaagctatactgaggcctattcaaaatctaacggcatgggttcaatgtttgttgcatccaacggctaatattattccgatgacatggcgctttgtggtggtgaaaaactttagtattttcactactttagatttccaatcactaacaaacagcgaaacagaggtctgattagagatggcaattggcaacatgtcccataacccgagatcccataggtttttatattattattacgagtcacatttttaattctgatatccatggatttattaatgagcaaaattccttacctgttgggttgtgtcacgccccgaactagtaccgaccggaactagcccgtgacgctccaaattaacctgttaatcgataccagtcccaggaaacagtgctggtatcacaggaagacagattatcacagcaacagaggtctctttattatagagtagaggtacagtcatgttgggctgcggacagaccccgagctcacaactgcattacaaaaggaaagcggaagccaggactaggaccaaacatcacaggcgcgacttgggaactaggccgaaaccctaaaactcatcgtagccggcttgctcctggaagaactcgtcatcagcaggatccgcttcatcttcttcagcaactgggggggattatttatatagagcaagggtgagtacgggagtactcagcaagccatgggaaataagtgtttaatgcaggcttcaaggaaaggctgttgtttttgcagttgattttatttgaactcttttctaaaaacaactaagtgagtgcttctcaaacgacacggatgagacagtgtgtctcgtctggtcggagtatgtgtaatgtatcagtctttagaattgattcaaggttggcacccggccaacagcttttcaaacggccacccgggccaacaactttcaaacggccacccgggcctagctgatcccatcagctgcagatttttcaatcatcgaacccctttctacaacagcaatttcacaagcagtagtcaaacaaaactacgctaggaatcacctcacatccgcccatgaccgtgggcacggctgttcaaacagtttgttaacctctgcagagggggtacactttacccacacgacattactaacccggatcacccagcccgtgggaatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcgagagcgggaaaccgtacacccggtaagttccccggtccgcggttttcgaaatttatttagttcgcaagcaccgacccaggtgtcgggttttccaagtcttttgtaaaacccaagttttacccaagttgttattcagattttaagtttgaaggcgtccgtcgatattcgcacagggtgcacgaatatcgagacgcaactagatggttacaaggggacatgatataacaattaacaaaggaaggatcaaatgcaataaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctggagcttgaccctcgaaatcctcgcactgcgggtcttcggtctccgaaactacacgcgaaacgggacaactcaacaaacggcgaaaataaagctctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaagaaaagaaaagagggagggaatatagacttttcctcggcggctagggcgcggcccgagagaaaaggggcggctcggccgagctaaatgggccggccggcccaaggcggcccaagcacgcgcgcgcgggaagggaggagagagagagccggtggaccgggctcaccacgcgtggtcccgggtgggacccgcttgtcggtgactcggttcaccgtgcggagcgagcacgcggcgcacgcgcgcggccggggctgggacgcggtgcacgcgcgcggttcgcggtggaatggatgcggcgggcccacgcgcagcctcacggctcgcggtggaacgcgcgcacgggaggggctgaccggggtcggcccgacccgatctcggccgagctggcgccgacgtggcgcctacgtggcgcctacgcgggctggcgggaggaagacgaaggcgccggccgcgaatggacggcgggcggcggcggtttctccgggacgccttgcgacgatgaggggcgacggggcgtacaccgggatgacgagggagaatgagagggagcgagccaacggcttggattcgccggagggtgtccgtcggcggcggattgcggcggcggcacccggcggagagaaaagggtgaaacggcgacgaggtcacgaggggccaattcccggcggtgagagcatctacgcggttacgggaatccgttgctagcgtcggattgggcggagctacgccgagcgaggtcggcgacgagcgggtgctacggagcacgggcggcgacggcggcgagcacatggcgagcggcggcaacggttggggcggcgccggctagctacggggaggctacacaagctactaccgaaaactaagggggggagatggagcgaggaggaagaacggagggaggcactaccgtgcgggcggggcgcagtgacgagaggccgacggcgcgggagtaatctctccggcctcgggccggggaagaggaggaagacgagcgcccggagtccccttccgcgtccacgaacgcaccggctctccctgcgcttggcgatgaacggcggaggcgagacagagctcggaaggctacggcaacggcgcggacgagaaacggggaggattgggggggagaagaggaagggagggcgcctgggcttacagggcggcaatgtcggtttggaaaccgactttgggcggtcaaggcgcgagctggcactcggcgctcgcggccaaatcggcgacagggcggagggaggatgacgccggcgggaggaaaaggggaaaaggagggagagaaagggggctcgccccttgcttctttgggaaaaggaggaggggagcaggggcgtcgcggcagagggaggaggggctctgcctccgtcccttggcggcttgcgctcggagtggcggggccgaggcgatgacgacggcgatgacggcggggcggtttggagcgaagcggcgacatgggcgacaggcgcgggcaggcgctgacgacggcggcgaccaggcggtcggccaccacggcacgcgcgcgcggcttgcaacgggagtcgcggcggattgagtggcgcggctcgggcacgcgcgctggctcgcggggccgagcggctgcgcagctgcaggcggcagggcagcgggaccgggtgacgcggacggcgcagacggcgcggcacgggcggcaaccacgcgggcgcgcgcaagaacaacggcgcgcgggggccggcttcgcgggtggggagctcgccagggatggggagaaggagagcgagggggagggggcgctcggcgcggcgctcgagcacgcgcgggcaaagcgaggggaagggagagggagagagagagagagagagagagagcgccgggagggagggggagatg

SEQ ID NO: 42693 - DNA, 1321 bp, Oryza sativa
  unsure (1)..(1321): unsure at all n locations
ccccggggtagatgggccgagagagattcggcccatcgaccccgggggaggcaaaatagacttttgcggagggatttgatttggaaggatttggattcgggattgaactcgacgatagatcggggattcgagatctgagatggcacggacactagacaacaagcaaagaaacaaattcgcaattagggtttttaagagataattttcccgctaggcgccacgacggaacgggcgctacaggttgataggtatgattcggttctttagccaccagtaccccacttacccatgggtaaaaaaaaggtgtgcctaaggtaatagctctaatccagtttatatgagattgatatggaaaaccatatagtacaaagacaacagatgaatccggcgttactgacgagatccttgtcgagatggttagacgagatctcccgacgaatctggcttcgtaaactatggtgggtatgttagcgctataattcgatgatctgaaccccttagggggtgtgtcttttataacgtgagttgccttagtctccaagtagatcttggagagaatgaaccctacacgatatagaatagacccaattctctccgagtaggactctgttaatcaccggcctatgaggatattttctataatatcttatagatttccttatcacctacggtcgtatgaccgatggtataccatactcgtatattccgtaagtcataggatatgaggtatgccttatccgtaaccagtcgtatatgacataattcttacatgattttttacttgcttttgaatgttaatgttaaaactaaggttgcctaatatgatgttggtgcttgccatcgtcatcatcggattattgtaaaaaatttaagtgctctaaattagtgtagtggtatggatatccattacctgtatgggtatggtttggggagaattttgcacccgcggttagatgtgggtattagagcgcgaacttttaatcataagtttgagtatgaggtaagaaaacttgcagtagaattatagttcatgtggatcaatttatttgtgtactgaagagaagagagttgtaccaaaggtaacctagtaaccagattatttgagcaggcgaccaggcatgaggcatccactgtctagctttagtagtactactattgatcaagtcaatgtaacaatatgtttggtagcatatgatgtattcttgatcannnnnnnnnnnnnnnnnnnnnncaagccgatgcatatcaaagaaatgaatacaatgagttccacttaccatcttgggaccacaaatatcttttaatctctctgaaccagaga

SEQ ID NO: 42694 - DNA, 31243 bp, Oryza sativa
  unsure (1)..(31243): unsure at all n locations
caagccgatgcatatcaaagaaatgaatacaatgagttccacttaccatcttgggaccaacaaatatcttttaatctctctgaaccagagaccaccattaaattagacgagcttcagaatcttctagttctttcggcgaggggaatggattgaccttaaaggaagtggattgactttgattctctcaacaatctcaaattccagaaacatgattacaatgttcgtaacacacgagagaatcgattcgtccagccgaacgacttccatcttcaccagctataaaaaagccgagaaatccaggtgctcagcacagtggtccagatcacttgcgccatcacaagtcgcaagccaaaaccatctcgctcgagctcaccatggaattctcctcgagttcaacctctctcttcctcctcctctctatcctgcctctcctctactttctttgccagcgcaacgaccccaagaagcagcctcacgcccatgggctcaagtcctaccccgtcgtcggcatagtgccgcacttcaccaagaacaacgaccgcttccttgagtttacaaccgaaatcatgaagcggagccccacgcaaaccatgtcgttcaaggctctaggtctcaccggcggcggcgtcatcaccgccaacccggccaatgtcgagtatacgctgaagactaacttcggtaactaccccaagggcgagctcgccgtgtccatggtcgtggacttcctcggccatggcatcttcaactccgacggcgagcagtggcagtggcagcggaaggccgccagctacgagttcaacaagcgctcgctgaggaacttcgtggtggacaccgtcaggtccgaggtcgtcgagaggctgctgccgcttctggagcgggcggagcgcgacggccggacgctggatgtgcaggacgtgctggagcgcttcgcgttcgacaacatctgccaagtcgccttcgacgaggacccggcttgcctcgccgaggacagcatggcctcgccccagagcgcggagttcatgcgcgcgttcaacgatgcgcagattgccgtgagggaccggttcatgtcgccggtcaagtcgctgtggcgcttcaagaggctgttcaacatggagcccgagaggcgaatgcgggaggcgctcgccacgatccacggcttcgccgagcggatcgtccgggagcgcagggagagagggaaggccggactggcgcgcagtgacgacttcctctcgcgcttcgccgcgagcggcgagcacagcgacgagagcctccgcgacgtggttacaaacttcctcctcgccgggcgcgacacgacgtcgtcggcgttgacctggttcttctgggtactgtccggtcggcccgacgtggaggacaagatcgtacgcgagatccacgcggtgcggcgcgcgtccggtagcacaagcgacgcgacgttcagctttgatgagctgcgtgacatgcaatacctccatgccgccatcacggagtctatgcggctgtacccacccgtggccatggacacgcacagctgcaaggaggacgacttcctgccggatggcacgttcgtggggaaagggtggctagtgacgtactgagcgtacgcgatggcacgggtggaggacatctggggcgcggattgtgaggagttcaggccagagcggtggctagacgaggtcggcgcgttccggccggagagcccgttcaagtacccggtgttccacgcggggccgaggatgtgcctcggcaaggagatggccgacatacagatgaagtccattgtagcatctgtgctcgagaggttcagtctccagtatgccggcggcgagggacacccggggctcgtgctctcggtgacgttgcgcatgaagggcggtttgccgatgcaagtggccacgagaggttgatgaccggagcgtgctgctacacttgtggacttcgtttttacagaactagtggcacgcgagattgcatggctagcataacaacatatatatttttatattttattgttaaaatatgttaaatgtatataattctaagttatgtaataatttcactttcagttatttctaaattcttccaatattccttcatttctattttctaatttccgttatttctaaattatatttctatatgtactactatatactctacttttattttttatttcaattcctattttcaggtagtactgaatttctatatggactctagatacttcttccaaatattccttatttttgtttctaaaattctattatttataattgtatttttatatggactctaaactcatctctcaatattctttttttttaattctgagtttcggttatttctaagttgtatttctttatggactctagcctcttattctaatattcatcattttttaattttgaatttttgttatttctaaattgtatttctatatgtactctaaactctacttttgtagcgcccgttccgtcgtggcgcctagcgggaaaattatctcctaaaaaccctaattgcgaaatttgtttcttcgcttgtcgtctagtgtccgtgccatctcaagatctcaaatccccgatctatcgtcgagtttaattccgaatccaatccttccaaatcaaattcctccgcaaaagtctattttgccaccccagggttcgatgggccgaatctcgctcggcccatctccctctccccctccctcccggcgcgctctctctctctcccccttcccctccgctctgcccgcgcgccgcgcgcgcgtgtgcgagagccacgcccagcgcccctccctccgctctgcccgcgcgtcgcgcgcgcatgcgcgagagccgcgccgtctgcgccgtccgcgccgtccggccccgctgccctgccgccctgcagccgcgcagccgcccggccccgcaagccagcgtgcgtgcccaagccgcgccgctcaaatccgccgcgcctcccgttgcaagccgcgcgcgcgtgccgtggtggccgaccgcctggtcgccgccgtcgtcagcgcctgccgcgcctgtcgcccgtgtcatcgcgccgctccaaaccgcccagccgtcatcgctgtcgtcatcgcctcggccccgcctctccgcgcgcaagccgccaagggacggaggcagagcctccctcctccctctgccgcgacgcctccactccctcctccttttcccaaagaagaaaggggcgagcccccccttttctctcccccctttatcctcctttttccctctcgccagcgtcaccgccctgtcgccgatttggacgcaagcgccgagcgccagctcgcgccttgaccgccctaagtcggttcccaaaccgacattgccgcccatttaaaccctagcctccccctttcccttcctctctcattcgcctccgcgccattgccgccgcccccgtgctctgttcgccgtcgccgttcgtcgttgcgcgtgtcggaggagccggcacgagccaggacgcggaaggggactccgggcgcgccctctccttcctcttccccggcccgaggccggagagattactcccgcgccgtcggcctctcgtcacagcgccccgacccgcacggtagtgcctctctccgttcttcctcctcgctccatctcctccccttagttttcggtggtagcacgagtagcctccccgaagctagcctgcgccgccccgacctttgtcgtcgctcgccgtgtgctcgccgccgtcaccgctcgagctccgtagcacccgctcgtcgccagcctcgctcggcgtagctccgcccaatccgacgctagcatcggattcccgtagccgcttagatgctctcaccgccgggaatcggcccctcgtgacctcgtcgtcgtttcccccttttctctccgccggttgccgccgccgcaatccgccgccgtcgagcatcccccggcgaatccgagccattggctcgtctcccctcgtcctgcgcaacatcccggtgtgctcgccttcgcctgtatcgccatggtttgctccgccgctcgccgctgtcgaccgccgtccgttccggccggcgtcgtcgtctacctcccgccggcccgcgtggcagccacgtaggcgccacgtcggcgccacctcggccgcgaccaggtcaagtagaccccggtccgccgcttccctccgcccctcgcgcgcgcggtccaccgcgagccgtgaggctgcgcgtgggcccgccgcaccgcgtcctccgcgaaccgcgcgcatgcgccgcgcctccctccccaaaccctagcacgccccgcgtgcacctcgctcacggtgagccgagtcgccgacaagcgggtcccacccgggaccacgagggatggacccggcccaccggctctctctctcccctccccgctcgcgcgcgcgccttgggccgccttcataggccagccagcccattaaggtcggccgagccgccccattctctcgggccgtgccctagccgcccgagggaagtctaatttccctccctccttcttttcttttcttttctttttcaaaaaggatttaaataaatccttttcctttagaccaaaaatccaataatcttagaaattcaatatctccccaaccgtaagtccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgtcgtcccgtctgcaaggcagattggcggacccacctaatttgttgcattgatcctcccttgttaattgttatatcatgtccccctgtaaccatctagttgcgtctcgacattcgcgcaccctgtgcgagcatcgacggacgccttcaaacttaaaatctgaaaaacaacttgggtaaaacttgggtttacaaaagacttggaaaactcgacacctgggtcggtgcttgcgaactaaatggattttccaaaaccgcggaccggggaacgtaccaggtgtacggtttcccgctctcgcacttaaggaccgattccttggaatttcatccaaacgtaagacaagtacgaccacatgggtggaatgagacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttagaaatgccttgtcatgaaagcttggaggtctcccgacgtggctgatccccacgggctgggtgatccgggttagtaatgtcgtgtgggtaaagtgtacctcctcttcagaggttaacaaactgttcgaacagccgtgcccacggtcatgggcggatgtgaggtgattcctagcacagttttgtttgactactgcttgtgaaattgctgttgtggaaaggggttcgatgtttgaaaaatctgcagctgatgggatcagctaggcccgggtggccgtttgaaagttgttggcccgggtggccgtttgaaaagctgttggccgggtgccaaccttgattcaattctaaagactgatacattgcacaaactccgaccggacgagacgcactgtctcaaccgtgttgtttgagaagcactcacttagttgtttttagaaaagagttcaaataaaatcaattgcaaaaacaacagcctttctttgaagcctgcattaaacacttatttcccatggcttgctgagtactcccgtactcacccttgctctatataaataaccccccccagttgctgaagaagatgaagcggatcctgctgatgagaagttcttccaggagcaagccggctacgatgagttttagggtttcggcctagttcccaagtcgcgcctgtgttgattggtccaagtcctggcttccatttcccttttgtaatgcagttgtgagctcgggatctgtccgcagcccaacatgactgtatctctactctataataaagagacccctgttgctgtgatattctgtctccctgtgataccagcactgtttcctgggactggtatcgattaacaggttaatttggagcgtcacaggctagttccggtcggtactagttcggggcgtgacaacttttaatattcctttttctaatccaaaatttcaatcatttctagattatattctgtatggactcttatacttttatttcaatattcctttttttaatttcatggtatttataaattccggattactgttatttttaaattgtattcctatttggaatctattttttatttttttcctctttttctccaattaatatgagaatttctcgaccgtgagagtgaatgtggaggctcctttttctattactttaataaattaatagatagataatattctatatggactcttatacttttatttcaatattctttattttttaatttttaatttttggtatttataaattgtatttttatatggactctatggagtacttttattattttatttttttgttaattccgaatttttatttataaattgtatacgtatatggactctagccttttcttttaatattccttattttctaattccgaattcagttatttttaaattgtattcctatttgcactatattttttctttttctatttttctccgattaatatgagaattttttaaccataagagcgaatgtggaggctcctttttctattgctttaataagttaactagttgggcagcccacgcaattgcgatgctagcaacaatttaaaattatctattttttacacatgattttatttaaaattatcattctcgtgattctaataattttatagttttaaaagccacatcagtcactaccccttactcctttatcacatttttatttgcttactcgatataccactacttctattcatcctctttaaaactttaaaaaattaggccttatagtttttagagttcattgtcttgttgggtttcgttttcataatttttaggagtattgtcaaacatcgtcaatttactgctctacggctcatccgctgccacctctctttattatcattgggattttaaaaatcgaacataattattgcttgtgttcttttttactttttataagtctcgtcaaatcgttaggggcttcgccccctatactgctctgcaccccgcccactgcctcccctctttattgttattcagattttaaaatcaaacatgattatcattggggtttattttactctgcataagtcccgtcaaccgtcgtgaccatgttgcataacagcatgcctatcttcactgggattctatttggggttttgtttatagttttttgatatcacatcaaccgctaacactctactcctttgtaggcctattgcttatctcctctttatggtaatttgtgattgttgtgttctagatggatttttttaaaattgcataatttttcatcccgataatttttttcataaattatattccaacttaaactcttataattatttttctatttttggaatttattttatttgttatttcaaactttaattaatctcgtcatgtattctagattgtctcttacttcaacggtctttattttttattacaaattttagttatttattataaattgtatacgtatatggaatctagccttttctttcgatatttcttatttttctaattccgaatttcagttattttaaattgtattcctatttggactctattttttatttttctgtttttctccgattaatataataatttttaaaccatgagagcgaacgtggaggctcttttttctgttgctttaataagttaatagattgctcccgcttaatctgagaaataaaaaaaatcggtgttcttgtcttctccgagtggcgaatggtcggccgacacctttcgaatcggagcttatgtcggttgcgtgtttgtgtttggcacgccaagtggagcttgagaaaacaatcgagatcgatctatgtgcagtattgcacaggatttgcatccttaagaaagttggtgtgccatcgcattcttggaaaaaccggttactgcgtttgtttgcaacagatagagagaaatcacagttttctccatgcgcaaatcacagttttctccatgcgcacgctttccaaactacgaatcattaaatatcatactttaaaaaaatataggaaagttactttaaaaaattaaattaattaatttttaaagtttaaaataattagtccttaattaattatgctctaatgtcttaccttattttgcgtattttctcaatcttttctttttacctcctctcaaacacggtgaccaatgagcactgagctaccactagaaacctaaccaattgagctacatttacttcgctagtatgtaatttataacgtagttctcttgtagaatatatgtttgatcattcatattatttaaaactttttacaaatatatggaaatatatagtaccgttatgacaaagtacttttagtgataatagaaatcacaataaaataaataatcataatattattttttatgaaacaataatcagatgtaaattaataacggcgtatattaaaatcggagggagtactctctatttgaaagcacgagcttccgaatatgatctgtagctctatcctactcctctataaaaaaaaattcaaactggtccagattcatccctacagtttgattttttttacggagagacactactacaggaatgattttccttgacgggggtcattttagattgcaaacggcgtgtaagtagttgcgtctgcgaaaatcgtgctccattttcacgtgcgactctttaagatgactgcacaaaaaaaatcaattatcgcaggcgggccacttaataggtccgcatgcaaaaataggcttgttttcgcgtacggacctgttaagtcaccgcacacgaaaatagcctctcaacttttaatccgccgtcgctgccccacatgcacccactctcatcgctatctccttagatcccatctcacacctgctcctcccatctccctctccgcctcctcctcccatctccctatccgcctcctcctcccactcctccctctccctatccgccccctcctcccactcctcccatctcccagcgacggcggcagcatcggagcggattcgttgccggccgccgcagtgaggatggatccatcgcctgtgaccgcgaggggatccgtcgccggcgacagcggggacgacggcggcgggccttaggcaaggcggcgatgacgacggtggtgacggcgacgatggcggtgacggttttttttgtttcgattttttattttcccgtgcacacgtgaaaatcgcgattttcacagacacttcgttccagacgggtggaagattcgcatgctcgaccgcacagaaaaatcattattgcactagtgggagtatatgttagcagatttgtttcgagcctaatcaacttttattatagttcgtgtgtgcgcctggatcaattatttgtgaactagagagagctgtaccaaagctgaacctaagaacctgattatttgagcgggcgtccactgtctagctttactagtactactattgatcgagtcaatgatcgctctactagtactactattgatcgagtcaatgatcgctctactagtactactattgatcgagtcaatgtaacgatctgtttggtggcatatgatgtattcttgatcagcaaaacgtatgcttgagctgcaagccgatgtataatcaaggaaatgaaaaacaatgagttccacttgccatcttgggaccaacaatatcttttgatctctccgaaccagagactaccattaaattagacgagcttcagaatcttctagttcttccggcgaggtgaatggattaactcttttttttaaaaaaaatccagaaacatgaataccaagttcgtaaaacacgagagaatcgatccaccagccgaacgactgccatcttcatcagctataaaagagccgacaaatctaggtgctccgcacagtgatacagatcacttgcgccatcacaagtcgcaagccaaaaccatctcactgactagctcgagctcaccatggaattctcctcgagttcaacgtctctcttcctcctcctctctatcctgcctctcctctactttctttgccagcgccacgaccccaagaagcagcctcacgcccatgggctcaagtcctaccccgtcgtcggcacactgccgcacttcgccaagaacaaggatcgcttccttgagtttataaccgaaatcatgaagcggagccccacgcacaccttgtcgttcaaggcgctcggcctcaccggcggcgtcatcaccgccaacccggccaatgtcgagtatacgctgaagactaactttggtaactaccccaagggcgagctcgccgtgtccatgctcgtcgacttcctcggccatggcatcttcaactccgacggcgagcagtggcagtggcagcggaaggccgccagctacgagttcaacaagcgctcgctgaggaacttcgtggtggacaccgtcaggtccgaggtcgtcgagaggctgctgccgctgctggagcgggcggagcgcgacggccggacgctggacgtgcaggacgtgctggagcgcttcgcgttcgacaacatctgccatgtcgccttcgacgaggacccggcgtgcctcgccgaggacagcatggcctcgccccagagcgcgaagttcatgcgcgcgttcagtgacgcgcagaatgccgtgatggaccggttcatgtcgccggtcaagtcgcggtggcgcttcaagaggctgttcaacatggagcccgagaggcagatgcgggaggcgctcgccacgatccacggcttcgccgagcggatcgtccgggagcgcagggagagaggggaggccgggctggcgcgcagtgacgacttcctgtcgcgcttcgccgcgagcggcgatcacagcgacgagagcctccgtgacgtggtgaccaacttcctcatcgccgggcgcgacacgacgtcgacggcgttgacctggttcttctggctactgtccggccggcccgacgtggaggacaagatcgtacgcgagatccacgcagtgcggcgcgcttccggtggcacaggcgacccgacgttcaacttggacgagctgcgtgacatgcaatacctccatgccgccatcaccgagtccatgcggctgtacccacccgtggccatggactcgcacagctgcaaggaggacgacttcctgccggacggcacgttcgtggggaaagggtggtttgtgtcctacagcgcgtacgcgatggcacgggtggaggacatctggggcgcggactgtgaggagttcaggccagagcggtggctagacgaggccggcgcgttccggccggagagcccgttcaagtacccggttttccacgcggggccgaggatgtgcctcggcaaggagatggcctacatacagatgaagtccattgtagcatctgtgcttgagaggttcagtctccggtatgccggtggcgagggacacccggggttcgtgctctggttgacgttgcgcatgaagggcggtttaccgatgcaagtgaccactagaggttgatggccgtagcaacttgtggactacgctgttagagagttgctcccgcttaacccgagaaataaaagaaattggtgtgcttgttttctccgagtggcgaatggtcggccggcacctttcgagcttacgttagttgcgtgcttgtgtttggcacgcagtggagcttttgaaaataatcgagatcctctgtgcagtaatgcacatgatctgcatcatatccagatatcctcgagaaaggtggtgtgctacagtacaaatagtactactattggtgtgtggacaggattgatatcctctcgccggtcgactacatcgttcacggacatatgggcccgatgatctttaggcccgcatgtctgtgacaaagacgcaccaagacgcggtgcagtcgactgcgaagaatctttatctatgtggatgatgtagatggatgccaactcaaaaaaaattggttattgcgttcgtttgcaaccgattggttaatagttcgtagtttggaaagagttcgtttgtacgtttttcgatctacaaaatattactcgacgtgtttttttataaaaaaaatatagaaaagttgctttcaaaaattaaattaactattttaaaattgtatgctcgccaaagctcaaagagatgtcggggtgtgggtgtgggtgtcgctggggcacgactttcccaacatggtttcgagccatcgtctctcgtgtcatgctcgttcgaccttgcaagccctaacgaggctcgcgcgtcttcctagttggttgaggggcttgcatgggacacatcgacacactatgaatgtccttacatgatctttctgtttagttagggcaacgtcaatgttaaaggttacgtgaaacataagagtgggacccaccacagtaagcagcagttgtttccatgcctacaatgcttgtgtcgcagagagaaaataaggtggggcccacagggtcccatcgaggggaaaaaatatcactactcactccttccgtgaaacacttggcgcaatgaaaagtccccatcttctattcacttcatattttattagcttgttgccgcaccgtaaggttaaggcttctttttctctatggttcttatggtgtgcttgcacaatgcttaaggtgttgtactgtataacattaattgcttaaggctaactttttaccaacattgtggatgcccttaggaggcaaaagacatggaccttccaacaacgcacaaccacattgagtgccattgtagctaaaataaagagtaaattgcacttacggtgcaacaacttagcaggtgggtgtaatttagtacaataacttaaaaaatgaacgttctagtgcaacaacttggtaggaatgtgcaatttagtataagaactttataagtgatcgtataaatgcaacaacttgtaaggtaggtaggattttgatacaataaattaagaagttacgtgacaacttaattatttagagcatttttatataaattcaaatttttaagtacttattttaacaatatactagcatggaattatataaacatatttatatttttatcctaataactaataactaaaaatcaattaaactggattaagaaattattatatttcggttgataattgagaaggtgaagaaaacaaaaattttaaagataattggatgtaaattgtatgtgcaacataattcttaaagattaaattcatatataaggtaatatccgtatgatcagtgtgtattggcatacttacatcgtgaaaaatctcatctagcatatgcttagctaaattgattcactaaaatactaaattattaagttttttactagaacgcacccacttgtcaagttgttgcactcggacgttcaattataaagttcttgcactatattgcacccacctatcaagttgttatatcgtaggtgtaatttactctaaaataaaagaggaaacacgaacttgtgtgtggtgtcagtgtgtactgtctacctttaatattgaagttgcggcacaacaaagtcattgtaacgatctgcttgcgctgaatcacttctcaccttgataggatgatccactcctgaatcttgagctgcaagccgattcatcttaagtaaattagaaacatttagttccacttgccctcttggaaccaataatgtcaccaatttaaactctaccattaaaattagacaagcctaagaaacttccagttcttctgatcaagggaatgtttgacttttgttctctgacctatgtgaagtcgtaagcacatttatctatctataataactctattaattgagcaccacgagggaactaaccgaaaatatgtaggagtagttgatgactaaccctgctgcaactaagcttagggtgtgtttagatcccaaaaatttttggtctaaaatgtgacatcaaatgtttggacacatgcatggagtattaaatatggacgaaaaaaaccaattgcacagtttacatgtaaattgctagaaaaatcttttgagtataattgcgccatgatttaacgatgtgatgctacagtaaacatttgctaataacggattaattaggcttaataaattcatctcgtaatttacagacggaatctgtaaattgttttgttattagtatacgtttaatacttcaaatgtgtctccgtatatttaaaaaagtttagccaaagaactaaacacggccttaagcaagttgtgccatgcaataaaaatatgattagaaatagtttatcataaagtatagcatggctaagttttttttagcaacagaggttatcgcagaaacaaatttacagattagcccgagatattacacaaccaaggagactcttagtgtcaaataattaagaaattataaaagaagtctgggcatgctagaactcaccccttccactatgctagcaagcactttcctagcattgttagttataaatttggaagtatacatgacatgtgataagtgcagtgcgatacaatggcggcaacaaaataaacatatatctaaccatgacataactaaagtgtgacttagcaaaataagacaaccaaacaaaagccgtaaaataccaaaatacccaagaacccaacacaattgatatgttgctgagccggacgactacaatctccagctataaagcagccaagcaatccatgtcttcttatcccagaaacattgatactgatacagatcacttgtctgccagtcacaagcctcatgccaaaagctcctctcacacactcactctctcgcgccatgaaattctcctcgacctcaacccctttattcatcctcctcctccctttcctgcctctcctatactttctctacctgtaccaggataccaagaagcagcctgcaggttccaatggactcaagtcctaccctgtagtcggcacgctgccgcacttcgccaagaacaggcacaggtttctcgagtggtcgaccgacgtaatgaagcgcagccccacgcacaccatgacgttcaaggcgcttggcctcacaggcggcgtcatcacagccaacgtggccaacgtcgagcacatactaaagactaactttagtaactacccgaaaggcgagctctccgtgtccttgctcgaggacttgcttggccacggcatcttcaactccgacggcgagcagtggctgtggcagcggaaggccgcaagctacgagttcaaccagcgctcgctgaggagcttcgtggtggacaccgtccggttcgaggtcgtcgagaggctgctgccgctgctggagtgggcgcggcgcgacggccggacgctggacgtgcaggatgtgctcgagcgcttcgcgttcgacaacatctgccatgtggtgttccacgaggacccggcgtgcctcgccgaggacagcatggtctcgtcccagagcgcggagttcatacgcgcgtgcagcgacgcccagaacgccatcattgcccggttcatgtcgccggtgaagtcgctatggcgcgtcaagaggctgttcaacttggacccggagaggcggatgcgagatgcgctcaccacgattcacggttacgccgaccggatcgtacgggagcgcagggcgagaggggaggccgggctggcgcgcagcgatgacttcctgtcgcgcttcgccgcgggcggtgagcacagcgacgagagcctccgcgacgtggtgaccaacttcctcatcgccgggcgcgactcgacgtcgtcggcgctgacctggttcttctggctggtgtccagccggcccgacgtggaggacaagatcgtgcacgagatccgcgcggtgcggagcgcgtcgagcagcggcggcacaagcagcgcgacattcagcttcgacgagctgcgcgacatgcactacctccacgcggccatcaccgagtccatgcggctgtacccacccgtgcacctggacacgcacagctgcaaggaggacgacttcctgccggacggcacgttcgtggggaaagggtggctggtgacctattgcgcgtacgccatgggacgtgtggaggacatctggggcgcggactgcgaggagttcaggccggagcggtggctggacgaggcgggcgcgttccggccggacagcccgttcaagtaccccatcttccacgccggaccaaggatgtgtctcggcaaggagatggcatacatacagatgaagtccatcgtggcgtgcgtgctcgagcagttcagcctccggtacgccggtggcgacggacacccagggttcgtgctctggtcgactctgcgaatggaaggaggcctgccgatgcaagtgaccaccagggagtaatcatcgtccacttcattgctagagttgctcttgctttgatcccagaaataaagcatgaatggttttcttgttttccctatagatggccaaatgagtcgctcgacacggcctggcctagcacaaccaaagcatggtctgagatcagtcagtcaggccgtgctcgcccactggttgcacctacgacccaatatgacacaggctgtgccatgctggtctgaaggcacaaccagtctaacgtgctcgtccttgcaataagtctattttgcctccctcatttctttgggtcgtgtcttgtatatctagaatacatctattttgcatctctcatctctttgggccgcccattgacgagctacggcctatgggagcgggggatcattgggccgtgccgtgctagatcggcacgtcgtggcgaggaagaggctcaggcacgacaattcatgtgagctccaacaggtacagacattcgccattcgggggaatatagttggccaaaagatccgcagctcgacaacccgacccacaacatggagaggcgtagcccacaacggaaccataatggcatggttttatattttggaaaggaaaaacaatcgaggaagagaggcgattgatctgaaattgtggagattttgaaatattctacccaagttaatttaaaatttagataaaatttgtataaaatttactaaattcataaaattaaaattttcggatgaaataatttcatacccgggaccgaagtttctaaaaccaaaatatcgaaccctgcttaattaacgtggtgttcatgttctgtggtcagtatgggcactaaagtacttcaaatctgtactgtcactaatataagtcggaggaattttataaaaaataaaatcaattcacatgtaattatgtaaacacttcaaagaatataattatatgagattattattacgagatttcatttgaatatagaaatgtaagattttgttgtgagatcttaataaaaggaatataacattataaccatatcgtatatttgataaaaaaaaacagttgaaaagataagaaaatctttatttgaagattttccttgttattaaataccgataagaagcattacttgtcattgatcaaatcatttgacggagagaccgaggaatgggcgcatgatcgtgggaagcgtttccccaagatctaatcgtggtaagcttcctaaagactactacttgcattaatttaaatataattgtgcgtgcaactcgtgtgattttgaaaattcacaagttcatattaggatttgttgagaaggagaaattagtggaattaaatggtgaaatattatgttcgttgagaagagaaagttggtatagaaataaaatgatggacaattctgatttgttaaaaaagagatatagatagagaaatagctacattttactttctccattgcaaaatatagctatactttctagtttgaactaaaaagtagatgcattttgggatggaggaagtaaaaaaaattgaaagctagaaataactatatttgtgatagagtgataccatagtagttgtccgcattacatagtactattttattttttttatatatgactccgttgatttttacatgtcatttgttcatctttcttatttaaaatttatataaatattatttttatatgatttatctttaaaaaatctctaggtttgatttagggggctgcaatataacggaatcctattttcgaacgggatgatcctgtcgacgtttgatgtcgtcattctggtatttgcatagtatggggatcgtcggtgctaggatatacgcgagactgaggtaaaagagacgaagacggggatttttatacaggttcaggctcctgagtggtcaggtaatggccctacatcctgttggccggagccggagttgcttttattcaccataatcacaccagtacaatatgtggggtagcctatctaaccgttgtcgacatggcggtctgaaggtctgactcgtagtcgacaacagggtagccttcctcctcgagctcgcgcccgacgaaatcagagacagtgctagatccctacggccggcctctgaaggtaccggatagggtcgatccaggcgtatctttgatgtcgatatctggcggcttgtcttggcgtatgtaggtttgtatgttgtcccgtgtatttgtgatgggtgtgttgattgtggtggtccgtgtgtccgtgttgatcgtgttgatcgtcctggggggccttgtatttatacccataggtgtcgccttgtccaagtagaactagggaaaccaatgtggatacaatccgagcagtccttgttgattccatgtagaactctggttgtccttccttatatggaactccctccatatctgaagtcagtttccgtataagacatggtatgtggtgggtcctgccgagatgcagtcaactactattaggtatgtggtatccataaccctgacagatcccgagtaggtatcaggtgtgatacctattaggtatcagacgattctacacaacaggatgatcccgagtaggtatcaggtgtgatacctatcaggtatcagacaattctacactcgttttatgtgatacttgcaagtatcatgtgatacttatcaggtatcatgcgatttctaccacgtatcgcgtgatactcgcgaggtatcatgtgaaacctgtcaggtatcagacgatttcaaccatgtatcgcgtgatactcacgaggtatcatgtgatacctgtcatgtatcatacaatttctaccacgtgtcgcgtgatactcgcgaggtatcatgtgatacttgtcagatatcagacgatttctaccatgtatcgcgtgatacttgcgaggtattggatgatacctaccaggtatcaggtgattcctactagatatagctgggcattccgttgggggaggagcaccccgacatgcgcgattggtcccctgcagctgtcccttgtagacgaggacagcgacggcggcggtagcgggggacgggcacggcagcggcgggggacagcaacggcgaccgtaggggatgggcggcatcgacgggggacaggcgcggcggcggcgggggatgggcacgacggcggtggaggcgacgggggacgggcgtggcagcggcgggggacggcgacggcggcgagtgagcaggcctggtgcgtgtatggataagaatcgcgttgtggaggaggagctatcccgttgggagacggtatcctgtcccctagcattcccgttaatttatactttagcatatttacactattgttttataaataaataatcaaatgttattctaaaagttaacaacattatctattttttttaaaaaaaacggaggtattagtagttagcacctccgttataaataacgacacatcatgcatcacttgcaatctccagccacaaaaaaaaaaaaaaatcgacctcttctcgcaagcacttgcgccaatcacagctcacaagtcgcaagacaaaagccccaaatcatctcactgttgccatggaactctccccaatctcagcttctctcttgctcatcctgatcctgctcgcttttctacccctcctctacttcctctacatgcaccaggatcccaagaagaagcctcgcattcatggactcaagtcctaccctgtggtcggcacgctgccgcacatcatcaagaacaagcaccggttccttaagtggtcgaccagcatcatgaagtgcagccccacgaacaccatgtcgtacaaggcgctcggcctcaccggtggcgtcatcaccgccaacccggccaacgtcgagcacattctcaagactaactttgacaactaccccaagggcaagctcaccgtgtccatgctcgaggactttcttggccacggcatcttcaattccgacggcgagcagtggctatggcagcggaaggccgccagctacgagttcaacaagcgctcgctgaggaacttcgtggtcgacaccgtccggttcgagatcgtcaagaggctgcttccgttgctggagcaggcggggctcgatggacggactctggacttgcaagatgtgctcgagcgattcgcgttcgacaacatctgcctcgtggccttcggtgaggacccggcgtgcctcaccaaggagaggatggccgcgccccagagcgcggagttcatgcgcgcgttcaacgacgcgcagaacgccatcttggcccggttcaactcgccggccaaatcgctgtggcgcgtcaagaagctcttcaacatggagcccgagaggcggatgcgagaggcgctcgccacgatccacggcttcgctgagcggatcgtccgggagcgcagggagagaggggaggccgggctggctcgcggtgacgacttcctgtcgcggttcgctgcgagcggcgagcacagcgacgagagtctccgcgacgtggtcaccaacttcgtcctcgccggccgcgacacgacgtcgtcggcgctgacctggttcttctggattgtctccggccggccggacgtcgaggacagggtcgtgcgcgagatccgcgcggtgcgcgcgtcgagcgggagcacggacgcgacgttcagcttcgacgagctgcgcgagaagcactacctccatgccgccatcaccgagtccatgaggctatacccacccgtggccatcgacacgcacagctgcaaggaggacgacttcctgccggacggcacgttcgtggggaaagggtggctagtgatgtacagcgcgtatgccatggggcgtatggagggcatctggggcgcggactgcgaggagtacaggccggaacggtggctggacgaggcgggcgcgttccggccggagagcacgttcaagtacccggtgttcaacgccgggcctcggatctgcatcggcaaggagatggcctacatacaaatgaagtcaatcgtcgcttgtgtgctcgagaagttcagtctccggtacgccagcgacgccaacgagcgccctcggtccgtgctctcgctgacgctgcgtatgaagtggggcttgccgatgaaagtgaccatcaggaagtaaccaacaagagtgctctcgcgcctcggtggcctcgccttcccggacactcgatcaatgcgggcaagaatttgggacgtgtgtccatctcggtaggccgaatcggtgagcgggcttatgaaagaatccttttaagtcccttatgtttgttgctaacttgttttggcgttgatagattctggcactgctaatcttggattgtagcccaagatgagatgcctcccatacatcacagctctcacatggtactattgggaaaaagtttacttcagatccctcatctcattgtcgagtttcagaatcgtctctaaaccagaatatcagatataacgcatcactatttttgcaaaatcgggtcccaaagtagtgttgaggacggttttggataaaacaaaaattaaaataaataaataaaaaccacgaaaatgtaagtgaaacattatattcctccttgtatatcttcccatcctccggtttctctccctaccgccccatcctcaccggccggtcaccgccgctgcggccttcctgcagctgctaccactgaagatcatcgataatgcggcagatgtcgaggtcaagctcccattcacaggccttgatgtcgaggtcaagcgtcaaaagagtctcttgaggctcttgacaagcagagaaggaagtttttgtgggcggggggagaagccttgacgggtggaaaatgcaaaatcaactggacccgaacctgcctacccactggttccggaggtctaggaatcctaaaccttgagaagtttgtaagagctttgcgcctccgatggctttggcaggaatggaagtcaccggagaaagcatgggtgggttctggtacaccgtgcgatgacaccgataagctccttttcgcggcagcgacatccataactatcggaaatggggcgacggtgagtttttgggagtcagcctggtggcaggggagaaggatgaaagatgtggcaccgctagtctacgcggtctccaagaaaaagaatagtacccctccaacatgccttgcaatcagatcaatggctgctcgatctgggattaccaacggacgtgggctggacaatagagctgattgaccaacttgtcacggtttggagcgccatccagacaatagagttgacagaacatgaggacgaccaaatatcttggaagctcactagccnnnnnnnnnnnnnnnnnnnnnnnnnnnnnaatgcacaactacttggaacaacggccaacaacttcaacaacctaatttggaagccctgggctcctcgcaaatgcaaaaccttcgcctggctggtcattcagaatagagtctggacctctgatagactatgtactcggggatgatcaaatagatccatatgtcccttatgtcgtcgggtccaggagacggctctacacctcctcgcaggctgctgctacacaaagagaatatgggcaaccctagcggaatggacggcgtgcaacaatattcaccccaaccattgacggcaggcttcgtcggtgttagaatggtgggatcaaaccacaagtgtaaaagaggcacccaaaaaggctctacgctccctaacgctcctagtcgcctggttgatctggaatgaaagaaatcgcagaatattccagcataaggagctcccaccgagtggtcttctgacaaaaatcaaggacgaggccgagtggtcttctgagaaattggcttgttccttagttgactagggccaaaggtcctgagttttttcttttccttttcactgtacagttttctccttctatattcaatgaaattggcggctcgccgattcgttaaaaaaaaaaatcacgggccagtttcttgctcctcgtccagcaccgccctatcgggcaagggtggcagcctgcaggtactacaatagttggagctcggcacagggctatgcattggctgaggtggagtccatgcgggcgtcaaggccgccaccatcgccgctagcacatttttgttgtcaagcttcgccgctccccaaatggaggaaagcgtcgatgcggtccctgtctcaccagtcggagttgagaaaaccaaaaaaataaaaatagtttgatttattttgagatacgacatatctaagttgtgttatgttttttaggttggtttatctccggttaaaagacaaaaggaaataaaattcatcggaaatgatgatttatgacgtcttatcttaagcaataatttatgacatactccctttgtttaaaaaagaatcaacttctgataatgaatatagataactgtcagttcagaattattctagaagttctttttagcggaggatgtaccccactgccgcaatccaaattacttacgccacttgcaaaatgacaaattacatttactctttataaatgacacaatattacgggaatgggcccgcgcgctggctgcttaactcgctcagccgccggcccccccccatccgcgtgcgattagcacaagctaattacgattgttactgttaaataccataattaaaaaatacatgtataatttaaaattttgagttatcagttttaaaaatttgggttaaaacttttgaattttgatatgaaagttttcaactagatatgaaatttttttaattttgagttggaagttttgaatttcaataccaaagttttaaaatttgagatgaaaatttttaattgagttgaatgtttctgaaatttgaattggatgttttcaaaaattgagttgaaactttcgaattttgacttgaaagtttttgaattttgagttgaaagtttttgaaatgtgagttgaaagttttcaaatttgagttaaaagttttcaaattttgagttgaaagtttttaaatttgacttgaaagtttttaaatctgagttgaaagtttttcaaatttgagatggtaagttgaaagttttcaaaatttgacttaaaaaattcaaattttgagttgaaagttatcaaatttagggtgaaagttttcaaaatttgacttcatgtatagatttcttatcaatctgttataaaaaaacaaatcttatcttaattattatcattatctaaaactaaccgtattagttagcatgtatccaaaaaaaatcccggaaaaaataaacacagaaagctcaccgagtgacaagggcccgccacgtctctaagtcgctagtacgcgcgaattagcaaaaccgcaatattactccatcactcgaactctgatccgaaaccaaaaaatccacctcttttcgcaagcacttgcgccactcgcaagtcgcaagccaaaaatcacctcactgtttccatggaactctcctcaatctcagcttctctcctcctcatcctccctcttctaccgcttctctacttcctctacctgcaccaggaccccaagaagcagcctcgtgcccatggactcaagtcctaccctgtcgttggcactctgccgcacttcatcaagcacaagaatcacatcctcgagtggtcggccggcgtcctaaagcgcagccccatgcacaccatgtcgttcaaggcgcttggcctcaccggcggcgtctttacggccaacccggccaacgtcgaacacatgctcaagactaactttggtaactatgtcaagggtgaggccatcatcaccatgctcgaggacttccttggccgcggcatcttcaactccgacggcgagaagtggctgtggcaacggaaggccaccagctacgagttcagcaagcgcacgctgaggaacttcgtggtggacaccgttcagttcgaggtcatcgagaggcttctgccgctgctggagcgagcgggacgcgacggccggacgctggacgtgcagagcgtgctcgagcgcttcgcgttcgacaacatctgccgtgtggtgttcgacgaggacccggcgtgcctggccaaggacagcgtggcctcgccccacatcgcggagttcatgggcgcgtgcaacgacgcgcagaacgccatcttggcccggttcaattcgccgatcaagtcactgtggcgagtcaagaggctattcaacatagagtcggaaaggcggttgcgggaggcgctcgccacgatccatgcgtacaccgaccggatcatccgggagcgcagggagagaggggaggcacgcggtgacgacttcctgtcgcgctttgccgcgggcgacaagcacagcgacgaaagcctccacgacgtgatcaccaacctcgtcctcgccgggcgcgagacaacggcgtcggcgctaacctggtttttctggttggtatccggccgtcccgatgttgaggacaatatagtgcgcgagatccgcgcggtacggcgtgcgtcctcgagcaacggggtcacaagcggcgcggcgttcagcccccatgagctgcgcgacatgcactacctgcacgcggccatcaccgagtccatgcggctttacccgccggtgtccctcgacacgtacgtctgcaaggaggaagacttccttccggacggcacgttcgtcgggaaaggatggcaggtgacgtactgcgcgtacgccatggcgagggtggaggacatctggggcacggactgcgaggagttcaggccggagcggtggctggacgaggcgggcgtgttccggccggagagctcgttcaagtacccggtgttccacggcgggccgaggatgtgcctcggcaaggagatagcctacatacagatgaagtccatcgtgtcgtgcgtgttcgacaggttcacactccggtacaccggcggcgaggggcatccggggctcgtcacctcgctggcgctgcgcatggagggtggcttgccgatgcaagtactcctaaccaatagggggcaagcagtgtcgtgctaggccagctgttctcgacgacttcattagtcctgcttttgttgcgtcgctctcggctctcgcctgttcttctactgttagtccttttatcttctccgaactacgaattgttcacatttctgggagctagcatgagttgcatactgctgtgcttggctctgccatactaatactagtggattttaaacctcgagggaatattttcttattatttctatgtcacttaagtagttataaaaaaaataaaaagtaacaagatagattaacctgtgatatattactttacaaacatataagctaaaattaaaattttacaagttataataaaaacaaattaaactatatggtgaactaattgtcggtattagttccgagattgagatgttcaccgagtgggccggaaaggcactcagacggccacaccctctatttctccaattacgtgttcaactgtcacatctcatgcccctgtatggctgtattcatcgccggatcgccccgtcacgctcaatagtcaatgttattgtttacgagtgaccagtcacacatacagatttcgcgttaacagaatcaccagctaatgacgttattcgctcggtctcaaaattaattaagcactttgtttgatattgcttgaatttttattacgaactttttataattgtttgtttaagggttttttttttctgaaatgttttttttccaaatccattattgtttaataaacatgttctatttgcacaataaagctcatgccctctaattagttagctttttgttgcatacttattgcagtctaatcatataagaactaaaaaatgatgcaatgcttatgctaatgggtaatacctttatatatcaacatttttacaaatatgaatcaacttttgtgtaaacatcgatctaatactaaaataggttcctgttgtttatttattcatggattgaggggattcaaaactatgttaaatacatatacttgtagagtccaattctagtgtgcagtgtaggagacaacccataagtgtacgaggctagcgagaacacaattattggatggctaaatataactacaaatatatgcggttatgttgagaggaacaaatatatgtggaaacttaagatgccgcttaagattaagatctttatgtggtacttgtttaaggggttgtgttgaccaaggataatttggcgagacggaattagaatggtagcttaaggtgttgcttttgtatgaaaaatgaaactattcaatatctcttcatagattgtcattatgcaaaattcatatggagagcagttcagttttcttttggttttaatcttccaactagtatatttcatatatttgatgggtggcttttgggggttgacaagaaaaagagtaaactgatactggttggagcttcttccatttgttgggctctatggttgagtagaaatgatttggtttttaataaatcaccatctatttcatatatgcaggtaattttcagagcaacgcactggctccggttttgggcacaactacaaaggtgtgaggatgatggggagttcctaaaggttgcatgctgcaagttggagtcgatggttatgcaattatttgccaattatggatggaggttcacaaatagacttcaataaatgtgttctccttattttggcttggtttcctctgtttttgtttggtgtgtcctatttagctgaactacgctcttttctggattgctacaatgtaataattggctgtagctctttttaagcaaaggctgggatgttaaattccattatctaaaaaaatataactacaaacatatcattatctggaatgagctttttatgattgttcccataatttcatttttttataaaatttttagttaaatattaggaattatgtaatcgaaagtaaccaacccacaaatattttgtttagctagcctgcattgggcatgaattagttacaattagattttataatcgtttatctgaagcctataatgtctatccacttgtcataattatcacatattctatgaagttctaaaagaccctagaaaatatgtgtttcaaatatcagataaattatttgaaagctttttgcatttgtagcatggaatttgtttggtcactatacaatccacttgcaccttctactcaatatatgccctatggtgacaaaaagtaaggactagctggagtcaataggactcctcttatcctctattgatgcactatttttatctcattaaaactggtctactcagtgtctccctgctttgctttctctctcattctagttcgcgcaagaaaatttttgggttccaaagtctaaacaatacattgtaaattttttctgtctagtagatgacaattgtttggtgataatggttttcttgcacctccaagtcatcatgttgcatggttgtaaaacttgtatatatgctgagacacggagattaccatatgattcattgtagtagtgtttacagtttcgatcgtgtttagttaatctttcttttcatgtctcggtgtatcgtaacacataaatggattccaaacttaattcttcaagtgaatatgtgcatggtgacatgtttatagaaagttaatgtccatatatatggatgataagatctttttaaaggtttgtgcacagagaaaacatacttttttttcatacccgtaaggtatggaatataagcacatagccaccggcaagtatatatatatatatatatgtaccatatactaaaatgctattaaataccgtctaataaagtaatttaaatgttacatagaatatattctagagcacttatgtagaagatcgtttggcactcttcgattatttgagcacattttagaaaactcatgaattcgattgtttcctctaactggcaaaactgcatttttcgatcaatcacaaataaagatataaaattataattgttatggtagctagagtcaaaagccgaccttaaccaaatatgtcattctggatatgtattggcagtgaaaacataaagtaaacatcgattgtgccaatatagcccgaggggcattgtatgtatgtacatacgtgcaccatcccaacatccacccctctgccctcattcatgccttctccccatgtattgtctctcatgttttcatcatatattaatcaggaaccctaatttattataatctttttaaaataaataactatttttattgaggacccatattaactatatttgaacttctaaaataaatattgtattttttgttatattctgactttttttcatatcatttaaataattattaaaaatatgaaaaaaatcaatgatatataccttacctgttgaaaatatttttggtgaattttctttgcatctatgtataatttaggatttattactattaaaataccaaccaaataattttagaaaattccaaaatgatttgagaatgttaatcttacacaaattaaaatttaaattggatctacttaaaaaaacacaactaaattacatggtttgcatttttacatagttcaaactaccgttgtatatttgttaagtaatatttgataccataaagtatatagtttgatgtgattatttttgaaaaattgttgtggagttaattaatacatgtggatgtcatcttacgcaatgtattttgtgctaaaatatagtgaatataagacatccatgtaaaatcataataaaataaatgataattatgtatttttattagtaagatgaataatcaaacacatgctcaaaagtcaatagcggaaaaaagtaatataaaaatatttaggggtatcctaggttaaaaaataacagtagggtgaatggtaagaaaaaaaagggatgagtacgtactacctgcctacgtacgtacgtgtgaggtgttaagtaatatttgatacataaagtatatagtttgatgtgattatttttgaaaaattgttgcggagttaattaatacatgtggatgtcatctgccgcaatgtattttgtgctaaaatatagcgaatataagacatccatgtaaaatcataataaaataaatgataattacatatttttattagtaagatgaataatcaaacacatgctcaaaagtcaatagcggaaaaaagtaatataaaaatatttaggggtatcctaggtcaaaaaataacagtagggtgaatgggaagaaaaaaaaaaggcgatgagtacgtactacctgcctacatacgtacgtgtgagggagggtggaatatgtacgtgtactgagggagggagggaagagtagatgtacgggcagggactggagaggaagggataaactactggttttaatctaatctaatgctgtaaaataatggatccaccagtttaaatgaaaattgagggttagatgtttctcgtctattaaaacgccacgtggcggcttaggagtgtttataggggtgccacgtggcagtttaggagcgtttataggaagtttaatggacttttagtatataatagatagatagatagatagataatagatagatagatagatagatagaagatagtcaaaactttgtctaaaaaaaatcataaattaattctagtgcttataaactaaaacaatttatattctttacctgcaccaccaacaatacaacttttacatactccctccgttttttaatagatgacgccg

SEQ ID NO: 42695 - DNA, 6338 bp, Oryza sativa
gtcatctattaaaaaacggaggtagtattatattaagacaaattttgccatagaaaatcgcgccttcgtggttttagcagtaggacaccgtacgaagtgagttttggtgaacactttataaacgcggtaatttactagcagacaccacgctgattgtttcagtgtattttgtgctgacgttgtgagagggacctacttttatagtcggcatgaccaagatgcccatatgtgttttggttacagtggcagacgagaatgctagatagcgatcagtcgcgcgcctccctccccgcgcgactggacacgtgtcgtgcgcggagagggggcggccgacgcgtcgcgagggaggaccggaggagcgagttttctttttttttttccgtttctgttcagttgttttttctttctccggttttttcgtttctgttcggcctggttttttttcagtttatcttctgtttggttcttttttcggtttttttaaagatatataaatacaaagtttgtattcatatgtatactaagtttgtattcgtacgtatagaaagtttatatacgcgtatacacttgtatagaaagtttatatacgtgtttgtatacgcgtatacaaactttctatatgcatatacaaagtttctatatgcaatacaaactttgtatatgtgtatatattttttatgcattaaaatatattcataaaaattatatatatacgtatgtatatactatatagtatgtatacatacgtatatacatacgatgtatatagtacttacatacgagagagactagggggcgactgatcgcacgcgcgcggaggcgcgcggctgatcgcgtaccagcgcccccctgttcctggcccggcccagcagtgagcgcaaacgaagcggtggaaggccagcgacgcgaacagatcacatgcgcgggtgcgtaaagagaatagaacaagaacagatcgtgagagtgccgccgtctgccgccaacgtcctctcctcccggcgaaatcgcgcgcaaccaggccaccagggtagcccgcatcgtcgcgtgtcgcgccagcgccgacgcaattctgcggtgccgctgcttcttccttgttgcaatttgcttgccgccggctgccctcgagtactggacgaggaggacgggacagtcaccgatgactgattcaggtgagtgcaacaccaatacaactttgctattgctaatttgtcattgccagatgaaaaattgaagttctggaacattgtgatttcatctgtaatctgatctgctggcttttaaattcagatttgttattttgtagtgtaatttatataggataaaccactataataatgttattttttgattattaggctatgtagtcgagaaagtatgcatcaggtagcaataaaatgaattaaatggtttggcaactttatgcatcgagaagaaattattggataaaaaatgataccattatcaatgacttcgcatctagaaatataagaatttttttaggtaacatgtacaatgttttgtatataaatattatttttgaatgcaatttaaatgtttataatttaataagggcctctatgtcaagtttcgcaccaagaccctgaaaagtcaggaccggccctgcgtacggagcaagggagcggcgacgcgtggccctcagcgaacccagccgtgcatggactgctgcggtgcacagagggaggtagcaacgcgcgcatcccttggcgaacccggtggcgcacggagaactcgatggcggcgagcaagcccttgtcggctttccatccccttcctgctaccgccggattccctaatcaattcttcggctttccctctcccttcttgccgccgttggtttcccctcccacaccggtgacgacctcgacaacagtgctctgcaccgagctctccatgatttgaagtcacgacgtgccaggggcaatttgtcatgatgagtcaaaaagtgcccactcttgcctagtcagcaccaaaacactaaataaatgggtgtggtgtctactggcaaataaccaagattacatagtttcttccttcaaaagtgatttcgtgcggtatcccacagctaaaacatgaagttatgatgtcctgtagcaaaatctgcctattattagtgagaatattttggtcttttcttcttctcttcgtaactccttagaattttagaggatgattttttttatacatagaatatcgtgtagttcacatgagtgttcaatgatgcacaaaacaccatcgtgtcccggttcttatcataggtgaagtcgctgtgacgtttcaagaggttgttcaacatggagcccaagaggcagatgtgggaagcgctcgcgcgccacgatccagctacaccgagtggatcattcagcaagcacaacaactagagcctccgcgaagtggtcaccagcttcctcctcgcgagcgttatacacgtcgtcggtgttgacctggttctctagttgttgtccgaccggtctgacatgtagccgtggaggacaagattgtagtgagatccaagtggtgtgtagcgcatcgagtgccgaagacccaaacggcgcgacatacaccacctcatgggcatcatcgagttcctatgccacgttcgtgggtaaagggtggctggtgatctactacgcctatgccatgaggtatgtggaggacatcaggggctcagactgcgaggagttcaggttggagcagtggatgaacaaagccggcgtgttttagccgaaaagctcattcaagacttcgagtaccccatcttctacattggacaaaggatgtgcctcggcaaggagatgacgtatatacatggattcggattcactgcattagagaagctaatgcaaagggtggcattagctataatccttccatccatcaccatccaatggttgtggctagtcttcatctttcttatctccgttgctagaacgaatgtcctgtttcatgtttgattcgctgaatcaataccaagctcttcataaattttgatagggaagagaattgttgcaaagtctaaatgttcatggttctttgctcgtttgtagtactgacttgtggcaaaagccaaactaaagcttcataataacaattagttcataacaaggttgattgagggacaaagtacaaaaggcatttcacaaaggaaaataaaactataaccctgattaagtacaaaaggtatcttagggaggaagataacactataatccataaaccaaaatatgcagagtagcatcaagtccacctctcagatgagtgaaatgtcattacttttcaccaaatagactacctgcactggaatcattctgcacaatgtagcaataagtatatatcaatcatgaacaaaatatagttttctagataaaaattaagtataagttccagattaccataagtaattatgggtacgaagtaaagacgtcgaagttttcaaatacttcttcactttttgtggagcttttttgttcttgtccttgaaattgagacacatgggtaagatcttcttcctgtgaacaattctttttttaaaaaaaaaacattgaggcatctagagaaattatataagacattgcattgtttgatatttctaaactttgtctgcaggcacctttttttgtgtcatgctctttttcttgtgaaacttgtcaacccaacctggtgtctgctttgctcctcgtctccagacctcctttttctccgaatgttctttcatcctcatattcaaatgcgcgggcactaaattcaccaagtatatttggtctatcactcttggtaagtgtcaaaggctagcttgaccgcactttacatgatgtgaaaagtacaaagcccatgccaagttccatgaaatactataactatagcctttttcatagccgtaccttgatctgttagatggcttttggatgcttttgattatgagctgccaaaaatgtttcaaaaagtcatttgaaggagtcgaatgtttcatcatacaagagagcacctcaaaatatatactctttctccgtaatggttaaatccaacaaacacactaagtgatctatgatctctatttgttccaaaggtggtatcaaaagtaatgacatcaaaaaaatatgttagcaatcctcatcaatctaagtgtactacatagtgaaacgaaggattctctacacatttatattgaaagtattttagcatacttccagtttcaccataaatccaaaggttacttgagccaccagcttccttactagctaactcatatccagctttaggtctgattccataatcatctaccatgtcaatttgaaaaccttgcacatgtgaaattttctgtggtgatggcatttaggtggcatgtttttggcaactaaaggatgtggtagcgttcagtcaccaaatcatatacttcataatttccttcaactttgtttaattttattcccatatgaacattgtagtcagttcttgtctgtgctcggggattcttggttagataatctcttttatcttttcctcgatgaccagcacttgagcaaacaaacctactagaagtaaacaacccatctacaacacttttgttgttatgctgctttctaacatcaaaaccaatcttaccaccatagctaacccaaaatttccaagcctcatctacactgctaaactttattccagtatccactttacaaatattgggctatattattggaatacaagtatgtccatctatgacatacttatgtttgattggaatatgcccccaaaaactgctagtggaaaccaatgaaataataaggataaattcaagcaacaaccttcacttctctgcatttttgttgatcctgctttcctttgtagcgttgactcatatttgtggaagcatatttggtgatgagagaaattgggagataagtatggtatgagagatagaaatgtgttactagaagccaagaaaaccataaaaaaaaatgcaagcaacgatcttcacttacctctctaaattttggttgatcatacttccatctcgtgtttatttatcttcatggaatcacttcaatgctaagagaattggaagaggtatgtcatgagagagagaatgaaaagacttatagaagaagcccgaagaaattggagggaaaaggaggagtcctgtagggttttggtgcctaaaatcgacctggacctatggtgcttcctctaagacctgtctcatctttgccttatgtaatagaaaattatctacaaccgttagatggagatggatggccaagattagagctaatgccaccctctgcattagcttctgtaatgcagaggatctggatccgacatactccctttgtccccaaaagacttaaattttagagataaatatagacacatgttaaggtaatatttttttagtgaatcttctgatgaatgagataacttttgttttattatcaacgaggaaatggattttatatcttaaagtgtattcgctgaactcatcaaatctcactcatatctgaaatcagtccggaaaacctaatgcgcgaggcgaacacatttttccttttctgttcaccccgcggcctgcatgctcccacgctgaaaatgggcctatgggcctatgggcaaatatgatatttgttattgggagtacctatacatctttcgaaagatttttatgatcgtatcacacagatttttaatctttagattaaaatccgatagatataataaaaagcaaaaagcaattaagaaacaccataatggacactaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaatttgagtgagaaaatcgagtgagagataagaaaaaatctttcgtgtgagatatagcaaaatcgtttgttatttgggagtacctatacatctttcgaaagatttttataatcgtatcacacagatttttaatctttgtattaaaatccgatagatataataaaaagaaaaaagcaattaagaaataccataatgaacattaaattaccatatcctcaagaaaaagaccaaatcaaatacaaaatttaaaatttacatgtgaagattcaaaaattacagtgtaacttacaaaagttacagtgtaagtttcataaattacactgtaacttacaagaaaatacactgtaaatttgagtgagaaaatcgagtgagagataagaaaaaatctttcgagtgagatatagcaaaatcgttgttatttttatct

SEQ ID NO: 42696 - DNA, 10958 bp, Oryza sativa
ggccaatgggccttaatgatcctaatataaagtctccacaaatatattttgagttgatcaaaagacgtttttttttttcgattttgctatatctcactcgaaagattttttcttatctctcactcgattttctcactcaaatttacagtgtattttcttgtaagttacagtgtaatttatgaaacttacactgtatgtaacttttgtaagttacactgtaatttttgaatcttcacatgtaaattttaaattttgtatttgatttggtctttttcttgaggatatggtaatttaatgttcattatggtatttcttaattgcttttttctttttattatatctatcggattttaatacaaagattaaaaatctgtgtgatacgattataaaaatctttcgaaagatgtataggtactcccttttttttttgacagagaattcatcaagacgttgttgggctaaagcctggtagaaaaaaaggaataagttcacccgaggtccctcaacttaacagcgagatttttcgaagtcccttaaccacaaaaccagaaatctccacccctaaactatacaaaaccgttcactcaaggtccctaggcagtatatatgggtggtttcgctgacatggcatcctagtcagacaaaatttttttttaaaagtaagtaggacctacatgtcagccgcacgtttttttttcttgtccttctcttctcttttctcgcttccctcttcttcttcagtgaggaggccggtggcgggcggagtggcgatggcggcgtgcttccgctgcgcgcagtcggcggcggcggcgtccggccccgcggggcccaaccgccttcctcccgcgggacggcgctgtccatcgccgtggtgcacgacgccatggccgcctcgaggctccgcggcagtggcggggcggtccaagtcgtcatccggacttctggaggcggaacgtgaacactgcggcgtagtcgtggatgacggtggcgtcgttggcacgagcagcggtacggtccacggcgaggatctcctcctccgccatgcttctgggcacctggccgacgaacagccacatcctctcgccgtcatcatcctccgcatctccggtcattaccgcgatttctctctctctctctcccgtctcttttccttttctgatggctatgcaacctcctgtccgtcctctcctcgtttttgcctgcgcctttggcctttctatatcggacgagcactaaccactgattgattgattgatcagtatcagtgtcttgagtataagttaattaatcgatgagtagtaccaactaccaagtcttgatctcgagtagcagtgaatgtgatcgaatcatctgattgagcaaaaagcagcagcaacattgatgcctccgcctcgccgtccagcgcgacgacaatgtcgtgctcggcgccggactccaggaaccgcgccctcgtggaccagcacccacacccgacgaggagacactggccttccgcgtccgtcactgactcctctggtggcagcgcgggacgaggcggttccgcgccgccggcgaccgccgcatcgacctggcgtgggacctctcacccgcgcacacttcccggtctcgggttcgcctgagccttcctttgggtgtagccgacgagccgccgtcgcgccgtggtaccgccccgcagccacagcagctgtgcggctggaacagcggtggtggccccttctcctcctctttctcccccggtgagtatagatggacagactacatcggcgtcgtgcgtgcatgcatgctgcattcttggcgtattagttttgtgcatggatcttacgaaggtcgggggaggacggcgatgatggtgtgccacgacgtcgagatgccgttcctgcgggggatcaacgtgaaccggccggcaccagcggcggagacgacgacagtgaggggggcaactgtagcgaggaggaagaggagcccagcgcgacctcccccaacagcacgctctccagccggcagcgacgacgagaactgcggcggcggcggtggatctcgtgtaccgcggctggggcagggatgggagcagcagcagtagggagaagagaagagaagagaagagagaagagagaaaggagaagaaaataagatatgcagctgacatgtggaccccacatgctttgctaactaggatgtcacgtcagcgaaaccacccatatatactgcctagggaccttgagtgaacggttttgtatagtttaggggtggagatttctggttttgtggttaaggggcctaaaaaaatctcgctgttaagttgagaaacctccggtgaacttattccaaaaaaaagacaggttgaagcccatgggctggtttttctagcttgcagcgatgcacgctggttgccacatgcggatgtacaatacataggttgttgcaacgttcgcgggccgcgaacgtccacgtactagacgcccctcaaatcagtctctatcataagaaagaaaaatgaatttaggatatcgtaataagaaaaataaataaatttgactaaatataacccatggtgacgtatcgactatcaattaattaagcaaacggcttgcaacctctgattgccagctaaaaaaatccacgatatattcttgtcctaagtacagtgacttatgacctctaatcccaactacaggtctacagcgatcaaatcacttgcgccactagcaaaattgacgaactggatttactgtttataaatgaaaaccacttcgtcgctcactcgcttgtagtctccagccacacaaccgtaaaggtccacacctcttctcgcaaccacttgagccactcgcaagtctcaagccaaaatcatatcacagtcgccatggaactctcctcaacctcagcttctctcctgctcatcctcctgctcaccctcgtctacttcctctacctgcaccaggatcccaagaagaagcctcgcacccatggactcaagtcctaccccgtggtcggcacgctgccgcatttcatcaataacaaggaccgtttccttgagtggtcgaccggcgtcatgaagcgcagccccacgcacaccatgtcgttcaaggagctcggactcaccggcggcgtcatcaccgccaacccggccaacgtcgagcacattctcaaggctaactttggtaactaccccaagggcgagcttgccgtgtccttgctcgaggattttcttggccacggcatcttcaattccgacggcgaacagtggctatggcagcggaaggccgccagttacgagttcaacaagcgctcgctgaggaacttcgtggtggacaccgtccggttcgaggtcgtcgagaggctgctgccgctgctcgagtatgcggggcgccacggacggacgctggacgtgcaagacgtgcttgagcgcttcgcgttcgacaacatctgccgcgtggccttcgatgaggacccggcgtgcctcaccgaggagagcatggccgcgccccagagcgcggagttcatgcgcgcgttcaacgacgcgcagaacgccatcttggaccggttcaactcgccggccaagtcgctgtggcgcatcaagaagctcttcaacatggagcccgagaggcggatgagggattcacttgccacgatccacggctacgcggagcggatcgtccgggagcgcagggagagaagggaggcccggctggagcgccgcgacgacttcctgtcgcgcttcgccgcgagcggcgagcacagcgacgagagcctccgcgacgtggtcaccaacttcatcctcgccggccgcgacacgacgtcttcggcgctgacctggttcttctggctactctccggccggcccgacgtggaagacaagatcgtgcgcgagatccgcgcggtgagacagtcgtcggccggcagcgagggaacgcgtggcgcgacgttcagcttggacgagctgagggacatgcagtacctccacgcggccatcaccgagtccatgcgtctgtatccgccggtacccttcgacacgcacagctgcaaggaggaggagttcctgccggacggcacgttcgcggggaaagggtggctggtgacgtactgcgcatacgccatggggcgcgtggaggacatctggggcgcggactgcgaggagttcaggccggagcggtggctggacgaggcgggcgcgttccggccggagagcacgttcaagtacccggtgttccacgcggggccgaggatgtgcctaggcaaggagatggcctacatacagatgaagtccatcgtggcgtgcgtgctcgagcagttcagcctccggtacgccggcgacgccaaggggcaccctgggctcgtggtcgcgcttacgctgcggatggagggtggcttgccgatgaaagtgacaatcagggagtaatcaaacaagcgtgatgctaggctagctggacttgtcgactccatactttatgtgtgtatcattgctctcgcttgtttggagaaataaaatagaactggtgtcgtgctccggttttttacccgaatggtgaatggcccacacacagccacgcttttcgggattcacgtgagttctgcggctgtgtttggcgcaccgagcgaaatgagatgggcacgagttgtcggatataggattgcagatttgcaggagaagctatttgcacgagttgatgggctgcccatggcgcgcccacatcgagcaaatttgaatacttcgtctcagccgaaaagtatgccgtggcggagcggtgttggaactggagacaaggccgagcaactgatacaacccctggtgctcggtgttcatcggttcatcctctcgccttccccgctgatcaatgatgagtgggcaagaatctggaacgtgtccaactcggttggccgaatcggtgagcggacttgcttttttttccgaatgcgcaaaagggtgagcggacttgtcttttttgcgaacacacaaagatgagcgaacttgattttttttcttgattccactgtggcgtcaagtttgccccatcacacggactaccttttgtctttgtttgtcgctatggcctcgatagaatctgctaagagcaaggtcaataatatagcccgttgttggctttaaaaaccagccatgtcatatatagtaaacaatataactaatgtctataataaaaatactataacacgaatattttattgtttcatgggacccaccaccttctcctaccggctacctcccattctctttctctctctttctcccatcagttcatgtcttctcttctttgtttggttcttgagcaacagagatggcggcggggtggaaaatagcggcggcggacgcaggagatggcggcggccgtgcggcgggcgttggagacggcggcggctgggccgagcggcggaggcggaagagggcggcggccgtgcggtgggcgtcggagacgacggtggccgggccgcgcggcggaggcggaagagagcggtgggcgtcggagatggcgtcagccgtgcaggcgaggggtgacggggaccgtgcgacggatgtgggagaccgcggcggccgtgcgtcgacgccggcgaggctgagggcggtggtccagtggccgcaggagttggcgacgaaggcaggcagcgcaagcatctaggcgagccccacgaactcctcgaccggcacgtgcagtccggcgacaaattagtcgtcggctcactctctctctctctctctcttcccctctctcctccagatcatcacaaaatcttatgtggaagcagtaccgccggttattgtacctgctctaaggggataagatgcaggtaaagctaatgggcggcgcccgcccctcccccctatacggctatacactccttcctccttcccttcttctcttcctattacagtacactataaatttttttttaaaaaaaataaaagttggaaaaatttatgtatagaaatactatatataaaaaattgaatttaaattcaaatttgaaacaggtatgcagacttttgacttataaactttgggtctataaactaatatttgaattcaaattcaaatttgaatcgggtatgtaaacttttgacttataaactttgggtctataaactttaggtgtatagaaatactatatatagaaaatatttaaatttaaattcaaatttaaaacagatatgtaaacttttgacttataaactttgggtctataaactttagatgtatagaaatactatatataaaaatatttcaatttaaattcaaatttgaatcggatatataaacttttgacttataaactttgggtctctaaactttagatgtgtaaacttgaggtgtacaaacttttggtgcacaaatttactaaaataggaaagtaatgcggtaccaaaaaagaaaccaggtggagggaggagggaccgaaccctgatcgctaggggcgatcgatcgccccttagcaatctcgataagatgcctcccacatcacagctcttagggcaacaacaatgtatatagcaaaagtagtccatatagatagatccacttatacaaactttaactattgtaacattcacaatgtatatggatagcaaatagtagtaggaggagagaagaggtagagacaaataatatattttattctctatgggcagcccatatgcttatgagtagcttttgttatttctttgctatggactagttccacaatgttactaggtggctgaaacaaatattgtattgcttatggacacttttagactatattgtggatgcccttacagaatggtaacaacccgacagtgtccgtcacagcgtgggcctaagaccaaatagaaatttcatcaaataataaatacaccaaattatccttatttatgcatccaaattaacacagggagacccatacgtggttcgaaattctaatacacatatagtttccatgcgagaaaattgtatatctaccatcgtataaaatgggattcgctcaaataccattgtttaaatgggtttcgctggaataccatcctcaaccaaggtgtctttgttcaaataccatcccagacgaaaatgccccatagttcttcttcctctctccttccatcccatcagctgaatagttcgccggcgaccaccaccggctccactgcctcaccgccgtcgctcgtgtcatcttggacatcgtcgcgcactgcagccccgaccagactcaccagccgccatcacgtgctcgcgtggtctcggctggccaccgtcatgcgccgccgcccaaccccgacttgtcgtcctcgccggtcgtggtcgcggtcggtgctgccgccgccgcgacgagagagagagagagggggggaggagacgccccgactcgtcggccgccgtcacgcgccgcctcgcttgtgtcgtctctgccggctgccatcgcacgccgccaccctgctccgacttgccagccaatgacgacatgagcgacggaccgccggcgacctattcagccattggagggagagagggaggaagaagaatagctaaggggcattttcgtctgggatggtatttgagcaaagacatcttggttgaggatgacattccagcgaagcccatttaagcaatggtatttgagcgaatcccatcttatgcgatgatagatacacaattttctctttgcatgcaccgcaaactgctatctatttagcactgccgcattccaaagtacacactcctttcttcccttttagtagcaccttctcttttcatatgaaaagtttgagattttgaattgattttttgattcaaaataaaagtttgatgtcacagttgtatgatttgactataaagtatttgagtttttaaatgaaagtttgattttgagttgaaatttttgtaattcaaaataaaagttatggggccatggtcgaaagtttcgtatgatttgagttgaaatttatattatctgagccgaaagttttgtgaaaatgctaataaaaggaaaaggagtttataatgggaacatgcaaacaatgtgtagccacatgcaatcctatatactccttccataaaaaaaatgaatctagaattggatgtgacttatcctattacaacgaatatggtcataagtctagttataggtttattttttatgggatagagggagtagcgcaagggaggaagatatacttaaaagtttattagccgtgcaatgtagatcttgaaagaagacattaatgagatgatcaacaattgttatcttgttatacatggtgaaactattaatttgacatatgcttcatatcaaactgttatttcggtttatattcacgccctcgtgatatatgctcaatgggaagtgactggcgtgtgctttgtgtcacgcatagaaaaatcaatatttttttaagtacataagccaaacggaaaatgaatggaattgacctaagggaacattgaaaagctaagcacgttagagtagttatttacctgcaggatttttttatacttgtttgtgcccacaagttaatgaaatacatctatactttttaaacatatttttaaacatatattgccatgtgattatatgtaattgatttttggttaagatttattgtgtccacacaatatcttataattgtactttccgttaaatacatttgatgtacaacatgaattgaattaagctcaaatgcatagattgctaatataaaaatttgaaaattattaaataaaataaaattgcatgtagcgtttagcatgggtatattactagtcatccaaaagaaaaaacaaattcactcacgtgcactcctttgtaattggcgggaatatattctagttacttgaggggatgacccctcgtataccttttctcctaaatgcactgctaataggtttttaaaaaaaatctttaaaaagtaacgatgtagagtatattgacatctatgatgcatacaccaaaaaataatcttaaattcgatctacaccttgaaaaaaaaagataataatctccaatttctacagcttcagaaaataatctccaattttcatgattagcaattgttgtatatatttcttcctcttcatccgatagtttgctaggaccgtcttcttgaaaattaaattgtccattaatgatatatatataatgaattgctggacgaacaggtggtgtgaattttggtggtatggaggagaagataatcctgtatcttccatgtccaagtctcctgcagacatctttcacagcgcttcctaaatcaaattgaaggatctgatcgagggttgcatagaaggaattcacaagaccatgatctataatagtttggagagatatttcttcatggttgtatgtgggtaggttccggaatctttggagatttatctcagctttgagaaccaggaatctataggatgggtcagagattgcctgatcatctagccttaagagagggagcatatatatgattactcgtatggctgggtttctttctcttccttctaagagatcaaagaaataatcttggagtccaaggaatattttcatttgtctctccttaaacttttgccaaacaagatcgaggatgtcttgcccaaagcaagataaagtttgctccgtcttgaagcttaatctaggttggagattttcgtatgtggtactcatgggattttggcttttaagtttcttttggcaagaatctttgtaggcacaagatctacatggtgcttttggctgggtccggagtatatattgtggaaggaatgaattgggatgattatgcagtatgtatggtgtttggggaatggtatcatgcctttttgtggatgatgatggtttattatgtggaaaagattgcaataggttattgatatttatgtggaaagcaaccatgctcaaagcaagatctgttgagatcaaaatcttatctgagaataccttggtattcttatctgttgccatagattgttcaacttccatgggaagtttatcttggccatcacgggatttctcctcgcgataatctagtaacctctcctcatgatgagggatatcttgtagtttagcccttttttctgttatcttttgatctgagggcacgaaatttttgaaataatatgccaggccatttaaggcatgagctttttcttttttgttttttgcctgccacaagaggtttaataacccttgttgtagctctgttactctgaaattgtgattaagtcgttctccatggcctctgggcagttggggcagtctccatgaactcatattcgtgaaccattcagacttttgtgatgccatttccctgcatatatattcaaaatttttagtagcttttaataaatatctatcttcctatgatgtcttacctggcaagtccatagattttggaagatatgatgggaaggaattgtcatgtagatatattgtattcacaacttgttctcttttggtctgaacaagctggtcaagaatctcatctgtgttagacgaaaatcttaggctcacctgtttgcccattatctcaaattgaatatcttcgtttgtgacaaggaagggacgaatgagtgataaaaacggtgttcctaaaataacatcttgcttaagatttttaacgagtagaaaagatgttttaatgcaaacttcagatatgcaaatatagatttcagggatttgatattctactgttaaaagtcctccatctgccccacgaattctgtgggcggctttacagaaatatttatgagggataataccttctcgaatgcaattgacatcagcaccataatcaattaaagtgatatactgaaagtaggatccgtctataaaacgatacataacttctgtgtaccatttttgcttcatatatttttgaatggttccaacaacctgatcatcttcttgaattggttcgtccttttcttccatatggaatccttcttttaattctaacatgtatagacgctttcttatttcttctcaat

SEQ ID NO: 42697 - DNA, 769 bp, Oryza sativa
  unsure (1)..(769): unsure at all n locations
ctcggacaatgaacaaggggtaaccacattggaggaggcaccaacaccatccattgaattcatagtcaattcccctaaatttcctgagaaaggtaaacttttgagaatatcagacaccaatgcacttttacccagtttaaggacaagagtagagcacctgccaaatgattaattgggtgtaaaatcaagtgccctgacccaggaaaatttagcatcctccttgcatgcatgaaagcggtcatccataaaccttgaattaactgcaggcccagaaattgcaggtgtattcttggtgcataattgagctgaaacaaaaattagaagtaaacagtatattnnttgtgcaggatataannnaattgtgattacacanatataggtagaagnaatatggntgccacttctgnannaatcgtagtccaagaggntatagtacaacaatttagccgctaatggtaatgttgtttggcataggaatgctactctttttttagattgttttactccaccatttgtaaaatctactcaaatatgtcaagtaaataaaagtttcatgattttgtaagcgtaaagaagtaaaaattaactaaatcttatattgtaaaaaagctcttgcgatcatttgggtagctaggtcacatttaataaaacgagtaagatctaaatcaacataatctttgaaaaaagttgagaactactccctccgggtgataatacttgtcgttttggacaagggcacggtctccaaaaaacaattttgaccattatt

SEQ ID NO: 42698 - DNA, 1356 bp, Oryza sativa
  unsure (1)..(1356): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgccatagtatggagtatctattttcatatattgtggcataatactttaattgcttaactgtgtaagtaatgcatggtttatcctatcatatcatatggattagccccatgatgcattctgccatatggcacatgctttctcagggcaaaagcccccgttttttttttctacaatagaagtgcagcaggacattcgattttccctcctttttcaaatacacatctttagagcactcaaattgtgttcccaaatacctcattctacagttttgagatgaccttttatcatctttttttgtggtatatccatccatccctttacctatttccagtgttgtttataattatggactagagcacacacaccatccgaaaaacaatgagatatcagatatattaaggaattgagggaatacaagctcgtggtttcaccaaagttgcacttaaatagctgactttgacatactttttgaacagctgccggactggaacattatgtggagtctctaatgaaaagagcagatgtggagtttaatgtatggattcttctcctgtgtcttatactaatttaagaagccacctctctaattttgctaaatccacaatcaccatttttatttggatgtgggggatcttggcacaatgtccaaactccaatcagccccccctcccccccacccacccaaagtacttaagactgaagtgaaactgcagcctgagtttgattgtagttgacatgaatattgtcaagctttgaatttgttatttgtggaaaaatcagtgtggtttgcttccgtgtttccttgtaggtggttgtcacccaaatgaatgggaatgattactcatcgaactctgtccatgcatttcatatcggaaaaatgagaataaagcttcgaaaaggatggtctacaaaagcaagagagtcatactcgaccacaatgaaggtacgcgtgtagtttaaata

SEQ ID NO: 42699 - DNA, 26111 bp, Oryza sativa
cctggaccaggtcatttaatggtgccatagttgttaccacaagggcgtcaaaatatagactaagccattgaggcgtatgcacttcagttgagttttctacacatttggatataccagctatcactaaagaaattaggaatatgaaactttcaggaacaacaaaaatagaaaagaagtttgcagaatttatccaatcttgttctcagggctctgtttttttatggtgcatgctatgaatcacatcttttttcatgaaaagatgtgcatagccgcataggattttgttagacttgctgaagctgatagagaacaaaaacattccaatccaagcatttctgcaagtctgcattctaagagtatttttttgtaacttatgttttccatggtcaatcttcagttgtgtgggagccgtggtgggggtaatgctgcagctacggcagttttctggcaggcaaggaaaggcctgtcctacaccttagcttttgaaacggacagggataggaacgcagcaatcatgcttgctcgtaaatttgcctcaaattgcaatgtaagtgcttttgccttaaaattgcattttgtttctaacgataatgtggtcaagaatccgtttcattcacttgatgttaggaagcaagttattttatacccttttgtttgctcaatgcagattacgctcactggtccaggtgatgaagttcatgctggtagctgaatttacagtgttcacggtgtgacagcaggagtatacatgtaggctgtgaattgtgtactgtgtcagtttgtgttttcgagagtagaggttgtacactaggctttcctctttcagcatacattctcaaggcaattctttttatttgcctgccagcagctgtttgtggtgttcgtcaaacatgctgtgcaaaatgatgattattcttgagcattatatctattaacgttcgaaaagtgatagtttgcttagaaggagcttcccttgaataatcaagaaatgtacatataatcacttccatctatggtgcgtaactggtcgcacgaagtcagtggtgattgtgttgtattcaaaggatcaactattgtgttatctggcaagtgattttaatagggcgttttgccacagtaattcttctaatggagtcatttgtttgcctcatggagaattcacccctactgaaaaccttgtcctgttgaactaatgctgtatatgaggcattctgataaacccctgtaaaatcgtcctaatttccagtttgaccgttttattctgttcacccacattttcagtagtactacggcataggagtatgcactaatgtactccgtatcctccccgagacgtctgtccactgtcatagtcacatgcaagtcaattcaagtcttgagatacactaatcttcaatccaaagctagctgtactggccttttgtcagtgcacaatttggaccacatggaccacatattcacatgcctctctcaagctctcagcaaaattctcagcagtgtacagtatactcttgtatgcggtgtacttcctcgtgggtgtaaataaggcttttgcttaattccatcagaaattgctgctccactcttctcgctcaaagtgttctctcttttattttggagatgcttttcttgcccaaagttgagctcaagctcactttcatctcctgggaagtttgcacagtgccctgtatgacacatgctcgctcaaatcaacctttttctcttatgatttttcatcgtcagtaaattccaagcaggtctgtatatgttaataaaaagaaaactcgaatgaaaatgaaacttccagcctactacgtacgagtacatagtattgtgttgttaatggcaactccactaaaatggaaggcttttccagctcgatggctcaatccatacccatacctacacccaacggctagtttcgcgtggcagccgcggccaatcatagccgtccgatgctccgcttcctgaccgttgcgattcgaagccctcccgaccgttggagcggccgctccccctccgctccacgtaaaaaaggcaacgccacccgacacagaggacgcgccctgccctagctcgctatatctcgcccctcctccacgcgccgcctccaagaactgtataccaccacgcatcaatcacacgccgcacgccgacgccgattggttgatttgattgattgattgggcaagaggaggaggaggaaggggattgtttgctgctgctgctgctccagagctcgccggagccgcggtggctgcagcgctcgacggcggggaagaggggtcgcgggcggcgcggctgcactcgttcttcgcctcggtgatctccgggatcttcggccagggcgaggaggaggaggaaggggagatggcgacacgcagccagaacgtcgctgccgctccgcagccgccgcagaacagaggtgagcgaaaacagcgtgtctcagatctttggggctttggcggctgcgcggattcgagttcttgtcgtgttcctcgttagtttcctgttcggatcctgtcccaagattgggttttttttttttacacgagttgccttatctttgggtaggcttctcttccccccaaacttggtactcatcggttcattgtccagctccagcagttgatctttgttcttgttcttattatttcatttacctgctttttgattggatttctgaagaaaagattccaatttgatccctatttggtggtgttgttcagtccgacttctcaaaatcgcgaaattctcatagcgtctgtctcctgctcaatttcaggcaatgttgccgctctgggaaagcagaaggccgtcgtggccggcaggcccgacgcgaagaaccggcgagcccttggcgagatcggcaacgtcatgaacgtccgcctaccggaagggtacgtgatacgaccaatcgcttagcctcacgctgtcataatttcttctgctctttatctgaaaccttcacttgtgttcatgtaaacagcaagcctctgcagcaggcgccggccggccgcaccgccaactttggtgcccaactgctgaagaacgcgcaggcaaatgctgcggcaaacaaggtacatcggccaaccaaatccttctttcattctttgtcttgattcttgaagcatctgaatctgaaccttactgaaactattgggtctgcagcagaatgcagttgcacctgctgccgtggcgaggcctgcgcagaggcaggccaggaaggcgcctgtcaagcccgcgcctcctccgcccgagcatgtcatcgagatcagctctgattctgaccagagcatgaggcagcagtcggagggcagcgccagctctgtccgcaagtgctcgaggaagaaggtcatcaacaccctcacctccgtgctcactgcacgatcaaaggtgggttatccactgaaaatttcaaaaagaaaaaaaaaattctgcataccaatcactgacaggttatcttaagttcttaacctgtatttactccatgctaatgccaggttgcctgtggaatcactgacaaacctcgagaagtgattgaggacattgacaagctcgacggtgacaatgagctggctgtggtggactatattgaggatatctacaagttctacaaggtcgctgaggtaactgagtcgctctctctgcttgatccttcttcgatgcctacgcaaatgctgtatgtgcttggtcactgaaaggtgcaatctttcctggccttgctgcagaacgagtgccgcccgtgtgattacatcgacacccaggtggagatcaattccaagatgagggccatcctggcagactggataattgaagtgcatcacaagtttgagctcatgccagagaccctatacctctccatgtatgtcatcgaccggtacctctcgatgcagcaagtgcagcggagggagctgcagctggtaggtgtctctgccatgctgatagcttgcaagtacgaggagatttgggccccagaggtagcaacatttttagcccctttgctctgcactgcccatttctagcagggacttgttctgattggatctctgtctatgtatttgcaggtgaacgacttcatcttgatatcagatagtgcatacactagggaacagattcttgcaatggagaaggggattctgaataagcttcagtggaatctcaccgttcctacagcatatgtcttcattatgcgctatctgaaggcgggggcgtctgcagataacaaaagtgacaaggaggtaaagagccatggcttctgtttgtttctgtttaccatcggattatatttcattgctaagcaacaagtttgagcgtgtactcaaaatttcttttggtgaatgcagatggagcacatggccttcttcttcgctgaattggcactgatgcagtacgggctggtggcatccctgccttccaaggttgctgcctctgctgtctatgcagccaggctcaccctgaagaagagccctctatggactgacactctcaagcaccacactggatttaccgagtcacagctattgtaagcactacatgactcgatgacttgtttaactagcatcactgaaattctccattgagcagatatactgaactttatttttctgcgatgatttcagggactctgcaaagcttcttgttacctcgcactctactgcccctgagagcaagctgagggttgtgtacaagaagtattccagtgagcagcttggaggagtggcacttcgctcaccagcagtggaactctgcaaataaatggagattagctttgtctcgtatttcgtttgcttatttggtttagagtgcaatggaaggcgagtctgacattcattaggcgtttgcttgttttggagtcaagaaagtttggaatcttgacacgcttgctatgacttctaatggccaggatttggcctttatgtgataatacaccttggtgtatataaactgtcatctgaatcttatcaataacggttcttgataagtatgaatgatgatcgaattacatgtttgcatacaacaatctcgtgtcttgaatcgatcccatactcctcgaaatgttttaatagctctggcaacctaaaaaaactggtaatcaagtggtaccatggagatatggtttgcatctgtagtctcttgaagaaggttatagccactggtaatcaagaaacttgtgtctgtgatgtttgccaatcgaaggtttactatcatattcttggtgcctgacagtagcagttttgaaaccttagataatccatgtaattttcaactcacatataagatttataaaaatgaattaagtatagagcaagatatggttataatagagtaattcgaataaggttaaacaaatgatacattaattagactttcatcggcacattcaaaatactggcgttcatcttgatgggcatatcatctccatcagtgaagccagattacaatgcgaagatacacccttgtcgactgctctatgagaaatctctttccactcaagagcgtgcctccttattgctttcatctcagcttcttcagatgccatcagcctcttaacagcccttgcaatctcctcccttctgatcaggcgatccttgtctgtcgagtccctcaagttcactccaatcttccactcttccacaattagccggccattaattggttgatcaaagaacaatggtaaggtgagcataggtaccccagcaaagacagcttccagcgtcgagttcattccacaatgggtcaggaagcccccgactgaagggtggcacagaaccttcagctgatcacaccatggaagtatcatgcccttgttggtgttaccgacaagttctcgcactcgagtggattgttcacgaagaatccacaagaatctgacctcacttgtggcaaggcccaaggcgatctcatcaagctgagaggatgacaccgagacaaaactgccaagagaaacatatagcactgagttctcaggttgacaatccagccacgcgaagtaatctatccgtccaggagcttctccattggacttggtatgctcgttttcaagggtcatatacggaatgcagggcccaattgggtacactgggcaggtgactaatgattcaagagagtcgattacactggcctcaagctcatatatggtggtgaataggaggcactgtgcttttctgatgctagagatacatgctaggatatactccactgttctctcactgtgaattaaaggcttgagatcagataacattattgaacttgaagccaagcttgagatatagtgctcaagtctctgatcagggttatctgctgatcaaaagtagataagatcgtaagagtgaataattttgtaaactgttagcagtagatgattcagatgcacagaaacttacctctctcaaatgttagtacaaaacaaaaaaacactaagactactcaagtttggtacagaaagtggattcatcttaatagagaaattaaaaagaagcgatacctctcaagattggggtgaagtggcgatgtgttctgcgattaaaccccgactaggggatttgttgattggagagccaaaatgagaaagacaaccattttgacgacttaaaagattttgttagctgaatcacgtgagctttgttccagactcgcagtaatggatttatgtgaaagaacactaacaaattgttctcctatttgacggtgtttcatttaccacgctatattcacacctacaactgcctatattcaaccacctttttgaacgaattaaacccaaagcactcaaaacacttcggaatgtgcgtataagtaacaaacaaagctaagtgtctgcgcgagttcattccgcaccttgtatagtgtatagatttcgatgatctcacattttttccgcaccttgtcagctctgcttcagaaaccttgagaccgcccaacacctcttcaaagaatgtccctttgtgcagcagatttggactgaggttgggcgtcagatcaggccacggcgcttccaagactcatcagaggacagtacactgcttgactggtggcatagccaaacaagcaatgcagagaaaattcagaaaaaaggactacgctctgctttcctgacggtgctctgggaaatttgtacggaaagaaacaaccgcatcttccgaagcacagagtcgacacagccggcgattgcaagcaagattgtggacgagatgcagctttggggaatggcaggcgccaagggagtgcagaatgtaatatcgcgagagtagttcttttatcaccttaatgtaggcgggaagtgtttttcaagtactacaccgcaccccctgtacagtgtttttctaacctctctataatataaaaccagctccgctgggttctttcaaaaaacattttttctttacccctaggggttgtattttctcgtgctatattcaatgaaaaggcacactaatgctatttttccgttcagaaaaaaaaaacaaacaaacaaagcaagaagtaagtaacattgtattcacagcaccgagtaatagccaacatatgtctctcttggagccttatctagtaaacaggcagaaatcagattcagtaaatctcctaactcatcagttcatggatgtaacaatgtgggtaaatctctaaattgattcgtatgtgggtgattcagtaaaaaatgagattcaggagagggtaagcttgacagtaacaggcaatggaagcaatgaagagacctcacctgttgtggcaccggcgaccggctggtgcggcggtttagcgagccacgacgggaggctgtcgaagtggtagtaggcggagaagaacacggcggccatggggaagagggagcagacgggcacgcccctccggttgccgacgtccacgacccacggcacgtagaagtcggccacgaacgccgcgacgggcgccgctgtctcctcctcctcctcgagccggagccggtcgagcagtcgctcgaagggcgcctccatcctggcgccgacggcgtcgaggaagcccgcgtggtcggcggcgcggccgttctcggaggggatgacgttggggatggcgcgcagccgcacgccgggcggcgcggaggaggaggagaggaggccgagccactcctcggtgactacgaaggtgaccgtggcggcgccccgcgcggcgaggagccggctcaggttcatcatggcgttcacgtgcccgcgccccggaaacggcaccgccacgacatggcagcggcacggctcgtccccggcggcggcggcggaggtggaggcggccatcgcgctcgcaatctctcccctgttgtggctgcgtgcgtgcgtgcgtgcgtgtggttctcgctctcccctctccctttgtgtgtgccggcgccacgctgcccacacacgcatgcccacatgtgcacgtgtcgatggatattgatacgatcatgtgtgatggcatgatcataatataacattttgagtaattctcatttcggatcatatttcattactgatagtttactttaaaacatcttttaatcgacgttcttattttggacagggtagtcttgttttttctttttcacttttgactaccgaccctcgtctcaaacatatgaacgattgtttgaacaatctagaatacgtcgattcctactcatcaataaactcttaaatctcacagctatatacaagttatttctttttcatgtaacaagttagatgtagataattaaaattaaggatggtctaaaacaccatgaaaataaaaatacccaatccaaaacaaaaatattggttaaggaactattcaaagcaaaacattgataataaaatattatttcgtgaccttgggtaacagatcaacagaggataggcggaaaagtatcatttttcccgcctattctaagaacgagatgagttcgagttgtaaagcccaatatatggtatggtattttactatgagattaggactggcttatatagtccccaaacataaatgtggagttataatcttaaccccgatggtgcacaggaagttactacaatacccctatgatgctagaaacccacattgatgtggtcctccagagttcctgccgctagtttgtaagtgtggttggagcggcccagcgatatcttctcgagaaatattcctcactagcaacgtaaccttcaagcttcatttgccatgatcgaatagtacatttctcttgcagtgggctcaaatattttcttttccgaacaccggtcatttagtatttaactgtcacattaagttagccgcaagtaaaaatcaggttggtcagtaaaagggtatctgccataagtaaaagcctcttaggctggtaatctaagagagtgtttcgatagaacagggatgatgtttgcctcgtacaacagattacctaaagtaaaattttctcttccattattctccacgtggatactgatacacaacaagcattcacgctagtacatttatttacttttttggtttaattcacgctgttctctcactggaaattaagtctcccgtcggcgagatctttcacgaatccgttcaacgagcggcgcgacgagccaccgtccggtccgtcctgcacggcgccacggcaagcctcgcgcagcagcgcggccctcctcctcatctctcggctctcgccgtcgtccggatccatcagcctcgccgcggcggcacggatcgcgtccctgccgacgacgacgccgccgccgtcgtcctcctccctcctctgctccgacaggttgacgccgatcctccactcgtcggccacgacgcgggcgtccaccacctgatcccagacgacggggagcgcgagcagcggcacgccggcgaacacggcctcgagcagcgagttccacccgcagtggctgaggaagccgccgacggagcggtggcacagcacgcccagctggtcgcaccacggcaccaccaacccgttgccgccggcgatccgtcgcaggtcaccggcgctggcgctgtccctggccacccagaagaacctgaccgcgctgtcgcgcagcgccacggcgacctcctccagctgcgacggccacatggagacgacgctgccgaacgagacgtacagcacggagcgctccggctgcgcgtccagccaggcacggtgctcctcgtcgtcgatcttgccggcgccgccgtccagcggcatgtccgagattgaaggtccgactgggtacaccgggaacggaaccgcctgcgtgattctgtccatggcgcagggttcgagctcgtagaaggaagtgaagaggacacactgcgctttacgcacgttgacgaacgcctccgttgtcagcttcattgaccgttcccaagaccggaagatcttgacgtcagagagcctgactgatgagcagcctgggacatattgctccaaggacttgcggcttaggtctgcaaagaaaagaagtagagcatataataagttatgcaatgttaggccctgtttagttgcaaagtttttttttccaaacttccaactttccatcggatcaaacctttcatacacacgcaacttttcagtcacatcgttccaatttcaaccaaacttggaagtttggttgaaattggaataatgtgacagaaaagttgaaagttgtatcaaaagatgcaattgcaaatatgcatgatgataggaatgctttagcataagaattttaaaaatgcattgtgactattagttccatacttgtatctttttatgactgaaaactgaaatatgtttcatccaaaaaagggggaaaagaggaaacttctcatgtactagaatcaaatacaaatatattgtggaataaatcactcattttccattattttattgataacaagtacttgtagtcactgaaaaagcaaaggactttacttactcaggacacaccgacaaagaaatataaagtttatgagaaagggttgtgcataataagctaaggaagggctctgtgtttgtgacctcatttaatacaagtaaaaatctctgttttggcatcacggcagtagacacgtttcagcaaacattcctaaagttctttcgactgcatctaacttcaacacttatgaacctatgaaaaagttaattgatacaaaatgcattttggtttagttatatccaacttcagaacttatgaacctgtggaaaagttgactgataaaaaaaaatgcattttggtttagttgtcctagtaatcagattatctacttctttggtttctccgcaattctacattttaatagtgctgtaggggcaactaatttatcatttatggacaatgtagcagaataatgttttgacaatggtgtacttcccaaaattgaggacctcaaagtcaaatccctgtaagtttcagcccctatcttcattaaaagaaggtgcagttttcatcttaggccttgttagatccaaaaaattttggcaaaaaacgtcacatcaaatgtttggacacatacatgggatattaaatgggaaaaaaccaattgcacagtttgcatgtaaattgtgagacgaattttttgagcctaattacgccatgatttgacaatgtgatgctacagtaaacatttgttaatgacagattaattaggcttaataaattcgtctcgcagtttataggtggaatctgtaatttgtttttgttactagtctccgtttaatacttcgaatgtgtatatgcatacttcaaaaaatttacgcccaaagaactaaacacactcttaggaaagaacagtaggacactatttcaattagaattcacgaagtagcagaattcactgactgtgcatttataatttgatttcagaaacattaaaacataagatgattcagttagaaattgtctagaccaaactgaatattgaaacagtatgtttggatcatccaaagttcttggaagcatacgatatcttaatttgtttcaacaagaacatacccctatatttgaaatccccaatatttgtcattttcaagagtagaaaaggtgctacacactcgaaatttgacgtagatgtctagaaattattgtggaaatctcacatgaagtcggagacatcgtggaaactacagtagtgttgatttaaagagagaaaattcaaagcgagaaaatcggagacaaggactgaagccaaataccttgctcgccctcccggtcatccaccggcggccagaggtggatgttgtagagcgcccagaagaacgtggccgccatggtccacagcgagcacaccgggatcccgcgcgccgcgccggccggcacgccccacgccaggtaggtgtcggccacgatcgcgtcgggcctccgctccagccggtcgagcagctgctcgacggccacccccatcttggcgtccacggcctcgaagaagccggcggggtcggcgccgcggccgtgctcggaggggatgacgttggggatggtggcgaggcggacgcggcccgccggcggcagcgtggcgggcacaccggcggaggccagcagcccgtgccactcctccgtgacgacgacggtgacggtgagctcgccgtccgcggccgcgaggaggcggcacgcggccagcatcgggttgatgtggccgcggcccgggtacggcaccgcgaccacgtgccgggacacggctgtcgacgccatgctaatctctatcggactatctctgctggaatttgtgtcttcttggtggaactaatataaaggcagcacagattggagagcttttgatacactgtagtacttgataagtgatacatagacccagctgtgaattgggaggtcagagcaaacaaaggagaacaaattggcttgtcatttcttctgctcccaccgtcgtagcaaccgacgatccaatcctatatgtccaaattcgcagtggttgctacatattgagatgaagagagtacaaactagttatataaggtttactttgttgagcccaaatatcgatagttatgtgaggttcactttgtgggacccaaatattagtggggtggtgcttgtgactctgtctagcgaacatttcttgcttccatatcccaaattacatgctattccggagttgaactccattgttgctcttctagtgaacaattaacagcaaaattatagcccttaagggtttattcggtttggaggggatccggtttggaggggatcgaagagtattagaggggatgtggaataaatctccttcaatctcttctttatggggattaaccgaacaaggtctaacgatgttatatttccctacagtactgccatggtgtcaccttattaaaactgattatatttaatcttaacatagtatttaatcttatattgaaaaaataatccctgtgcgttaggtgcactgtacacttagttctcacataaacagataagctataacagtactgccatggtgtcaccttaccaattacagtactagctctctactatggtttccaagcttcacaagcaacgccgcttctcttgtaaaaatgcctctagtttacttcagataagttacccaagctcaaggctgggaagtactcatcaacaaaatcaccacaaacagatcgtactagcagacctgcagcgatcatcatactttaaatgaatccactatggtcttgagaactttctccgacgactgccactgcttgtcgctggcacttgcgacgaagagcaccaccgtgttccccttggcagtcgccttcgccagattgtgagaaccggtcagtgccaatggagtctctagcacatagctgtagtactgcacctcagaagaattgcccatgcatcagagttcagaaacatttagcactccaaagactgttgattcaaatagctgcacaagtagtgtgcaagttgttagggaagtgatcaagtgaagcttacagtttggccatcgatcttctccacggaggtatcgacgagctcgtcggagtcgaaggtgttcccggtgacaaaaggccccagagaggcgattagcctctcagggctaccgatgtcctcaatcgtggcgttcggcctgttcgtcaggcggatcaacggcgaggccaccacctgcaccttgccctgcttgtcgtcctcgaatttcacctccacccacggctcggcgcacttgggctggcagtagttgccggacagaatgttggccactcgcgtttgcttccaggtgggtggcagaatgaactcgtaaggttgcacattgcctggaattggtgaacaatcatattgagtggattcaacacatctcagtatgtcacacaactaaatcaatttctccaggcagagacgacagctaaccaaatcagaagccagaagccaagcaagcacttaccagctcgaagtgcaggagtgtccttggaagtagcccggaagaacacgaacccggggttggacgccgccggcggcaggaccgcgccgacctcgacctcacgcgcctcggccggcaaaggcgccttcaggaacgccgcgcccaatgccgcccccagcaacagctccctcctgtggctgacaaccgccgcgaggggcgccggccgcggggcagcgccaccagcggcaacgacagcggcggcgctgttgtcgtgggtggcagaagagcgccccgagcaggaggtggacggccggagtgcacggagtagcggggagaagacggaagaggaggccatgaatgaggacgcgtccgcgcgggctccgtgtcgtgtctggtccgcgcgcgcgagcgccaccggctctttatccagacgccgagcgcgatatttttctctctcgcaggaaacgagaccgcaacgacccgtagacgtacgtacgcgcggctcagccgtgtcctcttgtcaaactggttgggataagataaaggagcggagcccggcaaagccgagcggcagcagagagcacagctcggcaacaccatggcgccggcagcgctagccgctcccatcgcgtccatttcccccagctccgccgggagggtcaccgccgccgccgccggcctccgctctgccaggatggccagctcacctgtagcccagcccattggtattgattgctccttcttccttttcttgccctcgcctctcggccttcttcacggatgtcacctgtctaacctttgttgctgttcttgcaaaggcgaggcagttgtgttacggcccaaccagatgttcagatcagtgctgcgacagcggaggcgtctggtggtccgaagcagcagctcagatgaaaccaattccaccaccgaagagaaggtatatccacacgaccacacgcctgatgaattgaaaaaaaattaaagcctgaacccaactgtgacgaccatgttttgttcacagacgccattcggatacacgaggaaggacgtgctgctcatcggcgtcggcgtgacactcttaggctacggcctcaaatacgggctggaggtgacgtctgttctttctctcttctccatcactactccagttcgctgcttcttggctttgacttcatcatcaagtacacttcactgacgaacatgtatgccttccctttcacatccttgccacaactgaacacagctggtcggagtcgatcccttgcaagcaggaaacgccgtccagctgatcatcgtgctcgggatgacggtggggtggatctcgacgtacatgttcagggtggccaacaaggacatgacctacgcccagcagctcagggactatgagaagcaagtcatggaggtttgacacttgttcattctagtatgcagtgtttgttactaccaagagtatgagtgactgacctgaagtttcttgctctttgttccagaaacgattggagagcttgacagaggctgaactgcaagttctgctcgagcaagtagaggaagagaagcagcggctgactccagtgagggatcagggtgttaccttcactaggaaaacggaggatcaggcgaatgccagctagaacaccttgattctgtaattagctagctctcctgcactgttagatagcttgaattaagaactagcggtggatgtggatcgtacgtcatacgaatgaccagctaatgtcttccatgtttgtgcatcattctgaaataaaaatagttggtaattctgcttatccagatttccagacacgtttatctttggataacccaatatttgaacaaaataaacatctgaatacataaattgctttcacaacaaacatttcggcgtgctccaccactcttacactctaaacttgctaataaaacagtaatgaatagataaactacttgtgcagtagaacaatatcattatttaaatctcatcagaactgcagcgaaaatttttttgttagaaataacgagataaatgcattaacatatgaatttccatgttatacttcaattgctttggtattgtgtcgggcaaagaggaatgtgcagaaaaatccagagggttctgagcaaccgtaggaagtataacatggaaattattcatcactttatctactcccaataccagggaaaaaaaagaactagatgtaatggtatatgtatcttacgaatttgattgaatgaatctgaatctttagctgacgttgatcctcagcagggagtgatcaaatcccagcatagcatgattcactaataaaaatgcctcttatggttagtacaaggtaaaaacaactgtaggatgcatgtagtactacattaaggttaacgaaatttccttggaaacgatcttgactgaataattctttgtttaaggaaaagaaatagggtacaatacttgcactgttgcctattaagcagcacggagtatatgcacttcacctgaaggttaacaaaatttccttgcaagtggtttgtactgaatcgccatttatgttaaggaagaaaaatatctatacaatacttgtctatagaaacactgagctcatgaagattaacaaaggaaatgcgatctttactgaatcacccttctttaaggaaaagatatatacatagtgctatcaagtaacactgagctacatgtattacaactgaaggttaacaaaatttccttggaagggattttgactgaatcgcctttggtgaaggaaaagatttacacattactagtgctcttgagcagcagtgggttgcatgtgctacattgaacatcaacaaaaaaaaaaatctcctaagcaatgtttgactgaatcatctagtgatgtagagagaaaatatcagataagagtagaagattcccttggatacataccatgttcttcgacaccttaatctcagagagtagatcagacgagcacttcgaccttcttcttccccttgaggaagacctccctgtcaacaagctcacgcatgtatccatcaaactccacaggaactccaccattgagcctcttcatctccagaaaccacttgctatctctcgcccagagttcctcaaacgcatctaggtaatgcacactgctgtactttgccttcagcgcatccaacaagaccacgttgatgccctctcccgcaacatacacctgccttcctcctccattgagtctctcctcaatccttcttctgaggttcccatcattgccaccaacatgaacagagtcaaaatctacttgcatccttgatatgataccatcaacaatgtccatcaagcttggcgccgtgcgtattgctccctgcggtggacggaggacatgctcagcttcgccctcgcacacattgtaccaataattccctggctccacgtccccaaatttcctaacgatcaggggatccctcgacttggagaacttggtgggcgcaaccctgctgtcctcgatgatgcggactccaagctgaccctgtgctccccacttgtcccaatcctcccagaaccgcttgtgttcaacgatcccgaccacggattgcaggtgctcaatgtcaatatagaaggcgaggcgcttgccctcctcgggcatgcccccggcgtaggcggcggcgagacagacgctgagatcgaggacgagggtgcggttgaggtagcgggcctcggcgatggagcagaggagactacgaagataatgcggcatgggcttgcaccggtcgccgccgccaaggtaagagaggtacttgcccgcggcgaactgggagcgcgagagcgcgggtgggggcggcggggcggtggcgttggtcccgccgcggcggggcttgcgggcgagggggccggagtggtattccccgatggaggtaacggagtaggcgcaggtgacggggtcgcgggcgacggagaagcggcggtagtccttgtagttggcggaggcggtggatcgggcgcgccaggccatgtcgcaggaggacgacggcgggtcgccggggacggggcggccgaagcggttgaagtggacgtcggggaaggcgtcgatggcgcggcgcatcatgaggtggaagagctgcgggtcggcgcagtcgagcgtggaggtggtgtcgcagctggcctgatcctgctgctccaggtgggacgtggtgggcgtcaaggcggcggtgggaggggagagggagatggggaggttgcggagggtgaggaagaggaaggcgacgagcaagagggcggcggcggcgtgggcggaggaggtgatgagggcgccccgccccagcaacggccggctcgggtccatccggcgacggcgacggccgacggcgatgagatctggtggctgattgtgtaataaagccccgtctgcaggcggcggacggtggtgaacttgtttctaggaagacgacgaactgttcctcttaatgggcctaacatgagtgggcctaagacgaaggcccatgatttggcccaagaatcgcatctcgtcgtggataagacgataaagcaacattgtgtggggatagccatagccctgcaccgcacctcgactccccaaacatggcgctcgccctcgtctcgccaatggcggctctctcactccactccgggaggatctcagcggcggctatcggcggcggcctccgctctcgcagggcatccccgatgggcgccgccgccaccccgttcctccggagctccttcgtctcctcctcctccacgtcatccgcctccgcctcccccgccgcgctctctgccgcggtctcggcgtcgctgaccttcacctctgcctcctcatttgctggtgagaatgtgtactttactcgttcctgattcgcttcgttctgttgctaccatttgggttggggaactagatggaggagagagttgcctgcaaagagaaagggaggaatgaacttttgtgctgctggtttcggctttaagtactgtacaatggagtgtttatactgtcagataggtagcgtgtacagttaatcagtgcttaatgtcagaagataactaaactaaactagcgattttaatgcaattgatatatttgaaagttctgatggtattctggcaatttcctgagaaatcttaaattcaaactctgccgtacttgttagctgctgtacgcagcttgttataatctgcaatgtctgatcctaaagcccacgcattcttatagttaaccatgtgctagagaattttgcttaagatgtggattccgattaagattaaaaaaaatcacttgtttacacatccagttttttagtgtaagaacgtgtatatatattcataattcagtgattagttctagatggttccatgttaggaaacctacacggctgaaagtttcttttcttcctccatgtactgtgatactgatattgtgatttccagtagtgccagatggactgtagattgtagtacattcttgcgacagaatcatgaaaacatcacaaaaactcaggaaactccactttttggagcgagcgcatgagcttaatttagtaaactcattatgaaatatatcatctaacataattatactacgaactaacgaaatcactgaatcaagaacgtttaactggacaactcaactttttaaacagttcagttacaattaatagccttgccacctaaagcaaaaccaaaatgctcctaaaacaagccaataacgttagattaaaggaactattgcaatgatattatccttttggaaaatgaactgtactttacatactagagtttttttccaaatgatcttagagaacaaaaacacaaactaagggcaatcaaatagccggtttctgtgctgtactgttgtatttagcaaatccatgttcttatgtatcaaaccatatttgttccaacctacaaatgatttcagtatcctaatatgttacatatttcaggttcatctttgggaattgaattcagctacaacagagttacaacaggaagatcccggattctgcagattagggctggaaaggctgctctgtgcatgaccaagagaaatagatctaggaagtcgcttgcccgtacacatggttttcgcagacggatgaggactactgccggaagaaaggtcctgaagcgcagacgcgccaaaggaagaagggttctctgcacaaagacgaactcccccactgggaagaaacgaatgttctgattgaatcgcattctaagtcgctctttgtcacaattgtaagtgtatttttttatcccacgttctcggttatactcaaccataacaattggtgcaaatccttcacccggtgtccggttaatgtgtgaagtacattatcaacacaaattcaagttagcctttttgcttgtgcagtatttagtagttgtttgctgtgggaatatgttctccttgatctgcattgccatggttttcctctgatctatcttgactgcattctgagcatagattttgccaaagggcctaaatgctaacttgagcagttgctcaaataaactcatcaatttttctattctgtagtagaacgtcccttttattttctgatacagtccagtgaattttaatattcagatcatctcatcatagtcactccatgctccactgtgtaacacaatttatccacctcctctgtgccaatctctttggtacacacttatttgtaaaacaacctgattgcccatccaatcctctgtcaccttataattttgctactatcaggcgaaaaaatggataatatccagaactcaacctggaataaatgaaaggcaacaagtagcaaagagaacatttacattctaacaaactgaatccctcctcttcttcactcgcatcggcaagccgccttccatcctcaaggtcaccgagaacacaagccctggccgtccctcgccgccgacgaacctgaagctgaacctctcgaacacgcacgccgcgatggacttcatctgtatgtatgccatctccttgccgaggcacatcctcggcccgccgtggaacaccgggtacttgaacgggctctccggccggaacacgccgtcctcgtcgagccaccgctccggcctgaactcctcgcagtccgcgccccataactcctccaagcgcgccatggcgtacgcgctgtaggtgacctgccatcctttgccgacgaacgtgccgtccggcaagacgtcgtcgttctggcagcagtgcgagtccatggccacgggcgggtacagccgcatcgcctccgtgatggccgcgtgcaggtagtgcatctcgcgcagctcgtcaaagctgaacgccgccgcgtccgtgctcccgctcgacgcgcgcaccgcgcggatctcgcgcgcgatcctgtcctccacgtccggctggccggacaccagccagaagaaccaggtcagcgccgacgacgtcgtgtcgcgcccggcgaggacgaagttggtgccacgtcgcggaggctctcgtcgctgtgcttgccggtcgcggcgaagcgcgacaggaagtcgtccttgcgcgccagccccgccgcgcccctctccctccgctcgcggacgatcctgtcggcgtagccatggatcgtggcgagcgcctcccgcatccgcctctccggctccaagtcgagcagcctcttggcgcgccatgcccactcgaccggcgacatgaaccgcgccatgaggatgttctgcgcgtcgttgaaggcgcgcaggaactcggtccgcgcgttcgtccccatcccctcctcggtgaggcacgccgggtcctcgtcgaaggcgacgcagcagacgttgtcgaacgcgaagcgctcgagcacgtcctgctcgtccagcgtccggccgtcgcgctccgcccgcgtgagcagcggcagcagcctatcgacgacctcggacctgacggtgtcgaccacgaagttcctcagcgagcgcttgttgaactcgtagctggcggccttccgctgccacagccactggtcgccgtcggagttgaagatgccgtggccgaggaagtcctccatgactgacaccacgtactcccccttggagtagttctggaagttggtcttgacgatgtgttcgacgttggccgggttgccggtgatggcgccggcgatgaggccgaagcccttgaagttgaaggacatggtgtgcgtggggcagcgcgccacgacgccggccgaccactcgaggaggcggtgctggttcctgacgaagtgtggcagtatgccgacgatcgggtaggccttgaggccgtcggcgcgaggctgcttcctggtgctgccatggcgcaggcagaggaaacagagcaaaggaaacagcaagaggaggagcaggggaacggatgaagtcaacgagagctctgtgcccatgtcgaattggtgattttggattggacgatggagatgccagcctcgtgaagtccgcagaggcgcagattatggagtgatgttgcttatttgattaagttagtcgatttgttgagtgcgagaattttcagaatatgccatcgaattcgcactactttcagaatatgccatccaattcatgctactttcagaatacgccatcggagcacgaatttcctttgttccgtgccactctgtctcttccgttcgtagcaccgtcgtcttctccgcccggcaccgccgtcgtcagtccgccaccgcccgcgccgacacccgtccgtcgccggcatcgtccatcctcgttggcgtccatcgtcgtcgtccacggcatggcgtgggcgcggagggaggcgagcgcgacgcgagtactagcagcggggcgagcgcggccgcgagtgctagcagcggctgcggcggcgggcgaagctgactgtctgcgtctgcgtctactaccgcccgggactggacctcgtgtgcgcgccttgtgaattttgaggcaccgttcgttccagggtgtttggggagattgagtctcgttttccgcgcgcacgcttttcaaactactaaacggtgcgttttttgcaaaaaatttctataggaaagttgctttaaaaaaccatattaatccatttttgaaatttaaaatagttaatacttaattaatcatgagctaatggctcacctcgttttgcgtatcttctcaatctcctcaatccccttcccctcaaacacaccctgagagtagagggcggccggtaaaaactccttgtatgttgttgctgctgcacgtacttggtccagatgatgagtgtgaattggcaaggacggaagggaacggaatgggtaggtagtagttggatacttggattgttcagaggaggacgtcggacttggcggggagtcgcttgtagaagttgaaggggacggatggtgagcgcggccgcgagtgttagcagcggctgcggcggcgggcgaagcggcggctgcggctgcgggcgaagcggctgcggctgcagaatggggcggcggcggggaaggggtgggggagaagccccttgtggatggtggggcgaggcggaatgcggcagctgtgtacaatgggggggcggcgtccgtggtggtggggaggaagatgaggaggacgaggacagggcaccctcgccggcatgctccagccggaggacgcgatgcgcgggcggtggaggacgacgatggcggtgacggcgaacggacaacgccgtggctgacacgggcgcgcgcggcgcgggcggtggacaacgacgatgccgacgactgacgccggcgcgggcggtggcggactccttccctccgcgcccaccgagccgtggacgacgatgacgacgacggacgccgacgaggatggacgatgccggtgatggacggacgccggcgcggctgacacgggcaccggcggcgaacggcgccgggcggagaagacgacggagctatggacggaagagacggagtggcacggaacgaaggaaattcgtgctccgatggcgtattctgaaagtagcacgaattgggtggcatatcctgaaagtagtgcgaattcgatggcatattctgaaaattctcaactgttgatgcttaatcaacggtccaacattgaactgggttactactttggcctcaataagttagacgaaaaatgcttcgtgttcttatccaaatatctcagtcacctcctccaccacacattccctcttctcaaagtctctctcttttcaacgcctctacacagggggttgcaagccaaggcgaggcatcgtcgctggtgtcgacaccggagcaaggcggcacgtgatagggaggaggtactcgacctcgctggcggccacatgacggcagcggggcaaggctgcgcgtggtagggaggaggcgatggacctcgtcggcagccacacgacagcggcggggcaaggcgacgcatgggagggaggaggcgatggacctcgtcagcggccacatggcggggtagacaacataggattgaggaggaggtgctggacctcgccagcgatcacacggcggcagagtgcagataacgcaggattggggaagaggcgctggacctcgccgacggccacacaacaacgatggtgatgtggcagaggtgctagatttggctgtcggtgaggactggacaatgcgactggtcttgggcgaggtcgccaaccttgtgccactattcttctcccacaagcatcaatttcttgattctagcagctagccgtagaagaagacaaagatgggttcattttattggagttttagtgatgttgcagcatattgttttatcttgttgcattttattgtattaaggtgtttaattttgtttggatttggtgttgcattttactgattcttagtgttgcaagcaacctatttcagatgttgcatttgattgaaacaattttgttcaagcaatgaaacatttttcctcgattgatgaaacatctgaaacattttcatcgaaacatttttcgtggagtggtgcaacatgtgaaacactttgtgataatatagtgcaacaccgtccgatcttttgtaatagatcggacgtctaatttgtagcagcctccaagttgagagtgcttctagatctaaatttctacacacttttgtggacttctatgtttatgaactgtttttctttcttttttttttgcaaacccggctagagatgccgaccaattttattaaggattaggagatagtttcgtatggtaaagcaacaaacatagttgtgcatatcatctactatcctttacaacacaccgaagaaaagaggagaagatgaacaatgttaaatgtggcaaagaataatggtcatgaaattagtttgagctaattcaaatcccatgagaagcaacggtctacttcttatctacttcctccacctcagaataggttaatctattacgaatgtgatatattcgtcagatttacagaactagaatatgtgacatcccgtaatagattaacttattctggtacggaaaaagtatagtttcaagggaaatcccccccccaaaaaaaagaagactctttgatcacgaagggccagacgatgaacattggatgcaatcagaaacgagtttgtcctcgtccttggttcccgcgccgctctaccacgtaagagctttgattgggataatattagaattttcccaacatgggcacgccgaaagtcatgtggacttcgggagctcatgtagtcatatgtaatgatgatgagagagggtgtcatgtggggaatgcactacgtccgcaggcgcaaggatcagcgacaacagcaaaacggcaaacagtagatacgcaggatttgttttcgtttgtttcagagtctgttaaagtttgttagtttgatctttatctctaagagtttgttagatggcatt

SEQ ID NO: 42700 - DNA, 751 bp, Oryza sativa
gcttccctggtcgttgtagaagcaacagcagcaaaccacccaccagcagcagcagctgcaacaaaagttggagcccaacgcacagcagccaaagaatcagcaggccacgcattagcaggagcagcagcaggaaacgcagcagcagggaaagtagcagcagctcaccaagaacagatcaaattggcagcgaaggacgacgagggctgcggcaaccggcgacggctgcaccggcagcggtggcgcagaggcggctggggcgcaggagtggtggcggctggggcgcaggacccttttttttttttctgttggttatatagagagaggttaaagaaaatcgaacagcccacattaattcgatcaccggaaataccttgggactccgattaccacaaacttagtctattttgcactattcagcgagctctatgcatccacggtccctgatcgcctattcaaacaacggtttaaaagttgaacttttgcgcgtttgttttaatatatcccgaaatacactaattcgaaactcggggtattacaaagaacatttcaaaaatcaaggaatccaacttaatgtacaaaatttaaacttatggaataaaagtgaaacgtcaacggagaaaccaagaaaatgttcgtgacaagcaatcttcgatttccgtaaaatcaataagatgcaaccaaatggagacgtctagcccgcaaccaacatatttttttcgataaacaaggagacaaatctctacaacttagt

SEQ ID NO: 42701 - DNA, 1401 bp, Oryza sativa
acaccccaaaagagaggaagataaaaaaaaaataagaaggaagaaacaaaccaatctcacaaaacacaatgctagaaaaagaaaaaaaaaaggtttctgatgagcaaaggcgaaattgtgtgacgagtgacgaccagtctgtctcaccaaacgcacataggtacagaacacagcacgaacaccgaacaagaccaccactactagagactctgctacagagcagtacaaggctaactgaaaccacaagttttttttttccttcttttttttacacggcggagcagagcagagcagagcagagaccgacaggtatgcaaaacgcagcaagctttactagacgaagcaaaggatctctcttcttttttttctttttctgttcccttctctgtcacgaaaggggagcgaggggatcgacgacgggcgaaatcagcggcctttgcaccgatctcggcgtcggcggcggaagaactctgacgcaggctttaactgcgcgcatcagatggtgtcgccatggggagtagtaaacgggagcagtaagacagtagcagtaggaggagaagaagacgacgactttgagaaaattttataatctttttttgttgctcttgccgttggcgaatggaagatgaaactctaatcaaccaaaccgctgatgtaaaaaaattccacaatccgtctcatcagttcataccgaaattcatcaaaagaatcgataagggaaaaaaacagcagagaaaaaacaggggaacacgaacacgaacaagatagccactctagcagccatcagccgccatgggcggcgaaggaaaacaaccaacaccgagaaaaccaaaaccaaaccaagaaaacgacgagacgaggaagaagaagatgaaaaaggagaaggatcaagaactgacctgagttcacttctctctctttctctccctccccggatagcaccggcaattcacttcacttcaccgcgtcgagcgaaaaaaaaaagtttccgggagaatcgccgggagcagcgggaggccaggccggcgaggagaggaggagtgggatcgcgtccgcggcgagcccgagaaccaaaaaaattctcgaaatatattaaaaaggatttcccgggcggagggtggagactttaataagcggcatgaagaggcagctcagtgcaataaattttcatggggcgtttttacagaaaggggcatgtgatttccccatatttgcagatgcatccctctaggtagcaacaaacaatgcccctttggatggagttttgtgggactattttcatcctagtgccttcgtttacaattctgagggctgttcagattgatgttatttttaattattttatttttgggtaaagttatcaaaaaaaatctacatttagtttattgctaaatttggtaa

SEQ ID NO: 42702 - DNA, 838 bp, Oryza sativa
aaaatttgacaggatatattttaaaattttggaaagggagagaccggatagtcagatagattttaaaattttgctcgtgttgccaaccgccaaacgcagctgcagaactaacttaagcccagcccccaactgcccaatagtgtggccgtgtgggctataacgcccattcgccgctcggagaaaaacaagaacatcaatcagggcaagttttataaaaaaggtgaatgttgcatctaatcttgaccacatcatcaactaataaatgtagaggtaacatgtacaatatatcacatctatactaattctaatacactagccccaatatttgtttgcccaatctactcttcctctctctccttttgtcttgaattttgtgtagtggttacctcttgcataagaggtggctcattttctctctcatctcatctctccacctatagatggccatgtgggccgcccggcacggcaaggcccagcccagccgtgcctgggccgaggattgtcaggccggcacggcccgaccgacgcaccgggccgtgccgtgccagcccacgtgccgcactcgcggcccaggcatggcccaacacgtctcgggccgtgccgggccggcccaaaggcatgatgggccatcgtgcgtttcctcagaataagtctaattttcctccctcctattgggttatgagtatatatatatatatatatatatatatatatatatatatatatatatatatatatatgtaccatatactaaaatgctattaaataccgtctaataaagtaatttaaatgttacatagaatatattctagagcacttatgtagaagatcgtttggc

SEQ ID NO: 42703 - DNA, 755 bp, Oryza sativa
aaacccgacacctgggtcggtgcttgcgaactaaatgaatttccaaaatcgcggaccgaggaacgtaccgggtgtacggtttcccgctcttgcacttaaggaccgtttccttggaatttcattcgaacataagacaagtacgaccacatgggtggaatgggacacccctggctgagtaactagcttatcgggggagccatgatgccaagagacatgtggattcgccggggtggtgtcggggaggacccctgggcttcctggcacagtatggtctgggacataatctggtgttggtctgggatccctctcgttggcatatggtgaacctgtgtcggctttcgaaatgccttgtcatgaaagccttaaggtctctagtcgtggccgttctgcacgggctggatgatccgggttagtaatgtcgtgtgggaaaagtgtaccccctctgcagaggttattaaaacttttcgaacagccgtgcccacggtcatgggcggatgtgaggtgattcctatcgtagtttttgtttgactactgccttgtgaaatttgctgttgtggaatgggtttgatgtttggaaaatctgcggctgatgggatcagccaggcccgggtggccgtttgaaagctgttggccgggtgccaatcttgatcaattcaaaagactgaatcattgcacatactccgaccggacgagacgcactgtctcatccgtgtcgtttgagaagcactcccttagttgtttcagaaaagagttta

SEQ ID NO: 42704 - DNA, 946 bp, Oryza sativa
cacactaacatgcatagctggtcatattgcaattgcaaacgacgacgactcatcctcatcatgtgagatgtgtccacaccgggtgtggtcatatgcgtgaaaatatcgtgaaatatcttggggtggtacggtgcaccgtgcatctagataagatgcatgaacttaattaagtgttctgctatcggtagggcgcgcggtaggccttcagctattataagccacggctaaatttaagtattttaatattattaaggtagagggtttattcgccgcttctttgttagtgattttactccctatgacttaaaaaagggcagcctacgagaggatgtgacatctcctatatttagattcgttgtactaggaggcctcgatcctatgtcgactctttttttttaaggacagatcgaggaacaaagaagcggctaaaagtagaagtataaaagtttgacgttaaaaagaacattttttactactgctttcgtttataaatagtagctcaaccaatttgatattttttactgtataaaaatttggacattaatagcaacatggatgcatgcatcagagctgtttagcgctggcggcttagtagccggaatttatggccaacatacatcgagaaaaggagtctacactctaaccctgctagtttcctgggaagtttgaaacgaacgaaacaaaaaaaaaatcatttcaacacaaagagctctcgacgaaaataggtctcctagctatatgatcaaagaggaaggaaagctttggctcttgctggggcaaagcacctttctaagttaattaaccttcttacatatgtatagtttttttttctagtttcaccctagcataggggatataaaactcttctatattatattcaatgaaattggtatagtctcgcgccggttcgtttaaaaaaattgacactcttttacttggaaattca

SEQ ID NO: 42705 - DNA, 730 bp, Oryza sativa
acaacttactcatctatctctgatcgaaaagagaatgagttcaaccattagatgtcacgtgcaagagccatgggccctagaactaggccacatgggtactctcatgcatttttcctttttcaggaatctggttcataatgaacaatacttccaatcttctccaaacaaatactctctttcaagtaaaattaaatcatggccattgcattttatataagcaaagtatgacaatttgtatagtaaaaacccttctacactggttctcgatttaccatgtccacagaacaactttggttgctacttggagcctcaaattatttagtgcatatgcaataatcagcgaaaatgggaaaatgcttgatccaacgcaaccatatgctgctatgctaaggaagctcaattggcaactcagctctcgcctcaaaatctatcagcatagcatactccattttgatttgcagacaaagtggaaatggccctgatggtgtaatccattacctcctcaacgacgtcttgacagtcatgttgcaaatgtacgggaagtcaagcggcggcgtgggcgtgggcggggcaccgggcgcgcccaccgcgtccagcgacacctccgccgtgcacgccatctccccgtagtcgtcgtcgtcctcgttgccctcgccctcctcctcatccccgtctcccgtggcggcggggcggtagtaccccacgagcacggcggcgtgcggggcgaggc

SEQ ID NO: 42706 - DNA, 726 bp, Oryza sativa
caggacacaggtgctgcagtacagttgttcatggagtgctcgcaaagaaagaatccatggctagctgctggccggctccggacacagcatgcattgcatgaaacatgcagtttcttgtgatactattcattgtctcattctattgtgatgcacctgatacactgtccggtaaaagactggctacgtagcaatcgcaagaaaaatccctcccttgatgacccataagtcagaacacgtccagaatcgtataagaacctccaacagcctcgtataagagtcaagaatcgcaaatgaatagtctaatttgcatttcactctaacggactcttttttatgtactatccaatctaaatgtgggtcccacctatcagcctctctactatttaaccccttcttcttcaccctctcctctcttctcttctctgctgagccactagccgaatccgcacgaggttggtggcggtggaggccgcgtggtgccattggtcgctgttgccaccaccgtccttgtcatcttgggcataggtggtggatgccgcatgtggacaggggacggtgacatggattcgagtgaacagcggtgacgcggattagggaagacgacggtggtgtggatttgggcggacggggcttgtgcggcaggggcgacgacggcgttaggccgatgaacaacaatggtggtcattcaaagcgtcacttcttctccggcttctcctgcaaggcgtc

SEQ ID NO: 42707 - DNA, 2693 bp, Oryza sativa
agtaggataggctggtaaagtttggcaaatgagggaaagagtttggccatccgtatggcttggagagtaagatgaagaggctgttggagtcggtcatttaaagttgctaaattttggcttgaagagtgggatggagagactgttggagatgctctaagcacatgaatcttttccttttgtctccctcctattagcgatgtgaggccacaagtgaggtaacctcgcctcctccaacacaactgcctccactacccaacacgctgctcctcagccccattggttgtcctcctccccaagccgtgcggctgtcgaagacgccacgccaccttcgtctcctaactactccgtatctaatgcaccacaatcctccaccgccctactatagccccgcggcttgaatggcgacacaaccgcccaccaccattcgtccaacattaggaaacctcaaatcctaatccataggttctttgcgagagttggggtgtcgccaacatcgaagaagacagggagtttaccggggacagaggagaaggagtccgaacatgaatcttgctgtgcggatacaaatggtggagaaatcataagaaatctccctctgtccacaaatataatggagtttgagggtacaggtttatctgcaattttaaggaattttgagtactacttgcatcactcaaccacccttcatttgatttttatttaattatattcctaattgtttctcatttattgagagacattatatccatttcccttaaccttaatctcctaaaaaaactaaaatgcattatatttgtggttgtaggagtacatttaatatatatccgtaccttttaaattatttgtaacttaattgaaacctatatatagagactgtctttcaaaattaaaattcggctcataaaaatcaacagagctagctagtaagttctaaaaaaaaaactagtgcgtccttactaattagtacttctagttaataaaatggtacggcgcttgattttcgttagtagaacgtctgcttccagaacatgctaggcataattcgatggggatgcgcaccatcactcgacgcagtatcaaaaaactctaattgagaatcgacttgtcaactaaaaccaaaaaggtttctgctttcctccctttcaagacatccatgccatttctttttccttatgagaatatatatatacactttagttaattattagcttctcctgattgaacctgttagcttggatagagtgactagtgaatccaacttgctaagtcaacacagcactatatgcttgacttatttaattaattgatttgtcatatgtgttcacatgatatcatgatagccgttaagcaaaccatgcatatgaatctagctacccggtcccaagtaattaacgaaaaggataaggtaaggcaaaatgtgctcactagctagatttgatctgagcaatcatttaggtatggatgagatgataatgttaattagtatattggtcctttgatcctttaattttttgtgaaaggtgtattaattagcactaatcttgttaagcagaagatgtcagtacgaccttaatttaaacctttctaaaaagagaagatatcacagagctgatctgaaatgttggcaactattactactagtttttattcttttctctctaagtagagtgtttcctatccactttccaaatccaatctggctccacgcactactacatacccattttccagtggtgtctgggaaaatcgcgattttcgcatacgggtgcttatatcacccgcacgtgaaaaacaaaaatccaagaggatggaatagaatttcacaaaaaatgaaaaccctagattggcgcggcgatgccgcggctcccggccgccgccacctcgtcgtcgacgcccgcctcccaccggcctccacgcccgcctcgtcgtcatcaccgcccgccggatcccgcgcctccaccgtcgcgctgtcgtcgctgtcgccgcgccgccgcggtatccgtgcggggacggccgccgcccgccagatcccgtgcctccaccgccgcaccgtcgttgctgtcgccacgccgccaccaccgcaccaccatcgccgtgggccgccgccgccgctgagaggcagtgagtgcagagagaatcggctgagaggagagagagagaaagagagagaagactttgggagctgaagagacttttgggctgagagaatcagccagataaaagagagagaggaccgaggcgcgcggaaaaacggtaaattttgaagtgggtaggaggaaaaagagagagtactatttttaggtgcggctcttttaatagatccgcatgggaaaatcggtttattttcccgtgcggttcatttaagaggaccgcacggaaattttcccgtgcgggcgatagcccggcgccggtccgcctatttttccgtacggttccacttacgaatcacatggaaacaaaagagggtagcgtccaggaaaatcaatccagtagtagtgacggttgaacagtacgatacatactccactaggaccgtactccactggttccaaaatggaaccaacttagtacggataaaacatattctagaaatacaaatctagacatgccacacatatccagattaatagtattagatattctcatttcgtaccagtgttatattttgggacgggatagatatagattgaagc

SEQ ID NO: 42708 - DNA, 735 bp, Oryza sativa
gaaaatggctttgaggctgtctcggtgaaacaagtatatatgcaggaagtggaaacaatgacatgagaggcccgaaatgaacttccaaaacaaaatttctacatttacatcgggattcttacatggacatgtaggttgaaatgtaaacctttcggtgaaataacctatggtctattgagcagtctaaactgcaattctgttgcatcaaaaccaagcgctgtaccacaatgatacatggaccagtggaccacctcgttcccaacatgtgaacaatgcattttccggccacctgcaatagcaagatattactgtcaggcacgttgttgtcaaacatgacaaatctacctagtgctcctgagaaactcgtgtgtttatggcaaatcgtagaccgtttgggaaacataggattaagatagaatcgaagtgtgaaattaatctttgggtaaagtacagaccttcgtaaagtgttggtaacagctgaacagcagaggtgtatactggagtctgacgcaggtcggatggcacatatccttctgcccctcaccagtcaccatgtccactctccatcttcaccttcagttcgtcaaaattttcatcccgtgcagagtaaggtttcacattacggcagtacctatcatatgggatggaagtaagttcattcgtttttttaaaaaaaaacaataaatcaacataattagcaaacaatgacgaaggagcccacataccattagtatt

SEQ ID NO: 42709 - DNA, 1672 bp, Oryza sativa
actttgtttctgtaactcatggtgatgtaattgtctatcagatttctaaatatgaaattggcattagacgacaaggaacgtgaagcatcaaagctaagagatatcgcgaaccgtgtggcctctgaaaagagaaatgcaagaacgaggtcacctctaaccaccaccttgtcctcgaaacctgaagctggtcaggattccagtgtagacacttgtacaagcgaggtaccacatactagaagcagtttcttgcaagttacattacagtatacaaaagattactaatttgaacatatgtctaccttgttccatttgcagatcagaagctcatcatctggaaagcagagaaggttccgctctccattgtcagtgagagaactggacgagaagtcacctgtcatcaaccgggagttatacttgagtgccaagttcaagactccatctcctccagtaagaagttcattgtctgccgagagagttggcattgccaaaagcgtggagaggtctgaaaacatcgactgcacaccagtatcaaggattgaagtgcccccaaaagtacagcacagtagctctaggaagaccccttcatccgtcctgacggctcaaagcttacggaaattccgagactccgaagaaaatagaagcgcaaagccatcggtccgagaaagcatgacaaaaaccaggctcgacagtgcaacaaagccgcctcagaaagaagagcaaactgcaaacaagaacacaggtactagagtgaggtcagaagccaagatccccaggaacatatctgacatagaaaacgagtttgcaaacagtgagcccaccttccattccaaccgaaaggcatggaagctcccaccacagtccacaagacagtcgcagagcattgatcttaggtactaagattcttcactggtaacaacatgacatgttttccagttttcctgttgcatacaaatgcatctgtagatgtctctctctttttttttgtgagttcgcttacaaagatgtctctctttttttttttggtttgggttgtcacttttggcagagcctctgtccgggagatggaacctctgactgaagggaagcctcgccggagcaaggcgccccacggtgatagaaccaacgtccccttaccggagacccggcgcagcgtctctctgccccgcgggaagatggctctcgtgtgaaaaatctagttttttcgtcaggcgaatttcattgtaccctgtgatccggctatatctgtaggtcttctacggctgggtagacgaacctgagaggaacacaatcattcattggtttgttcttttttttttcctttcatttttgaagttcgtgtgtctgtttcgtacgaacctcacgcccttttgtacaatgtaaatgtagcaattgccattattatatctcattttcagtggcgattgccttattggaagctgaaagcctgaaaccactagcactttgtatcagtatcaccgttcgtgcagatgttcggagttctaacaaatgatttgctcctggtctttgctactgcagtgcagcagactacaaggcttgaaaagctagtttggttttacaaattttgctatcgattttatattttcagcgaaaagagagagagtttgttttttttttcgaggaaaaaagaactgtttacccccgtatgagcttt

SEQ ID NO: 42710 - DNA, 1249 bp, Oryza sativa
ggtgcgcgaatgtcgagacgcaactagatggttacagggggacatgatataacaattaacaagggaggatcaatgcaacaaattaggtgggtccgccaatctgccttgcagacgggacgacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaaggtattgaatttctaagattattggatttttggtctaaaggaaaaggatttaattaaatcctttttggaaaagaaaaagaaaagaaaaggaaagagggagggattatagacttttcctcgggcggctagggcgcggcccaagggaaaaggagcggaccggccgagctaaatgggccggccggcccaaggcagcccaagtgcgcgcgcgcgggaggggaggagagagagggccggtggaccgggctcaccgtgcgcggtcccgggtgggacccgcttgtcagcggctcggctcaccgtgcggagggagcacgcggcgcggcgctagggtgggggagggacgcggtgcacgcgcgcggtctgcggaggaacggatgcggcgggcccacgcgcagcctcacggctcgcggtggaacgcgcgcacgggaggggctgaccggggtcggcccgtcccgacctcggctgggccggcgccgacgtggcgcctacgtggctgccacgcgggccggcgggaggtagacgacgacgcctgccggaacggacggcggtcgatagcggcgagcgacggagcaaaccacggcgatacaggcaaaagcgagcacaccgggtggttgcacgtgacgaggggagacgagccaacggctcggattcgccggagggagcttgaaggcggcgaatcgcggcggcggcaaccggcggcgggaaaaggggaaaacggcgacgaggtcacgaggggccaattcccggtggtgagagcatctacgcggccacgggaatccgatgctagcgtcggattgggcggagctacgccgagcgaggctggcgacgagcgggtgcta

SEQ ID NO: 42711 - DNA, 4146 bp, Oryza sativa
  unsure (1)..(4146): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaacggatcggcaatgttcaaattagcgtctatcgctatattgaatattatcatcaaaccatggccgttctaaggttgggctttggatttcattggtcaaatttatccttcgtcatcgaaagggcattggttcgtgctagttgcaatggattacttcactaagtgagccgaagccgtgccgctcgagaatattacttgtacggaggtaattgactttattttgaagcatattgttcatagattcggtattcctcaaacgttaaagaagcttcttttatgtccaaagaagtgagaagttttgccgaatcttatgatattaagttgttgagttcttctctttactacgctcaggctaatggataagccgagtcgagtaataaaacattgttgaaattgccgttttgccagttgaggtaaatcttggctctcttcggtatttcaagcaaggcgacttgtcggttaaagattacaagaccttgatgggaagtaatttttgaagatgtcatcgacgagcgtttgaagactttgagggagatgaagacacttcgagatggtgttttcagagatcaattaatgggaaatacttgaagaaatacttcccgagtatttggcaagatgcttaggaagtcttatggccggtaattggattatcgccctgagataacatgttctatgcttttaggttcacgtctgttcaccaaaaaggcaggggggcatgtgtttacacccaaatttagcacctatggacgaaataggggaaaattgccaaagtttggaaagtgacgggtttccttactcgggaaggcaggtttcgtgtttcctttggtttctatcccgagttggatgtggagaagggcctgtagagggcaagaccaacccctatttaagggacaaggccggttcattgtaaaaccccccaatacaatctacttgaatcgttcttttactatgttttctattttaccctagtttagtccatctttgtcggtttgcgccgtaaaccgtccgccgccgctgcgagagtgcgacacctctttgtaggtttgtcctgaaaaccttccgttttgcccacgagacgggtagttatcctcatatcgatctaaatcggcctagaaactgattttgatatctaaatcggctccgctagccggtttagcttttctttttgcaaaacccatcttgatttggccctttggctagatcgaggtggttggcgactccatatcaccgcaaggcgtttaggtgttgcgatcgtgcttgtcgacttgtcaaaaaagttatcaacacgtatatgagcacttctaaacaccgaacgtactatataaaaattacatggaaactccacgcaacacggctaaccgactacgactcaaattaaccgaaaagattattactcagattaatttcctttgttccaactcgcgcgctatgagactggattaatctcctttactgtgaacacacgggtgacacaacacacccgcccgcatcgcactttacctcggtcctcctcccgtagatagctcaacagcaatctttctctgcacataattcagctctgtccctctctgcaatcccgtgcagctaaaaacccagcacaacacggccatcagccttccaccactgctgtgtatatataatatacgaacagcaatgctactccatcttcacagctaccttcatgcatctatactggattgaaaattataacttctctcacccatgtgcttgcaaaccatcttcacgcaccagtgacgaatctagaatgaaaagagaggtggtgctcttaggtatactgcttaacacaagataatttttgctatagtctaatgctcacaaattatcaaattagtaccaaaccagagaaaatggaaaaatgatttgtgttcttgataaaaataaaataaattagtcgtcctaaaatctgaaattttgatttcctagattaccatggcctacggcctaggataggaaggcaccgaagtggcaccaaagtggcagctcttgttctgcaaactgctgctccagcttatggcctagtgctctgctaatattctgctactatgctctgtccggttggagctggggctttagccccaacaagccccaaccataaattcgctcttgtcacgcacccaaaatttgcacacatcatctcccgaatacattaactcctgcacatagaaattaaggttattttcttcagcaaattattaggcaattatactggttattctacataaattggcctgtctaaaatgaccgaaccataagccaaaattatgctactaacagatacgtgcaccttcagaaaactggctgagctttcttgtggtgatagggcaatggccatacttttgacctaaatcacccagcctttccatgctgttgtctgaacacgagccatcttgggacctactcaacgttccagcatgcatgaacagttgccagtagcaatcagataattaccattttcaggttcagatatcagaagacatacagagctttcaaatcttgctgtcttaacaaggatccagccatccaggtgttaggtcatgtccagaatgcctgaattcataccgaaatactacccccatcccaaaatataagagatcttgacaatgcaaatacatagctaaaatttatattttggatcggaggtatagtaccgaatagttcagttatggcatgaatcgagaaaaatcctggttcccaaaacagagcccttgagacacagtaaccgttctaaccaaaagtccaaaacagaggcaacagagcagctccatgagattggagacagtcacagtctgacagtgccagttgagcaaaaacaagatgcaaaccttgaagcaaaagaactctccaattctgaaacaattacaagatccatgtaataatagtaaaaccaaatcgttccttttccatatgtataaagttttctgttaaagcttgtcatcctaattataactttccctatataaaatcatctaagcttgttgcggcgttacatggtaaaaaagttgtccgggaatccaaactctgctacttgtatacacctccacgagaacctacttctcattcaacttcacatgttatggaggcttggaaaatacataccctgccagaagatgacaatccaaagctcctgttatgcgattatgctggaaatagttatgaatacaatgaagacaacaactcttaaaagcatgatagtgatgacaacggtgcaatctggaaagccactttagataaaccatgaaaatcgccaatccacgatgtagtaaaaaatttactaacatcaataatgacagctcataaacatgcatgttgaaggaggatagcaccagatggtccttttagaaaatacataggtggcacaacttgtaatacaagcagtctatggaaagcactcgatcaaaaaccagtcccataatgctcaaaaaccgatagcccgatattcccattattttcaactaggaagttagccagcgcatatgcgcgggcacctatttaatgtgtttgtaataatacaaatgtttgagtgactttttactgaaatattttttactcaattctaaatctgttcttttttgccaacaattcattttggattgctttgaatgctggttttgattcccttctaattacccttaaagcaaataaagtctaaactaaacttacttgaaaatcgaaatttataaaagaatattgtgtcataagaatggagttggttaccatgaaattatatatcatttgtattatgtgtatttactttttaaaatatttagcacatcttatttttggattttctaaactttaattaaggtaaaattttattgtatgctatatatgtctttacagattttagggcatattaattgaagatattttctattaaaaatatggctaagagactgtttcatctatctatatgatgg

SEQ ID NO: 42712 - DNA, 2575 bp, Oryza sativa
gcatgtttataataatgtggatacgtgaactattgatttagttgtagcgacataatattttacttgtaagaacatacttaatatggatatttgaactatccaaaatcaagggtttaaatatggttatttaaagctcgatcaaatatttagcaagtatgctcatgaatttagggtggtcaatgtgcacacaaattgtgctgcccgcgcatatggacatgtgaaaaaacagggtcaggtgctctacgcaaataattagttaacactccctaccatccaacaatgcaaatttgtttaaaatatgggtcattaattcaaataaaaaaatttaagagttgtatgctttaaaattaatttcattagctagctattctcatgttatcactttttcttcaatctttagagttataacagtaaaggaaatctggatgtaatactttataaagataagctataataaccttcaaaatactgcaggaagaaaaacatgccaaattaattggcttagcgaataagataatataccttcgtcccgaagatcaaaatttcaaaagtaccattgttatgggaacaaataactcaaaatatgcataaacatctttagaaaacctgtaatgttacgaggaggtgattgttagtttagcatcaaagagaaaagtaaaaataatgtgaacaaactatactgaaccatattaaattaattaatgtttttttataattgtataactgcaaaaacgattatgatctttgtttcaaaaatatgtcattaatgaaggatattggtattgtatcatctctgcaaaacttatgtcgtatctacaaatcacctagggagaagaaatatggaatttgcttttagatggatgatgggatgttgtctcgctaagcattgtgaggctgagtttaattttcacatgaagcttcctgctcaattaacggatgcagatcgatgcagcgattgactgcttaccggcctcatcttttttgcttaagcatcttattagccaacatttgaattttcaatcttaaatttgaagttgattttggagttttttcatataaatttatttttcagctcttggcttttagatcactaagaacacgtatataaaagttttaatttgaatttttaatcttaaatttggagttgattttggagttttttcatctaaatttatttttcagcgtttgtttttagatcactaagaacacgtatataaaagttttatttataaattatttttaatttacaaatttattgtttcgcttatttctcaaataagtgaaacgatggagccttgtagacgtatattatatacagacccaaaagatctacattacatatgctaccgcacataattctgagagcacctatgtgttccaatctcattcaccgctgttaattatttcgactgcaatgatgatggcatcaatcgaattagaatgcagatgcctcgtggccactcagacgaatcaaatctctattacgattcactaattacttagagaagggactaaacaatgcaattagtctcatggatttacctagatcgaacggaaggggcatcacaacaactcgataggaagggggcatcatgatgatcgatggctcctttcctgacagttagcacctagtgagctgtactcgtattattcaagcgatgcacggagattaatcgcagctcctctttccaatctgttgagagtctcggatcgatacggaaacgtgataaactgcaggcctagctaagacataaatacgtggattggaaatttttctttttccttaaaatttctatgatttttttctaatttatttattaatttccttaatattaggatgccacgtggtggcttatgagcgtttgtaggagtgccacttgacggcataggagcgtttgtaggaagtttcatggacttttagtatatataatagaatagatagataatagatagatagatgtaacgagttgagtcgaacctagccgagtcagccacgaattgagcgagctaacaagtaacgagtttaattttcatcctcccctaaacacggtttactgaatttgcactatgcaaaacaacagaaatccaagaaagcaggtagtaataatcttaaaacaagcatgatcagacgataaaattattccacacgactccgagcccaaagtactactctttcttggggtgaagatcaatataatcaacagggccatgaacgtcgaataaatcagcccaaaatccattcttcctcctcgggttgcaccccatgtcccggcatagcttatcattgtaccagatgtgaaggaatccgatgcaggatctgcgaaagtaagcacgagaatagcgcttcatgaacttctcccattcctggacatcattctgcatcacactgatgcttggcaacctgaagccaccatccatgaaatgtgcgagccacttggcccttaattctgatgtgtacaggtttgccaagctttctgaatagccgataaccgccagctgcgggatcttacagtgaatgatctccctgtgagaaatcatgcagcaaattaattaactacgacacagtcctggatag

SEQ ID NO: 42713 - DNA, 37502 bp, Oryza sativa
gcatgtaatcaaagcttcaaataggctatggtcaggcaccatgccatacttcttcattggaatggaataatagctttctgcaaacttcgaaaatatccacctctgaacatgtgcaaagaaggaaaacatgcatggatcagtcttgcttcaatttaaccagagaaagtatattttagcaatataattaaaacagaatatccataccaatggagtcaagagggtggccaagatgctaaggagtaagccttcaccaggcttgtgaataataagctcagaaaaccgattaagatacagctttgagatggggacgccccacgcataatagtctggtatgatccaatgctttgttcggaccaccattgtacatggaatctcagtacctacacgaagaagaaacacttaataagtggggaaattctaattcagcatctaacaagggaaaagaatactgaaaaattggttgatggaaatcagattgttaatttgtcagtaccatttacttctgcacattctgcagcaatgtcaagtgctgatttgaggtagccaacgatcgtgacacgcttgcccttgatcatttccttacaattcttggtgcccatcttggagtaatccatggagtggatcacctggccatcaaatgcttctggacctttgcatgcaggaaatgttggtatgttgggcactccactgtacttcccaacacaaagaatgacaaaatccgcagtgtgtgtctggaatatgagaaattcgagtgtcaaatgtcacttaatttagggataaggaaactatgatgaattatattgtactccctttctttcaaaacacggtgcctattttaaccaagaattgcaatattacttatatatgtgatacgaaagtatatatagttgagaataaagacttttggatatgaattttataaatttaattttatgtaaaaaatagaaaggcaaaacaaaaagaaagaaacacattagccaatggctatctctcgatcggcatggatgatgggactgggcgattggatgtctcgcgctagaaagtgatccgcccctgcgcgccacaaggttgcctctttcggaaccagctgaccatacccttcccatagtttgactttttaagattttatcatagttaactagaaagtgtcttttcgctacggtgtattaaaactaaaaatattttatttttaaccgaagttactttcacactgctttggtacttttgctcgttagaaaaagtctcaaatgatagagagtaatatagtagctaataataaattattattcaatagtgcgttgcaacatgaaaaactaatgttattaacttagtaaagtaacagaaaaagaagcatccacgttatctcttatggtctagatttctcatattagttggagtaaaatataaaaaatgaggagaactcattgtagacaatgtgatgaggacacaaactagcttggatataaccatgattaacttatgtattaattaatcaaaggtgcatatgttctatattagatttacttgttatatatttgaacaagcgttgctacataatgtgtttcgtgtgttttcgtttgcagaggtacttgcttgggtgaaagaaaagagaccgagcgtaatgaatgcatggatgattaaagaagttgattggggaccaaaccaagattttctcaagtccacttccatctcaccacatcacttttggtccatagaagacaagagataaagttctacacgttttggattcggattcgggcctcctgacagcatcaacttcaaacggacctagtctctgatctagaaggaatttcggggccatgagtacttgttggaaatcttatggagtctactttcaaatggttttggttccacgtcaaaattcctaccgagctgtcggaaatctacaaaacaaagccacgtatcttatccagtttgaatctgatttgagttttgggtcttgtaattatgtcgtgggcttaacccaagggggtgtgcgccctagggcaaacctaggacgtccctaatcatatttattcagtagctgtcatcgtttagagttaggtttgcttagattaatctgtcaagaacagtttcgccgctagatcagtttgtggaaccccaaattcgaatgcttaatcattcatatgcaatttggttgcaatctatcttgcttttgcttgtgttcttcgattcgcatgcaggaattagccttctcggcgaggtcaaccgagttttggcacggttgataaccagaggagatgtgatgctgtgattgcggggctcagtagcgtgttcgttcaaaagccggatcgagttgtgtcacgactccgcccaaatcgactgtttatcaatacctatcggaacatcgggacctattccccatcacaatgactcattcattttgttttttttaaaaaaatcacgctatccaattggatatatgcataaaacaaatcttttgccaaaaaaaaaactaaactgaataaattaatctatctatataaataatacaacttaatataaagtataaattataaattaaataatattggatgaggagtctagaatattctccaaaagagcctagagtgcatataggaatataatttagaaaaagaattaaaattcaaaataaaaaaatattgaaagaagagtttagagtccatatagaaaactaattagaacaataaaaaataggaatattggaagaagaatagagtccatataaaattaaaaaataattaatattatttaattttagtctacatttaaattctatatcatgacaaataaatatttacatttttagtcgacaaataaatccatatcatgagaaaaatctatccaaaattttagtttattcaatttagttggaattaaattaataagcagtcataaacaattaaaatggtattaatgtccctcgcaaaaaaaatggtattaatgctatttctgataatagaaagatgcttaaaattactaagagagaaaacattgattttaattgcggctcatttagaggcccaacagtccggtggcccgatgcgggagaagacgcagccgtccgatcgaatggacggtccagattgatcccagccaagataaatatctgtagccaaaaccataaccctaaaattcattccaccctccgcgcccacgatcccttctctctctcttgatcgaaaagcgatggcggcggttccggcgcccgccctcctccctaccacgagcggctgcggcggtgcccttccccctctccccgcgagcggcggcggcggctccctccgacctgtctcgctttcctcgccggcggccgctccctttgtcctgtctcgcctcctcgctccctcctcctctcctcctcgcctccctcccgcggtggcgcgggttgacggcggtcgcgggcgaatccgagggtggtggcggcggctccctccatcccctctagccttcctcctgtggcagatccgccggcggcggcggcctccgcaggcggatcaagcggcggtggctccctccgccccctctcgccaagtcccgcggtcgatccgacggtggtggcggcgttggcggcgtccgcgggtggatccattaacagtggcggtgggcagatccggtagcggcggctccctccgccgcctctcttctccctccggcggcggtggtggtgtcggcggcggccgcggatggacccagtggcggtagcaacggccgagggcagcggtggcaacggccgagggccacggtggcgatggccgagggcggatccggtggcaggcgagtgaagtttgtggtgtatattgttgttcttcttggatgattattttgtgattttgtgatgattgtggttgattttttgggggcaaagattggttaggttttgttcttttccttgcggtgtgtgcatctgattcggttgtgccgattttggaaagtgttttccttatccaattcggattcgggggctgcgaaggcgcaccgccgacggacttgcgacgaacagaaaattacgaatattttaattagttaagattaagatttttattatttgcttttaaattgttaatgacacatgcataaggttttacttataaattatttttttccagcaaatttggaaacttcctccacgcaaagccgtagcgaaattctcacctcaagatggccctcaccgtcggccacctccagccgccactcgccggagccggagccaaaagcgtcgccattcccggcccactcatcccacgccgccacatcctccttgccgacgccgacgtactccatccccgccacccggtggccgaacctgacgcagtcgagcaccccgaagcggcgcgcgtaggcgccgaggtagtccatcacctggcggtggtccgggaacacctccgtcaccgtctccggccacgggaagtcggagtactggtacatgggccgcggagtctgcagcgcggtgccctccagcgtccacgcccacacgccacccacgccggtgtccgcctcgaacaccaccggccggcagccgcgctccagcagttgcttgcacgcggccaggccgctcacgccggcgccgacgatgaccacccgcttcttctccatgatggctagtgggctaggaaagtgcgagctgtgtgagttgtttggagtctgatgagcgaggtggtatttatagttggtcagtgctatacttcctcgaaatatatcttttgaccatgtcatctaatcataatatatataatggataaaaatatttttactgttttttaaaagttatatatatgtagtgttaatacctttaaactatattttaaaagttatcgatgatcaaagttacaaaagtttgatctcaactttatctaaaccatcaataattataaaaccagaggtatgtcattaactgtttaattatatattttttataatgatgcattatgcactaaattgtttatggaacatgaattgcttaatgtgctatttttttatatggcgttactgagtattaaataataatggcatgtttgttatatgtacttataaatcattcttattatttttaatttgttaaacttatcagtggtgctaatacgcatgctgcgcaccgaatgctagttcgagcgcgcacaacattccctccgtccggttttcccgttgttttaccacccaacctttccgccgcaatccacctttccttcgtccgttttttttctttttttcacccccaccttccgtgtttcttttttctcttttccatctcatctatgcttcattaaaagagctgataaaatattaaccatccatattttctcattttctcgttccttctctccagatttgttatgcttcattaaaagagctgataaaatattaaccatccatattttctcattttctcgttccttctctccagattttttatgtattcttattttagtaaaatatttaccatctagtttttctactgtctcttcaagtttcaaaagtaagaaatttatgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccactggaatttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagctttggaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggatcaattacccaattaaatctaacaatttactctactgagttttccatttattcccagtatcccacctctgcaccttcaaaagtaacaaatttactcacataaatgcccccttcaaaagtaacaaatttacttgcatgaatgcccccgcatcgttcggcactattcctagatggtcataaaaaaaatactaccagcttacaacgctagtaattcttttaccagtgttataaataagagagaatcccttatatgccactgagtataggccgggcatggctaacaactcagagagggcaaatatgtcttttttacttaagagttaacggtcaacacacggtcaaccgacgggagtggcatgagagagtgcgcaaattcggaccaattgcatataagggaagagccaattttcagtggcatataagggatcagacagattttcaatggcataaaagggattatctctataaatatttagactttatagtctgcacgtaaaataattaccaccttcctcttaatttagcctatggtctagtagccaccatgtagtaataatataggagtaaaaactgatagtaagagtattgttaatatgaataacaaaatgaacaaataagtaaaaaatttacaggctcaatcacacacgagtgataaaattactcacaggtgaatcaaactagaaaagaacaaaatggtctagcaaaaaaaaaccatcatgaagttggggtcctgatggctgttctagatcttgtgataaggatgtagaggttgatctgtgtcttatgacagatggtggagagggcaaccgggtggcgagcgacagtcagcgataaaatcatagaaggatgtagcggcgtggtatagagatgagcttggcgatgtgcattagcaaccatccatcatctagcaaacagaaaaaaaatatgcaaaaacattcttgtttatgtcatagagatgatgagcaaaagaaaaacatcctggttgccctctccaccacataccaacctccccatctttgttgcaagatccagcaaagctaccatgatctcagcttcacggtggattttttctagaccatttttatttttctaatttgattcatttgtgagtaattttatcactcgtgtgtgattgaacctgtaaatttttcattcctatgggcattgtgtagtagtatcgcgtcaataaagacaacaactcttaaaagcatgatagtgacgacaacagttaggctaaccgtacgctgcaatctggaaagccactgtagatagagcatgaaaatcgccaatccacgatgtagtaaaagttttactagcatcaataattacatctcataaacatgcatatgtcggatgagtacatgcagatggtccttttagaaaatacatatgttagcctaatcatgacttgtacatgttttgagtcttgcatatagggatcacgtcatgtgttagacgtgtcatgtggcaggagattgaacgtgaagtgttcacgttgattacgcagttagaaacgtactgcatacatgagccaagtagttagctagttagttagcacttagcacatacatgtgttgcttgtcttataggagaataagtcttcaagttgttggacaggaggccttttgacttagtacagggacgtatagctacgaactggaggccccagtgcgaaatgcatgatagaaccctaaaattttacgaattttacatgtaaattctcacggtcctgttatcgcgatcaatgtgatatgattcatagaacaacaggggagacaaaatgatggccaactatttctagttacaactattatgctcttctacttttagttttgtgtcatagtcctgaccttttgcaggcttaagcattctatttataccactaattaaatagacttagtgctccatgcaattaaaattaatttggggggccttgaatagtcgcacactcccgcacatgctaatgtacggccctgcttagtggctatgcatgtgtggatcgtgcggccgtgtgcgagagactcggccaccacgactttggccggcgtgtatgtcacgtcgatgcctgggtctttataagcattctgtaagtgttcgtttctgagcgaagagagagctacagagaaaaaggaaaggaattagttgccgagaaaaacttgtgtgcgcgctgcgcgcatgtgcacttctgtgtactccagtgagcagtggcagatgtgtatatcggtgtcctaccatactaattatacttaggcggctatagcattataatatattggataagaagtttaatcataggttttgctaaaagtcatcgttgtcgcctgacaccaacgctaatactgtagatccctccctgagtgagcttctctgtgagtgtgtttactgctctgtgagtgtgtgctgctcacgtgagtttgatccttggccaaagctatcaacataggtgccacaacttgtaaaacaagcggtaggacctacagaaagatagcactctccagtcccataatgctcaaaagcgtgtattcccattatgctcaatatttcagcataacttatcatgacaaattttcttgttacacctttttttttttgcacatttttgtgaaaagagaaaggataacttgctgaagatgatatatcttccatggcatagtatctacctccggtggcaggaacgaaaagaaaaattgaactccgcttaggcctaactgcaaattggtaagagatcgtacaaatttaggctttaagagttactcgttaccgattccaaatcctgcaatcaaagaaactatgattacaaaataaaattatgttcccttattcctattggttgaaaaataatgtttgacagatcaaaacaactcaaaaccaaaacatgcttcgtgacagtagatcaacctatcgacagtatcatgaaattaagtagatgcatcaaaaacgcttttttttccttaaaaaatgcatttttttaatgatttccacaggttgcacaacttttataatgccaagtgccaaaggaaattctgaaggagtctgtaactagttcattatgcagtccagcaggtgcgatgaggaaattctgaaggagtctgtgattagagttccagttaatttggttggcccggcaaaaaaggatttttgatatcccctaactaaaacaaacttacacatttgttcctgctaacttataaaaaaaattcctgtacacttccctctttactgagaaacacgaactgagctcctgttctgcggcgtggtggcaggaccgctaggggattggctccgggaaaccatagtatagaaaccatatacagatgcaggtcaggtaacgacagccaggagcaataatcatagtatagaaaccatacatatgcaggagtcatacgaacatcaataatcatcactgcacatttctaattgtgaagaacaagtgcaaaatatatggtcatatcaatcacacaggattttaattcttttccccactatatattgatgttaccacttttaatcatggcatacaacctggagtttaattcttggaagtagttgcgctgtgaaacagcttcaatgtcctctaattaaatgatccctgtttagctaacttaaacagtttactggagtacctagatttatgtcagactttatacatcctaactcccaagtaaatggaacttctaaggaaacatcaagtcttatgtcagactttatacattcatgtgacactcaaccaatacaggcttaatgattggtatcttatttgaaggttagagaaggaaaatgcaaatacgcttgcaaagagggtatttggactataataggattatttatttataggttgtttatctcctagacctttactctcctagatagttaatcccccagacctttggtctaatataactcattagcattgattgcaattcagctatatatatgagagatcacctccccacattgtgtgtgaggcatctattccacttcttctacatggtattcgagtttaggctcttaccttcgtagctagaaacaggctgactgttgcatctgtagctggatctttggatcagtcgccgacaccgtccttgacctcgccatggagcaggatcagaccgctcaagagctttgggtcgccatggaagacatgttccgagctaacaaagaacgctgagcaatcttcctcagcaccaatttcactccatgattcaaggcgactcctccattaccgattactgcagaagatgaagaccgctaccgacgcccttcgcgacatcgaccacgccgtctccaactcctaacttgtgctcaaccttctccgatgcctcaacgatcacttctccaacaccgctgataacatcgtaggcatggccgttctcccgagcttcacatcggcacgcaataccctcctgctgaaggagctgcgcatcccgagcttcacagcgacgatgctggttgcaagcgccagccccggctcctctttccctcctggtggggatggtggcagtgggggtggtggcagcgcacgccagatcttctccaatggtgagggtggtggcgatgacttctctggtggccaagcccacgccggcggcaaccgcgagggcaacgacggctggactggcggcaagaacgaaagagggcacggccgctggactgggggtggtggaggtggcggcgcccgccatgggtagccaaccctagctggaggctgggccttgggtttgttttaggaataagttcatctaaggtcccttaacttgtcaatgaatccgattttcgtccttcaacaccaaaaccagatacaacaggtccctcaactatcaaaaccggtgcagattaggtcactcgtggtttcgatggcggttttggctgacgtggcgcctacgtggctaatttgactcggtctcgatctgacatggcattgacgtggcgcttacgtagcaattatacctcgaaaaataataaaaaccacgggcccacatgtcagcttaaaaaaatgctggggcccacgtgggccccacatgtcattccctctcccctctcggctctccctcttcttcctcactcccgccgcctacgagctccgacgacaacggcggccgaagcatgccggagcacgggcgcacgtacaaggacgccaccgagaaggctcgccgcttccgcgtgttgaaggcgccattttcctttcctattgatcacagtaagtggtcacgggaaaactgtgagaaaaattcctttttgatgtcgattccaggggaagacaatcaagcaacaaagagaaagacaagaacgggggttggatgaagaagaagcaaaacgagcctcctttccacacaagctcgcggtggctggccgccgtcctctccagctcgctccgccaccatccagccaagcgcgctcgtccaccatctgcggagggccggagctcatcagtgggttgccgccgccactgtttcaactaattttgcctgccttttgagattgggaaattagttcagcggtaaagaaataaaggggaaaacagatgggataaacacggtacacgtagatgataagtagataagtacggtacagaggagggccgcctctcctcgcccggccgctgcgcgccgcggaggagggctccctgacaacaactgcgcgggactcctcctcactgcccccctcctcctcctcctcctcctccacctcccgctgtgacacggccgacgggtcaggctcccggcggaaggggtcgggcacctcgagggagaatgcgaggcgttcggcacggatgggtggctccggctacgtcggcgggagaagcgacaacgtcggcagcagcagcgaggcatcgggcatcgggcgctcggaagccatgggggatgggagcgagcagggctagtgggtcaccaccggaggcatggcggcggattgggcgagaggtcgccggtgacggcgaggtcaatggaggaggcggtggcatgagcaccgacgcccaactcctcttcaccggcccccgcagtcgccagagccatgcctccgtcgcgagagaggagaggggagagagagttgatgagaggggatggggagagaggaagaagggggttgagaatgacatgtggggcccgcgtgggccccaccattttttattaatttctttgtaaaactgacatgtgggtcccacaaggtttattattatttttgattgaattgccacgtaaacgccacatcggtaccacgtcagatcgagaccgagtcaaattagccacataggcgccacatcaggcaaaaccgccatctaaaccgccgagggacctaatctgcaccggttttgatagttgaggtacctgttatatctggttttgcggttgaaggacgaaaatcggatttgttgacaagttaagggaccttagatgaacttattcctttgttttaacccttggctagccaagcaaccggcctagcgcccctcggctggtcttcttgggctggctccggtggcccactactcccaggcaaataccaccttcgctaggctatctatgtcacatacatcaactggctagcccaactgggagcaagctgacctcgttgcataaccagatggcattttttgcctatgttggatataatttggcttggagagtcatttgaccactctgttagagttgctcataaataatacaattttttaagaaaacacactttttacctttttagagttgtgaagtaaaataatccggtgaaatagcccaaaaaaggaacacatatgtatccctctaattaagaaaattgtcagatctcttgtcccatgggttcagatttagtcggctcgtgctattacaacttgaagtttattgtggtcatgattcattttgtattctagtattgcagattttctagtgccacggatcacagctggcgaactgtgagctcaacacaacttcatgaacaaagctatctttgagatattttctttcttgcgggaattttatctggtgccaacacagcgcatatgtatccatcatcaggtgtacctgggaatatcttgcatgaaccttgtggatctgtctgtatatgtactatgcattttcaacgctacaatcgggtaaccagtttcttattgtccaataataccgtgctgatatatactccgtatattttatctgccatgcatgtctaagcattgacggtgactttttttctgtgattatcatgggtccagctccaccgaaaccttgaaaccttgttcagttaatcccctaagaaacttgaaaagaattaagagaaaagacgtggacttaatcccctcgatcttgtccgatctctttcttgtgaggattaaccgaaaaatcctgaaacggtgaaaatctcctaacggtaggaagcaatgaagaaaaacgcaagcacccgcacaaaggcttcatttataggaaccataggtgactgagatttctaaaagtttttggaaatatagtcataattccaaatattttaatccataaatataatcataataaacatgacttgtgataaacatgacatgtgaaaaagagagtgattctaccatggtggtacacatgaatatgctaccagtaacaatagcatctaagaacacatttaacaccgagatgagaagaatatacctagagaacgctccgaatccggaggcgacagtgttgttggttttgtcgccgtgttgccattgtagttttctctcctctattgccgttgttcccttcgttgccggtgacgaagaggaagaatagcctgatgcagatgaaacaatgccgaaagcagtcacgtgaagaacgcactccgcaaaaacatgatcgcctacctacccttgcaggtacttgtaagatcgcacggcaagaattaaactaaccaaaatggaggtgaatgattgaagtatccaaatccaaaacttttagcgaaattaaaagttaacctattattgatggagatcgatctgaccggagtagatctgtcggtctgaccggtgtagttgttccggtctaaccgcctgatgtactgttgttgcttgtcgccaccaccggtctgaccgccatggagccgccgatctaaccgggtcgatgccatcggtctgaccgctgatatctcgccgattggaccaccgcacctgagaaaacacaaatcgaaaagtgggagctcaccgtggggcagcggccaagagggctcggtggtgaggaacggtgacggtgggctcctcggggtgtggacaacggcggcagctccacggcatctcgcgggtgcgaagcggcggacggccaccggatggaccttgacaggaagaagagggctccggctgtggatggtgaaggcgaagaggcggccgaggcgcggcacggcatggcaaagccgttggtgctggcagcacggccgggcgaggcttctctcgccagtggggaacggctagaggcggtgaaggaggcgacggcttgggtagcgcggtgaaggcttgctctttttattatgcccttggcttgctttgcactcgagatccactttgagccttgttctttttattatgcccaaactttgtgtgtctgtgtttgagttagggatttgagttcttgtgagtgcttggtgttgattgcgtgaagatttgttcaacacttgtttcttgcttaggatattcttgcttcatcttttactcttggaggtcgaggattcctaaacagcgaggtcattcttgagccaccgatctacgtgtggttggccaggagaagtttgttaaggttggtatcgattctctagatcagcaagtaaatttatagggtgcactagatcaaggagagatggtgacactgagtttatacaggttcaggccctcagaagagtagattggatctgtatagatgtatgcgcggtacggcgtatggagtagcacgtagtgtccaaggattacccgcgctagggtttccagctcctatatagacccggggaggctgactaaagtcagtaggatatcctttataatctgggtacatgtcgcctatttacatgagataagacttgtattcttatctttaatccccttgcgaaattacatcatgcggcatgggcctaaacctagtccgcccaccccatgctacacaacccaaacgcctaaccttcggtacctaggtaccgtgtaccccgtagttggatcttgcctccaaaagataagagaccactagtggaagaagtagtgctttgtgtaacctctcgaggaaagggactcggctctttgtgagatcctcaacgaagattagaatcccctcaaggattcgaacttcgggaacaactcatcttgcaagaacttctgtgacatccttttccctctcccttccactatctttgcttgcttgcttgtttgagcttgatgttcttggttgtgactagctagatccattttgctagtgagtttgtcgctgctatgctatttttggaaatatccgaagctccttcggatatatccgaaattccagcttccgcatttacttgagtttaatttagcctattaaccccacactataggcctaagtgaccctttcaacaaacacccatttgcttaaagaacatcagactccaactagcataaaaagcagtcaccaaattgtgacgcaaccacacaactggatcggcaaaattgagaatgtgggaaccaagatcagcctggatggtgaaggttactactagcatatcaggctgttagccatagccagtccaattgcagcctatggccagtcggatgcagaaccaggaaatctatgcattggttaaagaatagaagaactggggtaacagtaacacaatgattccaactaaagaacagaatattttatgggcaaaataaacatccttctgctgttggatcactgccgagttgtaaaaaaatacacccaactgaattttgctacttcataaattaattgtctactaaataaaaacataaaatcatatctgcagcaagtcacacaagtcggcgcagctccccagtgaggagtgcgaactgacggtgctgtgacaacacggatagtgttatcatgcctctctttttaaggtcacttacctcatcaagggaagaagggttctcctttgtttctttgagtactgcttgaaagatctgtagtgggtccccatgactgacaataagaattgcagagctgcatggaattgaacatacaagtcaactccacataatactccctaacacagtatatggaaatgtgtgttgaaaaaaatactaagcagcaactggatgtggaacaatggtgattatgtctaatttagttgttctattgtgccaggaatagtactcatgtctacgagagctatgggcacccctcctcaagcttgtaaacaaattattaggactccaaaatccaaggacgggataacttgccaaggcagcaatacatataggagagactcctatttctgcatatctatgctccttatatgatgagactctttttatttagtctgggccatggctggacagttattagtcattgtgtgcaatcgactcctgaatactgttactagttgaaaagtcctgtaacaaaatgtaagccctattgtgattcaacattatgccttcatagttcatatgttcaaccaagtgatatggcctagaggattttggtcatggctgagcacgctgagaaacgggaactagcacggcgagggacagcagttgcatggaggaggcagcaacatattagtgtcatctatatacggacatgcgtatgtgtagaactaagaaagaagaaatcaaagaccctatagtctatctttcctctacccttgtggtgaggctactgatcatctgcattttcaggcttctcatgtctacggctatccaatcctagcatgttagcatgtgacaagttttatgtaagtccagtgctatctttccccctattttcatcaagagttgactcattatgataaattaaacatcaataaatttaccctagaaattattcattacagttacttgtttaacccaaaatagcctaattttttctatgtaatatagagcatctgttctaacatttgtacacacagcagaacaaaatcaacagatatcccaaatagtttatgtgcgtgccctgaggcatggtagtaaatttgatgtttattctaggaagaagaatgtattatatccataatcattactagtgggttactgggttgtcaaggcatttacagtttacaatgatctacggagtcaacgcttgttattacaatgagattttttttaatcacataagggcaaaactgtaagcatggttctctgcatacgtgggtcttcatatagaagggctacgcctagacccaattttagaagctgaaatgtccatataggtatggcgataacgcagcaaaaagcaaatatcaaacttgaaaaatagatatattccaaatttcaatatttgagttgaagtacccatgaagctccatttctgcagcagacaggaattgagagaatctagtagcaacatctgcaacgctctcgccaccatctggtgccattaagggatctacttcatctactgcccatacttctgcatactagcacatcatatcagacttagtaagttaaataaaagataagatcataagaatgtgaaaaagatgaacatgtgcttatgtggtgtggacgtgtgggattttggaaaagctaaaacctctgaaatagatatgcatgaccagtaatgcagttagggaccatattgccatttatttggaaagaaaaactccttctggagattaagatcttattatgattcattttagtgtccaacaaaaactgagctgaaaagaaggaaatggccttgtttttcttcttgttcattctgtaatcgtgaaaaagagatgaaacatctgtttcccgcatgtgaggatgaatagatttgtggtgggttgcaaccttgcgtgttgccactaacagtagacccactgatttgtggtagtctctgctggatgaatcattacttatcattataagaaatcatatgtaatttgcaatctaacataattccatagctacattattaaaaaccacatgcacaaatatcaaattgtacttaaaagatccagaagttccagaggtgctctgtgacggacccgaagccatgacgagataagataaccactgccgggaggatagctgggcggagtcggctgttagggacgaggggaattagactgggaagaagaacgtggggagagagattagactaattgatattagttgcttaatccaaatgatgatacaatccatccttatataaatggagggaaggacccaaactaatcttatccaaccgactctaacccactgagctaccgtgtgtgtacgaggtgaggatgggatagcatttcctcaaccggtaccttgggcctcgttctcatggcccaatgccaatgacatgctcgcaggtggcagattcactattaccaccattaggttcacttctttaataatagagattgatgttcatgtcaaacgtggtaaataaattatattcatctgaaaaggataattagacttttttgcaatgacaatgtaacaattgaacctctttctagtggtacagaccacagaggcaatcaatcctcgaatatccgtagaaaggctcagttaataacaacagattagagaactataatttgaaaattggcttggaagaagtcagccaccatttctttgcttacaacaagaatgatcttttcatcaattttaatagatgtaatttttttattcttttaatggaggatgtatttgttacataacatgtttttgcacaatttcttatagcttcatatgacaagctcggtctgtgaaaaccgctaaattttggagttagtttgaataagacaaacaaggagggcttgtttctaaaatcattcttttgggaaaaattgcttagagcttcatgaaagttccctaacttttgtcattagcttcaataagataaaagaacacaaagaaattcgagaatatcgggctttttcttgttctgctcagacaaacatgggaaagaaagtctgggcatttcttgttctgttcgttagaagatggcatttcgcaaaaattacagctaatataatgaggaaggaaaattattctgattcaaatgagttcctgtatttttttaaaaaaaaatcatgccagtgctattagttaaaataggtctcagtttgtaccaccaactgtaagtatgcttagttgtttatttatatatcgaattagagtctgcacagtttgatagatcagcaaaacacaccttctcatgtgaaagcaattcatgcgatggcccaaaatagcgttcccgaagttcaacagctggctgcaaagaaattattattaccttaagaaagcagaatagaaatgtaaaaggtgtttcaaaaggaaactccacactgcttttcacgtttgaatagctcaggaaacaaacatttggcaaagcaaaaaaattggacaatgttttggagttaatacatttcaaatttgtaaatcatacatttgaaggggatgattatagttattgaatggtagaagttagttggcatgcctctgttaggttcacaggtcttctctcctaccagattatttacaggtcttgctagctgtaaacttgttctaaagaatgacaagtttaaacagggtttactatgacttatgtaaacatgcccagggaaaaaaagggaaaacaaagaattgcataattgtttagagtgaattaaacaaaagactacatttgttcattttaacttttgcattaataagaactaagaagtgccagcgcatcacttaactccagcgaacagaagcaggtactcctgggaagtatcacattttaaatatcacacatggaaatatcagttgcatgtcttttttcatccttccatacaaaattgtctgcggcctggccctttttcaatctttatgcacgcaagttggacaataaatcagtaactaattataaaatcttactacacattcatgattatcatagataaaagaatccaaagcctatagggaaagttacaagttacaactcgaataaattccatgcgaaattacttgttcctaaacgttagaatatctatgctcacaaataactgcacaataaacagtgacagattttatatgcaggaccaaaccactcacaatgcagctgggagtatcaaaggggacaccaagcactctagcaacctctctggcagtctccatggtccgtgagaatggggaatatcggatctgaacagaatccagtggcacacccaattcctcaagctcctgcacgcaatcagtcccccaaaatcactatggcacatcctctccaagagctcatggagacacgactaatgcacaccaaatcggataccttacggagcgattcgccggccaagcgcgcctgctcgacgccctgcggcgccagcccaaactccggcttcgtgccgttctcctgcgaggattggagcagttagaaggaaagatccgaatcaaactaaactgctaactggacacgaagttcttggaggcaagaaattgaagaagggtgaagacagcgaggtgggatgcacggatcggtaccagggaggagacgatgatgccgcgctcgttggggacgctgcggccatggcggaggatccagtacctgttgcggaaggagggcgccggcgccggcggcgagctgctgccggagtcatccattcccccccaaatcaaagcacgtagtgacacccgctccaatcaaagagcggagtttagagccaaacgtttttcttttcttttttaatgttttcgctatgcaatggggatcaaattcctcattttccatagtactagctaattcttagctaattatgcgctaatgatctttctcgttttgcttgcgtacgaagatttcatcccaatcgaacaaatgaacacagcattaggcctagctcacctgtttggatgagtttaagattatgagaaacagctggcaaatagtcagcttctaagaatctggaatccagcttttagtttctagttcattttctggattctacaactacagcttttcataatctagataaaaactggactacaactacaactacaattatagtttctaattgtgggagaagctgcagaacccccaaacagcaccctattcctcaactccaaactttaactttgtcgttttccattagcacgctttttaatcatgtgcaacgaggtttcttgtaaaactcgttttacatgcaacaaaaatccatccccaaactggagatcgaatgtggttttttatgttgaaaaacacacccactgtttatcattcccaattgttctggataaagattttttatcaaataactaaaatgctcttaggatcgaataaatcaatactagctctcctgaacccttaggatgtgttgcacattccccttgccaaacctatgcagaaagctggtggtagtgagtccaacaacagcagcagcatccacatctgacgatgacgaatttttcgtctacaatagcgaccatattccacacaagcattcatgacccctagctgcatgacaacgatggtagcggtggcgattatattgcagtaaccgtggtgacttacactagcagcatatctccctcgttgtgcacttctccttacaccaaagccatgaggcatatgttagggttatgggtgaggtataccctctacccttcgatatgcgtcacatatcgatatggtatgcttgcgcgtatacggacgttttcggcataagttaaggaattacattatggagtccacagatgtaaggagtcctactcggatagaactgggtcgtcattgtatcatgtcgggtccgacgtctccgagtcctacttggagaccagttgacctgcggtataaaaggaaccccccgggaggaactaaggcatcgaatcttaccgccaacacatccaccacagcctacgaagccggagcttacaggaaccaagtcgccgggtgatctagtcgaatcaactcggctacgatctcgtcggtatcgtcgagttccattattccttttgtaatctgtggtttccatcatataatcccatatcaactggattagggctatgacctatcaaggggcctgaaccagtataatctttgttttctgcctgcttgatgtcgtattacgtagatcctcgtaccagcgtaccccaataccctctatatccggtctacgggtatcccccgtcgacagtggcgcgccaggtagggggacttggtgctcaaggttctactactatgacatctagcttcgtcgacaacagcgtcaacaccaacctcaaccaaggagttcctacttcaacaacactggtgtggactcaagtcggtgaaatcgtctttccggtttacaccacagtgctgatctcagctggtccgccaatggccgaaaatgagaacgcagtggctacaacccgggacgactccatgtcgaaggatcctcccgccgaagcagagatcggaacgtcgacgacatccgagcccgagaaggatcctagtgcggccaagccttgtctttccgacaggaatcacgagccgacgaggattacttccgaggtgacaaggtcctggtgtcctatccacaaaaccagaaaacacaccttgcaagcctgctgggtttttctcaacgtctatgctgaaattcgtgcatgcaaagagtgtggaattcagcgtacctctccaactcgtgatgtctattgtcctattcacaagacaaagaatcacgacctctcgagctgcaaggtctttctcagcgccatgaagatgccacctcctaaggtccagcagtcacgcatccccctcagggatgaggacaaggaacaaggagcgacgccgatttcagatcgatttgttggggtaatcgacatcgatccccacgaaccatcagtcttgcacctgctcgaagactatggttcatcgacaacgagtatgccgcgtgaggtattggctattgacgatgtcggcacgtcagcacgcaccaattcggaagcggagaatcaagtgactacaccggcccagcatatcagagccgtcaacgaaatattgagggaaactccctacgaccccgttctgaacaacgatctcgcacgatggacagaacggttacgggagtcagtgaccaacctcagcaacgcgttcgaagaggccgctgctgcagcacacccggaacagccaccaactggcgatgctaatggtgaaaatcctgaacaccgggaatcgcctcatcgagccacccctccacctcgcggcaccggtgatctccgcgatcacctgaatggccgccgagaggtgcgacgcacacgagacaacgagaaccattctcgacatcgcgtctcttcacggcgtcacgataacgaagatcgaggaggccgttcgagcgaagaccgaggccatgataaccgtcacaaccgccgcgatcacgacgatcgcgaacggagggtgctgggcgatactggtcgaggacgtcgccataatgacgacgatgatggagatcggcgccgagacaacaacgggcgacgacaacaagggtctctagaacccggccgacgtcctcgtaaccgcacgccggaaccgagcgacccatcgtcatcgtcgtcatcttcctcatcctcatcatcagatagacatccacgaaggacgtatgatcgccgacaacccaccgcccccagcgccgggtgtagagctttcggtcgttcacttcgagatgtccgatggcctgaaagattccgacctcgagcaatagagaaatacgatgggagcaccgacccagaagaattccttcaggtttactccacggtactctacgctgccggagcggacgacaacgcattggcgaattacttgccaactgcattgaaaggctctgcacgttcatggctgatgcatctcccccctactcgatttcttcgtgggcagacctgtggcagcaattcgtcaccaacttccaaggaacttacaagcgccacgcgatcgaagacgacctacatgcgttgacatagaacccgggtgaatccttgagggattatgttcgacactttaatgagtgcagaaatacaatccccgaaatcaccgacgcttctgtaattcgcgctttcaagtccggtgtcagagattgctatactactcaggagttggcaatgaggcacgtcacgactacttggagattattcgaaattgtcgatcgatgcgctcatgctgacgacgcactgagacgcaagaacgacaaaccgaagaccagaggagagaagaaaccagccaaggacgcacctgagtcaagtaagaagaaaaatcgcaagagtgggaaaaggaaggctcaagcggaagttctcgcaacagaatacgtggaccctcccaagcgcccagacccacaaggcagcgacgcgaagaaaatatggtgccctatacacaagtcagatagacactctctagaagattgcctcgtcttcaaaaagtcgctcgcaaaacacatggcattggaaaaaggcaagcgagtacgtgtggtcgagaaggacgctgaggcggttactcaggaatcagactcagcatatccagactccgatcagcatatccagactccgatctccatgtttcgcacatcttcggaggttccacggcatactcctcaaagcgagaatacaagaaggtggaacgtgaagtctgttcgatgtggcaggaggctgcgcccaagatgaagtggtccgaacagaagatagtattctcagaagaggaccaccccaagactgctatcatcccagggcgatatctgatcgtggtagaacccactattcggaatatcaaggtcgcacgagttctgatcgacggcggcagctcaatcaaccttctcttcgccagtgccttggacgcgatggggatcccacgaagcaagttgacacccaccgatcaacccttccatggaatcactcctcagtcatcgtccaaaccattgggcaaaattacgttgcctgtgactttcggccaagcaaataacttccgaacggaacagatcacctttgatgtcgctgaattcgatacagcatacaatgccatcattgggagaattgcacttgcgaagttcatggccgcatctcactacacgtatcaagtgctcaagatgccaggaccgaagggaacaatcactattctagggaatactaagctggcaatacaatgcgacaagcggagccttgacatggtcgagcacacgcccagcccacccgccacagctgagccacccaagaaagtgagcaaaacaaacaagacgccgaaaccggacggcgcaatcaagatcgttccactctccagtgccaaccccgacaagaccgtcaagatcggggcatcactaggcgagaaataggaactcgcgcttatcaccttcctccgcgacaaatgctgacgtgttcgcttggcagccgtccgacatgccgggggtacccagggaggtgattgagcacaaactcatggtgcgacccgatgccaagccagtaaagcaaaaactgcggagatttgcaccagatcgaaaacaagccatacaagaagaacttgacaaacttctcaaagccggttttatcagagaggtactccatccagagtggctagccaacccagtcatggtgtggaaggccaatgggaaatggataatgtgtgtcgatttcatcgacctcaacaaggcgtgtcccaaggatcacttccctcttcctcaaatagaccaactggtggactcaacagccggtttgtgagttgttgagctttctcgacgcttactccggttaccaccaaatcagcatggcgaaagaggacgacgagaagacagcattcatcacgccgttcggggtattctgctacgttaagatgccgttcggactaataaccgcaggaaacactttccagcgcacggtccaaggtgcacttagcgaccagctcgaaaacaatgtcgaagcctacgtcgatgacattgttgtcaagaccaagacaagcgactcattgattgacgatctgcgggaaacgttcgacaacctccgacaatatcgcctcatgctcaatccagagaagtgcacgttcggagtaccatcgggcaagctactcggcttcctcgtctctggcagaggaatagaagcaaatcccgggaagatcaaggcaatcgagaacatgaagtcgcctacaagactcaaggaagtacagaagctaatcggatgcatggcggcactaagcaggttcgtcgctaggatgggagaccgaggacaacctttcttcgctctgctgaaaaagcaagacaaatttgtatggacacaggaagccgaagaggcattcattgcactcaagcgctacctatcaaatccacctgtacttgttgccccccaacctaatgcagaattatttctctatattaccgccacgccatattccgttagcactgtcattgttgtcgagagagagaaggtgcaacgaccagtctactacgtcagcgaagctctccacgacgcaaagacaagatatccacagatccaaaaactgctctacgcggtaatcatgacatcaagaaagctacgccactacttccaagcccacagggtcacggtcgtatcctccttccctcttggtgaagtagtgagaaacaaagacgttgtcggccgcattgcaaaatgggtagtcgagctaagccagtttgatgtccgctttgtgccacgaacagccatcaagtcccagctgtacttgccgacttcgtagccgattggactatgcctgataacaggtcagataaccaaatccacaacgaaacgtggacaatggcgttcgacggcgcactcaatagccaaggagcaggggcaggattcatcttgacatcaccttcgagagatcaattcaagcatgcaattcacctcaacttcagggcgaccaataacacagccgagtacgaaggactactcgccgggataagagctacagctgcactcggagttaggcgactaattgtgaaaggggattccgaactagtcgcgaaccaggtgcataaagattacaagtgctctagccccgagttatccaagtatctcgcggaagtcaggaagctagaaaaaaggttcgatgggatcgaggtccgacatgtataccgtaaagacaacatcgaaccggatgatctagcacaacgtgcgtccagacgagagccacttgaacctgacacctttttggacatcctgacaaggccatcagtgaaagaggcaagcggcgaaggtagcccggtcgcccccaacatcagctcggggttacagaggcagaacacgccgttgccgatatcgagaccacagacgactggcgcaccccactcattaaattcataggcagtgaagagttgcccgaggacgacgcagaagccaagaaaatatcccgtaaagcaaaagtctactgtatgatcggcaacgatctatacaagaaggcaccaaacggggtactcctaaaatgcgtcttctccgacgacggcagacatctcctcctccacatatatgaagggatctgtgggtcacatgcagccgatcggacattagtcggaaaagcttttcgacaagggttcttctggccatccgccctcaaagacgcctgggacatggttcagcggtgtgaagcctatcaattccacagtaaacacacaaggctatcaccgcaagcactccagactatccctctcacttggccgttctcgtgctgggggctagatatactcgggccattcccacgaggacagggcggctacaggttcctattcgtggcgatcgacaaattcactaagcggattgaagcgacacccacgggggaaatcaaggccgacaatgccatcaaattcatcaaagggatattctgcagattcggattgccgcaccgtatcataacggacaacggctcccagttcatcagtgccgatttccaggattactgcattaggctgggagtcaagatctgcttcgcctcggtttctcaccctcagagcaatggacaagtcgagagggcaaacggcatagtactacaaggaatcaagacccgcgtctacgacaggctcatgtcacatgacaagaagtgggtcgaggaacttccatcagtactatgggtcgtgcgtaccacaccgacaacgtccaacaagtagacacccttcttccttatgtacggctcagaggccatgctccccaccgagctacgacatcacagtacacgagtacagaagtattccaatgaggatcaggaggagcagcgacacgacgatgtaaatctactcgaggaacatcgtgaatgaattgctgttcgagcagccagctaccaaaagggccttcgccgttaccacgagaaaagcatccgagcacgcacgctttcgatcggcgactacgtcctccgatgggttcaaagccaagcagggcgaaacaagctctcacccaaatgggaaggaccgtacacgatcacacaagttctgcggctaggtgcattcaaaattgcagacggcgatggtcgcgagttggcaaattcctggaacattgatcaattacgtaaattctatgtataagtcaatagtatccatacttgtaagacatcttacagcttcaataaagcctatttttcaggtccagaccacaatcaaagtgttccttcccgatgatcccttacccaaatgacacctagcgttgaaacctatcctcatgtccctttacgccgtcttgacaaggcctccgaggaacctaagggaacttcggctggggacgcccagagccgataaggccttgtcggatcctgttgagacgaaagaccatgtaagatctggtcgtgtaagagttctcgccgtgcgtattaaccaagccgtgtaaccggaaataaattttccaacttcacggctgggggctaggatcagtgctggttcaaccgaggcaggtcaaaggtccaaaagtcttatctcccgagaagaattctccgatgacaaggctgggggctagggagagtgtataacacaaacgactaattgaagtcgcgaagtgagaagacactcatacacgctaaatccagagtaagaaagcttagttagatagatttcttctctatttcacaagtacttcttacatttccatcaaaatccaaaattatattacactttttccctaagacatttgtcacaggacacggagactaccaggaaggccaacgccagtgattgactggaagaccttctccgccagcagcgccatcgacttcgctagaccatctatctccgtaggagttctccgagaacgagaaaacccttcgcggaggaactcgaggtgcagctgcggacgatgatctcgtatgcaagccaacacatgccccccggcatatcggcttgaccgacgacactcctgcttcaaggcttcgtcgatacgttgaccgatgccttcgagctgggtgcaggcgccattcagccacgagatatatccggccgccgattcctcaggatccccacggggtactcggaggtctctacagactctggacatggacgtgcagcaactctttagatatgagttgaaccacacctcacgaccccggagtgtctctacggcctgatccttcttcacttccagcatagtcctctcgagttccgcgacctcaaacttcatcctccaatactggatgcaacgatcctggtctgcgcagcatggaaacgattaagtcaagctgctcttctctcccgagaatacaacaaatcaagtcgacccagatggaagcgtaaaggaaatgataacaaagacaaccaacctaagggagtcgctgccatgctcgtttccacaggtgaattttgagctacatcgccctccggcgcatgcggctcgaacgcaagtaacggaacgaccactggcaactcaggctgcccgtgctgctggacatcctcgacatcaacatctctacaaacgacaacaaagtactcaagatcaaaatgctaaagaaagctaaggcgataactgcacacacaaaggcggttggaaccaataagagttttacaaagcatggctaaagagtacaagagagctaagatcctacgcttcaaatagcgggaggacggactcccccaggtcgccgacctcctccatcacatccttgctcgcatcgctagccgccccctgatccaagatcttccgcagatcgagttcaggatgtgccagcctcacacacgcaaggacatggcacaccccggtatagatcccgttgaacgtctcctctccgaccctggccgcgtgcttggaggggatcgcctccatcgccgttgccagttccgcaagcgaagacgtcaacgagaactcgtcgggattcgccgggatggtggccttgacgccacactccccggcgagctggtgcaggccggtgtaggtgacccacagtgagccacagatctccgacaagtggttctcaagctccgacatacggtgctcgagcccttgccgttgtcgctcattgccagccaccagctcccgcatcttctggaggtcctcgcgaacctccgctaaatcgcgcgccagccgatcggcgcgctcattcgccgacgatgccgccttcgcctccgcgatctcgcggccaataccgtgagcaccagcctcgaggaggcgccccatctcgacctggagctcctcccaggtgagaacggcagccagcagaccccgaccagccgcaagatcaatagctgggccgctaggtgtcgcctcgcggctcctgggcgcgaccacgacatccgtcgaggccatggcgtgtgacgcgctggaggtccctccagacccgtcttgcgccgccttcgcccgcgccgccctgcaaaaagccgcaactgaaacaggctacaaaaatttgatgaagagacaagacctcaaagtcatccacttacttctcgccaagcgtcattagccgctgccgtcgtggaggcgggggagacgcgtccgaggcctggagtacaaccgatatgatgtgaggtggaagttttccgactacacgatcaaagggcaggagaacttaccgagggggtgggcgtcttccgacggtgtccgaccacagaggagaatctcctcctctttttcggaacattgccgccactcgttgtggcagcggcagcggcagcgtcagacgcctccttggcgactttctccctcagcgacgccgccacctgatggtccacaagtggcccgatgatatcagtcagagggagagcctacgcttcatgaagtcataatgcgatcccggaagaaaaatgcaaaaggaccgctgagcacacttacattgatggtagcgtcgcgctcggctgcccctttctcgcaaggggggacggggacgttgctcgccgttgtcgggccactgatcatcagttagccgacgcggcgctccacggtggcgctgtccaagcctgtagatcgagaccagaatccgataagccgggaacaacacgcgcataagggagtcaatttaactaaaaaggaaaataccccgaggacaaacccgggtcgcgtcctctggctcagaataatcaaaggctggatgggctcgagcctgaagtggctggatccgcctaccgatgaagtcggcagcgacttcataccccgacaacccccgttctcggaggtcgtcaacgatatcgatgaaagattggagggatagggtcaaggcgggtttggtggcccaagtggaatcttgtctggttgctcctcaggaacaacgaagaccggatccgaatcctctatctgaagatagaaccacctcccccgccatttgctgcgagatgaggggaactggaaggggatgtgtcgcgacttcaggccatcccgaagtcggaaaccaacacacccggacacctttttaggttccatccagcgtaactcatagtaaaagaggaagaggtcaagaaacggctctaccccaatgtaggctccatccttcccgctttagtcgtatcacgcgacacgcctcacagccgttcgatcatgcctgtcgtcctgacgtacatccgcgtggtcgcgctctaatggctcaatgagaaggatcaacgtagtgcctgcctgccttttttttaatagatatgtatgtctttttcctcttcaaataaagttttctctcaaattacttatccgatctataatccgattataccattatgttcattacaattaaatcttcacaacaagatcttacatgattatattatgatgaaaaaatatttatatttataaattacttttattatatacataagttacttttatcatatatataagttacttttagatttgactaaattacttcttagacatataaaagtaaattcaataaagtctaaaagtaatttacatatattataaaagtaacttaaaacaaaacggaagtaactttgtcacgatattagaagtaaattcattataaggataaaaatatgattttatctagaaattaaatttaatcagtacagatcaacagaagtaagattaacatttttttttaaaagtaacttcaatgttaattggaagtaacttttgcatggttgagaagtaactctctttaatagatggagtggtagctggtctagacaagatgtaaaccagctaccactagctgtgtagccacgtccatcatttgacgatatttctctcacaaaaatagctagaaatggcatatgatggccttgtgtccagtggcaaaataatataggcacacatagggttcggactacaatctatttaatttctataactatattgatcaagtccaattcatttatacaagccgcctcagtccatttctttctcctactctaaaccacagcccatatcctccccccctcccccctctaaaaatttgactacccggttctcagcctattctcttctttatcgccagccaattcttctcagcctgtcccatctcactttctttctctcctagaaatagtctattttgcctccctcagccataaccctagtttgattcgcatccctcagacacaaaaccagatagatatcaagtctctctcaattatcaatatcagatcaatttacctccttcagtgattgagatgctagtttcgtccaatgtggcatatggactgggtgacgtggcaacaatgtggcatatacgcggcattattggtagaaaaataaaaaatcttagtgggacccatatgtcagcaacatgatctctactcctctatttcccaattggctctcggccaaatgaatcacaacaatgagacgaggaatggagaatgccaccggtccactaccactcaagggggagcaagcaggatggtctcgcggtagcggtggtggacgatgacactagatataggagtcaaaggcgaattgagagaaccagattcactagccgctctcagccaccggtcttgagatggccattcacttgttggccagtaacagtggtggtgcccagatctgccatctcctccgtgggtccttgcaacaagctctctcatcccattccctatttgtcactgcctactatccctgcaaccgttgtgccagtggctacttccaatcccccatcaatgaagagaatatcaccgctgctgcttcatagaggacaatgcggacttggatcttgattgccacaatgatggaaaggctctgcccctcttcctcctttcctccaaagccgggagatagagatatggtggtggattacctctctttccctaagcatggcggcgttgatttgctttttacgatggagttggagctcactcgaacagtccctcgatgctttgtgaacgcctgaacggggaatggtccgggcggataggctctccttgatgcggcccaatactactagagcggcaattggtggcaaggagaacgactttgcttcgaaagtgggcctcaacccttgggggagaggcgagtagcgtagtggccactgccaggcatcaaggtcctcgtcttcccaatggaaactcggcgctgcacgcctctgttgtgcgtccctctgacttcgccacctgcactgtgagtacatcagctttcgctgccattgaccattgcctaccaagaggcgttgctgtacacccgcccaccatgagatagtggggaagaagatcaagggaaggtgtcactaggtgtaggtctcaactctttatatgtttttttaaggtcataatgctacatagatgccatgttgaccaaaaccaccatacaatccactaaaagcaagtttaatagtttacactagttttgatagtttattgagtctctgtatacaatccactagaagtaagtttaatagtttacattgtgttaatgcaaaaatttgataagattctttagtgaattcagttaagaaaagattacaatcagccgatgaaaagcttatctagaagagaacgggttcgagaaggagtcacgaagaccatggcatgcatggcagcttgagtttatctatttattaggcacgtttcgtatttaggaaatgttgtgtcatgtccgatcaagacttatgttttttttctttttatctttagaaagtttgtgtcgtgtccgattaggactcttatcggcctatgggtataaatatgtacatgcaaggtcccctgtaatttatctccacaaatcaatacaattactttcggcacatcgtcaccctcttttctgaggtttttacttatcaccggcagaacttggtacctgacacgaggctacatcggcttcgatctccggcgaaggagtaagtccttagttccatcagccctagcaattgtattggctacattggcattgttcaaggctgcatcgcttcgtcctcttaaattgctcttgtttggttaatatatttcctacctaacatcgcattgtgtttagagatggatcggtttagttgtgactatctcggttagatctgatcttttgccttagccgatatatctctacaaccacaatgttgttttaaataaatttattatatccatcacattagacagatttctcggcttattgagtattatattattattatatataatctggtgctgcatcggctaggttcgatctactagactgttgataatctaaatcttgttaagtcgataggttcatactaatgtttcataagagtgttagccgacgagtcatatgttgaagtattgcatcggcttataaggattatatacaagttaatctagccgatcgcagcaaagcttcattaattacttaattatttggattcagtgacattggatttccagccgatataggctttaaccatcagatcaacatttattctatcatatcagctgattggatcattggatatttatttcattacattattatcacccaattgcctttatatcattatttatccaagtatcagaatctagatcggacatatagccgattgttaaaaaccctatcgacattagctagtatcactacatcggtttaatagccgatcggctctttgatcatccatttatatatcttgttagttgtaggatcaagctgactgacacgcccgctaagcagatctcccaggcattcgtgttgtttttcacgtcaatacactagttttggtttcgatggtttactgagtctctgtagttattaggactagaccggaccgacggttcaattggaaaaaccagttccattggtccggtccccttaaaaaccggaaccaaggcctccatcggtctggtccccttaaaagatcgggcatgcaatcggaccggatataaccagttaatggactgagtcaacagcccaactagttgcccacaatgcaggctcaccaaaaatcccaagaaaaagtgtggagatcatgggattgagagcatcacgtgctagccatgccaccaccgtcatacttgatgaggacgtaactagctcagatataaccatgactaccgtatgtattaatcaaccaaatgtgcatatgttctacattagatttgcttgttatatatttgaacaaacgttgctacacaatgagttttgtgtgttttcgtttgcagaggtacttgcttggacgaaggaaaagagggcgagcataatgaatgcatggatgatcaaagaagttgattagggaccaaaccaagaccttctccaagtatacttctaccacaccacgtcacttttggtccatagaagacaagagataaagttctacacgttttggattcggattcgggcctcctgacagcatcaacttcaaacagacctagccgctgatctagaaggaatttcggggcccatgagtacttgttggaaagcatatgaagtatactttcagatggttttcgtcccacgtcaaaattcctaccgagctgccagaaatctgcaaaacaagccatgcacctcatctagtccgaatctgatttgggttttgggccttgtaattgtgtcgtgggcttagcccaagggggtgtgtgccctagggcaaccctaggacgtccctaatcatacttaatcaatagccgtcatcgtttagagtcgggttttgcttagattattctgttaagaacagtttcgccgctagatcggtttgtagaaccccaaattcgagtgtttaatcattcatatgcaattgtgttgcaatctatcttgttcttgtctgtgttcttcgattcgcatgcaaggattagccttctcggggaggtcaaccgggtttcggcacggttgataacaagaggaaacgtggtgctgcgattgcggggctcagtagcgtgttcattcagaagccggatcgagttgtgtcgcgactccgcccaaatcgactgtttatcaatacctatcggaagatcgggacctacatccctcatcagttaaaaatatctcaaatctacaaccaccaaaatacctaataatctgataattgaggaagcggcacggaagaatttgccgtgaggtggaggtggcagtcggccttgaggt

SEQ ID NO: 42714 - DNA, 3945 bp, Oryza sativa
aattgtgtcgtgggcgtagcccaaggacatccctaatcatacttaatcagtagccgtcattgtttagagtcgggttttgcttagattattctgtcaagaatagtttcgccgctagatcggtttgtagaaccctaaattcgagtgcttaatcattcatatgcaattgtgttgcaatctatcttgttcttgcttgtgtttttcgattcgcatgcagggattagccttctcggcgaggtcaaccgggtttcggcacagttggtaaccagaggagacgtggtgctgcgattgcggggctcagtagcgtgttcgttcagaagccggatcgagttgtgtcgcgactccgcccaaatcgactatttatcaatacccgtctgaaagtagaccccataagctttccatcaagtactcatgggccctgaaattccttctagatcagcggctaggttcgtttgaagttgatgctgtcaggaggtccaaatccaaatccaaaacgtgtacaacttgatctcttgtcttctatgggccaaaagtgacatggtgaggtagaagtatacttggagaaggtcttggtttggtccccaatcaacctctttgatcatccatgcattcgtgatgctcgccctcttttccttcgtccaagcaagtacctctgcaaacgaacacacacaaaactcattgtgttgccgccactctgaccctgccccccgctattgatggttgttatgtaccagtttcgaccaccaactagcacaattaataaaaggaaaattagcatttcttacacgcataccaataataaataatgtagttatattaggattggagaactaatgttgatgcaagaattatacaccaaagtgaaggagaaatgaaatagacatgcaatttaataattaactagagttggattgtgatgactacatccatttcaaattacttgtcgtttcagatttgtcgaaagtcagttaaatatttttattctttataacctttttctataaattcatatagtttagtaacatgtgaatgatatataccgaagtatatttctcatgatgaatctaaaaatataaatctcatgattttaaaatttatgaatttctatagattaaattaactaggaagtaagtccgtgtagatgcaccgacaatttatttattgtttatataaagaatattaaagaaggcatatctcaccaaattcacatattcactataaggacaatagattaccttataatcataaaagaaagtatttatatcgtaaaaaagaaaaccataaactttgatatattgttccggttatatgcaaattcgtatatcatcatccttcggaaacatatgatttaatatatatttttttttgagttttttctcttttgttatgtagcttattcacttgtgttgtgcatgttcatgggtaatatatgatagaataatctatatcatcaaaattatttagctagctgcatgctcattgattgaaacttcatggagtgaaataactaataaaaaaggattagaaggagcaagtaactgaagattttttgaaaggaatcagcaagagaactagggtgctagctaatttattgaatatatagtggtaagtaactaaagatggatgtgaagtctatgacatagttgcatctgcctctgcacctagggatcaggaagagaccaggaacaacattgtgtgcaagaagctagcgtatagcgatcaagcacgtattgctagcttgctgcttcatcttcctctctgtaggtgcaggtgcaaatgcagctctatcacacatcacttgctatatatatgtagcacactaacactaatatatatgcagtgttcacttggcttcttggcttacatgaacaatgcacattctacatcttatatagccttctgcctctgcaaagtgtcactgatgtaatgaaagtgtcacctgcataattgtgcaccaacgcacatggcacatcgccacggttcacatgggacttgcacggcaggccaatggcacggcgacacgtgccggtttacacgtggatcagttagctagcaacaatgttggatatattgctagctgctgcagtacatgtcacatgtagatgtagccaaaagcttcgttctgtcggatttggccggccgttcaacggcagctaaagatttgcgtatcaaagctgctttctcgtccaagaccgggacagttctgtgaggcgtgtgggtgtagatgaacagctcggattttattcgtttttactttggatatgaaaggaactattgtcgatgggttttggatttgactgttcaacattctgtacgtgtggcagcaacactgctagctagctagcagcttctaagagaaaccatctgtagtgcacgtgggaaaatatctactacctctgtcccatattacctgtcgtattgaatttttgttggtaatgtttgatcattcatcttatttaaaaagttttgaaattattatttattttgtttgtgacttactttattatcaaaaagtactttaagtatgacttattattttttttatatttgtactagtttttcaaaacgaatagtcaaacgtgtaccctgctttaatacagcacgtagcacaattaccatctgatccaattggagacctacttagcctcatagcattatagtcctgactggtatatcatcagaagtgtatgcaattaagcaagaaaaaacatatatttgcttacatatacaacttgttagctatccttgttggagtgtgaagtgaattgtctgattattcttatcagcataagctttcggtttaaactagtcggtgcatgcaactcaatatgttattagggccagagatcttgattttgaaacctgactgacgtgtaattaaataaataatttgcagcccacttccgttttatgcttgaggaggcctcccatgacggggagtattagaatatgaagtgaataactcttcttttttctgacagttattaagtccaaacaaaggtctactagttagcaatattttctaacaacagttgaggacagcatgcagaaagataggtgcatgaagtgaacatataaataaactctcaataatctctaaggagaaaaataagttatatgtccataattatcatacatgtactctcttcattctcaaataattatcactgtatgtactatggctgtcttaagtttgaccactatctaaaaatgactataattttatgagtaaaaggaatattattaaatttagagagaatcaacccaattaacgatctgccattaatattgtctctttctataatatatcgacgagtttatcgattattcttcaaaagccattggattgggtctttttttcacccaaaatatccttaaagatatagaaggttaataattgatttatcccattaaaagtttaaaacaaatatgaaatttttatgtagcctccttatacagcattgaagttttataagtttgaagttgtttcttttggtattttatttttttagggagagttatatatatatagtcgaccaaattgctacacgttacaaatatttgatgtttaaatcatcatataccatctattttgttttaaaactaatttgggaaactattgaggtcgaacatttactttttaactaaattttactgtaaatgtcaaatatttatgatcagagtagtaattaattctgtagctaacgatggttgtaaaacatttatgggcttatcgctatgcatttgcctaaggtaatattttctatctggctttaggtgccggttgtcaaccccacatgggtctcgaatttggcaaccggcacctttgagaatactaagaatgcaaaaaaaaaaaaagaaagaccagctacgatcgcatccaccccgcttcaccaaaaaaaaatcaaccactctttgcccctaaaatcaaccacaatcatcgcaaag

SEQ ID NO: 42715 - DNA, 31119 bp, Oryza sativa
  unsure (1)..(31119): unsure at all n locations
agctcggttttttggtgtcggtttttatacaaaccgacacgtataatattataggcgtcaattaattaaaacaatcacatataatatattatatgtgctcctatagtatatgtgtcagtttttctctaaaaccgcacctataattagttaaaggtgccggttttttatattttcaatctatgaaggtaggaaaattacaataggtatcgattttaccagttccaacacctatagttacatgttccaatacctataatgccgacctgaatgtgtcttttttttactagtgcgttctatgtaatccgcttcctttcccctaaaaataagtactattccgcatcctgacgttaagccctcgctgaccacatatggctgattacacgtggggcaatagtctttggctaatctttggcacggagcaaaagttccacagatattttggaacatatcttttgaacatcactgcaatacgattgcattaagggatgaaagcggccagaaaaccacctgtgtcatttttgtttcctttttctttttgaaattttgcattaagggatgaaaacggccagaaaaccacctgtgtcatttttgtttcctttttttttaaattaggcccggtttaattcccctgcaaaaacttttcaccatgtcgcatcaaatgtttgacacatgcatggtctattaaatatataaaaaagaaaaactaattacacaaattacatgtaaattgcaagacaatttttttgcgttatgatttgacaatttggtgctacagtaaacatttgctaatgacatattaattagacttaataaattcgcctcgcagtttacaggcgaaatctataatttattttattattagactacgtttaatacttcaaatgtgtatccgtatattcgatgtgacatgtcaaaactttttacccctaaaactaaacagggccttgatcaaaatgaaaattcccggatacggaaacgacacttataaggcacgtcgtctagaaccatgcgatatgatccgcatgattttgtttccttcatttacatataattcaatcaaatacgtaaacacacatacccagcgcacattaatactacgagcgtatatgaaaatgtggtctaccattctattactttttagaaagagtaatcttccgtggtacatccatcgatctacatcatgccgatgagatgttatttcaccacaaatcagatagaagtaataaagtgcacaaaaggacaactgagaacattttaggaccccagccctcttgcaccgaattattcttgcactagcctgattgtctaagtttcatactttgcttttattgtatgactcacgcttattcacagaaattatgtttcactcattgacctacaaaagaacagatactatcagaagtgctattcaaagtggagaaaagaaacgaaggtggaaaaaatattcttaccattatgtttgccatccctgaattgtgcattcttggatgacttgaatgtttccaggaaatctttacccttttgtagttcaagcttctgccttgccttgtcccacttgcgttccagagctaaaatctcgatgatccgaggcaatgctctcccagcagcatctgtgtcaagaaatgcaagacggcatctccttgcaatgaagtccacagcagattcacagtactcgtggcgagcacagtatgctacttcagcctccaaaaatgggtatccatgagcaagtcgcttccccaagccttcattctaaacaaaatgaagcataatgattaccacaaaacattattaagttgtacagggaaaaaaaaaaggtttccgggcagaataatgaagcttggatttctgatgaaccaaattgatagatcgcatattgaaaagaaatgtcatgctagattaacgtgaccaaaaccatgtgttgctgccgcaggttacttaaatgacagaagttactacaatagtagccatgctagattcagcagggataatcaaatagctaaacaactcaattgacgatgcatagcccataaaggttagaccagcagagttaaaaaaaaaaaagggccagcgaaaacaaagtacaaggctacaaactccataagtagcgcaaggcacatggtgcaaaacagaagaaaaactaaagcgtaagaaatactaggcacatattaaacatgcataataaatcacttaaagcacatcacagttagttcccgcaaaaaaaaacacataacagttagaattcagctaaacaattagttcagaaaattccaacatgaaaacaaaaggtaagtaggtatacttaggctgtgttcgatactagatattgggaactagtgtacagtgcacgcaaaacgaagcgactcattagcgcataattaatttaaaaacgcaccgtttaacagtttgagaagcgtgcgcgcggaaaacaagggggagttgggaacatggaggaacgaacgcagccttagtccatccttaaaatattgggagttcaacataagtgcattttatagtcaattatgcattaccacatctaatccaatggaaggattttttcttcgacaaatcggtagtgggtgcaaagaatgacaatgttgttcatagacagaagagtgtatggagccatggatattattactatataggagaatcatgaagactaaacatcgtcataaaagaacgcattagaactggaccttttccccttctatttctctacatcaaaagtttctctacatcactatgccatgtctgatcctcactagcagcattaggggacatttacacgtgtcacaaattgagctcttatatgctgccaactattgtcatcggaatacaagggagcactgctgcaaactttccatgtactttactgttaaaacttacagtttcataagtaacctactttgtagtataaggagcacgaacctgggcaattgaagccacttgtgtagccaaagttccatatgcatgtgacagatgcttcgatacagcactgtccattgcacctggaatgatcttcccaccatatgtccttttcatccgtttatagttctgtgcaaggacagtaaacgaagcaggatcccaaccatatccaccaagaatatgcagatgatcagtcacacagccattggcaggcttcaaattacctgaccttatggctgcattaacagcatcttcagccatgctggagataaggcaaattattagaatccaattatgaagaatatatattcaatacttcatgtgcatgcatgcccatgcattcatgtaactacaatcccagatttacaaatattttctgtaggtaatatgaatataatagcagtacatcacaaatgcaataagtgatggtctataactagaaatacaatgtacttatgtgttcaatcacagttcaaatacaatgtattacatctcgaattcatgacatagtgatagtccaagagcatatagggtccgtttggcatagcgctagctccagctccacctctcctagagaggtagcccaaccaaacagtttcagctccacccaaaaaagaagtggagctggttggagtgctcttactaaatgaaatagagttgtggagctgggtttaggcagctcacaactccactccagacccaactcatggagttaaatttagaagttggagccctaccaaacgggcccatagccagagtagaaaacctagctttgcacatgtcatatcagtttcattcaatcaattagagataaaacactagctcctagaacaccataccttctataagttgtccattttccaccagtgatagttattagtcctgggtagtcttcaaatacaacatgatctctggaaatgctctcagtattttttgccgatggatccatagccagtggacgtataccactccaggcagaaagaacatctgaacgccttacctaatatggagattgaaattattccaaccattaaatatttccgttatttttcattctcgattgacagaaactgttttattaatggaatcataacaaagtggaaagttgctagtacaattctgagtgtgaaacctatgatggcaagttatcaaaaaccaatatgactagcccaaaagtattaccacagaatagaatacgaagggatcataaccacactggaacaaatgcacagaaaaataactgtactctaaacttgtagttgcagaacaaggactaagtctatctaagattgccacccatgcacacatgagcatcccatggacccatcaaatacaaggtcatgatgtgctactaaaagttctctttcatctcacatatgtagcaaccaaatggttctagaaaacatgaaaaacactatatttcagaaagaaaaactttactattttttttcgacagcgtcaaataaattactgtacattacataaatgcaaccacacaaacctgaacgttaagataatcacagatagcatctaatatgaactgtatctcatcctcatgtggttcaggaagcattgttattgctgtactagagtcggttgtaccagctactgtccttcctaaccatggcagcataaatacaactctaccatccttggttttagggacaattagccccatcccatcaggggaataataatcaggaagtacaatgtgcactccactgcttggactgatcatgggcactacgtcattgttagccatcttcctcacagagtcacagaacggtcctgctgcgttaacaaccacctttgcaaatgcatcgaattctttacctgttataaattagcaaatatgaaatagcaatggaagattgaaatcattgctaactaaataatcaaccgcgacacagatgataatgctagtttcaggaaaaaaattattatgagaacatagttgatcatcaatcaacttaacatagtatgtttcagcacatacttgtgctagcaggctacttcatgctgtataccaaactatagtctttcttctaaaccataagagttatagtggcacaatattcacagaccaaccgctcttatcatttaataggagaaaatgtacttcagcaatcggtagtttatactttatagtgtaagttatttagtctgctccaagcataggtactcagattaacagcatgctaccagaactgaatgtttttccttgttttcactgcccaaaagttccttcctcccagagttgctgccagcctactgttcctttctttttatttttgctaagctttgtaatacttcccatatccaagacttttcatacttgacagagatactcagcccaaattggcatatggctttggaatgctagtatagtcactcaagctcagtgaccacgcctccctctggtagagattggactgtcagtttcccgctagaaaagctatgccatcgatcaccaccatcaggaaatgtctgcatatgagttacgcatctgactgcagcatctacacataattccacatttccaccaccacaaatatattacagtagtctacagacactaaatgaggggtgaaaaacacatggcaagccacatgcctgcattcctgcagctctttaactgcatatcctaaacaacatgcttgtaatttcttcagttcaaaggaaactatgaatttttggtgtcggctgtactgtatgacaatatgtaaagcagggctatttgctgtttgaaatgtattagcttaaaaaaaaggtagaaagagacattgcataaaggtatgctgaagtaaaaaatacatgatcattagaaaggtatgaattacacattctaatgtgcctccactgtataaaggaagagaaagacatactttattctacctgatagcgtatcacggatccgtgcaccaataatcctttctccagattcatccttaatgagggataccacttcagcataattaagaatagctgcaccaacaaccgctgcagtgcatgccaagcccacattcagccgactgtcattcatttgaccgtcatagtataccactgtccctcttaggctacgatcatggctgttttttgcaagggttgggaaaagttcaactgattcatctacagaataatatcgtgacaaatgtagcagccttcttccagcaacgatatcatagaatttcaggccgaaccaatagtatacaacctcaaaccaattaaagcaaggagtcatgcatggcaaagcatggcataagtggggagcattttcaataacctgctttctttctttcaaagcatgaaaaacgagtttcagctgcccataatcaagattgaatactgccttctccaaatagcgcacacctgtaaaaaagtattcaatataagcgaggaatagtggaatttacattatcaaatattaaccacctaaaaatgtacaaatctatatctttctgaaactggagacattcctagtgtattagttatgtttttatgtgtttagaacaaacaaaattttcacctctcaagttgcaaaatgttaccaagtctatatgcatagttcattacatccaccatcagtggcgtatccaccattggggcttcttggggctcgagccccagctccatggttgtggcacttcggtcagggttgggaataaaaacgttgctgcctactgcctcactgcatctttgttgtcaaggcctctacgacgtattccagcttgactggacaaatattaatttatctgttgtagtctgtaaacgtgagcctctttattggtaaattaggtttggaaatctttcagtgtattgatgcatcattcatatcaaattctatttgtttgccagattttagtggacatatctgcacattaaagcggagaagcaaagttaacatgtacttttccaaataatgaacgatgagctagagttattttattttatatgataccctctttctatttatttgttaattttacgatttgattagcaaaatgtgtcatgtatgtatatttggcttacttgattctatatgcaagttttatacatataggaccccctctattttcattctagattcaccactgtccaccataatatatcacttccagaaaatatatctctatttgaaaaatccatgacccatccaacaatgtagagttcagagaggttcagtaaatagatcacattagtgcatgaggaaacaacagtaaacatatttgccacaatgtattcctgttattggtatactagaagagcaataagcaattaagcatagccacatataggtcctgttctgagccttatctgaataagtgctaagaagtgtttaatgctttactaggataaacttttcccctattaatcatgtacaagcatcatgtaagtttattgcagccaaagagtgaaaatatgtatggctttctactgaacagacagcaacctgtagtttttttttctgtttttttggaacttttttctgtttttttggaagaggccgcttaattagtgctgctacaataatattcagtcgcaccttctccaaaaaaaaaaaaacaaattctatgctaatacttttaattgaaacaaataagcatatgactatataggtataatgtgagatgccacaataacaaactagaggaatctacttgcaaacgaatctggattgggggaagccacgcaccgccatggatgagtttggtggatcgggaggatgtcccagaggagaagtcctcgcgctccacgaggccgacgcggagcccgcgggttgcggcatcgagcgcgacgccgcacccggtggccccgccgccgacgacgagcacgtcgaggggatccgcgggggtggacccggccagcgccgccctctgcgcggcgcgtggcggcggggccgcgcccggctgggccacgcgccgccgcgcggcctcgagggccgcgggggacgggtcggaagcggacgcggacggccaggccgcgcccgcggcgacgacggcggaggacgcggcgatggcggcggccgcgcggcggaggcgccacgtggccatggcggcgggcggacgcgtgtgcctccctacctctcctttgttcggcgagggcgctgggagttgggagatcgcgagtttcacagctcacacgggcggcggaacgcgtagagaaagcggcctctgatttcttttctttttcttttctggagatactaaaaaattgttacggagtattatataagcgaatcggggaggaattccggcggagaaaataggggaacaagttccgtgatttttttctctttcttttctgaagataataaataatgagagaatagctactatagtccctaaagtttctctgtaggatcaatttagtccctaaccttttaaatggtccaaagaaatccttaacctttatcataaggcctagaatagtccttgggtccacaaaaatcgttatatggatatgccatgtcatcattcatgcaaaatctataatgaattgtccaatttacctttacgtatatcatagaaaaataaatataagggtgaattagacataaccataggaaaaaatacttcttttttttcaccattttgaggtatatttttgctcttgcatatactatatatttttttaactttttccttttgtttttttattttcctacgcgtaagggtaaattggacaaaccatatagattttgcataggaaggtgacatggcatgtccatgtggcgattttggtgggaccaataactatattagcccacataacaaatttaaaagacttgtttggacaatacgaaagattaatgactaaaatgacccaggagcgaaactttagggaccatattagctattctcccataaataattataggtgaatcgtttaaacatgaggaattcgagcggagaaaataggggagcaagagcatatcagttattctatttcctacgaaaaactgattttgagggtttttattgagaaaatcggatcctaacatatcccaaaagccctgtactattttagagttcccattccccatatattttggaaataagttcatctgaggtctcttaattttatactgaatctgattttcgtccttaagcacctaaaaccagatataatcgatccctaaactgtcaaaaccaatgcaaacgaggtccctcggtggttttagctgacgtgccaactacgtggctggtttgactagctctttgtcccacgtagcattgacgtggcgcttacgtggcaattatatctcgaagaaataataaaaactatgggcccaccagtcagctatacacgaaaaataatttaaaaatgatggggccacatgggcccacatgctagctacaaaaaaaataaaaagatggggcccatatgtcaatacatcctctccttccctgtctctatgtttctctcccttcctctcagcttcgacgacgcatttttcttggcatcggcggcacgggagcaggcactgcggatggcggtgactggtggtggcgtggaggaggacgccgccacgccgcttctaccgcccccgacgccacctcgctcggcgttaccggctccgacatgtccacgaagccgaagcagttagaggacccgtcgtacgacgactagtatggtgagagcaggggctcaggcttcacctccacgacacacgcagtcggagagccacccgcaagagaacgcaacctgcatcgcgcagaacaccaccatgtcgtcggtgtcggtgtcgcggaacggcagtgaatccctccgtccccacatagggaatggcaccaaagtagttgactactccctccgtctcaaaaattgacaactaaaccatgccttatatttggggagtagagcaaagttgttgactactccctccgtctcaaatataagcaaatataagcagtgaaagggagtagtatggctgtgtttagttcagcgcaaagtttggattttggttgaaattggagatgatgtgactgaaaaattgtgtgtatgacaggttgatgtgatggaaaaggactgaagtttggatccaaactttggatttaaacacgacctatatatgaatcatgcagtcttgctacgtaggaaaatgcctggtttagttatcaactttttctccaaactttctaattttttatcacattcaaattttcctacatacacaaacttctaacttttccatcgcatcgtcctaattccaatcaaacttttaattttagcgcgaagtaaacacacccaaaatcactcaaaatgtggaatctttagcccggtcttcgaggtggtacagccgtgcaatcaaatcgttcacggtctcactgtctccactgtccagcacgcaaagcgcagccccaggcgatgacgagaacaggccagtcctgtcttgtcgccagagacggtgacgcgatcacggtctccgcctctccggcgaccgtgacaggcccaaaaccttcacttgctcccgtcccagttgtatgattcaaaattagaaaaagtatacggaaggtcctgagcttgttatcgagtaaaaaaaaaaacatccttaaaccataaaaccatatatccagcgtcccttaactaatcaaaaccggttacaataggtcggggagaggtggacgccgccctcaccgcgtcgtttccccatccgccacgctgtgccgcttccccatccgtcactccgctgcgcggcaccgcccatccgctcctgcttggccgcacggtgtctcctcgccctcaacctccaagaacaatgccctctccttcaagctcgtctcctaaactgctggcctctacccgtctcctcaaccgctggccgctacccgtctcctcctccccgtgcctccgccgccgcccaactccaagggccctcgcacggtcccactagcgtcgcggccctcgcacggtcgcgtcgcgaagctccgccgggctgccgccaccaccggccgccgtggcggcgccgtcctcctcctctcctgcctcaccccgctgaccggcctacagatagagagagagaggaggaaccgaggaagagaagaggggggagagatgactcagcctgacatgtgggtcccacgtggtcccacgctgactcagccgtcacgtaggacaaaatctgggtcaaaaccatcgaaggacctattttgaccgggtttgattagttaagggacaccgaatatctggttttgcagtttgggtttggggacgattttgtaactcgatgacaagttgagggacctttggtgtactttttccttcaaaattttgtcttagaaaaactgtggttctacgacatactccctccgtccaaaaaatcctaacctagaacaagatatgacccctcataatataacgaatctggacaatttatcgagattcgttatactaggaggtgtcacatcctctcctaagttggattgtttggatagtgggtaagagatacacatacaccgtaggattgagaagggaaattgcaaggttatcttatcctcctagcgaggagggtgggttatgctgggaaatgccagcgatgaagtggtgtggctgcgaagcgcgacggcacgaaggaagagatcgcggtagaagagggatgcatggggtggacagacgagcgtggggacataatcgagccactttctcgtgcgtggcggcttcgcgtgcgtggcagtaggggtgaaaatggtacggaaactttctggattcgggcttattttcgaaacggaatatgttggtcggaatttttttctggaatttttcggaaacggaaacggattcggaaatattttctcggaaacggaataaaaaaatgataagggtagtttccgtcggaactcggaatcggtctgaaacattctggaaattttctcggaatttccagaaatcacaaaataccatgtattcttttttttaagtactgaatagttaataccatggtgcttggctgttatttttataaaaaaaattgttatgcaaataaaaaatacttaagaatatttttttcctgcattgggatttatcaacagcattactaatttattccgtagattgtgttttgtgatgtactgttgatacttttttttacgagggatgtactgttgatacttaacaattggacttatatgattatgttttatgatgaattgttcaccattgagacttgagaatcaggttatcagtttgagggttttttttattccgataaattttcgttaccatattcacgccggttcattttcgctccgttttcggttttgataatatttgattccattttcatatccggccggggttttcgattccgattttgattcgaaaaaaaatataaaaataaaaatgataaagatgatttccgtccgtttccgtaccgtttatagtttacacccctacgtggcagcatgggtcagcgcggtggagcggtggcggctgcatcatatccccgcgagcaggaggccacgacgtcctccgtcgtttccttcgccagagatgcggcagggcgcattcccctcgcgtcgccgcctagcgcatcggcttggagagggccggcatctcttccacacctgatgcggtgcatgcctggcgcattcggcttggagaaggccgacatctcttccacaaggataagcagcggtcaccgagcttggccaacgcatccacctacgaaagggaatggacgagaagacactggtggttggattgagcggaggaggatgaaaagtttacctctgtgatgttttgatgctaagggtctgtttagttggtgaaataaaaaattttggtgtcatatcggatgtttgaccggatgtcggaactcggaaggggttttcggacacgaatgaaaaaattaatttcataactcgcctagaaactgcgagacgaatcttttgagcctaatcaatctgtcattagcacatatgggttactgtagcacttatagctaatcatgatctaattagctcaaaagattcatttcgcgatttacatacaaactgtgcaattagttttttattttatctatatataatgctccatatatgtgtccaaaagattcgatacgatgtttttggaactaaacaggacctaactaaaagtattaaacataagctaattataaaactaattgcagaagcctaggactaatccttgaaatgaatctattaaaattaattaatctagctacgattaacacatgtttatagtagcatcatatgggcaagtcaagaactaattaagtttaatagattcgtctcataaattagtctaagaattacataattagttttattattattagtctacacttatgatacttttaattagcatgatagacaaatttagacccggcagataaaaaaaaaacgcaccatatttttttccccatctagtacaagcgtgaggtgtgtgtgctttttttctctcatgggacccacctaacttaaacccataccgaactgagccaaacatgggattggagtagttatatttatgacactatatttttttgaaaatagtcagcatgtattcacattgtaaatttctaaactttagtgtatttaggacgtagtatatataatttaagtgtaatagttagggcatgttcactttgttgccaaaaaaaacttaccaaattttgacattgccaaaattttggcaacttgccaaaattttggcaggatttcttatatagctaccaaaatttggcagcaaactaaatgtagccacttttttagcaactttatcaaaatttggtaaggttaaaaatgacatcaaagtgaacaggcgcttattacataggagtaactcctaaaccaattaaatggccatacatgcatgttgggcaatgttcagtgggcgtggcgcatatataggagaactacgttagcacacgaatctagacggaaattaagggcaagtacaaaggtagatggtctctacgttaattaaagactatcacgttacaattgttaagacaatacagtctctaaccattaatgtaccaaaatactttcttactagttatctttcctttattagactcaatgcaacaaaaaatttcctaataaatgctaagagtcgactatacgctgttgtcatgcgtagcaaccatctttctcttttcttcttcccctctcttccacgtcaccaaatatacttgcatgataataaagaaagaccgctaataaagaccgttgtacatgccctaaaagaaaaaaaaatcgactgtaatctagtgataattatgtcgctagatttatagcaaatccgttttttcatctctaacctaaacccagcatatcatatcccagattcccagtacatttccttatcccaagctatccaaacgccaccgcaaagatttcagacggcaaatcatgaaacagctacgtaatgcaacatacaacaacccgaatcgcatgacggtcgacattcatttaagttcaaggttccaaccactaatccaagcagtaaacagtacgatcaacacaaaggcgatagccaaatttatatggcaaaaagataaaagccccgtccaaccacaaaggacacgacatcatcatgcgccgtcgcagttgcaggtgtagagcctccggccgacctccctggacgcgaacgcgtcggcgcaggcgtacttgaactggtcctcggagaggttgcgcttgtcccaggcgctgactcgcacgtggtgcggcttgtccatctgcacgcccatcacctcccgcaccagcgcccgcagccccgcgcggcggaggtcgggcctcccgagcgtgtcggcggcgagggcgcgcaggtccacggcgcgcggcacctccagcccgtacccgacccgcagcctggcggcgtcgtcgcggaccccgacgccgacgaaggtgaacctgggatcggcgaggaagcgggacagcgcgtcgggcacgtagtcggcgtggaggatctggaagacgaggcagcggcggtcgacgcagagttgcagcacggcgacggggcccggcacgggggcggcggggcgccactccacgtcgaggccgacgacgagcgggtggccgcagctgcggtggatgcggtacgtctcgcccagccaagactccaccttgccgccggacttggtgagcgttgcgtcgaaaaagtcctcgtcgaacgacaacaggtaggtgccactgccatcgtcgtagtatgcttcaatctcggtcgccatctcgctcgggtgcttgctctatatgcctctctcagcgttggggtaataagaacaggcgtagaagacggagagtcggagctcgggcccnncaaggggagcgatnnangngngnnnnnnnaannnnnnnggggggggggggggagtgaatggatggctcggattcagtctggagcgttcccgtgtgcatcgacgaccaggatcgtgaccaagcgaagatatttgtatgagaactgagatcgtggggtatgacctcagcaagcaggaccctacttggcagtcagaggccagcagtttccgaaccgtcttgtcgaaggctcatctgacatctgtcgtcggtactctggagtctggactgcggccctggtttcaactttttttttttcaaagtttcaacttttctgtcacattaaatattaaatagttggacacatgtatgccgcattaaatatggatgaaaaaaaattaattgcacagtttgtatgtaaatcgcgaaacgaatcttttgaacctaagggcatcaccaatgtatatggcaaagtgatccatatagatgggacccacataaatagtttttccctatagcaatctccacaatatagatacaaggtatcattaggagaagagagaggagtagagatagataatataatttattccatatgggtagtccatatgcatatgggtatcttttacaatttttttctatatagactagttgcacaatggtaatagatggcggaatgaaatattctattgcttatggactacttttacatcacattatggatgccctaattatatcatgatttaataatgtggtgctacaataaacatttgctaatgacggattaattaggcttaataaattcatctcgcagtttacatgcggaatctattactccctccatcccaatataaagcaattaggttgatgtatgtggacatatggggtgtccacatacatctacctaggaggtgtcacatcccctcctaggttgctatattttggaacggagggagtatttgttttgttattagtctacgtttaatacttcaaatatgtgttcgtatacttaaaaaaattttagcacacgaactaaacacaacctgccttcgactatgtgttagagcatccccggagatattctatccctaatttggtgcataggagtgaaaaaaccacctccagcggatgcgccattcagtcatccaaaaatagtgcatgcgctaaaacgggagagagaaagggcaaatatagcgtgtctctctcctcacgccatatcacaacgaccgcactcccgccctcatccggagttccccgacctccccaccatcgtcgtcatcgcaggcctgtttttgattttttttacagcagatggtggagagggagggtgtagccgtggagtgagggtggagagggagaggcataccagatctggaaggagagcgccgccagcggcagccctacaacctccgcgtgcacgtttgcgcctgccaccgtcgccctgcgcacggccgccgcctgcctccgtcaccctgcgcccacccgccgccgccgccttcgcccatccgcggccgccgcttgcctcctccacacccatccgcgctcttcgtccgatcgcccgccgccgccccttacccggctgcccgccagccacctgcacccatctgcgcgctgccggccagccgccccatatcccttgcagaaaagagtagagaagagtagagactagagaagagcggagaaaagataataggtatagagtagaaacttgatttatattgctatatactatttgctgtgctttttatgttcatttactttgctatgatttttcttgctaggtaaatttatggacagctatgttgatttgttgggttagctggaagatgttattaaaatatagatgggtgtgatatatatgatgtaatatggatgatctgttggagtgggaagggatatgaatgagaaatcttttttggatgactatccatataaacatgtggaggatcaaatatggatgagctcctgggaatgctcttagagtaggtttaataggagtgctagctgttagctgcattaggggtagtttggatacagtaactaaacatgctacatccgatattggaacactaatttggagtattaaacatagactaattactcagatggaggctaatttgcgagacgaatctattaagcctaattaatccttgattatcacatatttactgtagcactatattgtcaaatcatggactaattagtattagtagatttgtcttgccaattagcctctactcccccggtttcattgtaattgacgttttggacaatgacacgttttacaaaatatatctttgacattatttttctattataatatatacaataaataaatgtatatttacttttattattgtgctttgaaagacacatctatatatgttgctctggttcctttcaactaaatatttttaaagttattgatggttaaagttataaaagttttacctaaccttgtccaaaacatcaataattatggaaccaaagggagtatctatgtaattagttttataattagcctatatttaatactcaaaatagtgtccaaacatccgatgtgacatgacagggactaaagtttagtcctggtatccaaactaccctagtgtacgtgtcatctccacgttatttaccatcatctctgtagctaacttacacaatgatgatctccaccaatacttagcatcaaattctagaaagtattatttatatattatgggatcctgccatgcatgtgttctgctgtactccctccgtccaaaaaaactcaacctagacaaggatgtgacatcttctagtacaacgaatctggacaaccctttatccagatttgttatactagaaaatgtcacatcccctcctaagtttaggtggtgtttggatccagggacttaactttagtctctgtatttagacactaatttagagtattaaatatagactacttacaaaactaattatataaatgaaagctaatttgcgagataaattttttaagcctaattaatccataattagagaatgtttactgtagcatcacataggataatcatggattaattaggctcaatagattcgtctcgcgaattagtccaagattatgaatgggttttattaatagtctacatttaatatttataattagtgatgcagtgtcacaccctaaaaattcaaaatatataaattgttgcttaattggaatttttagaaatgattttaaaaaaagcctagaagagaagatctaattttaaataataaattccaatataaaatggtgctagataaaatttcattaaatactttgcttaattctataattcttagatttttctgggatttatttgagctaaggaagtatttttaataaatggaattgcatttaagaaataatttaaattgaaaaaggttttaaaaagtctcttttggctttgggccgaaagtcggcccaaaacctttctctctctcctcggcccagtccggcccagtccgccgccgcgcgcgcgcgcgtccgcccgctgacaggtggggcccaactgtcagggccgtcgtcaacctccggccgccgccgcccgaaaccctagtttcgcgccgccgccgttcccttccaaatctggtcgatcctttcccgatccggtgaaatcaatagaggggaaacaatctccgggatctcctctaccttttctcttttggaaacatcggctaattcgttttggaaatcgttggaatcaagttcgaatcggattcgtctctctcctccgaaccctaaaccttccttctcgtcgccagccgccgtgggccttcgccgtggcctccgagtccctttaaaaggttccccggtgtctcctctacccgccgccactctcgccttcgcctctcgtcgccggaagagctctagcgccgtgcaacctagcgccgccgtcgccgccgtcgctccagccgtgcgctgccgccgtctcggtcgtcgtcatcgctcgggaaggccaccgtcatgatcgccaagtcgccgccgttctcgtccgctccttcgccgccgccgaagaccgccggaacaccgtcgccgccgtcgacccgaagtttgccgccgattcctcctcgtcgccgtcgccgtccgttgatcttctgccgctgttttggtcaccggtgagttcgccgcgtcgcgctctacccgttggtgccttccgttcgcgccgccgtgccgtcgttcgccggcgagcatgcaagcccgagccgccgagccgccgccgccggtggtgacgtcatcgctgacgtcatcgtcgccctctcccgtgagccggtcgtagaccgatcgatctcggccgtccgttttggatggatcgatctcggccgtccgttcgcgtgaaccgtcgcccgtgcgcccggtccaccgaaaccctagccgctgacgcaataaacccctttttccttttcaaaaataattcattattgcgtcataattcaattaaaatcaatataagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgctgttttggtgattttgttcttttctgcttagattccgtcgtttccggagagtccgttttagcaggagaagattttgaagagttccaaggccagcaaggcaagtcacacagatcccaaacaaccctttgagcatgttgatcctatttaaagctattgtttctattcaaatattgcatttattttcgaatgtcattggatggaattaacctattgtttgttatagcccttttgttcttgattactttattccttgataccttgggttaatataacttgactagttgagctttatatatattggttcaactagatattagatataattgcttagccctgcttagaaacattagctcacttttgggataacttatgactcactattatttaatgatggcttaatgatagttcacgatggacaatcgtgattgattaattaattaatgtgccaactaaaacctgataatggtgggttgtgagcacatggttttgatggtcgtgctcatgacaattaaggaccggttcacgagtttcggttgtgaaacatttaccgtgccaaccacaagccagcgtgggcaacggctttaccttttgtatagcatggttcattgcggagcaccagactgagaagtggcggagataagcccacgggggttcgctggggagtccatgccttgttttataagggggtgattatgatccaggaaaggtgcactgcagtggattgtgttgtacgagaggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataactggtgataatttgattagctcctggtttggaatggtacattcctggtttggagatagaactgtgcaaccgggatggttgttcagaatggttgggcctatacaacagggtatgttgtatagcgttgatttaatattgtttaattattacttaactgttttattaaattctcaaatgtttgttaaatgctgcttttgcaaatgaaaccctactatgccatcctttgttatcctgtgcacttgcatatttgctgcgtggcttgctgagtatgtcatatactcaccttgcaatcattcatcagaggaagagttctacaatgaggctgatggtggggaggattaggtgtagccctggtcaagctgcctgtggagtggagccgtctgcgccgtttattttatttttccgctgcttagatctttattgattgagaggaactatctacctctgtaatgacattatattcgcttattaattagagtaataattgtactctattatcaatttgttattgtgtgcctcggctgattcctggacgagggttcacacacatgtaagcgtttggaattttggatagaaattccgggcgtgacatgcagcaacgggggttcccgatctttcgatgagaggaggataaacttcaatttgagggaggacacgacgttggcggtccgactacaactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaactgaaacaaaccaaaatggggttctgaatacaagtatccgggtggtctagccgacacacgcgagtacaaggaagtagctgcagctaaacttacatcaaaacaaaacccaaaatgcaaaatggtggctgctaggagtttatataggtggaggaatgaccaggagaggaggtgggagcaaaccctaggttttgtggacccctaatgggctgtaaagatacaaggcccaagcccaagtttctgatgtaaagaactattttcgtcattctgagcagcctgggtcaaatttgatggtgaggccacacatagctgaaagtagacgacgagatctttccaacaagtactcatttgccccgtttgccctccggagtgaagagcattgacttcatcaaatcagcgctgctagtgctgcttgcgatctggttcctctcccatattcctaacaacaagtagatcacaacaaccatttagtagcacccaattctgagaagaacttgtatgattagctaggaatgactttacctgataattaagttcacgagctcgagctttagtcattggtccttgctgtgcaataggcgtggttgtatcgttggaagggatgtcctcatcatcctccccttcttgcatttgagtcgtcctcgactctaactcatcttcttctcccaaatatggctttaaatctgcaatgttaaacgtggggctaaccccaaaatcggcaggtagctcaagcttgtatgcattgtcattaatcttttgtagcactttgaaaggaccatcagctctaggtagcaacttagattttctcaaattagggaacctatcttttctcaaatgcaaccaaaccaaattaccaggttcaaaagcaacatgtttctttcctttgctcccagcaagtttatacttaatattcatgcgctctatgttctccttagtggtctcatgcagttttaacatcaattcagcgcgatgttttgcatcaaagttcactctttctgaagttgggaggggcaaaagatcaattggagcacggggtagaaggccataaacaatctcaaaagggcacttcttagtagtagaatgttgtgaacggttataagaaaactcaacatgaggcaaacattcttcccacattttaatattctttttcaaaacagccctaagcattgtagacaatgttctattcaccacctcagtttgtccatcagtttgggggtgacatgtagtagaaaataaaagtttagtccccaacttagcccacaaggttctccaaaaatgactaaggaattttatatcgcgatcagaaactatggtgtttggcactccatgcaagcgaacaatctcacgaaagaacaactcagcaacatgtgtagcatcatcactcttatgacaaggtatgaaatgtgccatcttagaaaatctatctacaacaacaaagatactgtccctccccttctttgttctaggcagccctaaaacaaagtccatagaaatatcctcccaaggcacactaggaacaggcaaaggcatatacaaaccatgagggttaaggcgtgacttagctttttggcatgttgtgcagcgagcaacgaacctctccacgtctctcctcatcttgggccaaaagaaatgattagcaaggatatcctccgtcttcttcacaccaaagtgtcccatcagccctccaccatgcgcttcctgcaataatagcatacgcacggagctagctggaatgcataacttattagctctaaacacaaacccattggtgagaacgaatttgttccaagtccttccctccttgcaattcaacaacacatctttaaaatcatcatcgtgcgcatattgctcttttattgtttctaagccaaaaattttgaagtcaagttgggatagcattgtgtaacgtctagacaaagcattagcaatgacattttcttttcccttcttatgtttgatgacatatggaaaagattcaataaattcaacccatttagcatgcctacggttaagttttgcttgacttcgaatgtgtttcaaagattcatgatcagagtgtataacaaattctttgggccataaataatgctgccatgtttccaatgttcgcactagagcaaacaattccttatcataagtagaataattcaaactaggcccactcaatttctcgctgaaatatgctacaggtttgtcttcttgtaacaacacaccacccaatccaattccactagcatcacattcaagctcaaaagttttgttgaaatcaggaagttggagtaaaggagcgtgtgttaacttatctttcaaagtgtcgaatgcattcctttgtgctgcagcccaagtgaatgtgacatttctcttggtaagctcatgtagtggggctgcaatggtgctaaaatccttcacaaagcggcggtagaacccagcaagtcctagaaagcttctcacttgtgtgatcgttgttggaaccggccagctatgtatggcttcaaccttggcctgatctacttcaattccctgcggagtcacaacatagccaagaaaagagactcgatctgtgcaaaatgtgcacttctcaaggttaccaaataaacgtgcatctcgtagagcatcaaaaacagcacgcaaatgaccatgatgatcctctattgatctgctatatatgagaatgccatcaaaatataccaccacaaatctgccaataaaagcacgtaaaacttcattcattaatctcatgaaagtactgggtgcattagtgagaccaaagggcatgactaaccactcatataggctgaatttagttttaaaagctgttttccattcatctcctaacttcatgcgaatctggtggtaaccactacgcaaatcaattttggagaacacaagtgaaccactcaattcatcaagcatatcatctagcctaggtataggatgacgatatctgattgtgatgttgttaattgctctacaatccacacacatgcgccatgagccatctttcttaggaactaaaagcacggggacagcacaaggactaagagactcacgcacataccccttgtcgagtaactcttgcacttgacgctgaatctcctttgtttcctccgggttggtcctgtatggcgcacggtttggcagagaggccccaggaatgaggtcaatttggtgctcaatccctcgaattggtggcagccccggtggaacctcctttgagaaaatatcagcatactcctgcaaaaggttagtgaccggaggaggcaaagaaataggagtatcctcaattggaaataaggtttctttgcaaaccaaagcattgcaaacaacagtgtcagtgtcaacttcatccaaatctgattttgttgcaatgaaacaagatctctttagcttaatctcatttttattattttgaacagagttggtgggtttgttcttatgcttctcaagttcattagccgcaataagatgctcactcctagtatgctcttgattttttttgtttactagctctagcaagttcatcctttaaaataacttcaggagacattggatgtaacacaagtttttttccattatgcacaaaggagtattgattggatttgccaaagtgtaaagaatctttatcaaactgccatggcctacctaataacatagaacatgcttgcataggcacaacatcacagttgattgaatcatgataagaatcaatggcaaaatgtactcttaccaatcgtgttacctttaccttgccgctgctattaagccattgaatatagtagggctgcggatgtggctgtgtgctcaatgcaagtttctccaccatttcagcactagccaaattattgcagcttcctccatatatgatcacgcggcaagagcgttccttgatcacacacttggtttgaaacaaggtgtggcgctgattctgttcagccctttccatttgtgcgcttagcactcgctgcaccacgaggctctcatagtgctctgcagcttcagccccaatgtgttcctcatcttggtggggcgcgtcaccttcccctgtattgttagttgcaagcaaagcataggtttcttcatctaaatcactagcggaggagtacccaccatcagctctcacgatcattacacgagtgcttgggcagtccttgcgcacgtgaccatagcccttgcagcgtaggcactgaatatctcttgtccttcctaatgatgctactgatgatgagctcttggaaggtgtagcagcaacccctcttgttggttcactcgggcatggtgtagagtttgttgtagagggacgcagcttgttgcttgaggacgatggtgctgctgctcgagttgacggtgcagcagtgttggaaggtgtccaagagctagcacgacctgcagaaatgttagtcctgaagctagctcttcgtcactgtacttccctttcagctttacaagcaagatgaaacaaacgattaattgaattatattctttgtaggctagaatgtcttgaatttctcggttcagcccacccatgaatctagccataccagcatcatcattttctaccaatccacaacgaagcattcctgtttgcaaagcttgataatactcctctacagatttgtttccctgtctaagttgctgcaatttgtgcagcaaatcacgtgcatgatatgaaggaacaaatctagctcgcatgactcttttcattgcatcccaggtttggggagtgttatttggattggaacgaacaaattcactccaccaaatggatgcaaaatcagtaaactcactagtagcagccctaacacgtttattctcaggaaaatcatggcaagcaaatttctgatcaatggctaactcccaagtaagatatgcatcagggtcatattttccatcaaagcaaggaatggtaaacttgatcttgcctaaagaatcatcattatcacgtacctcccgccgtggtggagcgcccatgccatggcgctgccggcgctgttgtctttgtggacgaccaagtaactcctcatcatgctcggtgtcagcagcgtactccagttcttcccttgctgcgatgctgctattagtatcatggccattgtggttgtgcctagccgatccatcatgaccatcttggcccattctctccaacgtattcaagatacctgcaagagaagtgttcacagccacaagggacctctccaatgaggaaagcttggagttggtgtcaatttgagcagcctccaattgaccaaggcgatcattggcgaccctaacatcctcatcaaggccttctgcatgctccctcacttggcgctcaaaatgttgtatgatgcccctcgtacgtggtgaatgttgagggtgctcccccgatcctcctgtcatggttaatgggaagaaacaattcacaagaaatatgtcctatcaactattggagctaggtgttgtccatctccacttctaccaaacttgtgcaaacgagttcttacatgttcttactttgttatgtaaaaggcgttggcaaacagcaagaacagcaacaatggttagtagtaccggaatttaattttatttcaaataaaaatttaatttatttcatttattttatttccaaaatttatgtcaaaattttctgcactatttatttattctcattagtttcataaaatgcacatactgtgcgcatcaaacaaaattttcaatcgttttttaagtttatatttaaacctaaagtatcaagggcaaaaaatacatttgcaaccaaacgtaatagtgaaatgatagaaaatgtaacggtaggggcatggaagggatcaagttaaaatttcaggggtatagaagagatcgagtaaatttcaggggtacggaagggattgagtgagtttttaggggtacacagagaatttactcatttttatcaatggatgctaattatttagagtggttaaaacatcgtgttgagcaatatcggcttatatgaccgatacctatgaagctattgatgattttgatgagcttgataaattaggacaaaggtttcacgtcggccgacccaatggaacaagttgatattgcggatggctctgtgactaggctgatgtttataaatcaaaacttagaagcccattaagtctgggtttatgcctcataagcaacacccgcgtcgctttaattctactatatttgagcggattaaagaagaaattaattggttgttggaagcggattttattcgtccatgcaggtatgcggggtgggtttctaacattgtgcccgttaagaagaaagattttggaaaaatccgggtttgcattgattttatggatcttaatggagccactccaaaagatgagctgtcacatcctgatttttgttttaggatttatagattatttaacaaattatttttagaatttatattaaatgttcattaatttacaagtgaagctaaatgtgggaaataaaatttcctaaatataaagaatggatgtatttaatttttattaaattctccatgactaattatactctctggaattatctcagatttttcaaagctcaattactaattttaataatacaaagaatacttcagtaattatttaaataaaaaaggaaatcaaaatcctttccaaagttttgggcttaatctggcccaactctctctcagcccagccgatccagcagcctttccttcccttttctctgcgcaagtctaacttggtccctctctctcagccggcccaagcaaggaaatggaagttcaggaaaaagtctgctttatctccccaagctacagtgtcgtcttcaagcttcagcaggcctcccgtgtccgacccagtgccgcccgacgcctccgtcctccgcccgattcgctcgattctctcggccgttccttgaatttgttgaggggaaatattccccttatctttatcttccgtttccccccaaaagcggaccttatcccgaagaaatcaacgcggaattgagctaatctctccaactaaaccctaggttttcctggcgcgattccttgcgttccaagcccgatctctctcccgtgtctataaatagaacccccatgccctcctcttcctaatccaacccttagctcgagctcccgtgccctaaatccttctccccgagctcggctgtctctctccgccgccggtagccgctcctagcagtcgccgtagtcgccgccttcggtcatcgtggcctccgttgggtttgcaagagcaaggtgaaggccgtctacccctcagttgctgccgtacctcgccggaacgccgtcgccgccgtcaacccgagcccgccacctctttaacctcgccgccggagcaccgtcgccggccgtctcccatcactgtttctcgtcgcgccgcccctcggtaagctcccttcgtcgtgctctttcctccggtgccctcggtttgcaccgccgtgctctagatccccagcgaccatagggttccgagccaccgccggctacgatgtcatcgctgatgtcagcgtcccgttagctgccgccacgtggtagatcggatcaatctccgccatccgatccggtcaattttaggtcaactagatctcggccgtcggttccgtggaccgcttctgtgaaccggtttacagtggaccgatccttgataccgatccttgatgacgcaataattcttttccctttttaaaattaattctttattgcgtcataattccaatataatttctgttaatggttaaaagttgtttaatcttagaaaattcatatctaattcatggtaaatcggattaatgtggtttaagttgcaaaggttgtataaaataaagatctatatattaaagttatctataaattgttttaaaagtttattaaataggtttaattgaattaaatcttctaaaattcataactaaatcatatgaagtcggaatgaggccgttcaagtctcgtaattcatctaaaatcatgatctatgtgtttgtttactttttatttactgtttatttggagttagtcttttcctcgttttgtgtgtttgctgtcgtttccgtcgtttcaaaggttcacaagtgcgtcggaagtatttcagaagactaattgaagtccgattattgcaaggcaggttatacagatcccaaaaacaattcctttgagcatgttgattctatatttaaattctctatttatttcaaatgtgcatttattttcgaatgtcaccgggtggtatgaacttattcctttgttatggccactttgcattgattaccatattctctatttatttcaaatgtgcatttattttcgaatgtcaccgggtggtgtgaacttattcctttgttatggccactttgcattgattaccatattccttgatatcttgggttataatttgattagccatgcttagaaacattagcacatgattgggataactaatgcttcagtattacttaatgatgggtatttaatggtggctcacgatggtcaattgtgattggttaattaattaattgtcaactataacttgataatggcgggttgtgtgcacataattttgatggtcgtgctcatgacaattaaggaccggttcgtgagctactgttatgaaacattaaccgtatcatccacaagctagcatgggcaatggctttagcttttatatagcgtggttcattgcagagtatctgactgtgaagtggcggaggtaagcccacgggggtcgctagggagtccattccttggctaaaagggggtgactaggttccgggaatggtgcactgtagtgaattgtgttatgcgaagggtattgtcatgatttcctcctttggagtgcagtggtggtacttcggggcatggcaacatgtgtgaaatcgtgtcttgtaggaatagtggtacatctctggccagagtaaacctattcgaataatcgtgctcacggttatgggctggtctaacaatgtttttcgtgattagttccacactactcattaataataatagtgtgataaatgatgattagtgtaactcctggtttggaatggttaatttttggttggaggtttgatctgtatgatcgaggcttgttcggggcttgttgttcaggtttggttgggcctatgcaacgggtatgttgtatagtgtttatttaatattgtttatctattacaactgttttactaaattctctaaagtttattaaatgctatttacgcaaatgagttgttctagtggatttccgggcgtgacaagttggtatcagagccagagccaccttgaccataggacaagccaaatggtaaatcttaagaagccttcaaaatttgaaaaagtagaactgttcttctctctttctcttatgaattattaagttgacagcacatgcaaaaggttatttatagaaatactgtcaatccctttcctgcaaaagatgttttctaaaaaaaaaaattgtttagcattctgatctctttctcttataacataattaagttgatgacacatgcaaggttatttatagaaatactgtcaatcactttcctgcaaaag

SEQ ID NO: 42716 - DNA, 40999 bp, Oryza sativa
ctacattattaattatggttatatttaatggtagctcacgatggttcatcgtgttatgataattaattgataattaaagcctgattaatggtgggttgtgagcacatggtttggaaagtcgtgctcatgacaattaaggaccggttcgcgagctactgttgtgaaacattaaccgtgccaaccacaagccagcgtgggcaacggctttaccttttgtatagcatgattcattacggggtgcgagactgtaaagtggcgagaagtttgtgggggtcgctggggagtccattgcttctggttttgagggggagattatgattcaggaacggtgcactgtggtgagttgtgttgtgtgagaggtactgtcacagttcctttccaaggtaccgtggtggtactgaggcgcatggtgacatgttgtggagctgtgtcttgtgggtacagtggtacaattttggccagagtaaaactattcgaatagccgtacgcgcggttatgggtgagtttaacaatgttttttgtgattagttctacacttctcattaatgataatattgtgttaattaatttgactcctggtttagaatggtatattcctggtatggaggtttgatttgtacaacctgggttggttgttcagatgaggttgggcctatgctacacgggtgtgttgtatagtgtttatttaatactgtttaattattcaactgttttattaatctctaaagtgtttattaaatgctgtttatgtaaatgagttttactatgtaatcctttgttatcctgtgcacttgcatatttgctgtgtggcttgttgagtatgtcatatgctcattcttgcaatattcattcatcagaggaggagtatttcagtgaagatgatgatctggaggactaggctttgtccgggttaagttgcttgtggaggggagtcgccatagctgttctgttttgtttttttccgctgcgtagaaatttattctttgagaggagctatccatctctgtaataatttattattttgcgaatattaattagctgtttaagagtactctattatcaatttgttattgtgtgcctcggctaattcctggacgaggatttaacacacatataagcgtttggaattttggatagaaattccgggcgtgacaagttggtatcagtgccaggttgaccttaggacaagccaaatggtaaaccttaagttgccttcaaaatattttgggaaatagaactgctcttctctattctcttataaactaattaagttggcagcacatgcaaggttatgcacaaaattttctaaattctactttaccaaaacagaaatctgttcttttatttttttaaaaaaactttactgttcagaatagcaaatagtttaatttttgaatttcattgattagtcggcactgtacatctattatggtactgattcaatcaagatagcatcagtactgctcatctctgataatggagtactcatctctgataatggtgacactgtaccgtgcttatggtagtccctaagtattttagttttaatttattcatttgactaaaactatttgtctctgttcaaagttgatttgttcccatttaaaaaaaaatttagttctgtttgttcctttcttttatatttttctttttgggttcaatttaattaaatctagtttgtgcagctaacttagaatatgcattaattcctcctttctatgttcctttagatgccgccccatccgccgaaaaacttgatcaaggtgctaggattcgtcagagagctgagattgatggcatttgaagtaggctatgaggttgcccctgagtatcgccagattccccatgaccccaacgaggagaagtgtcgtgttcgcgtgacgttggctagtgatcgtgaagaccttccgttgatatagttcgaagctgggggaagaaagtacaaccatgcttgtcaggaagcagccttggtggccattggagagctacgtcttcgctttgatgaggagttagagtcatcagctttcaattatcatccacagaagcctcatggtcaagactatggaacttacaattgtcctgaaggcgaagatagtgccactctgacgcatgcggtgtatatgcttagcgccatggatgcagtaggcgtggagcgggagaaagcagctcatgatagggaaaactggaaccgtggcagggtttgcaagttggagagcgaggtgtaccgtctacagaaggaactagctgagcttaagggagaagcaccaccgccagcacccaagcttcgcctcaccgcaaggaagagaacctgtccaccgcctcgtctccagttagcttcgaagactcgtgtggtgggagatgctgtgcctaatcatgctgaacctgtcatccatgtcttaagtgatgaggaagaagaggaagacccagaagaaagagagccagctactccagaggaagaaaatccatctcttcgttccgacgcaaggcgggattagttgcctagttagaccgttgccgtagttcgctgtgttagcttgcttgcttaagtttgcttgtgtgtgtgtgggtttagcgtgttgcttacatcattggtgggatgtaactacatgagtttagttcttttgcttgtcagagagtaagttagttggtgagacagtgttaattcaatttaaatgtaatcatacacagttaagagcaatatagagtttaaattaattaaagttctccgttctaagggtatctctctgtcattctttcctcttgcccgtgcttttcttcagatggtgaacacccgcactggacgtggaagtggtcacaatgaaggagatcccacacttgcccaagttttggctcagcaaactcagttgattaatctgttagtgcagcaagcgtagaaccagcaggcaaacaaccacaatcaatcaccaccttcacagaacaagttggcagattttctacgtgtgagaccacctaccttctcaagcaccactaacccagtagaggcaggtgattggctgcatgccattgaaaagaagttggatttgattcagtgcaccaagcaggagaaggtttcttttgcttcgcatcagttgcatggtcctgctgctgagtggtgggatcattttcgccaaaacagagctgtgggagagcttatcacttggcgggagtttactgctgctttcaagaagacacatattccatcaggagttgtggccctgaagaagagagagttcagagcactcaatcagggatcccgttctgtcatagagtacctccatgactttaatctcttagctcgctatgccccagaagatgttcgcactgatgaagaacgtcaggagaagtttttagagggactgaatgatgagttgtcttatgcattgatggctacggattaccgggatttccagcagttggtggacaaggcgattcgccaagaagacaagtacaataggatggaacagaagaagcgtagggctgctcaattcaaggctcaacagggtagtagccagaggccgcgcattgttttgggacctcaagctgcaccatacccacagggaggatcctcgtcagttgctcgccctcaacgccagttctacaacaacaacactggtaatcgcagcaacgacaatcgtaatgtggtcactcgacctgtagcagctccaactcagaatcaacctgtcaggaaggaacagggaagcaagccaggggtgtgcttcaattgtggtgatccaggacattatgctgataagtgtccaaagcctcgacgtgtgaagaatgctccggtccagaacagctccaatgctccagcaccaaaggctcgtgttaatcacgttgcagctgcagaagcccagaatgcacctgatgtggttttgggtacgtttcctgttaactctatacccgcatctgtgctttttgattccggtgctacacattcctttttgtctaaaagttttgcgagcaattatgggatggaagttattagtcttgggaggcatttactagttaataccccaggcaatcatgtatcctcaacgcagtattgtccttccgttaccatagaaatagaagaaattcctttcccatcctcacttatcttgctagaatccaaaggcctcgatgttatcttagggatggattggctaacccgtcatagaggagttatagattgtgctaaccgtaaggtgactttaacaagtagcaatgggcaaacagtgtctttctttgtgtcatcccctaaatctcatggattgacattaaatcaagttgatttgcaagagatcccaatagtacgagactatccagatgtgttccctgaggatttgccaggtatgccacctaagagagacatagagttccggatagacttagtacctggaaccaaccctatccataacagaccatacagaatggcagctaatgagttagcagaggtaaagagacaggtggatgatttgcttcaaaaaggatatatcagacccagtacttcgccgtggggagcaccagttatcttcgtggaaaagaaagatcatacccaaagaatgtgtgtggattaccgtgagttgaattaggtcactatcaagaataagtatcctctacctaggattgatgacttgtttgatcaattggaaggtactacagttttctccaagatagatctccgttccggatatcatcaacttcgaatccgtgaggaggatataccaaagaccgcctttacaacacggtatggtttgttcgaatgtatcgttatgtcgtttggactcaccaatgccccggcctttttcatgaatttgatgaaaaaagtgtttatggaatatctggataagtttgtcgtggtgtttatttgtgacatccttatttactccaagacaaaagaagagcatgaagagcatcttcgtcttgctttagagaaactacgtgagcatcacctctatgccaagtttagtaaatgtgaagtttggttgcccgaagtgaagttccttggtcatgtcatctcagctggaggagtggctgtggatccaagcaatgtggagtcagtgctaaactggaagcaacccaagacggtttcagagattcgtagtttccttggtcttgcggggtactatcgcaggtttattgagaacttctcaaagatcgccagaccaatgactggactgcttcagaatgatgtgaagtataaatggacggaagagtatgaacagagttttcaagaactaaagaaaaggccagtgtctgcgcctgtgttagtcttacctgatccaaggaaaggttttcaggtgtactgtgatgcatccagacttggtttgggttgtgttttgatgcaagatgggaaggtggttgcctatgcatctaggcagttccgccctcatgagaataactacccaacgcatgacctagagttggcagttgtggttcatgcattgaagatttggcgtcattatctttttggtaaccgtacggagatgtatacggatcataaaagtttgaagtacattttcactcaacctgatttaaacatgcgtcaatgaagatggttagagttgatcaaggattatgatatggaaattcattatcatccaggtaaagcaaatgttgtagcagatgctctcagcaggaaaagctactgtaatatgtcagaaggacgacatctaccttgggaattatgccaggaattggaaaagttgaacttgggaatagtcaacaaaggttttggggccgctttagaagctcaacctactctgtttgatcgagttagagaagctcaagtgaatgatcctgatatccaagaaatcaaaaagaacatgagaagaggaaaagccatcggttatatagaagatgagcaaggaactgtgtggctaggagaaagaatttgcgtgcccgataataaggagttgaaggatactatcatgaaataagctcatgaaactttgtattccattcatcctgggagcactaagatgtatcaagacctgaagcaacaattctggtgggccagcatgcgatgagagatagcggaatatgtggctttatgtgatgtgtgtcagcgagtcaaggcggagcatcagaagccagccggtctgctgcaaccattgaagattccagagtggaaatgggaggaaataggaatgtactttatcaccggtctacccagaacgtcggcaagacatgattctatttgggtagtggttgacaggcttactaaagtcgctcatttcatacctgtcaaaacaacctacacgggaaataagcttgcagagttatatatggcaagagtggtatgtttacatggtgttcccaagaaaatagtgtcagacagaggtagtcagtttacctcgaagttttggcagaagttacagaagttacaaggtacggcctatcaccctcaaactgatggtcagacagaaagagtgaatcaaattttagaagacatgttgagagcctgtgttctagatttcggtggaagttgggataagaatttgccgtacgttgaattcttttataacaacagttatcaggctagtcttcaaatggctccatatgaagcattgtatggtcggaagtgtcgtacaccgctcctttgggatcaaaccggtgagcgtcaagtttttgggacagatatattgcgagatgcagaagaaaaagtgaagattatccaagaaaggttgcatattgcccagtcgcgtcagaagagctatgcagacaatcgacgcaaggatttgactttcgaagaaggggattatgtatacctacgggttacgccactgcgaggagttcatcgttttcagaccaaagggaaattggcaccgcgttttgtgggaccttttaagattgtgagtcgaagaggtgaagtagcttatcaactagagttgcctccgtcaatggcgggaatacacgatgtgttccatgtgtcgcagttaaagaaatgtttgcgtgttcctacggaggaagcggatcctgagcgtatagagcttcaagaagatttaacatatgttgagaagccagtcagaattttggaggtgagtgagaggaacactaggaatcgcgtcatacggttctgtaaggttcaatggagcaatcattcagaagaagaagccacttgggagcgggaagatgaattgaagtcaactcatcctcatctttttgccagttcttctgaatctcgaggacgagattctgtttaaggggggtaggcttgtcacgccctgaaaatcgcctaaattaataatccatattttaaatcatttttagaaattattttaaaagcctacaagttaaactctaataaacaaggagaaatttcaacataaaattgagctagataaaatttcattaaatactttgcttgtttatctattttctagatttttctgggaattatttgagcaagggaagtatttttaataaatgaaacatcacttcacgaattattttaattggaaaattctttaaaatcctcccctaagccgttgggccgttttcggcacaacacctccctctcctcgtgcgcgccgagcggcccaagccggcccagtccaagccgccgcccctcctctcccctagccaccgacatgtgcggcccgagccgagtccgagccgagtccgagccgccgccgtcctccgccaaattcgcctcacccggttgcccccgagtccgattagttgaggggaaatcatctcctccttatcctctccctttcccctaaagtctcggagtttaattttgcccggataaaccgaatcgaattcgttttcgagtttatctctccaaactaaccctagtttttccggcttcgattcctcgcggttggagtcgaatctctttaatccaagcctataaatagcatcccctagtcgtcctcttccgtttgccccaagtcccgagctaccccgttgcccgtagcgccgccgccactttgttctagctgccgccgtcgccggcgatactccggccgcgtcgcgccgccgcggtagccgtcgccgttgccgtccgtcaccaccgtcgggtgcgcacggaggagaggaacctcggccgccccttcgccgccgtcgcaagccgccggagcgccaccgccgccgccgacccgagccgagccaccgtcgaacctcgtcgccggccgacgttcgtcgtcgtccgtcgtgttttcttgtaccggtgagttcgtgtcatcattctctacgcataggtgcccttagatagcccggccgacccctctagcgccggtggtcgcgacgcccgcgccatggccggcgatgatgacgtcatcatgacatcataaatccctttttcttagtttctttattagatgaaaatcgattaaacttcggaaattcataactaaatcatcgtaactccgatttgagtggttcaagttgctaaatttttctaaaatcaagatctacatattaaaaatatccacatgtactgtttatgcttgtttttgtactgttttgttgattttgttcttttgctttagtttccgacgttccggaggagagcgctttcgttgaggaaggttcggaagcgtttgcggaagctcaaggcaagtcacagagatcccaaataaccctttgagcatgttgaacccatttaaagctattgttttatttcaacttatgcatattttcgaatgtcattgggtggtgagcctttcccatttaattatggccgaagatgactttattttcctatgggttataatttgactagcatggaccttatatattggattggttcagctagatgttatttatagttgcttagccatgcttagaaacattagctcattaatgggatgaatcatactacattattaattatggttatatttaatggtagctcatgatagttaatcgtattatgataattaattgataattaaagcttgattaatggtgggttgtgagcacatggtttggaaagtcgtgctcatgacaattaaggaccggttcgcgagctactgttgtgaaacattaaccgtgccaaccacaagccagcgtgggcaacggctttaccttttgtatagcatgattcattacggggtgccagactatgaagcggcgtgaagtccgtgggggtcgctggggagtccattgcctctggttttgagggggagattatgatccaggaacggtgcactgtggtgagttgtgttgtgtgagaggtactgtcacagttcctttccaaggtaccgtgttggtactgaggcgcatggtgacatgttgtggagctgtgtcttgtgggtacagtggtacatatctggccagagtaaaagtattcgaatagatgtgcccacggttatgggtgagtttaacaatgtttttcgtgattagttccacacttctcattaatgataatattgtgttaattaatttgactcctggtttagaatggtatattcctggtatggaggtttgatttgtacaaccggggttggttgttcagaacttcagatgaggttggtcctatgctacacgggtgtgttgtatagtgtttatttaatactgtttaattattcaactgttttattaatctctagagtgtttattaaatgctgtttatgcaaatgagttttactatgccatcctttgttatcttgtgcatttgcatatttgctgtgtggcttgttgagtatgtcatatgctcattcttgcaatattcattcatcagaggagtatttcagtgaaggtgacgatctggaggactaggctttgtccgggttaagttgcttgtggaggggagtcgccatagctgttccgttttgtttttttttccgccgcgtagaaatttattctttgagaggaactatccacctctataataatttattattttgcgaatattaattagctatttaagagtactctattatcaatttgttattgtgtgcctcggctgattcctgcacgaggatttaacacacatgtaagcgtttggaattttggatagaaattccgggcatgacagaattcctcctttacttcgcctaaacaaatctcagccatccgttttcattaatgacctaatctccaactaaacttcctatcaatttccaccacctctaccaaacaagagactgggatgaaaaatcaaattcccatcttaatctcaccatcaattccctcgtgtaaactccctatccccttccttcaagttgccaaacaagccgtataaagcatcccctagtcgtcctcttccgtttgccccaagtcccgagctctaccgttgcccgtagcgccgccaccgcgtagccctagccgccgctgtcgttgtcgccgcttcagccgcgcctcaccgctgctgtggtcgtcgccgccgccttccgtcgccaccgtcgggttcgagaggaggaggagcaccccgtccgccccttcacagctgccgaagaccgccggagggccgccgtcgacgttgagccgaacagtgctgccttgggacctcgtcgccggccgtcgtttgtcgtcgttcgtcgttgttctttgcaccggtgagttcgcatcgtcgtcctattcgcatgggagtcctcggaagacccggccgagtcctctagctccggcgacctcatggttcagagccatggccggcgatgacgtcatcgatgatgtcataaagcccttgtcccttctaaaaataaatcttaaaatcagattaatcttagaaaattcataattaattcatatgaagtcggaatgaggccgttcaagtctctaaattcatctaaaatcatgatctacatgtttgtttactttatatgtactgtttatttggtttttattagtctttttcttcattttgcgtgttagcttgtcgtttccgtcgttgcgaaggttcgtgagtgcgtcggaagtgttcaagactaattgaagaccgattattgcaaggcaagtcacacagatcccaaacaaccctttgagcatgttgaacccgtttaaagctaatgttttatttcaacttatgcattattttcgaatgtcatcgggtggtgagcctttcccaattaattaatggccgaagatgactttattttcctatgggtaataatttcattagctagaaccttatatattggtttagttcagctaaatgctatatatatatatatatatatatatatatatatatatatatatatatatatatatatgattgcttagccatgcttagaaacattagctcattaatgggatggatcatactatattattatttatgattatatttaatggtagctcacgatggttaatcgtgttatgataattaattgataattaaaacttgacaatggtgggttgtgagcacatggttttgaaggtcgtgctcatggcaattgtgaaacattaaccgcgccaaccacaagccagcgtgggcaacggctttaccttttgtatagtatgattcattgcggggcaccagactgagaagcggcgagaagtccgtgctggtcgctggggagtccatgcctctggttattgagggggtgattatgatccaggaacggtgcactgtggtgagttgtgttgtgcagagggtattgtcacagcctctattcaggtactttccagtatcgcgacgcatggtagacatgatgttgaggctgtgtcttgtgggtacagtggtacacctctggccagagtaaaactattcgaatagccgtgcccggggttatgggcgggttgagcaatgtttttcgtgattagtctcacacctctcacaataattattgatgctataactggtaataatttatttagctcctggtttggacttagatctgtacagccgggtatggttgttcagaatggttgggcctgagcagcatggcgtgttgttcagtgttgattaaaattaatgattaaattactctactgtttcactactcttaaatctttgctaaatgctgcttttgcaaatgagcctatattatgccattctttggtatccttgtacacttgcatatttgctgtgtggcttgttgagtatgtcatatgctcaccttgcaataatcaatcaacctcagttgaagaaaaggatctagaaggagaagacgtttggcatataccccagttgagctgcctgtgggagtggagctgaagccatcgctagaccgttaatccgctgctgtttttcttttcttttgtaagcatgcaacgttattattatgatggatttgtatattaaattgtcagtttgtgtacctcggctgattcctggacgaggattttatgcacaaattagttcggaaattactagtgaatttccgggcgtgacaaagatgaagccgagcggatctccaggcacagcaaactatatgtcatccatgagaccgagttgtacaagaaaagtccatcgggaatcctgcaacgctgtgtgtctttggaggaggggaggcaattgctaaaagatatacattcaggcatctgtggtaatcacactgctgcacgaaccatcgttggcaaagtttatcggcagggttttttctggcccacagctgtatccgacgctgacaaaattgtgcgaacatgtgaaggttgtcaatttttcgcccgacaaactcatctgccggctcatgagttgcaaaccatccccatgtcttggccgtttgcggtttgggggctcgacatggtcggcacgtttaaaaaggttgtcggtggttatactcacctctttgtggctgatgacaaattttccaagtggattgaagctaaaccggtcattacaatcacggcagacaaggctagagatttcttcatcaacattgtgcaccggttcggggtacccaatcggatcattactgataatggcactcaatttactggcggagtatttaaagacttttgtgaagacttcggcatcaagatttgttacgcctccgtagcgcatcccatgagtaatggacaagttgaacgtgccaatggcatggtacttcaagggatgaaagcgcgagttttcgaccgactgcatccctatgccggcaagtgggtagaacagttgccatctgtactttggtccctgcgcaccactcccagtcgggccacgggccagtcgccgttttttctagtgtatggagcggaagcaatgttgccctgtgaggtggaatttgaatctttacgttttcgtaacttcaacgaggagcgctacagagacaaccaagtaggtgatcttaatcgactggaagaagcctgcgaagcagctttaattcagtcggctcggtacttgcaagggttgcgccgttatcataatcgcaatgttcgatcacgagcctttttagtcggcgacctggttctaagaaaaattgaaactacacgggatcgacacaagttatctcccttgtgggaaggaccattcataatttctgaagtcactcggccaggttcttaccgactcaagcgtgaagatggtactcccatcgacaactcttggaatatcgaacatcttcgtcgattttatgcttaggcattacttttgtatttccctctttgactgataacatcaagtttctccttgagttatcagtcgggggctactataataataatggagtgtgatttttatcaattcaatttgtttacttgatttatcattgcgttgcttgattttttggcttagtcaataaggactgaaagttttttaataacttttgcgggttttaggctcagtaatgtttgacaaaagcttttaagaaatcaggagctaagtttgaaatatcaagtacagcataaattcatcagtattgtacaaattgtgcctccatcaccttcatcatcagaatcattgttataatataaaatcagttggtgtcagttttttcatcatcggaattatcagatccaatcggccgaaggtcgttgtcctggaatctctcaactacatcaacggctatcttatcggcggctttctgcgcatcgttgatgaggtcaagggcggcctcttcgctcgtcccgtctgcaaagccattaatggcgtcaatgtcaatcttcgggtcattgccaacgccaggcttggtcccatacttccagcttccttgatattcttaaagtatgtatccggagcaattctcagcttgtcgaagatctcagaagcatcaaatgtactcggaccattgttattgaagaacatggcttggacgagtggggtaccagcggtggcgacttcatccctagcccctccaagcctcttgattttgtggaccaagacgtcgaattgagcctgggacttgattttgcgatctgcatgaatggattcatatcaacgagtgggcataaaagaaagggatggtttttgaagtgttagtcgccagtaccttcaacatctttcagagctgagtccctctgtctcgccaattcggccttgtcgttctccagagcttggatccgcttttccagttcagatatcttggcggcttgcactgtattgcttcatgttaattgatattacaaggatggcagcataagtaagttggatagagattgtatttaccttttgatgaaccactcagttcgaagttggagtcttgaagctcggcgatccaatccctcagatcatggtcagttttcctggcaagctccttaccttcgtgcagctggtttctggtggcctcaagggttccaagatggggaactaacctctcaagagtcgcagtcttcgcctcgttcctgagatggattctctgcaatgcgagtttgtcggcatttgtgcgaagtggcaaacaggatggttgaagctgtgtatagggagacttacgtttacgatatgagtagcttgcccaagtgcctttttcagcaggcatacttcctcatcttccttttgcttgtttatcacaattccctgaggttgcatgtcgtcgtcccaccacttgactaaaatgggtgggcgagaatccttagctgactgtatccagaggatctcttcttcgtcgccgatcattgggccttaggcattcatgaataaaggtgaaacaattgaagaaagtctgtcagatcaaaatgggttcggaggatgtgtttacttgtaataattttcggtcggggacgagcaggctcttgtactttaacaggagagctggaccctggatcagcactggcatcctttctaggagggctattcgtctgagcttctacttcgggaatatctttatttggttctgtacccgattggtttccagtcgggggctcctgattagcaccaactctagcctcggccgactggttcccagtcgggggctcgttgctagcttctacattgtcggttgccggttgttcgttactcgggcgatcctctgcagctggcccgttctcttttgaagggcccgtctccatgtcagtcggctcggagtcttttccgaaaggatctatgtcagatggcttcctacaaatttgagttatgccattagtgctatttcaacagtgggtgagcagcaatacaaggaggatggtcaaatgatttgtatctggaagatttcctgattttcggcatgggacgactggatgttttcttcttcggattggtttgccttggttgttttccagtcacctctttgttgctagaatttccagcatcatcgccctcatcatcacttagagccaatttcctcttgcgagagtctgactggctggctgatttcgaggtgtttgtttgagtatcagaccgaatttttggtcctccactcgcctgaccagtctgccggcgaggtgatcggcgttgagcaattggaggatccgatttcatcaaagcaaattcgtgtgcatgatagtccaagttttcagttgaccttacagaagataaaagcatgctttgggagaagctgagttgtataatacgtaccggtggaggagggttgaaggcattgtacggcacaactggcagtaagtgtgaatagctgaccacgatggcattcgagaagattttgtacattctctcctatataattttaaattcaagagattctgggttttctcggttggggtcatgcttgccgtcaaactcaaaggctgttttggatctttccttgattggagccagccgggtcttgatgaagtgccgggtgatttgttccccctgcagaccttgttcttttagcttcagcatgcgatccaacaagttgagcgcttgggcggtttcttctcccatcggcagtgagttccaggtatcgcgataaactgggggaagacacgagtatccgggaagcgctggctcggggttttgcacatagaaccagttcacatgccaacctttgttcgaggttttgaatggcatggagaaatatttttggctcaaagtccccctcagttgaaatccggctccccaactacgcatggtttgcttttgtttggttggggcttgaggaagaagatgcagcggaatagagcgaaatgcggcctaatccctagaaaagcttcacaagcgtggatgaaattggcgatgtggactatggaattggggtttaggtgatgcaatctaattccatagaaatccaaaattcctcggaagaaacttgaggttggaagagaaaatccgccatagaagaaatgagaaaataccacgacttcatgtgtgtcgggggtcgggaatgcttcgccgaacgccggacgccatccaatgatctccttcgccggaagaacgccgtgcgccaccatctccttcaggttctcctctgttacatcggagggcgcccactgactctcgaagctttctctctcttccgccatggatgcgaactggatgatatgatttggtccgagatatggctggaaatggatggggaatcggtgcggtggttgcgcggaaagtttttgtggaactcaggaggatggatcggagtggatttgtaaaccctagcttccgccagtgtggtttgcactgtagcagagaatggggaaagtggcgagagtttcggcggggaagacgaaacgacgctctgacttcggcgtttatttcgctagggcttcgggagtgctaatgggcctgggcctatacagtacttcagcccaattctattgccagcgtggctagttgtgatccttaaggacttaggcatttttgctttggcaatttttgctcacaacattatggcccaatgttgttaaaatcctttttgacgcggttagatgattccttggaattactacgatgcaaataaaaaggtacccgacagaaaggtgttatactacttttgtaggccttattaggctgcaaaggctgtttgggttttattgagatgattggttttaatacagtcattcactcggcatgttatatgcttatttttatggtgtgagtcatagcctaggctatttagactcatcacttgttgtgttatcacatttacatcacgtttgatggatctttttgagagtttttactcggattcttatcaaatgtgtgaatttatggatcttcagagtgtttttcactcgggccttttcatatctccatttttggtatattaaagctaaaagcagtcggctgaatgttttattgaacgccgcatatactttgctatatgatattcggttgtcaaaccactcggttggatgtagtttgcatcttgactatatgtttagttttttaacaaatcacatagtcgggggctacacctaattaggtgcatctagtcgatgcacccggttttttctatttttagaccttcacagtctttgatttttggtactcgggagatcagggcagaagaagtcggagtactcggattatcattctgtgctacgagaagagattgtttcgtcggctgtaaaggtctctggggctactgtggagtttatggataccccatacctacacggcatgtatagtccgactgggtatggggtgccatgtatagatagaatatctttaaaaggactcgggttaaattctaaacttgtatgtcaaggaaatatctgagatcctagttggttatgattgcattttatctgtaactacctattccgttagggatatggactgtattttgtaatacggactccttcccctatataatgaggggtccgggtgcctctaggggcacgattttctctcagatcatacgatcaataatatactcggcggatcaatccccggacaggagtagggtattactttttgattaagaaggcctgaacctgtataaaattctttgtctctaaatccatccacttttccaacttgatagccacccccttttagtattgccgaaatcttgtttcgacaatagtagatttgtttattttaaaacgaggaagaacatagaaaagagctattaggagcatctcccccgctagtggatttgtttccatttcttaatgaaatctacagtatagtctttgaaaaatcacaaacatggtagtgatacatcacccgcagcgcgtgttataatatactccctccatccccaaatgtttgacgccgtttacttttttaaaaatgtttgaccgttcgtcttatttaaaaatattaagtaattattaattctttttctagtattttatttattgttaaatatacttttatgtatagatatagttttacacattttcacaaaaatttttgaataagacgaacggttaaacatgtttaaaaaagtcaacggcatccaacatttagggaacgagggtaccccccgagagaaattactggcggctgtaaccagatacatgaatacacagtgactaaaaaaatcgtgcgtcgtaatatacgagggcattctataatgtaacacaagacacagggtgtgcgctattatagctgtgataaatgaaattgtatatcagaccggtacatacagtgacataaacaatcactacaataaaacctaacctcctgtagaggcgttttttagacgatttttaaatcgtttctaaaatcaagagttctgtaaagtggagataatttttagagacactttaatttactctatagatgctaaagagatattttcagctcattttgttaaattttattttttaaggcattcttttcgcatgctgatatgtaaaggtatttttttatgcatttaagctatgtgaggctcttattagaatattaatatatttttaatacaggatgcctttgccttttttatattaccatttctcttatttaaaacaaattatgtgattattatttattttattgtgacttgatttatcattaaagtttcttaagaatgacttatatttttattatatttgcacaagaaatttaaataattacataaaaaagaaatttgaataagataaatggttattaaaaagttaacggtgtcatatattaaaaacagaggtaatatcataaaacataaatatacacgtaataacataaggtttagtacgttcaatatacaaatgattcacccaagccgtctcaagtttaacgattggcaatagcaacataaaatattatattctcttttttcacattggaattgtcagggataatattttttgaattttctttgattcaaaatgattaacaggacttaaaagaggaattctcagagcaccggaggcaatgttgctaagtttaaaaatgtcaagatcacattaataataattcttcctttttgcctttggtcgtgaaatgtgcccaattcactcccatctctgtccgcggtttcgttttgcatgatgaaccgtgtccgtcttcactcgtggaaccgtgtccgtcttcgttcgcgggcctgtttctgttatttttctaaaatggcaccgcattgattttcctatttggggaagtcccaatcctattctccctctcctatttttcctccgcctctcaccatctcccactcagcctccgccccccctctcccagagcgcgcgccctccccctctccccatccaagtcggtctcccctcccaccttccaatctgactcccaaccggcaccacctttccttaatccactcctatttttctcacctatataagtcgcacccaaccttttcccttttagattttgttttgctctagctctagccgcagccgccgccgccgccgcttgctgtcccacagccgccggcaagtgccgccgcctcccgccatcgccgtcgtcgccgttgcgccgctggtactccgttctcactctctgttgatgggtttgcttctgcaatcatcaattcatctatgtaatctattccgttcaatcttacctagcgtcgtcgtcgtcgatcccgagctcaccggcggaaccaccaccgctgttgtcatcctttctccgctcggcattgttttccggtgagacttccgttctcttttagggttaagttttcctgtacctagtgtttgtgtcgtagtgccgagccgtgccgccgcctctgccgagccgctgccgagccgttctgccactgacaacaagccacgctgcggcctctgccgaaccgccaccaagccgccgccgccgcatagctgccgagccgagccgccgcttagagccgtcgtgccgcagccgtgtcccactaaaacctagctaccgctttgacccgttgcccggtagttgtgttgtctagccgtaggtgtaaccctgagttcctaccagcctattgtttgtcgtaccgaggctttaccgtgtatcgtgtctagcctaccggtttagccacagccgttgttgagtcgcgcgcttgttcgttcgaacgaaatgtcgtcctgtgctttgttcgtttgatcgttttgagctgttccttagtttagagtcattcagagccacgggttccgttcgccgatctcggttgatcatttggatggtctcatgtcacgtagaattgcctcattgagtcggtatctcatgaggcttgcttaccaatgttcttttccttcgatcttacttccttttgggcaataataaatggcaaataattaaggttttttggttattagtaataacacagttcttcttgtaaaattcatatttaattcatccgagctgctttttaatccattcaatttgtagtaaattcattaaaatatctaaaatccattaaaattggtttcttttgctatttcagtagtgtcggagatatgggcccgggggtatgtggagtagaagggaattattttccctccggccacgtgactccgcaggttggccccactcgcgcgccacgcgagtcgtagaagcgcgggggggagggctcggggcatgacgtcacccccctcgggctctcccgtggcttcgccccgaggccctcgcctggcagccgcgcggcagagagagagaacaagaagggagcgcaggctgaacagccataaatgtgcgacgccccaactgtccctcaccgcagttaatgcagtaagggcagagacgtgcggcgtgcctagggccgtctctgtcacatccgatagatagggcgaccatgtcctcacgtcgcccttgtccccgacggagtgggggtgggtatgacccgtcacatccgagagccgctcggagaagggctgttgcgtgtcttcgttaatttatgagggaatgacagggctatcccccgcgtcaggcggggggcggcgccgggtttcattcgagaatcggttattgcttagcttccgggagaaggcccggtttaaagcccgaaaagtgaagtggggtccccccctgtggggggtaggtagaggcggcacatgtggcatccccttaagctataaaaggaggaccctgcccactgagatgggatgactcccagaaaacctgaacttgagaaggaaaggagcaggtgcgctctctgagggggaggaacccttgtaagaatcatccataatcccaaacacaggagtagggtgttacgctcgatagcggcccaaacctgtataatccgactgcgtgcattcactcctgagagtcgtagggacgagcaagcgactaacgagagacgagcctccgcccctggccgaactcacgaaaggggggtctcacgactccccgctattgagggtcttccctcgacagctggcgcgccaggtagggggcggtcgtgcggtctgagaggaaatcgctttcttccgtcccaagtttttccaggccttcgccgaccatggtcgaggtcctggaagtggaggaggaggcggtggcgtttacccccaccccatctgggagtgaggattccggcgagagccgaggacctcgtcaccgtcgccatgggtctccaactcctccccgccgcgaacctttgcagagggagaattccgctcgttcgagtggttcggctctccctccgcctcctggcggagagaggtcgcgtcgcgtcggggcacgccaccatctcgattatggggacggcggttcgccccagggcgcacttcaggcagcaagcgcccttctacggcatcccccggtaagcccagagccggagactcctgttcggcgctggttggacgacgtggccaacttggtcactgctgcccaatggcagttgtccatgggtggccgatccactgctgccggtacatcatgtacctcggtcactctctccttgccggcgaggagaagagctcgtcgatcggccacgatctcgaggcggtccacggtcccaacatcgtcgggggcctcaggaagccggaggcgtcatgacggcctctacggtacgcaggacgctcgaattaacatcgagcgacaccgggatgagcgccgagctgcccttatgggagaaggtgcctcctcatctggagcgccacgctcctcttcactaggcggccctcctcccacactcacccctggggggacaggttgtagggctttcgtggcgagtctccggaatgtccggtggcccccgaagtttcgccccaaccttacggagaagtatgatggtagcatcaatccctccgagttcctccagatctataccacggttatcgtggcggcagggggtgacaaccgggtcatggcgaattactttcccatggccctcaagggtcaggcgcgtggctggttgatgacccagccccccgactccattcactcttgggaggacctgtgccagcagttcatcacgaacttccaaggcacatatccccgcccgggggaagaggcggacctacacgcagtacggcggaaggatgatgagtccctccgttcgtacatacagcgcttctgtcaggtccgcaacaccattccatgcattccagcccacgcggttgtatatgcatttcggaacggcgtgcgacataatcacatgctggagaagattgcctccaaagagcccaagactactgccgagctcttcgagctggcggacagggtggctcgaaaggaggaggcgtgggcctggaactctcccggcaccggtgcggcggccgtggctatccccgagtctgccccccgctctaagcggcgagataggagaggcaaaaggaaatcagttcgctccgatgacgagggtcatgtccttgcggcagacgggcccacacgggccccacgcaaaggaaaggccaccggcgataagccgagccccactgttccctctggtgagggctggtcggtggacaagtggtgctcggtacacaacacctaccgccacagtctcgccgattgccgctcggtcaagaatttggccgagcggttccgaaaagctgacgaggaaaagcggcagggtcgacgggagggcaaagccgccgcgacctcaaccggtgatcggcgagaggaggccaagaacaaggcccccgccgatgatggcggagacagtgaggatctggatttccagatacctcagtggaccgtcgccacgctcgacgggggggcttgcgcccacacctctctccgaagcttcaaggccatgagacgagagcttctggccgctgttcccacacatgaggcggtccggaaggcgcgctggtcggaggtgaagctcacatttgaccagagcgactatccgacggtactcgctcgggggggggggaagttggccctggtggtctccccgaccatccacaacgtcaagatgaagcgtgtgctggtggatggcagggccagtctgagcatcatctccccggctgcctttgacgcgctcaaagccccggggatgaagctccagtcgtcgctcccaatcattggcgtcactccagggcacacgtggccgcttggccacgtagagcttccggtgacattcggcgactccaccaacttccgcaccgagcggatcgacttcgatgtggcagatttcaatctaccctacaatgcggttctaggcagacccgcgttggtgaaattcatggccgccacccattacgcctacctccagatgaagatgccgggtcctgctggtcccatcactatttttggtgatgtcaaggttgccctcacctgcgcggagcagcgagcagacaacctggcggtggccacggaaccacaggcccctgaggcctctgcgtcccgcgcttccaagaagcgcctcacctcggccgacgaggtacacgtcaaggaaatccccttgggcgatgacccatccaagaccgtcaggattggcggaaccttggacgccaaataggaaggcgcgctcgtctccttcctgcgggcaaattctgacgttttcgcgtggaaaccgtcggatatgcccgggatccccagggaggtgatcgagcaccgctgccgtgcggccggatgcgcgacctgtccggcagaaggtgcggcgtcaagccccagagcggcaggccttcatcagggaggaagtggcgcggctcctggaggctgatttcatttgcgaggtgatccacccggagtggctggcaaacccggtggtcgtcccgaaggccaatggcaagctacggatgtgcatcgactacaacgacctcaacaaggcatgccccaaagatcccttccctctgccacgcatagatcaaatagtcgactccactgcggggtgctaccttttgtgttttctagatgcgtactctgggtaccatcagattcgtatggctagggaagatgaggaaaaaaccgcttttattactcctgtggtcactttttgttatacaactatgccttttgggttgaaaaatgtaggccctacttttcagcgcatgactcgtattactttaagtaaccagattgggcgcaatgtagaggcgtatgtcgatgacctggtagtaaagacgcgacaccaggatgcgttgctacaagacctgaccgaaacttttgatagtcttaggtccacgcgcgtaaagctgaaccccgataagtgcgtgttcggtgtgccggcgggcaaacttctcggttttctagtctcttcccgaggcatagaagctaatcttgagaaaatacgtgcgatagagaggatgcgcccccccagcaagcttagggatgtgcagtgcgtcactggatgcatggccgccctgagtcggtttatatcgagactgggtgagagggcgctgtgtcacgtccagaaatttaacccaaatttccagactattttgcgtattaaatccctgtccaggaccagccagggtacacaaaacgacaagtaatatacagttccaaacgtaaataaagcgtaaaatacttacaggagaggcacttagtcctcacaccgaaacaaaagcggcggcagcggaaaagacgatcctagcggggcttcagctccactccacaggcaaaactcaactggggtctgagccttggtcctctaacttcatcttcagctcagaagcactacacttctgaaaagggggaataatagcaagactgagtacaaccaccgtactcagcaagccacaccaacgatgcagacgtgcaaaggggatacaaggaggggtttgtggctatttgcataaaggcggttgtaaaacattttattgagcaaaacagtaaaactgttgagtaattaaagtaacattaaatctccactgatcaacgctacaccacgttgaacaggcccaaccaacccacctggactacagtgcattgggtcgatttattaagatgggactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcgatgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttcactgccatgggtgcgactagcaaaaccatgcacccacagcccaccataaagtcgcattttagttggataattacgaccatgaagcatggccaggtgtctcgagcacgcagctcaatctgatactaaaaaggtctaatactgcaattatcccatcaactgagctagtggtatttaagcatggctaagcatatagttctagctaagtcacataagtaacatgagctagtcgattcattacccaaagttgacaaagaacagatatcaagtaaacatggcacaagcgagcagataggtaataccctgaccccatgtaattagcaaaatatgcatatttatttgcaaacagtaaaacatttgtaaattgggatcaacatgctcaagggaaatgtgtgacttgccttgcttcttcactttgatcttctgaactcttttcctcgcgaccgcgatcttccgaaacaacggaaactacacgctggcacgcaaaacgaggaaaaactctaataaaaaccaagaaaacagtacataaaaagtaaacaaacatgtagagctcagttttagatgaattttgcaagttgaacggctcaattcggagttcgaatgaattagatatgaattttagaagttttgagccattttaatgaatttctagaattattaccgaattattgcgcacttattaaatatttttacaaaggaaaagcaatcgctgacatcatcaaaagggggaggccggcgccgacacgcgggccccacacgtcagcgggttcaaggggagggcacacggtggaccgcgtccaccgcgacctcgggcgcgccgtggaccaggaccacgggctgtccacggggcaccccaagtcggcaagggaggagcccggcaaggcggcagaggaggacggccggacggccgccggcgacggcgacgcgacgcggcagcgagcatgggagatggccgacgaaggggagaaagcgggaagggagggggagtgctcaccatgggtacgacaatggagggaggcggccgacgaagctcggggcggagggagacggcggcactccggcgacgggtggcgctcgggaaggagtggacgagcagcggctgcacaatgggatgggagaagaggtgttagagaggacggggcggcgtcatggccggccggagagggaaaaaagggaggaagggctcaccggcgcacgggaaaacggacgtccagtgaatttccggtgatgggaagagatggtcgaggttctccttgtccttgcggagccgagggagacgacggcgtgggtcgacgtggacgggagcggcggcggaaggcggctggaggcggtacaggcggcggtcgctcgagctgcgcgtggacatggtgtcacggcggtggttcggggaaaagaggtggaggccggggtgcggcggggagcggcgaagccggtggtggtgacggcgcaacgcggggatggcgggagtggcggcaggggccggctggaggccgccggcgagcggcggagctagagcgcgcgtggggagagcggtacggggcgcgaggagatcgggaaaattggggaaacgagagaggaagctgcagggagtgtttatatgggcttggagtggcgagatcgtggccgagaggggcggaatcgggcggcaaccggccggcgacgtggaggtcaacatgcgcggagtggggactcgatttggcgccgaaaattggggaaaagtgggggatttggtagaggaggtggaggggaaccgattttatgcggtttgggcgcgagggcgtgagcgggaggaccggaatcgacggcgacgtgggcggcaatggcggttgccggcggcttctgctctggagaccgaaggtaggaggagggcctgacaggtggggtcgccgggcccacctgtcggggagggagagagggaggagaaaccagggggttatttagactttgcgtgagggaaaggggaaacgggccgagggggagagagagagagaggcccgagagggggagggcgcgcgggccgcggggaggggaaggattcttgggccgaaaatggcccaaggaggaaggggagtttttattttgttttcttttttatttaattgattcgatgaactttgtgccattaaaattacttcttgagctccgaaaattcacggaaaattccggagagtacattagggcacaaagaatattacaaaatattcccggccatgatttttaaaggaaattttaattccctcaataatttcacttgattaactagctttaacttttatttaatttctagaaaatgccttattaaatgatttttaatcccgaacgaaaatcggggcgtcacacgctgcccctgttcaaactcctcaagcgctccgggccgtttgtatggacggaggaagctgagcaagctctcaatcagctgaaagcttacctcacttccccccccccatcttggtagccccgggaccggaggagccattgctactctacttggccgcgaccccccatgtggtgagtgccgccctagtagttgagcgtgaggaaggtgaacgggagggccctccggcttgcgatggcccctcgtcccccgaaggtctagcgcccaaagcttcctgcccccgggagggccccgaggcccccaagggaggagcggaggctttggcaggtggccctgggcttgatgattccgaggcggtccgggatccccccgggacctccgaacgggtgcgccctgagtcaccagcccctgacagcacgaactagccccgccgaaaggtgcagcgacccgtctacttcgtcagcgaggcgcttcgagatgcgaaaacccgatatccgcaggcccagaaaatgctttatgccgtcttgatggcctcgaggaagttgcatcattacttccaagcgcatcggatttctgtagtgacatcataccctcttggccagattttacacaaccgagagggtactggacgggtggtgaaatgggctatcgagctggctgagttcgatctgcgtttcgagccgtggcgtgcgatcaagagtcaaatcctggccgacttcatcgcggaatggacaagaggtgcacggatcgccccggatatcgcggccgcggccgcgactctcccgcccgcacaatggcaccgtctggcatgatcttgcgagggaggctaaggtgcctgtctgccgtgatgcgggaggaagggagcactgcgtcgccggcatcttgggccatggcaaccggcggagaggtggtggagaacgaggggtacgagacagtatgagttggcgagaatattagagttcgagaagcgagaggacgagtgggcggttggcgaaaggaagaaggcagagactcctcctccgcccccttttatcctcgcctcacccacgcttgcctcctcgtttcgtacccccataactgccctcacgatcttcgcgcccacatttgtctcttcgcatcccgtgcccaatcatcacgttgcccgttgtatccgtttccgcctttagtgcacctgtcaggggcacactcgaggtggagtgcgcaacggccataagcacaagctgggcaaaccatcaccgttaccgccgcaggagtagtaggcgagagaatcgaggcgaggtctaagtgacccccccgattatcgcgcctcaagcatcttcttcatgagcacagtcagaggcggtcaaaccgctgtcatgattggtgcgtcaacctggccacgcgatgatatccttttggattccctgccgggcccacaacccccgcttgaggagtcgtgaggcgccatgtcagaacgatcccaggaaatcgatatctgatatagcgccgggggctactgtcggagatatgggcccggtggtatgtggagtagaggggaattattttccctccggccacgtgactccgcaggttggccccactcgcgcgccacgcgagtcgtagaagcgtgggggggcctcggggcacgacgtcacccctcgggctctcccgcggcttgccccgaggccctcgcccagctgccgcgcggcagagagagagcaagaagggagcgcaggctaaacagccataaatgtgcgacgccccaactgtccctcaccacagttaatgcggtaagggcagagacatgcggcgtgcctagcgaacccctgtccatcggatgtgaccggtctgtgaccggcccgtctccgtcacatccgatggatagggcgaccatgtcctcacgtcgcccttgtccccgacggagtgggggtgggtatgacccgtcacatccgagagccgctcgaggaagggctgttgcgtgtcttcgttaatttatgagggaatgacagggctgtcccccgcgtcgggcggggggcggcgccgggtttcattcgagaatcggttattgcttagcttccgagagaaggcccggtttaaagcccgaaaagtgaagtggggttccccccctggggggtaggtagaggcggcacatgtggcgtccccttaagctataaaaggaagaccctgcccactaagatggggggacgactcccagaaaacctgaacttgagaaggaaaggtgcaggtgcgctctctgaggggaaggaacccttgtaaaaatcatctataatcccaaacacaggagtagggtgttacgctcgatagcggcccgaacctgtataatccgactgcgtgcattcactcctgagagtcgtagggacgagcaagcgactaacgagacgagcctccgcccccggccgaactcacgaaaggggggtcttacgactccccgctattgagggtcttccctcgatactaatagtctgctattgtacccgctctaaggtaggatgttcagattgacgtgtgtagtagaagaataaggccttgtttagattccaaaaaatttttaaccaaaaatgtcacatcaaatgtttggacgcatgcatagggcattaaatgtggatgaaaaaaccaattgcacagtttgcatgtaaattgcgagacgattcttttgagcctaattacgctatggtttgacaatgtgatgctacagtaaaaatttgctaatgatggattaattaggcttaataaattcgtcttgcagtttacaggcaaaatctataatttgttttgttattagtctatatttaatatatcaaatgtgtgtccgtatacgtcaaaaaaaattgggtcaaagaactagacacggcctaacaagcaaaagaacaagagcagtctatggaagatggtgtggaaagtaaagacaccagaaagaatgtttcttcacgtgacttcgcgaggggcggcggcggcccggatccaccaccttgggaatggctacggctgcggtaatgacgtgcagcgacggcgacggcggcagctaccgcgagctcgcggatcccgccgcttcccctccctctctccctcgtcttctttgatccttgtggacgaaggtctcgtgctttctcgccatgcaatgctcaacaacaatgttgttgtaaactatgtactgtacgctttttcccccttgcttaataaaattttggcctgcgaaaaaagaacaacaaacaaaatggacaaggaaagagacgaggatcgcaagcgatgctgatagattgcatgggaatgctgaaaggcatgtggcgctagagtatattctgtgtggagttgcctgttggggacgacacataggtgagatgccgatggattggacttgccgacgagcaactggtggcaaaggtaagcgaaagagcatcagagcgaagtaaggcaccacacacaacagattgatttgcgtataatcctatctttaccacatcgaatgcttatctcttctctatctctatctctgctactattaaaatttgtagtatttatgtcttaatttttcgtccaatgcttattcgtgtccggtttttgtacgtcacgcctttgctctcgatcttttgtttgtaataacttgcctctctgtcttgtattttcctacatcccatgggtcagctctccgccaccagaacgaactcctttgtctcctatctcaagtgtggctaaactcttagcctagttgatgtatgagagcttttacggtgcttgcgaggtacttaaagatattaaaaggtattaaaagatagaacaatatgaaccgttaatcaagaaaggggcaaggtacggaataaaagctatcgtaatcaatgatagcaaagtaagtaactagtaaaatatgggtattttgggttaatcaaatacctagctgaattgatcggtattgtttggtagaaaaagttgtaaatcttccgaggcattttgtctccgatacattttgtatcattcggtcgaaaatgtaaatcttcccatacattttatctccctaataaattttatctcctaaataagttttatcattttctaatatttgaatgtatttttgtgttgtttcatgtatcacaaatttataattaagctggcatgcatgtttctatgtaggtagcgtacgtggcagcaaaattagcccctaaatttagcatgtgttcatgcatgcatgatgattaagttggaaacgatgatgttcaaattagcccctaatttctagtatgcttaacaagagtaacgcaagtacgctcaattcagggctgaggtgagctcaactagattgatccaacatatcaactttatcaaattgatcggtttctgttgtgaaggtgatgagaggctacttgtgtatgaacacatggtaaatggttctcttgatgcccatctatttcagagcaaggctactattctgaattggaccaccaggtataacctagccataggagttgctagaggattgtcctacttgcatcatagctgcaacgaatgcatcatacattgtgatattaagccagaaaacatacttctggatgtatcgtttgctcctaaaattgcagactttgggatggcagcatttgtaggaagaaattttagccgagttttgactacattcagaggcacagtaggatatcttgctccagagtggattagtggagttgctattacaccaaaagttgatgtttatagctttggtatgatattgttgaaaatcttatcaggaagaaggaattcacataaagtacatactgatgacaatagtgatcaagttgtctttttttccctgtgcaagccattagcaagcttcatgaaggagatgtccggagtttggtagacccgcagttaaatggtgacttcagtatattagaggctgaaagagtttgcaaagttgcatgttggtgcatacaagagaatgagtttgatcggccaacaatgaatgaagtggtccgggttctcgagggtttacaggagcttgatatgcctcctatgccacggcttacttgcagctttaacagaatactctgttgtggcttactttgatgatgtttcataagtacttcctagttgatgtaaatagtatttgtcttagaaaattttgaggttctaacatgagtggaagaaaaggaatgtaagctgggtattgctaaattgtaatgcattttttcaataaccaattgtggtaagcaggcattacagcaaagatttggcagaaatagagatacatgaccgatgcatatgttttgttgatgaaactcaacaagttaatctatgccactacttgctgcgtgcttgcttcaaagacatatcagttctaagttgcttattgcaatatgctaccataggtttcaactgaaatatgttaatgtttctgtttcctgcaaaatcgtaggttttcaacagtattccatattagttgctcaatcatttgcttcattccaaacaggtgaatagatacataacccttagtccaaacggactcagaatatctcaagcatagttttttttccaataaaatattttttgctcacctttttatataatatataaagcatggtcttggcaacgatcttgctgagcacatcatgagcagtgagtgaggattggctgagcgtgctgatgcggacatcactccttcggatacacatgacaatcctccaacagtcattcaaggaccgataacaagagttcacgcgcgacaattgaatttagaggtgagctcgttcctatgttctactctgtacgaattcgagaatagattgctacctaatgattatattgtgattaggaacaatagatgggacaaggagacatttggagaaggacttagagccatggaggatcaacgaggacgtccaagtcaaggtggaggcccaaaccaagtcgaactcaagtgcaattcgatgtccaggaccagtctgcactaaaacgggcgcccaggtcgcatacgtgctcggattagggcgttctttatatggatggaaagctaagaagataaactttccaattgtttttgtcccacgtccaaattatttcagtgtcaacagaaatcgagcgaacaatttgacgtccagaatctgtcccagtgctgcgtcaacgtatttgggcctttgggccgtgtatcatgttggaacccattaggggtgcatcgagagggcgttgcatgaccctaaaatctatatatcagtacccattgtcatcttaagggtttggacttttgcttagattattctatcgagaacagtttcgccgctagatcggtttgtaagaccccaactcgtgagcttaatcactcacctgcaattttggttgtattctatctcgttcttgtttgtgttcttcgattggcaaacagggattagccttctcggcaagatcatccgtgtttcgacacgggtgataaccagaggaaacgtggtgctgtgattgtgtggctcaagagcgtacgcgttcaagaagccggatcgatttgtgtcgcgactccacccaaatcgttgtttattagaatctgtcggaagatcgggaaccctagtacacatccacatccttaccatattcagtggttaaacgattccggaagagcaaaggtagcacaggtttgtagggtttcgttttccattggctcatatgcagattttgttgattgtgatgtggttcctatgcaagattgttcacttttgttgggtcgtccttgggaacatgataatgatgctacacaccatggtaggagtaataaatatacttttgtgcataatggaaagaaaattgctttgctacctttgacccctgctgaaattgtataagctgataaagaacgagctgctagtttgaaacttgatgaatctaaaaatcagcaagttgctaaatctgtttttccacctaaaaaggataagctttcacctagctctaaggttgagggaattaagttgaagggtggtgttatgcttgcaacaaaatgtaacattgctgaaatttcagatgatgatatttgctattcatggatatgcaaagaagctttggtttctctagatgatattgctagttcgatacctcctgctgttgctaaccttttgcaggagtatgaggatgtttttccagctgagatacccccgggattaccacctatgagagggatcgatcatcaaattgatttgattctgggagcatcattgccaaactgagctacttatcgaaccaaccccaaggagactaaggaaattcagcggcaagtccaagatcttttggaccgcgggtatgaacatcaaagccttagtccctgtacagttcctgtaattttggttcctaagaaagatggttcttggcgaatgtgtgttgattgtagagccattaataatattactattcgatatcgtcatcctattcctaggttagacgacatgcttgatgagttgtgtggttctataattttcacaaagattgacttgcgtagtggctatcaccaaattagaatgaaacttggagatgaatggaaaacggctttcaaaactaaatttggattctatgagtggttagtaatgccttttggtttgactaatgcacctagtactttcatgcgcttaatgaatgagattttaaggccttttattggacggtttctggtagtttactttgatgatatcttgatttacagcaagtctttggatgaacacatagatcatttacatgctgtttttaatgctttacgtgatgcacgtttgtttgctaaccttgaaaagtgcatcttttgcacggaacgagtttcttttcttggatatgttgttactccacagggaattgaggtggatgagacgaaaattgaagccataaagagttggccggttccccaaaccatcacacaggtgaggagttttcttggtcttgcaggattctatcaccttttcgtcaaagattttaacacctttgctgcaccattgaatgagttgacgaagaaagtggtggtcttccattggggaaagacataggagaagtcgtttgacactttgaaagacaagcttacacacgcaccattgctacaacttccaaacaatggtaagacttttgagttaaaatgtgatgctagtggagttggcattgggggtgttttgatgcaagctagtaagcctgttgcatactttagtgagaagtggcatggtcttgttttgaattattccatatatgataaggaatttaatgctcgtgtacgttctttagagacgtggcgtcattatttgtggcctaaagaatttgttattcactccgatcatgaataatgtgaggaaagataatgtgattgttgatgctttgtctaggcgctatactttcttgtcccaacttgattgtcggatttttggacttgaatcaattaaagaacaatatgcgcttgatcctgattttaaagaagtgatgttgaattgcaaagagggacgtacttggaacaaatttgtgatcaatggtggatttgtttatagagctaaccgtctatgcattccagttggttccgttcatcttttgttgatacaggaaacgcatggaggaggattgataggacattttggagctaagaagacggaagatgttttggccttgcatttcttttggctaaggatgagaaaagatgttgagaggttcgtggcacattgcaccacttgtcagaaagctaagtctcgtttgaatccacatggtctgtatatgcctcttcttgtaccttctattccttgggcagatattcctatggactttgttttgggatttcctaggactaagagggggagggatagcatttttgttgtggtcaaaagtttttctaagatggcgcatttcataccatgtcataaaagtgatgatgctattcatattactgatctgtttttccatgagattgttcgcttacatggtatgccttctactattatttcagatcgtgatgcaaattcttaagtcatttttggcgcacactatggaagcagttgggtacaaagctattgctttctacaacatgtcacccacaaacagatggacaaacggaggtagtcaaccatactttgggtaccatgttgagagctattttgaagaaaaatttaaagatgtgggaagaatgtttgcctcatgtggagtttgcatacaatcaggaaacacattctactaccaaggtaagtccttttcagatagtgtatggtttcaaccctcgtgctcctattgatatcttgcctttacctactagtgagagggttcataatgattctcaagcacgtgttgaatttattttgaaaatgcatgagacaactaagcacaacattgaaaagatgactgaaaagtatagaattgctggtagtaaaggtaggcaagaagttaaacttgaaccgggtgatttattttggttgcacttgagaaaggatagatttccagaattgagaaagtctaagttgacgcctcgcgctgatggtccttttaaaattgctgagaatattaatgataatgcgtataaacttgagttgcctcccgagtttggggttagtcccacgtttaatatttcagatttgaagccatacttgggagaagaagatgagcttgagtcgaggacgacttcaattcaagagggggaggatgatgcggacttcactccttcgaatacacacgacaatcctccaatagtcattcaaggaccgataacaagagctcgcgcgcaacaattgactttagaggtgagctcgttcctatgttcttctttgtacgaattcgagaatagattgctacctaatgtttatattgtgattaggaacaatggaggggacaaggaaacatttggagaaggacttacagccatggaggatcatcgaggacgtccatgtcaaggtggaggcccaaaccaagtcgaactcggtgcaattcatagtacaggaccagtctgcactaaaacgggcacccaggtcgcatacgtgctcggattagggcattctttatatggatggaaagctaagaagatataatttccaatggttttggtcccacatccaaattctttccgagtcaacaggaatcgaccgaacaagttgacgtccagaatctgtcctggtgctgcgtcaccgtatttgggcctttcggccgtgtatcgtgttggtacccattaggggtgcgtcgagagggggttgcaagaccctaaactctatatatcagtacccactgtcatctttagggtttggggttttgcttagattattctgtcgagaacagtttcgctgctagatcggtttgtaagaccccaactcatgagcttaatcattcatctgcaattttggttatattctatctcattcttgtttgtgttcttcgattggcaaacagggattagccttctcggcgaggtcatccgcatttcgacacgggtgataaccagaggagacgtggtgctgcgattgcggggctcaagagtgtgcgcgttcaagaagccggatcgatttgtgtcgcgactatgcccaaatcgttgtttatcagaatctttcggcagatcgggaaccctagtgcacatcacgtgctttcaatgcttgtggtggagtactctcggaattattcactctactattgcctcaggatgtgatcgggattatgttgcatgttgaaaccaagggggacttaagagattcaatctttttcgcactaatggaggacatgaatcctaggaaaattatctatggtatagtctattaaaaatagaacttctaatgagaaattctactgctaaagtcaagcctattaatagaagcttcatcacacactatattgtgcgggacaagaaagaaagagtcgaagccatggatatcgttgcacgactaccaatgattccataggaaatccaaaatatagaaaacaataagcttgaagtagagcaagtcatggatttcaccagtgagcctttgtttctgtctatcatggctgccaccatagtgaccatagaaactaaaatagaaaaggtagttacttgtctattccaacgtaaatgaacaaagtcacttgagatatctacctctttttctatgttagtttctacggtcaccatggtgggcagccatcacgatgaggcatgagcgattgttgttcttccagctgcaccctcctcatattttcaagaacgtggatttggttctgaagatgaactctatggttgtatgtatgccaacagtatctacttcaagccttttgatttccatatttggatttcctagggaatcgcaaaaaatcttgcagccatatccacgtatttgagcctttgactctttcttttgttatcccatataatatagagtgcgctgaagcttctatttataggctcatctattctttagcagaagaatttcttatcaaaagtcctttattacaaagaagaatgaatcccctcctccctccctccctgatgttaacatacggcttaatatcgatcacatactaaggcaataatagagcgaataattatgagagcgcttcactacgagtagtgctcgatcacatgctgaggcaataatagagcgaatagttctgatagtacttcatcatgagcagcgaaagcatgcagaaccgatcctcactttgacaccaaccagatcagggagggtccaagctagtggtggggttaggcatctagaaagctagactaaatctcattttagtttatgtttggatatcatctggaatttcaataactaatcaaaataagatagagagagagagagaaactcacatcccaacattgagcagaggagggattcggggactgaatccgagcacaaactggattggggatccaggcaaagagcgagcagccaagaactcaccattcacgagcacaacataccgttgtcaccaatgacgtcaacctgtcaatgatggcgagctagtcccaatgccgcatcgacgccactgccacggatgtggatggatggatggaatcatggaggaagttggcggcaacgcgtgggaagccgaggaggccggtgaggcggtgctgcaggcgtagaggaaggaggcagagaggggttggttgtggaccggaggaagcggcgatcgaggaggaatcggatgctgatgtttatgattccaagggcttgtttggggagcttttagttgctacagcttcttccagaatcagaaacccccctaaacagcccagcttttagttcagattctaaaaggctatagttatagaatccagaaaatgaactagtagccaggagttggaaaactagacctccgtaataacaccaagcaaatcatggaagatcaaattcatagctctttaataagttgccccggcatttttcaatccaaaagtcatgacaacccac

SEQ ID NO: 42717 - DNA, 15490 bp, Oryza sativa
aatagataaacaagcaaagtatttaatgaaattttatctagctcaattttatgttgaaatttctcctagtttattagagtttaacttgtaggcttttaaaataatttctaaaaatgatttaaaatatggattactaattttggcgaatttcagggcgtgacaaattccctcccaattaccacccctacccaggtattaaaaaggagggagttcattcctcaattccccatccctatcccaccaaaattctcatgtctcccaaccaaacaaaatagttaatagcctcatccctctaaactcctagtccctcctaaaaactccccccaaccaaacggaccaatataggcatgggtgagggagatcggactccaaacgagcggattttaaccggaaaatccgagggttatgtggagagataaactcgaaaacgaattcgattcggtttatccgggcaaaattgatctccgaaactttaggggaaagaaagaggataaggaggagataatttcccctcaactaattttaggaaaacacaagagaaaaggtcggattcggagggggaaaaccgagccaactcggtctcagtttggctgtcctgaggttgaagacgatactgtagcgacagggagagaaagtagacttctgtcttgggctggctgaaacaaagcaaagaaagaaagagaagggggagctcggctgggccgacttgggctgcacagccgtgcacacaaaggagggagatgggctggaatcaatccacggctctggggaagatttaaaactttttccaattaaaataatcattgaaatgatctttgaattgttaaaaatacttccaatgctcaaatgatttcaagaaaaatcctgaaaatacttagacactcaaagtacttaacaagattataatcagaccatttaatgattaatttaatatgtgggtaattactgaaatgttctttgtatgattaaaattaggaattgagctccgaaaaatctgaaaaaattccagagagtataattaaccatggagaatttaataaaaattaaatccatccatgctttatatttaggaaattttatttcccacatttaacttcacttgtaaattaatgaacatttaatataaattctaataataatttattaaataatttataaatcctaaaacgaaaatcaggatgtgacaatctttatcttgagggagttcttgtttggtaaaaaatcttatgaggggctctctccagtcggcttcaatcatgcttatgtcttgagtgtccgtagcctcagttatttctttccttggtacggttggctcatagagatgctcaacgaaaacgtcggaaggagctgcttctcgctttgaaccgaaattagctagcctgtcggctgcctcgttattgtgccgaagaaaatgggtgagctcaagtccatcgaatctgtcttccaacttgcgtacctcctgtcggtaggcagtcatattatcatcgaggcaggaccactctttcatgacttgattaacaaccaactgagaatctccacgaactatcagacgccgaattcccaaggagatcgcgatccttaatccgtgaagcagcgcctcatattccgccacgttatgggacgcagaaaaatgtatccacaatacgtagctcaatctttctccagtcggggaaattaaaacaaccccggctccagtgcctgaaagcctcttcgacccgtcaaaatgcatggtccaatactccatcttctcctcgggcatgtcttcttggcactcagtccactcggcgacgaagtcagctaaagcttgggacttgatcgaagttcgcggtttgaaagatatgtccaaggacattaattctagggcccactttgcgatccacccatttgcttcgcagttatgaagtatatccccgagtggaaacgatgtgaccaccgtgaccgagtgaccttggaagtagtgagatagtttcctgacggtaatcaaaacaccatataatagcttttggacctgaggatatcttgtcttggagtcagccaacgaagtaaattggtcattggactttttgaacatggccttcttcttcacgctcaacaaccaggactgtgcttacaacctgggaagttgctgacacgtataacaacagcggctcttgcggatgtggcgaagctaggtctagtggagtagtgagaagttttttgaagtcttgaaaggctttttgtgcttcgtgtccccactggaaaaattgtttgttttcttcaacagcttgaaaaagggcatcccccgctcggcgagtcgcgaaacaaactggctaagcgccgccatgcaaccagtcagcttttgaacatctttctgggagctcggcggtttcatgttgaggatggcattgattttctccgggttggcttgtatgcccctatgggacaccatgaatccaagcagcttccttgacggtactccgaagatgcattagggtttagtttcatcctgaaagcgcggatgcttgcaaaggtctcttctacatccgtaatcagatcatccttctgctaggtcttgacgactacatcatccacataagcttcaacattgcggccgatctgagttgaaaaacatatctggatcatgcgttgataagttgctcatgcgttctttaatccaaagggcatggtgatgtagcagtatgctccgaagggcgtgataaatgaagtctttaagcagacggattcctttagtcggatctgatgataccctgaatagcaatccaaaaagctgagtagctcgcagccgacggttgagtcaactacctggtcaatgcgaggcaacccaaaaggatctttgggacaggacttgttgaggtcggtgtagtcaacacacatacgccattgtcctgtctttttccgaaccaggactgggttagccagctagtcgggatgaaggacttccttgatgaagcctgctgctaacagcttggtcagttcctccttgatcgcatctgtgcgaagcggcggagtcgttgcttgattggtttagcatcttccttaacatgtaaagagtgctcaatcacctctctaggaataccaggcatatcagatggtttccacgcaaagatatctttattattttgaagaaaggtgatgagcgcactttcctatttacaatctaactcagcgcctattacagcagtcttagtaggatcagagggatctagaggaattttcttggtcttggcgtcactttctccgctctttggtatcttggttgcaggcacttctccttcgcttactgtggacgcagccagtcggatttcttctcgggcgagcgtgatctcgcgggtctgggccatctcgcagctttgcttgtcgcacgtgacggcttacttgatgtcgctctggagggatataactcctcgaggaccaggcatcttcatcatcatgtaggtatagtgcgggacggccatgaacttggctaacgctggcatgatacgctgtctcgaaatcagcaactttgaagcaaacgttttatgtgcggaagttctcctgagtgccgaaagtaaccggaagagtgatctagccgagtggcgtagcggatagccctggaatgactccgtggaagggcgcattactcggctttaattctgcgcgagggatctgcatgtcgtccagggttttggcgaaaaggatgttgagtgcactgccaccatcgatgagggatctgcgaagcttgacgttgcgaaccactgggtctaataccgggggtaccacctcgggtggaccactcggtcagggtgatccgagcggtcaaacttaattgttgtctccgaccaccgaagatattggggcgtatcgggcagaacagcgttaatctcccgttcggtcagcttttgcttcctcttagattcataagccaggggtccgccaaagatgtggttgagttccttgcgatggtcttgaaaaccagttggggcatcatcgtcatcgtccttcttcttcgacgtgccctgatctccgtcggaggccttacgtgcgttcttggcgtattgttctgcaaactgtttgtagacgaagcaatctttagccgcgtgaatggaattgggatgatgcggacattgggagttcatgatcttgtcgaaagtgttgacgcgcgaacgttgtcgggaggaaggtgtagtagttgctacaagttccttgggcttacgcttacggtccttgtgattggtacttccactcccccctgtagtcggcgtatctttctttggcttccacgtggtgcccgactgcttggacgcgataatggcatcttcggctttggcatacttgttggctttttcaaacatctgcttgaccgtcttgggaggcttgcgcccgaacttgtcgactaggtcttcgtgacgaattcccttggtgaaggcggcgatgatgacgttgtcggtaatgtcagagatcttgttgcgttgctcagaaaagcgtcggatgtaatctcgaagggattctctaaacttctgaatgacgttgtagagatcaaaatgtgtcccagggcgttcaaaggtgccctggaagttggcgatgaagtggtcgtgaagttccgcccatgatccgattgtgccatggggtaacccatgaagccaggaccgggcagaatccgctagagacacaggcaagtagtttgccatggctttgcagtctcctcctgctgcgcgaattgcgagaccgtagacggtgagccaggactccgggttagtggtgccgtcatacctctcgattccagtcggcttgaagccggctggccaatccactcgacgcaggtcgcttgtaaaggcagcgactccatccacgtcgtcgtcgtggtgatccggtgaatggtggggggcatagctgtaacataccgaaaattaaccattttctaattctgcatcatgctgagtcttatgttcttaataacgtcctaaacataggaaaatataattagagggaccttctaaaacttacttgcataaaatctctttctggtatttaacttcttttgtgtttttcatttaaaatacatgtggttgaattgaggcatttcttgatttggtttaaaaccttcttttgactaaaatttctttattcaaaattagtttgaaaaccctttctatttttttatggattatggtccaagaaaccttcccaatttttcccttgaacctaaaccaaagtaattccaattttattggaattaattgttagcctattctttgatcttaaacctatcctttgattctcgatacaaatatccaaattcttccttttgatctagccactgatttaattcctgtggcttgatttcctcttcggcacaagaatagtattattgcaaatattgtgaataattgctcttgtgctaagaaaataccaatttatattcttcactcaactttcccttttagccacaaatatatatcacaccaattttagagtttaaatcctatttattgtcttcaactaattcccttctatattcccaaaaatatttgaggaatattattaatttcccttcctatttgagtgcttccaaataaatgccctcaaactccacctctaaatattgcactcaaataaattaggaaatatcttttgtgaattctttccgaattcgaaacctttgcaaaacctagttatccaaatcaagtattcaaattagacttcctttctttttgtcatcgggccgaaactccattctttcttccttttggcccaatcccttttcttttctattttcctcctccttcttgggctgccggcccagctaagccgagccggcccaaaccagcccacccccccagccgagccgcctcctcctcccgcgcgcgtgccgtgcacggcgcacgccgccgccaacgccttccctcgctgcgaagtaatcggccgccgtcattcttttcttcacgctaccgtcgtcgtgcactccttgacctcctcctccacaaccgcctgtccccaccgacatccgccgcctataaatagccggccatccctcctctttttcatacaactcgagctctctctctctctcttttgccatgcccggccgtcgccgtcgtcggtcgatctcctcccctatagcttccctcctagtttccttgcaccatcggcttcgcctccctccggcgagcccatttttcctgttttccccttctcccccaccccatagcaaccaccactgccacctctctttgccgccgaagacaagctcttgactgcgctgttccggccaactccttcactctctccaacagccaccgccctccccgggtgtgtcttctcgggaacatgtgtggccactgacgtcgccgccttccattcgccggaaaaccggcgcccactctctccctctcctctgtaaccggcaggaagaaggagaagaagagagggagaagaagacgagagaaggagagagaaaaagaaaagaaaaaggaaaagcattgacaggtgggcccctgcacagtaactcttcgtattttctctatttaattcaaatcctaatctttagaagcccatatctcctaaaccgtagatccgattgcagtcaaacttggatctaaattcatataaactcaaaatctatattttgataccaaatttgctattttaagattttatttgaatttccttaatttattcaaatactatttgaataaatatttgattaaatcttataattgaatttacaacttaaatttatatttgcttttcaaatattttcttttattccaaattacccctttagccactaaaaatccgccggttggaactttacgccttccatggggacgttcgcggtttactatccccgacgtcggaccgttggttgtaaagcctggcaaaaaccaaacctaaggtcgaagtgctgctcctggcaccccacgccttgatgcatatagtggttggagcttcactattccctcgacctctacagcacgccgcacagttagctcttgggctctgtgtgatcctagccgctccgccgccactcacggttgtcggagtaacacttccgccccactaaacccacacaaacttcctatccctctagccgttatgctatctattgacaccggctagagaagataccaattctagtcgttatactgcccaactctagcaacgaccagcaaacacccaaatcctagccgatattcatcctacctcgatatcggctgcttaatcaaatgaaaccccagccagcctgctatccaaactccgtaccaaccatttacccttctactacccatagcctatgcataaaatacgagccgatatgctatcctatttcagcatcgactcgagaacaactaaatcctagccattcttctaccaaagcccaacctcgaccaatgctagccacatatccacttaaccagttagattattcggtatatcccctattctccaagaaaccaaaaaccacacataaaatataagtgacaattgttacttaatcccctctagcctccaacccttcagaacctacacatattagcccaataatccttacaccctataaaggagataggttataccctaaaccctagtccttttagttgtttatcgttttcttgttattttatggattttattgaaattggttcttcctctttcttagtagaatctattttattttggatggcaacctgtggtatttcgaagatcggataatcaggttgtctatcttggatttatttgcgttggagcaaggcaagttattattcctcccttgaagataattaccctatattctatatttctattctatgcattagccattcatgattttgaatgcataacctgaacatatagcaaaccagatatgctagcttttgcttagccctgcctagttagactgcataaaaatataatgaacttagattgggacagtacgtaagatttggttgatttccgggtggctagtattgtctcagtcgatataagtttataccaaatacttatgtcaaacgaacgagtacgaccgcagcttctagaatggggacagacctagatattatgttaattagcaatgtggtacctctgtacagtggttccttttgtaagtcctcgcgcaggaggcaatcttatgccgagcagggcatcttatgatatttaccgaggcgcaggtaaatatactgattttcgctcatgagctgtgtgtgtgattttatggaaacctggttgagatgacgtggggtctctcatccagttctctctaaaaaccccgggaacgccagaactcctctcgctgctgataacgttacgttcagagcgcatggggactagagttcatgaaacatgtgccactattgttaataacctaatactgggccatgactaagctaatgaatattggcaagtcgtggactgcgggtaaagcgtacatctattgcagtagaatatttatgaaactattcgaatagctgtgctcacggaattgagtatcgggactcatatggtatttggttagaaacttaattccatattttattaaatactgttgcatcaaacacattgcaggatttctccttctatattctctgctttctgcaagtaatcatagccctactcaaatactactaattcatacattcatattgaatataatagcttgctgagtacattgtactcacccttgcttcaaccccctttttcagagtccatttggagttcttatcaaagccgggagttcaatcacataagttagttccctttaaacctagtcttgaaatctagtattgttagacggtttaactctatagcaaaacattagagttggttcattctatagctcctgctgtattagttagccacaagtttgtaaatacccatgtattttataataatatctcccttggagccttgtcaaaatgtatgcaatgaagatccagattgttgaacctttatcaatctattgatccagggcttgatacagtgtaaacatgtcggtttctgaatcgttaattttgggacccgacagcgctggtatcagagcatatgttttctatagccttaaacccataggttttctaacccctctaggagtaactttactacatatataggataatcaggttaaaaactaaaattttgcctaataattttgctaaggcctttgttaaaatgaactccccttcatcgttggttttatttcttgcttttacttgtgcatcatatcctccttcaaaagagtagttattttatagtatattataaacccctccgaagaaccttgtcctggatatttcaagaaaggcagttagtataaaagttcagttatgctagtatgaactgatttattacaacaagaaacacaagttattgaagaattatttgatgaagcaattatttatccttatcatcaaagaagattggaagataagttattccattttaaggggggtagttcaatataagaattatcaagattcaaggagccattatattcggacatgaacaaagttttgaagctcgtattatgatggagaaataaagaatatacattatataattttggaatctggataaaagaagtttctgagtactattatggaagtattggctattcgagagaaaacaatcggagatattctaccagtttacaagacattatatatatgcctatcagactaggagaatatttataagattaaaaaggagggagaatgttacgttttatgctatgaagcaagattttatgcaaagcaaggatagccttaatcttttaatccctatcaagacctattgttaatgtccatgtcatcaagaagacatacagtatgaagccaagtgatagttcaaatgcttgagaagcaccaagatattttcaagcaaacaagtgatttagaatgaagaattgctgagattatagaaatcaagctgaagaacttctaaatatacaagactatgaatatttaaaggaccccaagaactccaatttcaggaaatggaagatcaatagaccggtgatgacaacaatcatgcaaactgatggacacattatgaagaagttcaatcaaccgagaagactcttgctccgtgaaggtatcagtaatgttcatgaaagccccagaaacatttataaaccacctctactcccaaactttccaaacacctccaccaaacccaaatcgtacaagctctataaccaaaaaccaaaccccacagaatagcttgtacaaataagattttgtacccaaggcatcttctacccaactcaaaaatggatatagcctagaagagaacaatctcttccatcaaaaaatcccctatgccatcataaaccataaatagagccaattgtcaagggatacactaatatgaggttataagcatacactgagaagtggttatattaatattgagcattgtgtggagcaataatttcatgaaactgagaactcccatttggttaaggtaatttcggattttaaggtcaggtatatgagttgcatattctgtatacgaagaacctggaagtcaaccatccttagaattgaacaattcattaagaagaataaatgaagctacagaaatcgcttgcagagttaaccaggaccgaagcggcgatcatggtcttggtctggttcaagatgttgacgacgtgattagcttgattgagtgcgtcttccttgaggagggtgtcgaggagggtgatcgctgcaaccgcgttctattgaggggtgcgaaaaaccgcagttccctcgatgtcttgctgcccgataagctctcgtgctcgtcgcttggcgtccaaggcccgttgccatcgatcctcagcctcttttgcagcccgttcgtgttcctgttgctcacgctgcagccgttctcactcttgtgcttggcgctcctcttccagtcggtgtcgttcggcttcctgttgtacgcgtagttcttctgcttctcgggctttgcgttgttcttccgtctcgttgtcagccatgaagatgccgaagtagagaggcgtatagttgtcttcaaagccttcgtcgaagtcgtcaaggttgcggtagtcgtagcggtagccgaagtcgtcgtactccacgatctccgtgggtcgcgagtcaacgccgggggagctgaggtagccgtccagttgttccgtcgaaaccgtgccgagtggctggagtatgacgccgacttccctggagctaggccggaccagggctgaagccgtgttccgcctaggcctacagggagaagacgcccttgtggtgaagacagcagccagatcatcggggagtttcatcaggattggcggataggccccatcgtcttgattgggtcgttttgaagtagattggatctcgtccgagtggtttggagccaactcagtagagatgatcttggggtagatctcggtcgagttcgggataccgaacggagcggagatctggtctcttcccgactggttcgaatccgagtcgaggagagaaatcttgccgaagtcgttggtgatgaagtcgaggctgccgaaccggaacgcatgcccaggagggaagacgaagtcgtcgatgccggagacgaaacgcatcgcactaatcaacgaagaacttgacgctacccctacctggcgcgctaactgtcgaaacaagatttcggcaatactaaaagggggtggctatcaagttggaaaagtggatggatttagagacaaggaattttatacaggttcaggccttcttaatcaagaagtaataccctactcctgtccagggattgatccgccgagtatattattgatcgtatgatctgggagaaaatcgtgcccctagaggcacccggacccctccttatataggggaaggagtccgtattacaaaatagagtccatatccctaacggaataggtagttacagataaattacaatcgtaaccaagtaggatctcggatatttccttgacatacaagtttagaatttaacccgagtccttttaaagatattctatctatacatggcaccccatacccagtcggactatacatgccgtgtaggtatggggtatccataagctccacaactataataaaatttgtttttttatgttaggtttgtttattcttgctgccccctcagggggtaagagagacgagagaacatctatttttcttctgtgtcttcagtgcgcaatgctggagtgttttgggctggtcttggagttccaatcttacaggataattcaatctcagagctcttccttttcgaatgcctgtttcatggaactcctactacttgcagtctggattatatgggcccgtttagttccaaaaagttttttctaaaaacatcacatcgaatctttggacacatgcatggagtattaaatataaataaaaagaaaaactaattgcacagttacgggggaaatagcgagacgaatcttttgagcctaattagtctgtgattagccataaatgctacagtaacccacatgtgctaatgacggcttaattaggctcaaaagattcgtctcgcggttttccggcgagttctgaaattagttttttcattcatgtccgaaaaccccttccgacatccaatcaaacgtccgatgtgacacccaaaaaattttcttttcccccaactaaacacgccctatatatggaaggaaagaaataatttgattttcaatggagttctgcctactgtagcttcctggaagcgtaacatgaagacagatttgagtctacatttaattaggctcaaggaggctcatcgtcccatgattcaatcatggatattgatactttgtaaccttgtgctcttttgttcctttctgttctttattaattttgtttttatttggctgtgtacataactctttcttttgatatatttaccgtggaggctttctccactgtgttccttttaaaaaaaacagagagagtaatgccctgttctataattcaactgaaaacttcaacttccttatttttagttagcacgcttttcaaactgttattttcaaaaagtttctaaatagaagttaaaaatagtaaataaatctattttttaaatttataataattaatactcaattaattatgtgctaattaggtttatcgttttgctagccataaaaatttgtctctattgtgaatagaattgattgagcgagagagattgagtgagagagaattgcacacaagtgtagagaatgaatgagcgaatctttatcgataacaatggttacaatatatagggggagagaggcggcaacagaagacgcgatggtttgggaaccatcgcgtcccttgttagaatcgccgtgaggcgagaagaggtgtggggcacgaccaaccgtcgtgtcccagatttattgctgctctatccatatagatggatgagatcaaccaaatatttcataacactccccctcgatcgaatccagctttgatcattgctcgtttagtgttccagatatctgtaaagataatcttagaaataattatagttaaatatatcacgtaaaactcctcgaaaaacccagtgggaaaaataaggagagaaccgtgatatatattattgactattttagatctacgagtaaagctcatagtttgatccaaaatagtataatgtctacagttatcatttagtaaaaaccccagtggagaaaaatcaaatgatatgacatataagcttatgttgatattacctcgttaaaaactttggatgagaaaacctaaagggtaaaactcatacaaaggaaaaagagtataatatgacgaaaataggttatttaccagaggaagatactccctctgaatcctgcaaatttttaagtcgtctcataccaattccttcgacacatttaaagaatgtggagtatggtagagattttgtgaataaatcggaaagattatcacatgacttagtttgcaagatgtttatctctccatgttgctgaagctcatgaggataaaataatttaggagcaatatgcttagtgatgttgctcttaatataaccagtttccatctgaacaacacaagcggcattatcttcatagataaaggtaggtgattccaatgaaccaataccacaagatgttaatatgtggttaaccattctgcgaagccatacacattcacgtgatgcctcatataatgcaattatttcagaatgatttgtggaagtggctaccagagtctgtttagaagacttccatgaaatagcagttccaccctgtaaaaatacgaatcctgtttgtgatctggcgttgtggggatcagatagatagccagcatcagtatacccaattaaagtcgaaccctggttctttttaaagaaaagtccaagatctcttgtgccattaagatatcgaaagacattcttaactccagtccaatggcgtttggtaggagcagcgctatatcttgctaatagatttaccgagaaagcaatatctggcctcgtactatttgcaaggtacataagtgcgccaatagcactaagatatggaaaatcaggaccaagtacatcctctccatcttcctttggtctaaatgggtctttctccacgtctagagatcgaaccaccataggggttttggaaggatatgacttgtccatattaaatttctccaacattttctgggcatatgcactttggtgcacaaggattccagaaggtaaatgctcaagttggagacctaagcaaaatttggtttgacccaaatccttcatttcaaattccgtctttaaatgatgacgtgcttcattaatatcttgtgtattgccaatgatgttgagatcatcgacatataccgagataatacaaaatcctgtgggggactttttgataaaaacgcatgggcaatcatcatttttagtgtaaccctttagcgaaaggaattcacttaatcggttgtaccacatcctgcccgattgttttaagccataaagtgacttctgcaacttaacacaatacatgttacgatttaccttctgattcgggatgtcgattccatcaggaaccttcatgtaaatatcaaaatcaagtgacccataaagatatgctgtcactacgtccatcaactgcataaatagacgattttgtactgccaatgatattaaatatcggaaagttatactactcataactggagagtaagtttcgttgaaatcaacgccaggtttttgcgtaaaaccttgtgctacaagccttgctttatatctcaccacctcgttgttttcgttctgttttcggacgaaaacccatttgtatctgacggagcgtggggcttctcaccgggagaccgcgcaagcccccctttgccggttcggccgggggccctgggtgagattctaagctcctagtctgtggaaagttcgcgagaatggaaaaagcacaagacacgggcgatgtatacaggttcgggccgctgagaagcgtattaccatacttctgtgtttcggcggatctgtgtatgaagaagctacacagtgccaaccagcccccgatcct

SEQ ID NO: 42718 - DNA, 14491 bp, Oryza sativa
  unsure (1)..(14491): unsure at all n locations
gacccccccccccccccgggggggttaggccacgtgagtgatcgtgtctgcctcaagtctctaagtcatgatactcccggtcccatgtcaccgacagtagcccccggcgttatgccagggcgattgccctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcgtcatggcacggggctccgctccgcttgacggtagcgtgctgccgccttcccgcatcgtgagcgagagacaggccgggctgccgcgccgcttcatgccggaatctgccaccggccgggagatagtctcgctgggcgagggatgcccggcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgtcgtcggtggttggtggttgctacttccagccgcgggggccggtgttgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggttacgacgccgtcctcgaccgcctggcgggcctgcgatcccaagggctcacaggggccatggtgttcggcgactatcttcgtcgccggatcgcgccactccagcggcgcgcccggggcgcctgggagtacaccgggtccgaggactgtatgaggacccaccggggggtcaaatgggactgggtccccaaagacttcaaggtaatgatccaacgggtgctgaatctcagctccgcggaggcatccctcatcccccaaggagtcctccccctctgcagcgatccagatcgcgccaacatcctgaccatcatgcaggcggtcggggcgtcggaggagcgggctcctcgaggccacgatggcgcgggcgggagccgcaggggggaacaatctaccccgggagggggtcgtgcttctgggccccgcgacgggggcccggggagcggccgccctgccgacacccgagggaagaggaagcaagagggtatttcctccccatctcttccccgagggggcagggcggcgcgtgacagcagcaggcgcccggagggggccgcgccgacgctgcagcccgaggaggagcggaagaagaaacggctccgcaagatgggggggacagaaccatcccggggaaacctcatttcccctccaaggtggtcgtttaaccgaccccctcgcaggttcgtcccacgcccattgtggctgtattcattcttccaacacaagtttttattcacccatcttgtttgtcttctggcttttcttctgcttcagcgagatcccgtcgcgtccctcccgccattccaaatccggccagtctgaggccgaggacccggcgaccacagaggctcggaggcgggaatctgaccggcgagaagccgcggatcgccttcgggaagccgaggaggccgctcgggaggccgcccgggctcgccagaccgaggaagccgctcgggaggaggccggactccgccaggccgaggcgacgacatcctccgaggcgacccgtgaaactgaccggcaagaggccgcggatcgccttcgagaagccgaggaagctgcccaggtggccgtccgagctcgccaagctgaagaagccgctcgggaggaggccagacttcgccaggccgaggcgacgacgacttccgaggcaactcgcgacgaggccgcgggcgcatcgcttgggcccactccctcgtgcgacgctcaggacaaaccaggtccgggggacatccccgagtccggcacgtccatcggcgggccaagccgcgcggcatcctcttcgaggcggctcttccccacgccttccgttgctccactgagcgcagaaccccttctgcagaccttggccgtcgcaaacaccacggtgttggacgggttaagtgcccaggtggaggccctgcaagcagagcgggcggagctcgacgccgcatgggcgcgtgtcaaagaggggcgacgctcggtggaggccatggtggaggtgggccgcaaggcacaccgccggcacgtctcagagctcgaagcccgtcggaaggtgctgggggagatcgccaaggaggtggaggaggagcggggggctgccctcatcgccaccaccgtgatgaacgaggcgcaggacaccctccgccttcaatacgggagctgggaggcggagctagggaagaagctcgacgccgcccggggggtccttgacgctgccgctgcccgagaacggcgggcggcggagaccgaggtggcatcccggcggcgcgaaaaagcccttgaggcccatgccatggcgctggaagagcgtgcctgcgccgtggagagggacctggcggatcgcgaggccgccgttgctatccgggaggtcaccctggcggtgcacgaagccgcctgtgccgaagaagagtccgcgctccgcctccgcgaggacgcgctcaccgagcgggagcgagctctcgaggaggccgaggccgcggcgcaacgggtggcggacagcctatccctccgcgagactgcgcaagaggaacaagcgcgtcgcaatctggaaagtgcccgcgccgagagggccgcactgaaccagcgggccgctgaactagaggcgcaggcaagggagctggatgcaagggcgcgtagcggcggggcggccacgggcgacagcgacttagccgcccgcctcgcagctaccgaacacaccatcgcggatctgcagggcgcgctggattcgtccaccggggaggtcgaggcccttcgcctggcaggcgagatagggcccagcatgcttcgcgacgccgtgtcccgtttagaccgcgccgggcggcaggcgggtctctggggcgggcggactgtgaagtacgccgccaaccaggggggcctcgcccagcgcctctcggagatggccgggactctccagcggctccccgaggagctcgaggggacgattaagtcatcctcgagggacctcgcccgaggagcggtggagctcgtactggcgagttaccaggccagggaccccgacttctccccatggacggcgctggacgagttccctcccgggaccgaggacggcgcgcgcgcgcaggtccgggatgccgccgaccatatcgtccacagcttcgagggttcggccccttggctcgcgttcgccctcaactccgacgaggagggcgatgacggcggtgtgggcaacagtggcgacgaggctggcgacccgggtgcatcggagtgagcccccaggcccccgccaatctttaaatagtttcttcttttcttcttccgaggccttcgggcccccttcttgtatagactaatttaatctgcaatcaaataaagaggaaattttttgtgtcaattctatttgttgtgtgtatgagacgaggatggtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcaccacaccccggggcacggctcggttctgggccccgtttggcgattttagccgacccgagcccccgagggcaggattgaacacgagtgacctatttcaagtcaagatccttcaaaaggaaacaacagcacagatacagcctttaggaaatcgaaaatgcttttattgagaaacagatataagagaaataagaatatgcatgtgtggtagcccccggccaaccctgcacgcccgaggggggtgcggggttggcccgagcccgaaacctgacacccgatccccctttaggggtagaagcgacgaaggtgttcgatgttccacgggtttggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccacgcgccgccttcgctcttccaagtagtcgaggtcatctctgcgaagctgatcttgatcagcctcgcagtacatggtggcccgaggggacctcagggtgagctcagatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcattggcgcgctccacttggccgttgcttctggggtgggcaggtgaggcgaagcagagtttgatgcccatgtcttcgcagtaatcgccgaaaagttcactagtgaattgggtgccgttatccgtaataatacggttaggcactccaaaccgggctgtgatgcccttaatgaatttaagtgctgagtgcttatcgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcattcactcccttcgcggtcctcgggtagagtcttatctgtgaggtatgcttggatctcaacgatccaagcaatcaatctaagggagctgggagcgctcccctcgggtcccgaggcctggactccgacgggcctcgggggcctatcaggcgcgtccgtctcccctaaggggtcgggtcgcgccgacggctgggcaagcctttcttcaaaggcgcccggtggggtctgggctcgcgaggaagcgagccgtgagagttcatcggcaaccgtgttatcccgtctgggcacgtgccgaagctctatcccgtcaaaatggcgctccatacgccgtacttggcgcacgtaagcgtccatctgcgggtcagagcaccggtactccttacagacttggttaacgaccagctgggagtcgcctaacaccaggaggcggcggatccccagtccagctgccaccctgagtcctgcaaggagtccctcgtactctgccatattattggtcgcccgaaagtcaaggcgaaccaggtatctgaggacgtctccgctcgacaaggtcaacgtgacccccgcaccggcgccctgaagagacagggagccgtcgaactgcatcacccagtgggcggtgtgaggcaactgcgaggggcccgagctggcctcggggactgagacgggctcgggagctggggtccactctgccacaaaatcggcgagggcctggctcttgatagcgtggcgtggttcaaagtgcaaatcaaactcagaaagctcgattgcccatttcaccacccgttcagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcatcccggagggcctcactaacaaagtagacgggccgctgcaccttttggtggggccgatcctcttcgctaggggccgcatccctggggcgctcttcacccaagcggcctcgcggggcgcactcgtcttctgtgccgacgacctcggggtcggaggacgacaggggcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccaggtcgagtcggcacagggttagcctcggggtcagagggcgataggtgcggccttcccgcagtggccgtcgggccatcctgggggtcgggggcacctggcaccgtctgacaagcgggcagagggcctgctccggtcgtcgggggccttgggccaccgttcggctcgggggcctctcctccctgctctctcccgggccaagccagcacatggtgggggtgcgcggaatgaggattgtcctcatcgcgctccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgagccgcctaggactttggcgtggagggggcggtggagtacgagctcgacggcgtgggtttggctccccgtcgtcaccgctaacactcggagagaggttgtgcgcctttgcttgttcggccattgggctgaacaggaaaagcttggcgcacacgaaagagtgcgagagctcagaagatcactcgcagagccccctacctggcgcgccagatgatggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttttggtggatctgtgtatgaagaagctacaaagtgccagccagcccccgatccttctgggatccttctccctcctttttctctaagtgggcaaggtcctccttttatatctcaaggggataccacatgcaccatctctccctctctttcttttgtgtggggactcatcctctcttccctccaacttgacttctcttcattaatggacggagatttgtatggctgccgtccgaataaccttctgatgggacggcccatacctacctccacttccgccggaagcaggtgcgacgtgggaacatggctgtctgctgacgacatgaccattgtcagaccggtcacaaatcggtcattcttgtccaccacgtgtcagtttaacaatctgcatgttcgccctttttcatacaatatcttgtctgtaatggttaggatgaagcctggcatatatctgaccgggaccaacgtgccatctccaggagctaacacgccggctccggctagggacgagtgcttggaggcactcatcctgacgggacggggcgaggcgtgcgtcagaccacctgtcgccacctaacccacgatctgaccggtctgtgactgatcacagaccggatggacgagcacgctgcactgcgttacatgcggcgtgacgcgctcgtccaaaccgcaataaatgcggttaggtgagcgccgntgggctcacctaacccatacacgcggcgcaaaatccacaaggggtcggggcgccccagccctcggggccgagacgggagcggtccgacccctcggggagacaaagagaagggcggccgtatcaccctcgggcccgacccccccgggggggttaggccacgtgggtgatcgtgtctgcctcaagtctctaagtcatgatactcccggtcccatgtcaccgacagtatcccacaggaaagataccacgaggagtaggcattacagccgagaatacatctcttttataaagcgaggctaattctgcgtcagttgcgtccttccatttgttccagttagagcgcttttggcactcttttatagacctaggttctggatcaacttggaggcattcagcaatttgttcagaaaaattagtgtcgacaattgtagctcttctatcaaaagattctccagtttcagagtaattgatggcaatttcatcaacccttatagactcattgtgatctcccgaaacaatgtgtctatggtcttccgaattcctagtctcagcattgtgcaccaccgagctaggttgcagactatcacgatctgcttgacatatagtatcaatttggtgtgtaccaactaaaggttggtttgcatttaccgtctttctttgcttattagcaattgtttctcgctgagtggtcatacttcttcctctctttttagtgagtggaagttgagtggttttatttggtacctccactctttctggcgcattctgagcgggaatgaaagatttagtcacacctttataattggtaaatgaatctggcaggttatttcaagtctttgcaaatgtataattttctgaacttgaagttcagcttcagtagtacgtgggtctgaggctggaaaaccctgggcatcccaatcaatttcctggcattctttctggtacttgaattctccccctaatgccgggaaatgttcctcatcaaagatagagtcagcgaaccgggcagtaaatagatcacctgttaagggttctaaatactttatgatcgacggagatttgaatcccacatagatccccactttcctatgtgggcccatagcggtacgctgtggtggtgtgatcggtatgtatacagcacatccgaacttacgcaaatgggaaatacttggaggatttccacgtactaactgcattggggaagtttcatgatatgcagttggtcgtagttggacaaggtcagcagcgtgcagaactgcatgaccccaacacgacgaaggtaatttgcaattcatcaataatggtcgagcaataagcttaattcttttgatcaatgattcagccaaaccattttgtgtgtggacatatggaacggagtgctgaacctgaattcccaatgccatacaataatcatcgaaagcatgagatgtaaattcggcagcattgtccatacggattgattgaatcctatgttcagggtaatttgccttcagccttataatttgtgacatcaatttggcaaaggcatggtttcgtgtcgatagaagacacacatgagaccatctagtagatgcgtcaatcaaaaccataaagtacctgaacggtccagatcttggcacaatagggccacagatatctccttgaatgcgttcaaggaatttaagtggttcggctctgattttgagataagatggtctcaaaatcagtttcccagtagcacatgcagtgcatacgaaatcagaggatttggaaaatttgtcagtgatcaaatgatgaccaatagagttgccaataatttttctcatcatcccgataccggggtgcccaagtcgatcatgccaagtgtggaatgcatcaacattttgaaaaattactttgtacgcaacatgtgcaatgggcttaatgtatgtatagtacaatcccgatgtgagagatggaattttctcgcaaatgcgtttgccatatccgttttgtttggttaagagaagaaattcttctcgattatccatatgggtttcaatgtgaaacccattttgacggatatctctataacttagtagggtacgggttgaatcaggatacaataaagcatcctcgattgtaatttgtgtacccattgggagtgtaatagttgctcgtcctgagccaactatcacagtatcgcgcccagcgatagtcaaaactttgccttctctctttttgagagtttgaaagtatttgatctccctaagtatagagtttgtggtaccactgtccacaagacataattcctctccaatcggagcgatatccttagacatctataatgaaagaagaattgcatgattaagaattctttatccaatatatatacatacatacaataattaaaacatcaaatacatagtatgacgtttacatatgttaatagtacatactctaatgactagcaagccatacaaccttacaatacaagggagttcgtacttatctacttattacaaccaatattatttggcaaacttataggacatcaatatactgtttcaagcacactgagataagggcagcttcatctccaagtgggacgcaccgagatcattgcaaatctccaagtgggtccgttgagcagtattcgatgaacatatcatccatcgtagagagtggagcgacatcttctgggagaacattgaggttgctctctggttcagcaggagcctggtgagaacttgcaacctcagggcgctcttcatgtgtgagattgaagtgtgcttcaaatcttgggttctcagaagattttttgtccttgagagatttttggtacaagaggacaagatgtttcgggatgcggcagtctttagcgacatgagtgtcagatccacacctgttgcaatgcttgttgccattgctacgaggttgtggtgccttacccttcccttttcctttctttcgacccttgaatttgcgcctgttgttgttgcgtttgcgctttccagttagattcttaggattattcgaagaatttcccttgaatcctttcttattctcagcattattctgtacattgaagtgcacctcaggcagtggagcagagcccggtgggcgctgttgggcttctttaaagaaagctcatgatgtctttctgcctgagtcaatgtatgtataagcagagaatgtttctggaaattgttaccgcgatactgttgagtcagtatcctgtcctcctgaagcatagttgatagagttttctctatcttttctgcctccgttggctcttgttcgcaaaacttcaacctggaacaaatgttatgaacagcatggttgtattctgccatagttttaaagtcctgtaggcgtaaatgaacccactcataattagcctcaggccaaatgagttccttttgctgatcataacgctcttttagagctttccaaaggttgagagggctcgtctctaacatgtattcatgtttgagatccttgtgaatgtagagtctcaaaagaaaaagggttgtattgagcttcctaggctcaattgccggatccccatcattaggttcctcaattgtatttagaatcccccgagaggcaaaattgattttgatatcagaaacccagatgggatagttagtcccatcgagggcgagttcgtcgaactcttttgttgccatgtccctacaattatggttaacattatcaatttacagaggtaaattaataaaaacatgatattaaggttgtaatctcaatgcgaaatgtaaaacttcatattctgtaatgtttcgaaagatgtaggttatggacctgacaattttgagttagaattcgaaattaggtggcacaatgtggataatctccaagtaattaaacagtggagtagatctcttaatagtgggcaagttatacttgctgcctaaaacacggtctccaggcaaatatattctggtgaatatatcgcagccaatgtttaggactccactaccttgtgttcaaccaaatttcaaataatctcatttctcaaaacatattcttggaaaagaacacatgtgggtaatcatcgtgagatgtagacctctgtgagatgggcgaggtgctcgctgcctatgttatgaccagtgcggccaatttctagggctctatcgggtaatcatctcaaaatgtagaccactttatgatgggcgagatactcgctgcctaagttatggtcgatatgaccaaagtataagactccatcgacatgtgattaatttccaagtcaaagtgtgaagtggaacatgcattaaatcctccattagttatgttggacataattaagagaatttgctaaatcaaaatacaaaatttatagaattttgtaaattaataaagcgagaaagtagagcgtgtcttgaaataatatgcaaaaggcatgttattaagacaacaaataaatttagtgaaacagggtatttagataaacacctatgttcataaacatataacatcagtggtctataggaccattacataattgtttgtacaactgatgaactgtttcgactaaattacataaaacatagggactaaagtgaaattactgctgaaaataaaaaataaaaactaaatttaaggggtaaatgggtggtgggccgaaatcaataggattcgaccgaccaccactatctgcggccggcccatcaggcccaaggggagaaggggcgcaggggggcgtgggggggttaagggtaaccctaaccgcccctgcggtttgtgccgccaccgccgccatgacgccgcctcctccacctcgtctgccgccgccgtacgccgccagtgggggaagcccccgacgccgccatgggagtgtcgtggggcgtcgccgtgggggcgccgccggcgcagccgacgtcgacaaccgccgccgtggagcgccgccgtggagcgtcgccgccgccaccttcgccgccgccaccaccttcgccgccgccgccactcgcctccaccgccatctccctttcaccaccacctccaccgccgccatccaccatccgccaccgccgcgtccccctcatcggccggcggcatgccggccggcttaggccgacgatcccgactcctcatcggagtcggagaccggccggacccgaatatcgttcccccccgcccacgccgtttggtatcgtgcggctccgggagccatggggaacggcgatgaaggtatgacgaaggccgggacggcgtgcagcggtggctccagcatggcgacgtgttggatacggtgtaaagaaaggcggctcccccgtgcgcgccgccatggttccggtacggccgaatcctggtggtgcgggagtgggggagcgtcgaaagctagtcgtcggttgcgatgttgatggaggtggggaaggagcggttggtggtgacggagtggcgacgaacggggccggcagcgactccatctccagtgggagttcacacggctcgccgggcattgtcaccaccgccgtccatccatggtaggcacaatactgtaccccttgcacaaggatccggcgaggttgcggtgcttcggcaaccggaggcggaggaggaggtgcgacagggacaggcgggggggtcacaaccggagttgcaggcacatgacgagggtagtggcggcggccaccaaccctcgccctgcctccgcgggatccccggcgcgtcctcatcgatcgacgaagaagatggtgaagccagcgtgcgcgctgatggcgagggaggccgagaacagcatccataatccaatgaaaggtaggcatcgtaccttctttgttgattcttctgtttgcttttctgttagatcaaaagcgatgtttcttcctttcacttcgcgatctccttcgcgagagcgaaagtgctgataacgtattgtgaatagaattgattgagcgagagagattgagtgagagagaattgcacacaagtgtagagaatgaatgagcgaatctttattgataacaatggttacaatatatagggggagagaggcggcaacaagagacgcgatggtttgggaaccatcgcgtcccttgttagaatcgccgtgtggcgagaagaggtgtggggcacgaccaaccgtcgtgtcccagattattgctg

SEQ ID NO: 42719 - DNA, 5011 bp, Oryza sativa
ggggggcaggattacaagatagaaaccttaaccaatacggtatcggtttcctaaatcaggactctaggccgttccgtaatatacaaggaaacgtaacacccaagtcatgatctgttacatattacatagatataagttatcccctataactagtcggataaccatgctgtgtgggtatggggtacccataatctccacagtagcccctgagaccttcacagtcggaaggataaccttctctcgaactagattactccaaagccgagtgcttcaatcatcttcgccatggtctcccgagtacttttaccaaatctgaagactgtggagggctgaaaaatatagtcaggtgcatcgactagatgcacctaataggtgtagcccccgactatgtggttaattgaacaaaccaagcatatagtcaaggaataaataatccaaccaaccgagtggttttaataattatagtcaaccaagcgacctgatattaatatgtagcatatgcggtgtgaatccctgaataacatgatccgagtgatataccgactgctttgtaaaatatgatgagtgtaacctaaagttggttacatcattgaaaattcacatagcaaaacagctataaagaagcttatatattgtgaataaagaaatttccaaagtattgggcatacgccatgcgcacactgctttaacagatgtgcttaagtccctaaaagacacatggtttcaccacacccggaaatatatggcatatgtggtataaaatccgagtaaataaactcataaaggatttaccaaccgcctaaaaaatgaccacaatataatcagcctaagccataatattggtcaataaaaatgcacacttacgtggcaaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgcttccgagtaataaatcttccgggtaatatagaccaagtgtagctcatatgaatagcttctgatctgaatgattatcccttatgggatactccaaaataggtgtaacaattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcgtagtcacaatcgtccattgatggtagctgacgcagttggcatatagacaagacgaccaatatagagataatattgcccaccagaggtggcaacaatactggtggtagtgaagatagtgataccaatcaaaagtaatgaagtcgcatagccatggaggcgaagaaaccagtcggcggcagacagatcaactaacaatgaagatgaaggagcccagcgataaaattgtgtagccatggcagcaaaataatcagtcggtgacagacgaggtagatcaaaggtgatgacaaaatccaccaatcatgaagatgaagaaaatagttgacgacgacaaacgcaaccgacatgatgaagaagacgatgtcggtgatccagccaatagcagtgtagcaaccaatgataatgacaaagacgctcatcagcatttgcatagtaggtcaaccgtcaaggtgaaataataagtcggcgaaaacataatcatccattagcaacagcggagatgtcagggccgatgaagcagaggtgctggtgatgatgtcagtgacaataatccatcaaattagtgttataactgttgtagatgcttcacttggaggagagttgatgttgttgcccaactcgtctaaaccgaaatatttaaagttgttgaagtagaatgtctgctccgaatcaaagatgaagataatgactcctggagttgactcgttggttgatgaattgatttcttcagcctgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcatgaatgttggagagccacttgttgtagtaaaataacacgacattgcatgccgagatgttgaggttcacaaagacgtcgtggttggtgaagtagcaaaacttgcgaagtagcagcaatagagtttgccggtgccgaagataataaagatgaagtcgctctaccatgatgacaaagttgcattgccgtgatgaagtgaacacgagtcggcggcaacagaagcaaactggtagtgaagacgcgcagttgtgaagataaaagcaccagtcggcgacagcataaccagtcggcgacggaaaacgatgatgtttatcagtagtggtagctgtctaaaccagacgtagaggtgagggcactagtcagcagtagacgtagacagcttgcgttggagatgatgatgcctattagcggtgacggtgatgtagccagccatgaagaagatagcatcagttggcgtcataacaggccagccgtgcaggcggtgacaccagtcggcggcggacgatgcggccggtcggtgaagacgtagacgcccaacatcggcggtataacaggccagccgtgcaggcggaaacaccagtcagcggcggacaaggcggccggtcagtgaagacgtatacgcccaacaacggcggcataataggccagccgtgcaggcggaaacaccagtcggcagcggcgaaggcaagccggtcggtgaagacgtagacgcccaacaacggcggcataataggccagccgtgcaggcggaaacaccagtcagcggcggcgaaggcaagccggtcggtgaagacgtagacgcccaacaacggcggcataataggccagccgtgcaggcggaaacaccagtcggcggcagcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcggcggcggacgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatgtatttcttctcttgttaattttgatttccccgagcggatgactcattacgtttaaacactctgcccgactagtcatagccaccaagcactgggagtcggcctaagcacttcccaaacatgcatataagtgacatgagttcgtcattaatggaacaaagtttcatggatcggagtttactactcgggtacttttgcaattattaagagcagaaaataaattatcttatctctatgcttttgatttattccgaataatacttagcaccttgcgttactcggtccatccaacgagcccccgggtgctaggaatcggcccaaaggcaaccatccattggcaaatcaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcggaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcagcgaaggtgagccaacggtgaggatgtagacatccaacaacggcggcataataggccagccgtgtaagcggaaacaccagtcgacggcagcgaaggtgagccaacggtgaggatgtagacatccaacaacggcggcataataggccagccgtgtaggcggaggcaccactcggcggcgacggaggcaagccggcggtgaagtcgtagacgcccgacagcggcggcataataggccagccgtgtaggcggaggcaccaatcggcggcgacggaggcaggccggtggtgaagtcgtagacgcccaacagcggcggcataataggccagccgtgtaggcggaggcaccagtcggcggcgacggaggcaggccggcggtgaagtcgtagacgcccaacagttagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcgaggacaccagtcgcggcgacggaggcaggccggcggtgaaatctagacgccc

SEQ ID NO: 42720 - DNA, 9297 bp, Oryza sativa
  unsure (1)..(9297): unsure at all n locations
ggaggcatgccggcggtgaagtcgtagacgcccaacagcggcggtataataggccagccgtggaggcggaggctccactcgggggcgagggaggcaggccgggggtgaagtcgtagacgcccaagcagcagcggcataataggccggccaggtaggcggaggcatggacgcccatgaacggtggtgtgaccaaccaaccgtataggcgaggacaccagtcggcggcgacggaggcaggccggcggtgaagtcgtagacgcccaacaacggcggcataataggccagccgtgtaggcggaggcaccactcggcggcgacggaggcaggccggcggtgaagtcgtagacgcccaacagcggcggcataataggccagccgtgtaggcggaggcatggacgcccatgaacggtggtgtgaccaaccaaccgtataggcgaggacaccagtcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgggattaaaaatcagtacgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgcttgttgataggaaactcgacgcaacccctacctggcgcgccaactgtcgaaacatgaattcggcaataataaaagggggtagcgcacgagacctaaaagtggatggatgcggagacaaaggatttagacaggttcaggccgtctcaatgagaggtaataccctactcctgtttggggatttgaatccgccgagtgtgtattgatctgacgatcaggttgtctcatatatatatgccccctagagggcctcctgcccaccttatataggatggggggcaggattacaagatagaaaccttaaccaatacggtatcggtttcctaaatcaggactctaggccgttccgtaatatacaaggaaacgtaacacccaagtcatgatctgttacatattacatagatataagttatcccctataactagtcggataaccatgctgtgtgggtatggggtacccataatctccacagcaaccttccaatatgcaacttgtgggaatttggctataaatatcgacattgcacgttgtgcatcttcatccatcaaagtccaattcactttgccatacgtagagctgatcactacattgtccttctacaatggatatgatcttcgctcctttcttttgcttcctgctggttcgttttccaccagttttcaccatatatatacagctcatatattattgtgctgttctagcttttcccgtacttcagatttttttattttctttttccattatataaaaagtgtgtaaccttatttatatttgtcgagaacggatcatgtgcaagtggtgtaactgtcaaaagcatcattttcactaagaaaatagacggaaaaacttctaatatagaatccaattatccaattatatcttttagtgtgtgtgtgtgtatatataatccaaatataatacttttctataattttttcttaaaaaatgtttggaggcaaactcttcctctaaatctctgttttttttctgttacattctagctagtttcctaatacaataattctcaaattcacaattcagtaatataaattatacagtgttacttctctgttaattgttcatattatcgtaattaaataattcataatactcttttctgttaacttctctctttttatttaccaattaaacaattaatttctccgatggttccatgttaggacgtatcacgtatgttcatgacatgattatggttttttctgacaatttctacaagtcaggactaaatcctattttctcagagtgtctcagcttagtctcaattttacttttttttccatataatttctaactttgaaattaatacaaaaatcattgggatttgtacggacgaaattttgaccacacgtgaaaatctattttcacatgcgactctcccaaaacgattcgtccatgaaaatgaattttcagttttttcattattgtagtcgaaaaaatatttcgttattgtccaaaatgataattattttcaatccggaggaagtaattatttttcgtatctttatagttaaaatagttctattgtgtgcaatacgtatacatcgtaacaaaacatagtgagaaaagctctgctccaataatccatacattatattcctaacttaactgatccgaagttccattaaatgctttaaatttggcgtaaagaaattaatttcatgccatatttatgtagtttttgtggcgaactatatctatctatctatctatctatctatctattatatacttatatactaataaaagtccattaacatttctaaaatcgctctcaagctgacatgtggcatcctaaaagcgctctcaagctgccacgtggtgggaggagaggagatgaggacccacaaaaaaaacgaaatcctctcccacaacgtccgcatgtacgcatgcatgtggatgctttcctcccatgcttagcggcaggattaccaagtaatcagggttttacattaataaggttttttttctgttatttggatcggtatgtaggagtccatgttgggctttagtctgttcagctggctaggcctttgtgccacctatatatgccatgttccttgtattaggagattggtttttagttttcctctgtgttgtgccgccgccaccgcctaggtcaggaaggagatggcgattccatacgttttgccagcatcattgctgcgttggttaatttggtcctaggcatgttctgatttctgacgaagtcttcttgctctgatcggctatcattcttgctgcatgagtggagtttatgtacaggttccgttagtttattcattataaactgaatcatctgtctgttaaatttgatgctactggagctattcagttcagtctatctggagtaaacgatcttatgtgtgcgaccctatgtactttgctggatgagatctctatcttaatattgatgctgctcttgattcaactggagattagggtgtgtgtgtctatatatatatatatatatatatatatgtgtatatatatatatatatattccaaaaaaacagaaaggatgactggaattcagacaaaatttgggctaaatttaaacaaaatttgttgaatccaaagcccaatataaattgaagaaatcatttgaatttttttttttgcttaaagttcaataactattcttaagaacacgaatttcttaaagtttagaactccaaaacgaagatttggtttgtattaaaaataacatatagtttagatgacagttcataggaaccaacttcatttttgcgacataatactttccaataattaaagatttcatgtttgtaagtaattttagtttagaatttatgtgttgcaaggataattagcattcaaaatattcacaaacaaaatattgacaaaaaaacatgttgccaatagaatctggaacaatcacgcatatacaaacattatattcacatgtgtagagtaatatttcaagcacattaaattagatgcccgtgtatatacgcgggcttcctttctagtttatataatttgaacaactcttccatatgcaggtttcggcggcacaggggggaggaagccatgcagctatgtcccccgagcaatactggcgatccatcctccccgacagtacccctatgccgatctccatttcccaactccttggcgatggttacccttactcaccagctgttggattaccgaagcgtggagaccgtgttcagattaggtacggtccgaatatttacgggcttgcagcgtcgcagcagttcttcaaagacccaaccatgggactcttcttccttgagacaaacctccaaagcagcaaaagtattaaactgcacttcgccaacatgatggctggcaccaagtttctgccccgaggcgaggccgacgccgtcccattctcctccaaggatctccaggagatcctcgcgcgattcggggtgcggccgggctccgtggacgcgtcggtggtgaagaacacactgctggagtgcgagctaccggcgaacaaaggcgagaagaaggcttgcgccacatcactggagtcgatggtcgacttcgtagcatccagcctggggaccagagacatcaaggccgcctccaccttcctggtcggcaaggacggggacactccggctcaggagtacacggtcaccggcgcgcggcgcatggctgaaactgggcaactcatcgcttgccatcccgagtcgtacccatatgctgtgttcatgtgccacctcacagaggcgacgagggcgtacaaggcgtcgttggtcggcaaagacggtgcggcggtggaggcggtcgccgtatgccacaccgacacggcagagtggaacccaaagcacgctgccttccaggtgctcggcgtcaagcctgggacggtgccggtctgccacttcgtgcagcctgacgttgtcgtctggacccgccgtggctgatgtactactgcgccgtaaatgtataacaactaaatcgtagtactacgtacctactgcgccgtagctgtaggaaatacttaatatccagtatgtatttgcaacttccatcgttgttgatggtcgtatatactacatatcttttcgcaaagtacctgtttgtaatatgtttcgtgatccgttgcttcatccatctgtaccactaataccagtaataaataattaataatgctgtctagcagtacttgtttatgtactacatgccatgtttatctactatcaatgctacagagtgccaacggttgccgttttctcattggaggtgttcctcctcccttaggtaaaaatctagtccagttttgcgcgggcgtcggtaacggcttctgtcgttgttcatctccttggaggcttcgtcttgaaggtgctgctcttccctcggtcacttctatggttcgtagttgttttctcacatgcttttttttttgtctactgtgcaaggttttgcggatttccctttagcaaactgtgcagactgtgtcaactctcttcttttaatataaccggtagaactcctattgtctaatattaaaaaaaaagtgtgccggccgggaaaccctataggtacctttttttcgactggtactaacttggggacacctttgcatgcccattcaaatatgtgccagtttcagaaccggcacctacagagattacctataatcttaaaaaaaataaaaaaaaacaattgtattgtagccggatccgattctcagctccaacatcacaatttcccagctccaaccagcatctgcaattccctcatccacatttcaaatctacacaaacacactggataccaagaagataaaaacaagctaatcacatcacaggctcgagcctaccctcgaatttttgacagaaaggaaaatcaaatatatattatatctgagatgaacaggaatggatgagagatcaacaccgttgtacaaaccctctttaaccctagtttacaaccccctttagtcccagatagcaaaccggggctacgaatccgggactaaatatcacaatctttagtcccagttaaaatagccgggactaaaaatcatctttagtccctaaagatggtagcgccacatgcctggcccatccatcttaccaaccaggactaaagatttttttttctttttttcattgtttttgatgtttgaatattgatttcaaaccaaactcaacaacaaacatccacattcaccaaaacatcacaaaatcttccacaaattcatagatcgaatgaacatactcaacttgacatcacaaatttaaagatctaaacatcacaaatcaacaaaacatcatagaaaaaaatccccgagcggccacctgccctccctctccgccccctgcgctagcgccagccgccgccgccacgcgtaagcctctgcagccgcgcgcgggccgccaccgccctacccctgccttcgcttgctcccgctgctgctacgtgataagaaagagaggaaagttaaaagaaaaggataagagagagggaaaatgagaggataagaaaggaaagagagaggaaagggaggaggaggaagttaaaatgaggaggagaggataagtgtgagggattatatactacgtgttgatttttaatcagatcttttttagtctcggtctttagtcaaaccgggaataatgtggtttttgggcaacccggccaagatagtttctcaagtagtgcaagaacaagcttagtaataataatgtctacaagaaaagctttggttggcaagccaaaatttttgaagtggttcacctccacggctccaccccaacgaccaccagcaccggggctcccgtcttcggctctagcggcatcaccatggaagacgacggaggaggaggagccattgagctgcgtggaaggattgtggtgcagtgcttggcgttcaacggcagcgagcgcacgaaggtggcggcctttgcattcagcgctgccctcggagagggaagaagtgggaggcatcgacgccgatggcggcgctcggagtttagatgcggcgacgactgagaggtcgtggatggcggtgccgcggtgccggccaaacggcaagtggactgctggcgggagagggttggcgtggggagggctcgacgttcgtagcgcgagcaggcaagcggcaatagctgggagagggagagggattgagatcctctgctgtcgactgcaccgtgcctaggcgcggtgcagtcaactgcagaggatcctgatacgaggcagagacaacaggatgagagaaagagaggagagatgataaggacgggtacctgggtgggtgggtctaggccggtactggataaggtcgggtgggtggctcggctcggtttcatgggtgtcggtttttagaaaacaacacctattacatattttaggtgtccttttccaattatatattaggcaaaatttgcccttgaacacccaaaaattgtgtaattggctgggagacactgtaaaattgtgttgctgctgatggacaccacaaaatttgtgtaatttgctgtaagacacccgagaaaatattattatttcttatcaaaaagaggagagagaaaattgcccttagccctatctaacccccattgacggcagccacttcccagcgccgctcaccaaccaccactgtcgaagccgctgtcgtcgggctcgctgaccatcatcgaagctgtcaccgccgcccacatgccagcgccgctcgccgctaccctcgccatcaccgccgccatcgaaaccgctgctgccgggctcgttgaccatcaccgaagcagccgccgccgccgctcgctgctgcctccgtcgtcaccaccgccgtcgaagccattaccgccgggctcaccgacagtcatcaaagttgtcgccgccgcgcacttcctagcgctgctcaccaaccaccgttgaacccacggctgccgccatcaaagccactgctgccgggcttgctactttcatcgaagccatcgccaagcttgctagccacttcagaagccgctaccccggggcttgccagcaatcgtcgaagacggcgtcaggcttgcctgccaccgggttagtggtgtggaccgttgaagtcgacaccgggcctgcctaccgtcgggttaggagtgtggactggggcagggggaaaagtggggttagatagggctgagggcaattttgtctttttaaaatttttctctcctttttttctcagaaataataaaatattgtcttgagtgtcctaatcagtaatttagttttgcttggtaagaattacctcttgattagttcctaatcagcgtgcgggatcattgttcactatagtccattataatatagtgattactttagtgagttataaacactataatagttattaattgcttagacgcggtgtctaggtagttgatttcctgtgtttgctccgaatcccacagtaggtgtgaggtgggtgtagaggtgctgacagccctcaagatcactgaagtcctccctgtccgggtacgtagtagagcgatatctgggagcagtgagctggccagtgcctgaagtatcgcgttaggattaagttatattttctgtagacactgtttctcactagtgaatcctctctatcctttgcctatctttagctccgtgtccttggaagaacctaaccaagagttgacacacacgttccctgtggaaattaatacctgagaatactcccgggtgaagtgctacatcggtatcctccgtgcgcttccggtttctatctgtgacgttaagaaataccaacatcccacagacagggcaaacatccaagtcgacatattgtttgtaatattccctccatccacaaaagttacacttatttcacatttgagattttccaaataagttgttcccatttatagtctttatgcattcaagacttaaatgaagagataaattaaatattttattagaacccaaggagtcatctaaatactcattggttgcatgcttgcattcattctttgattttataacatccaaggtgatttaatttctccttgatcttggtgtcaaaagtaatatgtgtaacttttatggatggagggagtacaatatacaatcgttcctacaagaatgaattctttttactctccagacccaatgggcataagacttttttttgcttcgtatgttgtctgtggaatcaggtttccctctagcaacaaatcctttaagaactcaagaatttatgtgaaactcttatctgaccagctgttacttgccttnnnnnnnnnnnnnnnnnnnnnnnnnnnnnnnnnnnnnnnnnnnnnnnnnnnnnnnnnnnnnnnnnn

SEQ ID NO: 42721 - DNA, 1575 bp, Oryza sativa
ctctcatctcacgaagctctattcgaaatgaaaaaagctcgtgcaccgatgtatttttggttgcaatgggcttctttgttgaattaaggtagtagcagtacaccaattgaaagatcccacaaggcctccctataataaataatgtgaaaagtaaaaccttggcggcctggagtggtgtatagagtggaagacatggaacgaacctataggttcaggcttcgaatgaggaagttcaagacatgtaacgagcggtgaataatgtgaacggtgggggcggctcattctttccgttctctctcttacgtcttattctcattgttgtctattaccggccatatcagtctctgcgtatgacgtctcagtctgtactcactgtataccaggtgtacggaagacgacttgttttcagcactcatcttttcaagctatgatgaagtaaacaccagaataggtaggagcccgtgtcgatatgctttttcttcctctgtaaatctttcggtttctttgtcttaactcgacaaaatcaacttcttttgggaggctgatacatatttttttcactaaatgatcgtggggctttgtgctttcatgtattggctgatgtgtcatattgatgcttttttcactctctttttgaagagcaatcatccacaccaggctcagggacgaggatgggaagtacttactttactggtgaaggaaaggaaagggcatgatgggcatctatctcgatccggcagaggcgcaggccgagtagggaaagaaggaaggtagagcccgattggtgtcgaaaaaggttatcatcccgcttttggctactattacttctataaataaagaacgtcggtcggggctttctggtgatttctatataagaaaacactttgagaacttggcatagagtcggtgatcctgctttcattgaacgcatatagagagcggtctaacaaatgaaccaaactagtgcatcagcagtgcatcatgcttaggtgcaaccccatcaaactatgacaccacacttgaaacaatatcttgacaaaaaagacttgtggatgtgggcaacttactggatttgcacagtaccaggagttaaaaacggaaaacttacaccattaaaaaaaaacatactccatacctagtttacctattataagtccttgtgggaatatggtcaaattccactcatacctgtaatatgactcctcaatccttatgcatgcgtaggcttcacttattattttatttgtgttagaaagcctgcaagatacattaccgaatgtttgtctttttcaccatagctgttcccagtcccactagtgctagtatcaatagtaacatctttattgcttaggatatttcatccctttagtgtccaataaagaagttcatatttgcaggcaatgcacccacttcacttcaatccaagggaattctttcgttcaatgaaagcgaactagcgggcagaattcctctgagtgcaattcccaagcaaggtcacccacttaagtatggtaccgcgcttccctgtacatatagaatccttcctttgcctgaaacaattccaccaaccaaatc

SEQ ID NO: 42722 - DNA, 5085 bp, Oryza sativa
tatagctccaatcatagctactaataaaatcagactagaaaccaaaaaccagacggaatagtaggtataaagtaaattgcccaatgtttccaaattagtccaacttcgtacctttccggcataaaccgtatatctcagagaggtcgtatttctgtgggttggtagtaatggaatggtttcattatctaaaatgaagaacatttcccaccaaaagatcagtccaataataccactcactggtaaatagcgcaatactttttcgtgaatctccgctatttgaatattgaacatcataaccacgaataggaatgaaacggcaatagctcctatatgaactactggggagatcatagcggagaagtcgagacctaacaaaataagtaaaccagccgtgtcgcaaaagactaggatgggaaacaaaacggaatgtaccggatttttagcacgtacaaccatcaaaccagagaccaaagcagggctcgacaaaactgaaagtatcatggtacgtcgtcctcccttgaaatggaacttgaatgctggagcaagaagacgcattcaagtcgatctattacgaccagcgcggttgttcgtatttcattttcttcttccaagccgacgctcttcttataaaagaagaaagcactcactgaattacttactgaatctcgtcctactttttgacccatttatttttcctttctaggttggtgggcgctttcaccattcagccatggatgctttagcgagtgaactaggtttttatttgagagcgaactaggtttttagtggtattccttctcgagcttctatttcttccgttaagggagattcgggaaaagatggaataggaagacgtgtttccagaacgaacaagatacgggtagagaaggggaagttagcaaagttagacaagattggaatgggcataggaacatgtattgatgtaccagatcggctaatactcccaggttgatgcgatgtattccaccagttgactggagactttattattggtatatcgatcggtccagcacggattgaaataggagccggttcgacaggaagcttttgaaaacgcagtgcacccaggtaaataagaaacaagatgaatacagaagttaaacgagcatcccacacccgaaaggtaccccacataggccttccccgaaatcccccagtcactaacgtaaacaaagtagaaaaagcaccaatttctgtaccggttccggaagagcgaagaaaaaggggatgttttgttagtgggaacaaggaactgtttatagctgtcgcgatataaataactatactcatccgagccgcaggaacatgtacatacgaaatacgagaatttccaccttgttgaagatctggtggtgctacccgaagacttaaatgaatagccatcgctgttaagaacaaccgagatccaatgagaatttgcgcgtagctttttgtctttgacataaaaaaataaggttgtaataacgaaactgacattttttttccttgccttgcaagtggaacaagaaagactatatagtgattttgattctataaacaatcaaaggatttcgcatgctttccatggaatgacggaattccccttgcttagttttcgctccgctcgtgcgcggcactccttgcttgcggggcggcatatcggaaaaagaaggattgactttctatacgggcccgtcccctaactaacgattatgctgctctcgcctttttttaatcttttagctttggatcatcgctaagtcccattaattgatcataacgatatcgtggaaatgctgcacggacccatatatatagaaaataaactcgaagtagtaaaaaaactacagttaccgccatagacaatgattcatttgtgaatgctaaataatagttgcccataagaagatccattattgggtgaatgagaatggatccaaggggctcgccaaatcagttactggtcttaaagaatttgtgctttccgcatctgataaataatttgggctctcataggtcacagcatcagccaataaatcctgtgtcaacggctcaggttggtttaccgatgagcccgacgaggagagcctttcactccccgctgggcctgggctccctgcgtcattcccattggctggggcaggtccatctccctctttctctaaaagctctacagcgcgaataagccctatgtatgggctctgcgctactgtatccagatttttacttgcgaaaaaatcctctatttcctgctctatacttttatcaaaccggagtcccatagcaaatacatatttttatgctccctctacttcaatgaaagctcctcctactactcccccttatccttctcactcgtcgtttcgttggtcttttatatacccattttcattccatttggacccctggcaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacggaatggatacgaaatctagaggcggcaggtaaactagggaaacagaaactattgtttttggtgaattatcagtgtgcagatgaatttcatccactgctattgaagaagcttttagagggatatcttgtcttgtcggactaagagctcttatctctttcttttcccacggtaactagagattgaataatagaagcctgattcaataatagaagccagattcaatatcataagaaaatagagattgtagcgtagagtcaggctatcccatgtttgcaataacagctttgggatctttcctgttaatgatgaatagcttgcctcaacagagaatcagaattctttttattcggtataacaaccttaaaaacgaatcgatctagatgccccgctcttgccatctttgatggaattgaatcatcaactgacttacttgaggaataaaaaaatctgcagctttcgattcttgtctatcggattctattgagaagaagggacaaccatccatcctccccgaaactagtttagtgcctgaacgagattggtggcacttatgacgagaaaacaaactctttcttctgttcaaaagctagtagtgccgtagtgccaatctactccgaagaacaagcttctttgcaaaactactttcttctacggagctacctccgtctcactcttgtaccgaatgctacctggcataacatccttacttaaatatcttccgctctccagacttcaacagtgccatcttccagtaggaagagaatcttttcatcctcccacccaaccaagtaggcttcttttctataagaaatgctgtcgatatttcctgctaaatcctgcttatccaataagtttcggatatctatatcctggagtaagaaggattcaccttctttttagtggtgttcctttataaaattttttaacgttagggcccccaatgaatgttttcactaacacttgtgataaactcatcatcaaaagtaaatcctcttgttctttgagccaatacacagctatccctaccggattattattttcaatcaactcttccagccctagatatcctctatcacactccatatgaactagcttatacatgaaagcaggaaaagccaattcatttattctctaataataaattaccgataaagggtagttgtttcgtagggataatacccttattaattgatccttacggaatggaagtaagcccctctttcataagatcaagaaagtacgagcgtctttcgaagattgggaaaatctcccatacttgggagagaagcaaaccaaccggccgatttgcaatcgactatgcttagtagttgacatctttggtcaacacattttcccttccattttgtaaagttagtagaagaggatagatccggtaaattgtacatacgaatgtcaatcttaatttttgtagattaatacactggtaggggtcgatcaggcaaatcccaaagctgacccccgaacagctgccggactgctctactgatcttctttctcttcagactcgctgcaccttctcaaagactcctatttgtactgagaacacaatacaccttctcacatgcaaggaaaccttgtacgttgatcgactcctcttgcgcatccagaacagaggttgcgggctattcatgagagcgggtcaggtgactaccggagacaatgtttaaacacgtcagatggctttaatagggctcgaacctacactatcacctatatgagcgggacgctgcaaccaattaaactatgagcccaatcggatctatacatgccgagaagagcggtctgaaagaggagaccttagctctatctccttcttgctcttcccggggcctcagaggggttctttggcaagccctattaaagaagctaagtgacgaaagtcactcaagtagtgagtttgagagtgaccgttagggcgaccacttgtacttataggccctggcgacctatagtcttgttacgcaacacagcttcactcgattcagtaaatcaatagttcaaaccagcccactaatagcttagatagtggcccttccactttggtatagttgaccctacctattgactcaaggtaagacctctgactcaaggttcataggaagggggaacccagacgtagtgggatgtaggcttcagttgttttggtactttttcaccacgtcatattattttttttgtaacggcttttcaccggcaggtcagtaggccttttaccaaggcgaacaaacgaaagttctcagcaggcgctagcgcaatcttgttcgcttttgtcaactgaagtcgcgcgtagcgccaactaactgatagctgata

SEQ ID NO: 42723 - DNA, 1200 bp, Oryza sativa
ttccccgcccgatcttcctcttcctgcccgactcattttgtcttcactggaagctgctgatcccagcgtagcattcaagacaattgttccttcttcggtctccccctccacccccttcgtttgttgtgggtcgcgtctcaccgcaggcacttaatgaatgagtgaagatcttccttccccccttgtgtcttaccaaggactgagttcccacttgtggcgaaaaaaaagtctaccatcccacccggcctccccccggggggtgaaggttcctctcggagactgccagtctacaagaagctggcagagctttagccattggaccacatccatccatcctctacctaaacagtgacgccttttcttgttcgttcttcgaattgcgctagtggagactaattccatccggctaatgaagatactaccccagtcttcccattcattcccagtggatccttcttatcccttttcattgaacgaaccaaacaagcaacggattgagcgcactagcgcgaaagcgttagcacgcgcatccgttttcttgctcctatacgagagtgaggaatagaaatcctacaatcaacttcccacttttgatgtcccgtttgacgattctgctgcgtctttagaaaaaaaaaggagaaggacaacaggggtcgctagtcagaaaagctataactatcaatttgaattctgaatgaatcaaatctccccaagggggagtcgaacctacgaccagtcagttaacagccgaccggtctaccactgagctactgaggaagaacggacttaaggaagctgactctcgttctttggaccgaaaagaaaaaaagttcgtcactttttctctttcacatacaccgggagaaagggtgacgatagcaatcccctttgcctccccggccggggagcccccaggacaaggggggcggcggtcaaccatcaactctcgatatgcatattgatcaatcgatctccgcgtcctgccagttcgctaagtagactcactctaccgaggggcaactaaggatggttcctgccaattcccttgctgatcagcaagtatgagagaggactctctctgtctctccgagtttcaactactaagtgaagttaagtagcacttcagctattctaaatgtgaatagattccgttccccgatcaagcaagcaggagaaggtggtcctttcatctctctgtct

SEQ ID NO: 42724 - DNA, 7409 bp, Oryza sativa
atttatatagtggctatcttccttcaagtgagagagaggatcgagaaaccatcgcccaaaggtgctttcacgaaagccggtctccgggggtaaagaacctttcttcactcttccaaccttccaaaccatccactggattttcatgttcgtatgttgaaaggaatatgtgtgtgttgtatataaataaaggactttcgatttagcgttgtcatttttacgaggttttagataatccaattttctgtgagattactttcattttgactgaatcacttgaatcagttaaaggagacgaggcttccggcccagccagaggggctggagaggagagttttgaccgcgggggaggcaggtccaggtaacggggagaatccgctaggctgaggttaaaaaaatcttccaaaactttttctttagagatagaattcctcccgagaacacacgaaacaaaaatatgaactaggtaaatagaaatggaaaagagatgtttccaattcatcacaaaatctaaagctttttctacatccatatgatctactttagtagattggtattgcccatataatgaaagcagatcttggtccatggagtcccaagaaggttggaactccaacctgtccgatgctttttcggccaaataaatagaaaagtgggaccagcacaatgagcaagctgcgcgaaaaaccgcttctttttccggttccgcaacaacttgcgcgaaatggggttctaccgggaaaccatggtcgagttttcgaccttggttactggtcgagccactggataagaatctctggagatctttcctctccacttactcgtaacaggctttccctctgtataagacttcttccgaatggcataattgtcctgtcctattgacacctcgatctttaaagaaaactgactcctacttctcttttaggatttgattgtcgttggtccttttttcactaatgatctcaccatagtagttcgcgcgagggactatcttttctatcgcttgcttttcactctcaagacaacggtcggtctctctatgctataaagcggagcaaagcgcatggcgctgaaagttaagaaagctcaaaaacacacacgaacacgatgcagggcatagcataaatgagaccgctgatcattttgcttgacctttttctatgctttttttgggtgactcaccaaccgacccagcagtgatcgatgacagaatggtacgaacaaatcaaagtcgttgaccattataccgtgctatggcacactactagatagattgtatggctccgttggtgactttctgatcacgggtttcatttgaaaaaccccaacgccattcatcttgcgtccggtctttcatgcaagagtttcatttttggccgctactacgttcgtcgaaaacttcttgatggcaccatcatctcattaccttatttttgcccttcgacttcggctatgaccaatgccccacctagctgaataggcgtaacaaagctacctgaaaaaggcaaggtgcaccttagattgaaatcgacaaattgcgttttgccagatggattctttagaaagattcccggataaagttcagtataatatttagttagaatctaaataaaggcgcatacgtgggcgggcagggggccccactacttcttcattcaggggggctagcctcatgacttcccactgggcgaggggtgcgcctaacccacctactcactcatcaattacggtgttcagctgacttgcacagaaagacccctattgtttagtaatttggcgccccatcttttttttgattgactgttgtaactaatcttttcaatgttcgattctactctatgttagaacatttctgtgaatgctatttcgatctaagtggtcctattctctgtcccgtgctaggaagcattactcttcttttcattccaaattcttcaataagactgatacgattgattggtctgtgcgtttctcttattacttttttgtatccccttgttcctcggatacaattcgatccttctacggccaaatctcaatttgtggaaagccttcgatggcttccttatgaaaacatccatttgtatatgggtatagacggtctttcattattcttcgtgatattgaccacatttctgatccctatttgcatttcagtgggttggtctggtatgagaagttttgggaaagagtatattacagcatttctaattcgtgaatttctaatgatcgccgtgtcctgcatgctggatcctctactattctatgttctttccgaaagcgtgccaatccctatgttgtgcggagctgagcatcttctattcgctgggatcaagcttttcctctgcaggggccttgtgcagtaaaccccctacgggcggtcccccgtcgtcgtaaagtagtaaaggtccccgcgaagctttcgggaagaggggtagtcttgtgcgtaagcatagcatttctggtcgaaccaccgaaccacacatctttttttggtgggagggtactccgagtagtgggtacctcgtaggacctcgacccgcctactcaggtcttgtatggatatgcaggaaggggtgctcctaggtgtgtgtagggggtgtgtttgttcgcgagaatggattcctcgtcaagtcagggggggtgtggacacacttgcgcgaattcgggtaacggctacaagggataaaaataaaggaaactgtacccgaccagggatggacgtaaactcgtaagctaccgagggtagggataatcgtccaggtcttattgtttaaaaaaaagccgcaccgcccagcaggcaggttagttcctctgtcgttgccggagagttcttggcgaagagaccttaggataagttgctaaaacaaacgggggggggggaggatcgacccgttcagtagaattcccaagaaagactgttggcagcaggtggagacatttctttggcccccttccaaataaatgcgggcagggtagagctcggcggagggttcgagaatagggtagggtcctgtcctaataaagaaaataaagataaataaaggggcgggtccctttatgcatgcatcttcgtacaagtggaggccggaaagatcaaaccaatagaaccgctcacatcacagtagtcgtagttgcgtaaaggccgtcagtcggggggcgaccataacataaggcaatgactttcacggatctctctatcgttagatataacgaacgggcgggttcgaaaggtagggtttttgacggccctaccactagtcctgctagccttctttcgggcaggaagcaggccgggcccgacgggcgggcatctcccgctacgcaagcagcatggttcgccaccacccgagaagcaaaagattcgagagtcaaggcggaaaagacaagcatagtggtctaatgacaagggccgacgacggaagctcgggacggagccgtatgatgcggaagtctcacgtacggttccctgagaagggagtggctacccactggagcttcgaccaaccaccaccggtcaattccgctttggggccacccctgactctaccatcattataggggtatggggttcgagacaaagaaagatcaaggcagcatatcagtttttcctatatactttactgggatccgtttttatgctattagctattctgttgattcttctccaaacaggaaccaccgatttacaaattttattaaccacagaatttagtgagcggcgccaaatccttctatggattgcttttttcgcctcttttgccgtcaaagtgcctatggtaccagttcatatttggttacccgaagcccatgtagaggcacctacggctggatccgtcatcttggcaggaattcttttaaaattgggaacctacgggtttttaagattttcaatacccatgtttcccgaagcgacactttgtttcactcctttcatttatactctaagcgcgattgctataatatatacttccttgaccactttaagacagatcgatcttaagaagatcattgcctactactcagtagcccatatgaatttggtgactattggtatgtttagtcgggcggcggccgttaggtcacctattttgagttatggacacacaagcaaggccaaaacatgtgtgccgggcgtgcgacccatcaacctactagcaataggggggaaaacttatcatgtcgcaacaaaagcgtcgattccaggcgtcagcaaaacaccgccgtctgttcctaaaacaaaaccccttagcgccccggggcgggagtggggcacggcccttcgcagacagcagcagcaccggctcttcgaagtccgaatcgaatctttcggttcccgtgaataagaattgttgggcgcggcgaagcgagcgcttctagctgtttcgcttgcttctttcttattgtggcggctattatagcgtggctgaaatgaccgaaaagcgagatgaaccttttaaatcgattgatatagatggcctgatctgttctgatagatcgaaagggaatctatcaataataagggttgacctctttctatctattgatgatacaagatatctatctattctggatccatcagaaagaaatcgatatgtatctgatggagtctacatcgtatgtagagcgcccaagcgcttttttggccagctcagttctattatccatcggtccaatgcactggcgcatctcatggggggaaaaagcaaatgtagttagttgtcttgttgttgttcgccgcctcgacacattccccggcatcgtcccacacagaaagaaagagcgtggagccccggcccgacctgtaagtccgctaacgtaaagcgaggagttgagcctgaactggcgaaccgaagtcactttcgtaaccatacttcctacagctaacacgtgtccggtccagcgggaacgcgcagcgcaaacgaacgtgagctgctttaccgaatatcccccgctggccatcggggacctagtggtaaggccatgatccgcagcgcaggggaagggatcactcattcttctattggggacaggtgcacgaacgacaactccaaacgtcagacatccgccgcctatacctaccgtttaggtggcaccagcgagatccagctaaggtaaggaacttcgtgtcgcggctgctccactccgctgcggtcttttgaacagaacttcgttgccttcccgcgcgcgaaacgaatgggcgcagtgtcgtgggtcagttttggggcggggggcagagagagaccagaagaatgattcatttggatcgacgagccatttcgcgattcaatagaatgtctctctatccatatctattctatctttatatgacgggccataaaaaaaagaagtatttttttatggcatgtgagatgatcgcgcctagtagccacatatcagctgcgctcaatatgcgggatttccgttggatctgatctttcgctttgacgaatttggacctagcgaaaaggactctaagccttcgcgcaaacaagcaaagtagaagcaagacgaggaagcggagctgtcgtagaagcagtagcttcccccgacaatatacaatacaacagccatgaataaaaaagcccctagtttaacgagttcgctgcttttcccaggccggagaagggcaactacttattgattgatcgcctttctttgatatgtgtgcaatttagtacaatacaaactacaactagatcaaagcggaagggccactcactatagaagctataactagcctagccctagccaatagtatagtttagtagtcggccaaacccccatgctcacgacatgttcttgatattgattgagttggagggagtcagagactaccacggaatccttccatagtcaccccggtgaccttcgtcaccaaagcgtcacgacagtttccaagacccctcacataatctcctgtggggatcagtcggagcacgtaggaatgccgaccactacataagccgcaggcggagaaagctcgaagagcttcccttcattcgcttcgcgggagtcgcacacagcacatagctggaagtcagagggcccgtactacctgcctaacccttcgctccgagggaccgtagaacggaaagcgccttctaaacaactcggcagaagggaaggggcctatgtatttgcatgacccctgcggatttgaccctacctacacccggagccaatcccctagcggtcctgccaccacgccgcagaacaggagctcgtgtggaaccttggatttctggcgtaacagcggtggaagttataaaaatattacggccgcataacataggggcctacgctaaggtcggccaaaatatggacacccgaagggcccggcgcgcacaatcctatcctatccgagcccgtcattgcatgcacttcggacagccgtccgtagcatcataaagagcacctccctttcgaggtacccaaatggaacgggctttatttgtgttgttggttggtctttctcaacgtggtctatagcacgaaaaaccattctttacaagatagggccgttcacatgaaagataagaaaaaatccattcttcatggtcgggcgcatttctccaaatcctccaggatcacaagtggaacgctaagcaagggtggggaggctgcgagctccgcgtcgaacagaaagaagcaagcagggggtgttgccgtagcgcgccggggagcaagcgtaggcaaccaaactaaataaggctaaaaaaaaagtagctagcgtttttaagctggctgccttttctagcgcgcgtactcttctgtggagtcgcacggaacgagccttgtcttccctccaacgactagctcccttttcttgttccggtcacccttctcttgccgtggaaggacttttgcctgtggtgtggtccatcccgtgggcggagtcgccctcatccccccattgctcagtgctccctgcagcttcgctgggctttacccgcgtggacgcgggcttctataagagaatgaaaagctctctctttacaataaaacgcgaaccgcgcggagcccaccctttttcgttttctgccgccactgggtggccgctggggaaacacagcccggccgcctctcgggaaaggggggtgggggatgggcctacctatcccgagggagcagttgagaggttccatatgccgagccgaagggcagaacttcagtgcgtgatcgtagtatgtcacctcgtctcgtcctcgcagcatcaaagagtacctatgcactatgttccggttcactgataaggaagatagagttggggtggaggtctacgatgtgatactatagtatagtatgccccggggggaaagatgcgcaactcaaaacggaagcaggaagcgtgttgtaaaaaatgtcggaggttaccagatctctgagactaccatcgatccgacaga

SEQ ID NO: 42725 - DNA, 713 bp, Oryza sativa
cagggccgggcctgaatgaagagcggaccagactcttctttgtttcagctgctcccacgcacgcagaccggaagatcccagttgtcctggactagacaagtacgtagagatcttcgtggaaccggggagggagtctcaatcgatcttttctaggattccaactcacgccacgcacgaagatttttctattgatagagttaagggctcggctcccccgactctaaaaggttaggttactaccagcttgcctctacggaagaggtgtactttgtattgtctgggggtcatatagatcggaacccggagcgagttgaacgaaaaccttacccacagctacaactactggcgcttcaaagggcttagattctaaggtaggggtggaagccgtgaaagcctttggtactttagtcaggcgagcagcccttaaacaaaatcaaaggcgcgaccatccccccttcccctattttttgcatttcattctctatttggcccgcctcatgaaaaatgataggcctattgattcgaagtaaatacgaaagggtcggtcaatagcatagctatttttttttctcctttcgaaggaaaggccttcgcattcttaatctggtagggccggacggctttgtttgccctagcttggcgaatccgcgcccctgaccgttctcgcgaagtctttgcaacggctgggaaaccagtctacgaagcgaagccta

SEQ ID NO: 42726 - DNA, 883 bp, Oryza sativa
aagtagctcatcaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattcttattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctggttcaaatccagctcggcccaaaaatctagggcttcgtgaatatgagttaaatccattttttttcttccataaaaaagaatatttgatccatagaaataaaagaaataaaggattaaaagaaaaggggaaatatctttctaatctatatctctttcattcctctcttacaaacaaaagaccttttcttattggttattgaaaggtggattattatctatttttagcgataataaatcgcgacatactagttatgtcattct

SEQ ID NO: 42727 - DNA, 1883 bp, Oryza sativa
ccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctttgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccaccgtccatggatcaaattatttcgtggattggatttcacttgcctatctatggttcccttgcgtgtgctcgggataggtgctttgtataaatgtttcgccgtattattaagtattctcctttagttttttctctatctagaagtggaatagaataacccggttgaagggtaatggtcatacgtttgtaatgcattgtatgtcattgattctttcccaataaatgaagactttttctgtaaatagtgcgtatttgattccattatcatatgataatactatatttatatttatttattgtattatacctttatatcttctaaatatatagaatagaggaatcccgatttgtcaagtctcatgatcgtatcaagatctatttaaactcggctcaatctgaaaaaaaagattgagccgagtttaattgcaatcaattagaagaaaaaagaagaattactgcatttcgtaactgatttttgatctttctatttcgcttcttttttatttagaccttttttttatctacttatctagctatctagtttatctaccggctcgaactcgaatttgatcgccttccatacttcacaagctgcggctagttcaggactccatttgcaagctgctcggataatttcattaccttcacgagcaagatcgcgcccttcgttacgagcttgtacacaggcttctaaagccacccgattagctgctgcaccaggtgcattaccccaaggatgtcctaaagttcctccaccaaattgcaatacagaatcatccccaaagatttcggtcagagctggcatatgccaaacatgaataccccctgaagccaccggtataacacctggcatggatacccagtcctgagtgaaaaagataccgcgagcacgatcttttcaataaaatcatcgcgcaataaatcaacaaaacctaaagtcatttcgcgttccccttctaacttacctactactgtaccagcgtggatatgatctcccccagacatacgcaatgctttagctaatacacggaaatgcataccatgatttttctgtctatcaataactgcatgcattgctcggtgaatgtgaagaagtaggccgttgtcgcggcaataatgagccaaactagtatttgcggtgaatcccccgg

SEQ ID NO: 42728 - DNA, 6642 bp, Oryza sativa
atcgtcgcttacttccctttggggagttcaagtttcaagtctgcttcttataacatcatgttgaatttggtggtttgatggcccggcattttcttctccaagttgaggttcagggttcggcggggtgtggcttgtggatggctctccccgatctggaacagccccgaatacgtgttccaggggaacttccggaattgaataagggtcaaaacggggctgttccccttgcggcacctcttccccgggggaatccggtgcgggtatctggcccgaaagcccattgaaaaaagaggacgacggagtagaggcttcagctgacttgcccgcagcggatccggaaggacccgcttcactaggcccaggccctggtgggttctccatagcggaagcaacctctgggccttccacaaaaaaaaacgaaaacaaaccagagaaggatccaattagagtagaggaaaaagcctccctcctccttctgacaatataaagtcccaaaaaaatgagggaaataaaaataaaaataaggtaaggtctatcggtccacaaaccactgaagaaaaatttgccaataaattttgacacgatacgttcgtatctcgagattgagggaatctgtcccccccattcctcgtgagctacttactaggagaaggcagaaccagaagaattgtgagaaataagtcaatttatcaagtttaggcatttcgatttggatttaaaataaaaccttcaagacagaaaaagactcccttttcttcctattgatcttgacgtcggaaatggttggttttaatgctcgcacagacgaaatagaataccggattgtaccttagccgctcgggaatagaatccttcaccaccaggaaaggcaatcgccacgacgctgacatcttttcatacgtactagacccggaaggcggaagaagccgcttacacgacttccaatacagacaactcaagcaagaggtttgacatcactcctgcaactgcaagacaaagactcaatcaagcagcactgaccgctattccctacatagctaagatgtctgacactgcgcctaagaggctagcttcactataaagagaaataaagcttgatttcccccttcataatacctattaagtaagtattgccatctctttgccctagctcatcttcctttctcggggctaaagaggatcagagttctatccgttcgtggataagagaagactagttagaagagggaagggtggaatgaaacaatccagggtcaaacgaagatacttgttagcctagccccatgtgtatccgtagccttccctgttttgagaatctcatattgcttcgtaggacgtgtgtccttcgtatgttccgtcgcctgttcctggataagtagattttctaccaaccaagtagaatcagcctgagaatcagcagctgagaatgctggcaaatcataacattaactacgccattcttgagcgccaatcagtatcctcctagattctcatgtgttgagtatcaaacaaaagatcccatgtttggttggtcagatcaattcggctttacccattcattgttttatcgaggcaagacaaaaagggacagttttcttatcttttgaggtctcaacgaacggttcttaaatcattaacggatgcagaaatgggacaagttattaccggtttgaggggacaatggttttctaggttgtttcaccaatctgttgaattggaatggagctcacgaccgtgaaacccctcgttgtttgatggcacctatcttgttcccttcggggagaaatactactcttgtttttcttgttcttctttctcgaagagatgggtgcaccgccttggagaaggtagtgtgcctatcgacgactcctttccattgtatgggaggatatcttctttgttgtagctgaactgatgtatgaataaggagagtgtgaatggggattggagaatgccttgcaatgaattaaggatccttcttgtatggcctccagaggagcctctaatgacctttccacacctgttttgaagggaatcactcgtggcaactcctagaatgcggttagaacttgtttttcttcataaatatggggcttctgccatagaacctccactccactgctatgatccgtcttcgattcaccagcatcagctactctcacccgaaccgcacggttcatagtctgcacacccaccaaatcaatcttcagctaaagtaatatagattgcttcaagacaatgaaagagtttggtgtactacaggtggatgccccctagctcataggtcatagccgtagttcgtgcctttggagtctaagagaagggacttctttatacgtttgagatgtgggatctgtctaactcgcactatgtttaacccgttgacttcgaagtggtcccactctcttctatctccgaatctctttgctctgcctctgggcgctaatggattttactttgactctttacggcatctggttcaatccagttatcttgctcagatgtattccttttcccttgccaggttctatcacagcagactatttcactcccggaattgggtttgaatcagaatctctttcccttgccttttcagctagcgagcatacctagcttgcttcttgtcacgagcgggagtcgaacccgcattgcccttcctgaaagagacgtctctttcagatcgcgactttggtgacgcagttcagtcggcgataaaagccttcctacgtctgcgggccggtcggccacccaatcctgctcttcaaatgaatcactgaagtccccaaccctatctatgatacccccatcccaaccattctttctttgaaatcctttactggtggatcccccatccccatcgactatttggctaatgccatccaaaattgtataagatcctgaaaactaaggggattcgccttaatgaattgtagccagtccttcaaatcttctatgggatcgaagaagagttcaaaatcatcattcatgatcttgtagactatattccttatattctcctcgtccaggggactctttaagttgatttgttcccctactctccggtaaagctcctcagaaattgcttttaggaaagatgcgtgttcggccgcataagccagataaattgaagaagaaggggcagccccaccccctgtagagttactcgggccagcctccccttgtagctggggtagactggtagtagtttcacctataaaattttgcatttgtggaatgtaggttggaactacctgttccgggattgtagaaaggaagggctccacagttgaaactacctgttctggcatttccgaaaggaaaggcaggacagctaaaaataattcgctgtcagccgcagtatagatacttcgagttttggtaactctggaagtagcgctacagattgaagtttttctgcccccgattataagttctcgtcgaccacggcctataggaaccaggctatccactgcttttaagcctgtttgcatgggttcgtgcacagatttacgttccagaatccctgttttcgtgaccgaatgacgaaatagatatacgaactgtataggatcattcgctgggatgggataagtgattcttttatgggattcccctgggatcgtggaatcaactaagaatgcaataggtatttgtgatcgagcagcttccagtatgaccgaagactttctatctgcattcagaataaccgcacaatcgggttgttggttcaacccaaaatttatctttttcgttcttaaacggaattttttttttttagccaaataattgctaaaaaaagtcccgatcttccattgagaatcattgatacagctcgccattttttccaatatctcacatcgaaataaatgattggtctttaaaaggaaggaacggcattttttacgaatgggagatcctataaaatgaagagcggttcgtaaacaaatcagtgtcttgtctgaatcgagaatagcaattccacttctggaaccacagatatagacattgaaatggtgagcatctacccgacgcccgccgagatgtgcattcgtacaaagtaatttagtatagaccatagaaaggattgtcatttccggttttccgtttcccgagatactggtggtaagtaataatgcaggcatggcatatttcgttgaatcagtctttttcgccacatcgcgtataaagggaatcgaacccaactcttccactcgccgccaatgcggaaggatgccgccgaaaagaaaggagactgatcttaacgttggcgtcggtttttccaagaaaagtttgatttgattggtctttttcatgcggaacggaaccgtattagtaagcgggcccacaccttctccatccctcgatcaatagtttatttctcttctctatcccctttctcgaactgagctatttcgagcatttcataaacagagctcgatagtcccttaaagtattcacttttccaggagccgacttaccagttagtactggcacttttacaggaacagtaccagagactcatctcgtaagaagacattttcaattagacactactagtcgaggacacgcgacaagttacgttctcatttcgcagaggttcttctcgcgatctttctattctattctttatggacctgagctcacttaattgctttttgagggggcgcagctcattatctatgcattttctcattggcaacaaatcaatgtcatagcactatttccactaatcactgcacagaaatgcaaaaacagaagagaggggcagcccagacatgagaggaccaccacgcacagcaacgatttgctgattgaaagctccctaactatgtgtctgtgcggatcaggaaccaagtaagtaaagggatggttaaagaggcaaagtgatgcccgcccaagcaagtggtttgttttcgagagagaagtgttttttttggaaaagaagagctctttctaagttgacttgcattgcacaaatcatgcacatttttgaaagtgctttgtaaaagatcttcaatggaacgagtttcttttgaccattcccccctctgactgggatgtcgtgtgttaaagcacagtttggctctataagtaaggaaatatctctatccggttatttgtagtgaaaatctgtctcgaggagagaacgaggaaagcagggaatagcggaacaaagaaagaactcttaggggaggaaagcttgcctttccgatttattcgcaggtaaattcggagttacacgaagtggaaggaccaagggcgaagcgaaagagggcatttgcgttccggggagggcgtcgcgtaggcatagttccaatggtaagctgattccaggtacgcccgttcctctacatcgtttgactatcaaagtcaggtcaaatgtaggtgagtgttgcgactcagtagccgtacctgttccacttgcttattatgggaatagttgattcattgtaaggttcaatcaggctgcctggctctacctaaagtctaagtccgtccctccttcctacttagctctcctcacacgagaagcataggccgcaggttgacaatgcgctaccgatgaaagaaagtaagtcaagccacccacggatccttctactaaggaaagagttaaagccgaagacaatcaataaacatcttcaaccaatccaatacaaatactgaaaaagaagcagtctaccaacttttctttcacaaggccgcaggttgatctcatgcattactcaaccaagtcagataaaaaatgatcttatcatcgaaaaggcgcgcagcgagataacaaacacataaaaaaggatatgccctaactatatgcatgccccaaactctatataagaactttataaataaggcaaagagaatctcatctcctcacagttccttgccagcggatcttagtgcccttcaagcgccccttgcggctgtgggtaagaacgaacatcgttctagccagctagtgagagtttccccattgatctttgatctggctaatcaattttcaggttttttatttccttcaatgccgctggtgcatagtcagacttgcaggggcagctcaatcaagtagagacaagaccagctgttgaagcttggcagtggaatccaagagataagaagtagtatagagataataaaacgggattcaaagtagtagtagttgaaataagatagagcaagcaagagtagtagtattggcaaagaagattggaattattgtatccaccaatcgaagcttcctctccctctaacaaagcaatggaatgaaattctaatcctcatcctcataccttcaactataccttccctcgaccgcgagcccttatacgctagagaaatgctattcctagacctatcgctatcccctttaggagggctatcccttttacgagctagagcgtagcgattcgtactccttttgggggaaggttaatgtaaaaaggtccaatcctccagggcaaaggtatcttttgtttcctttagaacaatcctaatcgcatatccaaaccaaagaagatgatatttatttgataaagcgcattctattatcgtattgcgacactgctcctatccctaacgctagctctgttgacttcattccttgtcggtgttgcgagcccctctactttacgaaacgaagga

SEQ ID NO: 42729 - DNA, 3357 bp, Oryza sativa
cgcgccgttggtcgccggcggcgaccatcggggcgcgggtgcgcgccactcccgtcggccgcgccggagaggccgccctcgggtgcgccctcgcggctgccaagtgggcccggccgtcagccgcccacgcccgtgggtgcggctgacgcgcgggacccacggcgccgaccgccgccagccgcgtgcgcccggtccaccgtggaccgagcggctgacgcgtgggccccacttcccgtggacccggtccgcgcgcccgctccctcggctgacgcaataaataggatttttaattgaaaattaaatgaagaaattcgtaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttatttagccatgcctatttacctttgttatgaccttattattattgttattgttattactaccttgttcaccctagacaaacaaaacctcaactagtggacactctactcatggtatccctagtataattttaggtagatgcttcgcaatctaattaggtaaccttaggtggttttacaactatagactttgggaaatattcatatcatttggacactatggaattgttggcttatgttggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcagagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtataatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtatagctctaggatcgcctttacaaaatagctttgggcaactaagtgacttttaaatgctgtttactgcaaaacttaatccctatattattattcccttgtactcccttgcatttattctgcatttgtgggtgtgtcttgttgagtacggtggttgtactcagtcttgctcaattttttcccaagcccagatgaggagctccttgaagatgaaggcttcggtgtctagctcgtgcctgccgtcaagtgcctgtggtcgtcgccctagtcttccgctgtttctcgtttgtctttgtgtgtgctgggccttcgtcgcccatgtaataattttatatacgcttccgcttgttaaactctgtattgtatcaacttttgggtgtaccttgcctcctgggacaaggaataatacacgcacgtcgggaacgcctgttgggtgatttccggtcgtgacaagttggtatcagagcctcccttgaccctaggacgagccgtagatcccaagccttagctatattttcaaaaaaaaaaataaaaatcctttattatttgcgaaaacccgctattctctctttgtcttgctgcttcatttatcgtcaaaatctgatctttgaaaatgttgcttttcttttctttgtttttagatggccggcagcgtcacccgtcgtggtttgcacatgactggcttcgtcttggagctgcgaggcatgtgcgtggtcttggggtatccacatggagtggattaccaggccaggccgctcccggagcaggagggtgaggatgcagagcctcacgctggttgggaggtcactgcagtgatcctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccaccctcgtcgcggaggagcttgcgactacgccaccttccgagacgccagctcggaggatgacgctaccgtcgtgcatctggcacgcatggtggaggcgtacgacgcggctcgtatcgacttccatcagatggtgcgtcgtggcatggtggagaacaacctgaagatcctggagctgcgtcaggagaatctgcagctcaagaaggacctcgacgcgttggaggcgcagctgcaccagctcaagatcgcccagggagagatcagccgtcccaagcgtcgccgcgtctgccgcagccagaagatcaccgcccgcaagagcacctccaggcccgagcttgttcgtcaatccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcgttagacgagcagttagtaggcttgcgcgtgtgttttttttctcgtttatcttcttgttgagtcgtgtggggcatggttacgccggtgtgtggtgtaactatgtcggagcctgtcttattttatttgcctaagcaacttgaacgttaatgaaccaatttaatagcagtgataaatttaagaataatagtagtcgtgggtggttagttttaatcgtcagctctccttctctgtttgctggttctgtgaggggtttt

SEQ ID NO: 42730 - DNA, 4009 bp, Oryza sativa
  unsure (1)..(4009): unsure at all n locations
gacttttatctttgcacattttaattgttggaggctttcacattgaattttacttattcttttgcacaattttgaggatagattttagagtcgatttgggacgcgacaaacctaccccccttaaacggaatctcgaccccgagattcggaagaactggcgaagagatcgggatgggctgccttcagctcgtcttcgcgctcccaagtagcttcttcttcggcgtggttgctccactggaccttgcaaaaacggattactcggttcctggtcctgcgctccatggtgtccaggattttcactggcttctccacataggtcaagtcttcgcgaacttcaatttgctctgagtcggcctgctcggatggcactcgaagacatttcttgagttgcgacacatggaacacatcatgcacgttgcccaaggaggcgggcaactccagctggtaggtgacttctccgcgtcgagcagtgatacggaagggacccacataccgacgtgcgagcttcccttttgtctgaaacctgtgcacacctcgcaatggcgtgacccgaagatacacaaagtcatccactgcgaattccagatcacggcgacggttatctgcataacttttctgccgagactgtgccacctttagattatcccgaatgattctgactttagcttcagcttctctcaggatatcagtcccgaacacttggctttccccaacttggtcccacaggagcggtgtccggcatttgcgcccgtacaacgcttcatagggtgccatttgtatgctggcttgctgtagctgtattngtaggagaaactcgcataggggagactcttatcccaggtcttcccgaaatctaggacacatgcgcggagcatatcttctaggatctgatttagacgctcggtctgtccatcggtctgcgggtgataggcggtgctgaaattcaatcgagtacccagctcttcttggagcttcttccaaaagtgagaggtgaattggcttcccctatcagatacgattttcttgggaataccatggagactcacgatcctagcgaagtagagctccgctagtttgttccctccataagtggtcttcacaggaatgaatcgagctacctttgttagtcgatccacaattacccatatagaatcatatccaccttgggtttttggaagtccggtgatgaaatccatcccaatttcatcccacttccattctggcacttggagaggttggagaagtccggccggtcgttggtgttctgccttgacacgctggcacacatcacatagagccacaaactctgcaatttcccgcttcatgctgacccaccagtatttctccttcaagtctaagtacatcttggtactgcccgggtgaatggaataaggactttcgtgagcttcctgaagtatcagctgtttaagttctctgttatcgcgaacgcatacccgctttccgttccataaggttccgtgttcatcctctgtgaaacctgcggctttaccctgtttcatattcttgaggagtccatgcatgtccggatcattcttctgagcctcgcggatttgatcgagcaaggtaggcttggcttccaacgcagccaagaatccgcgaccaactatgcttaggttcagggcttccatctgttgattaagctcgggcggaatgctacggacgttgagagtattgcaatggctcttccgacttagagcgtcggcaaccacgttagccttaccagggtgatagtgaattcccacatcataatccttgatgagttctaaccatctcctttgccgaagattcagatccgactgggtgaagatgtatttcaagctcttgtgatcagtatatatttcacagcggttcccaatgagatagtgccgccagatttttagagcatgaaccaccgctgctaactccaagtcatgtgtagggtagttgccttcatgaggtcgtagctgacgtgaagcataggctaccacatgaccgtcctgcatgagcacgcaccccaatccttggcgcgaagcatcacaatacaccatgaaatccttgcgagtatccggcaagattaacactgacgaggaaaccagcttttctttgagagtttggaacgccttctcgcattgcgggctccacacaaacttctcttctttcttcaacaactgtgtcatgggtcgagcgattttggagaagttctcgatgaatctccggtaatatcctgccaaacccaagaaactgcgaatctgagtgactgtcttgggttgcttccaatcggtgacggcggtcactgtttcggggtccacagcaactcctttagcagatatcacgtgtcccaagaatttgacttcggacaaccagaactcacacttgctaagcttggcatacaattgatgttcccgcaactttcccaacaccagacggagatggtgctgatggtcttcctctgattgtgagtatatcagaatgtcatcgatgaaaaccacaacgaacttatccaagtattccatgaacactttgttcatcaagttcatgaagaaggcaggagcattggttaagccgaacgacatcaccgtgaattcatacagtccatatcgcgtagtgaatgcggtcttcggaatatcttcttcacgaatacgtaattggtgatatccgtaacgaagatcaatcttggagaatacagtggcacctttaagctgatcgaacagatcatcgatccgaggaagagggtacttgtttttgatggtgacttcattgagagctctgtagtcaatgcacatcctcttcgtcttgtctttcttctctacaaaaatcacaggagcaccccatggggaagtactcggacgtatgtaccccttttctttcaactcttccaactgtttctttacttcggctagttcatttgctgccatacggtagggtcgcttgtgcagaggagtggttcctggagcaagatctatccggaactcaatctctcgcttgggcggcataccaggtagttcttccggaaacacgtctccgaactctctgacgatggggatttctgacagttctatctgatgaagttctgaacttctgacagaggttgggggtgcaaagaaaacaaccggttgttctggtcctcggtacagagtgacagtgcgtctcgcgcaatccactactccttggaattgagccaaccaattcaccccaagaatcacatccaaattcttggtgtctagcagaatcagatccgagggaaaaggaatcccctgaatttctatagggacggcagggctatagtactttgctgtcataacccctccaggggtggtgataagcagagggtttctaagcctttctacccccaactgattttctccccacgaatggcacagatataaacgagtgggaagctccagagtcgaacaaaattgtagcagggatggaatgaacgaggaacgtaccaacgatgacgtctggagttgtcagcacgtcctcggccgtcacgtgattcacacgaccctgaatgacgtccttgccaccgttgttggagcggggaggcgcttggccttgctgacgccttggcttcgggcatttatccgcaaagtgcccgggctcgaagcagttgaagcacagacgctgctgaccttgagcgtccctgcggccttgaacgggctgcacagttggcgtaggaggacgtggcgcacgagtcccttgctgattctgctgctgttgctgctgtgggacgcgcaccacgaattgaggtcgaggcgcggagcgaggttgctgctgctgctgctgctgctgcgaggaggatccccctgggtagggattggtgtagcggaccctctggttagcaccctgctgattgcggaaattcgccaagcggcgcttgtgcgattccagctccttgtgcttggcttccaagcggatgctcttgtccaccagacgttggaagtccgggtagtctccagagactagacgaacggacagctcggggtccattcccgccaggaatttctct

SEQ ID NO: 42731 - DNA, 720 bp, Oryza sativa
catcacaatcttcagttttacgcttacgcttaagggaagaaatgttcttggtggatgcaggccttggtacccccaaaatttgtatgcaagatgagcttacaggactgccaatcaagcgagccaccaggtttgagaatatggtgggatccaagaatgtagtggctggtgaatcactgatcaaaaagcggattgaagagagattcttcatcgatctagtggccggtgaatcactgatcaaagagcgagcagccgccaggtttaatgattttgtgggatccctggatgtagcggctggcgaaccgcttcttcttccacaaagattcagacaaaaccgagcttggatagaactgaagaagatttggcaaacgaagaaaaaggtcaaagggtttcgtattaaaaaaatcaaaggaggttattcagtagccatcgcaggtttcattacttttcttccattcgctaaaaaaaaaaaggatagcgaatgatcgattcaccattgatagctttaaccctaaaaggagggatattgtgataatagcggcagatcaaacaagaacttgatgaaaaaaataataaattattaaaaatccgaagcccaccttaatccattttgttgaggatcttgcacttattccggccctatatttacatagccaagaaaggctctggcgatcatgtgtgactgcggagcgcctatcgccctggcacggcactctaaaatgt

SEQ ID NO: 42732 - DNA, 2763 bp, Oryza sativa
  unsure (1)..(2763): unsure at all n locations
cgaagtttagaccgctcacagtagttccacccatagaaaagatcatgaaagaggcgatcagaatggtacccgaatccatttacgatcccgagtttccagacacatcgcacttccgctcgggtcgaggctgccactcggccctcagacggatcaaagaagagtggggaacctctcgctggtttttggaattcgacatcaggaagtgttttcacaccatcgaccgacatcgattcatctcaatcttgaaggaagagatcgacgattccaagttcttttaccccactcagaaacagttttccgccggacgactcgtaggaggtgagaagggccctgactccgtcccaaacagtgtactactatcggccctactaggcaatatctacctacacaagctcgatcaggagatagggaggatccggcagaagcacgaaattcctcttgtagtgaaaatcagatcggttctattaagaataggtcgtcgtattgatgaccaagaaaagtatggaaaagaagcaggcttcaacgctccccaagacaacagagccctcatagtggggagggtaaagagcatccaacgcaaagcaacctttcattcccttgtttcatcgtggcacaccccccccacaagcacccccaggcgaaggggagaccagaaaacgccttttgttttccccccttcagcggccctagccgccttccttaacaagccctcgagcctcctttgcgccgccttcctcatagaagccgctgggttgaccccgagggccgaattcaatggtagagaaggctttaataagaatttggccatgagagaccttcttaagtattgcaaaagaaggggcctgctgatagagctgggcggggaggcgatactagttatcaggtcagagagaggcctggcccgtaagctggccccctttaaaagccattccttattaataaggatttgttacgcgcgatatgccgacgacttactactgggaatcgtgggtgccgtatttcttctcatagaaatacaaaaacgtatcacccacttcctacaatccggcctgaacctttgggtgggctccgcagaatcaacaaccatagctgcacggagtacggtagaattcctcggtacggtcattcgggaagtccccccgaggacgactcccatacaattcttgcgagagctggagaagcgtctacgggtaaagcaccgtatccatataactgcctgccacctacgctccgccatccattccaagtttagggacctaggttatagtatccctatcaaagagctgacgaaggggatgagcggaagaggtcgtctactggacgcggttcaactagcggagactcttggaaaaaatggactaaaaagtccccaagttagcgtattatgggggaccgtcaagcacatccggcaaagatcaagggggatcccgttgttgcatagctcaggtcagagcaaggtgccatcaggcgttcaacaggcagtctcacgatcgcgcatgagtgtcctgaagacaaaattgtatactccctttggtcggaaggcggcgggggaaggaagggggcactgggcgggatctttcagcagcgaattccccatacagatagaagcgcctatcaaaaagatactccgaaggcttcgggatcgaggtctcattagccgaagaagacccaggccaatccacgtggcctctttgaccaacgtcagcgacagaaacatagtaaattggtccgcgggcatcgcgataagtcctctgtcctactacaggtgctgcgacaacctttaccaagtccgaacgattgtcaactaccagatccgcttttcagggggatccggccggccggcgcccacccgactagagggactgagaaattaatcgagtacaaaacttatcttcaagctttaccttattttgatcgttcagagggcgatcgcggagtcactgaatgaagtcctccctccctttctttcggaggtgctgacccgctgcaaggcagatatgactaagtgacatattgaatatggcgacgactacagcatgtcgtagaaggagataagaggtggagccaacgacccactaagactcacgtatctacaactacattcccgagcggcagtcaaacggaggcgtgaatgcaagatgccagcggaatgatcgaccggacagaggctagggcagctttcttcccaccgcgtccttccttgtgtgtcggagatacaaagcgagtgcaccggaaaagaaggggaactgagtcgatctatttccatgtgcgaaggcatgcggaagcataacnntgcaacactcacacgatcgtgttgccgagagataggagcattcggtggatccggtgaactacacttgcttcttgatagatgtgtgggacagagggctcgtggtacctgctgcccacccttcctccgctttgataaccgtgtgatcggagagtggtcagagcaaaagggaaggaggtcctcatacggagtcgcacacttgagcagtgcgggagactggagaatgggtcgagtaaactcccttagggccgattaaatcacagacgaggaacttttcttgatttttgctttttgatttgaagggtatgttctaaaaaaagaaaggcagaggtaaatacttcgaagaggcggctcggtagggatggaatggtcaatcgtcaagtcaagcatgacttctttgttggcgaaacgatcggggggagaaagcacgccactgattctccgagccggtctccatttccaacgcctcgggc

SEQ ID NO: 42733 - DNA, 1492 bp, Oryza sativa
gagccccactcatattcaaaaggcgcccagctttaaagacgatgataataagtagttaggctgccatttttccaatatcatggaatagcatggcccggggctaaggtaactccagtgggagagccgtgttatgggtgaccttattgcacggttcagagagcacttgtgtatgtgatgcaagtgaacgtgtacgaaaaagctgtcgtaaagtttcgttgttcgttccgtagttgaccctatctatgtttctacgatggcccaagaacacgctcattcttcagccgtagagagacttttgaattgtgaggtaccattacgagctcaatatatacgagtgttattctgtgaaataactcgaatttcaaatcattcacttgcttcaactactcatgctatggatgtgggagcatcaactccgttcctttgggcttttgaggagcgggagaaattgttggaattctatgaaagagtcccgggagccaggatgcatgccagtttcatacgacctggtggagtggcacaagatctgcctcttggcttatgtcgagatattgattcctccacacaacaatttgcttctcgtatcgacgaattagaagagatgtcaaccggcaaccgtatctggaaacaacgattagtggatattggtactgtcactgcacagcaagcaaaggattggggattcagtggtgtaatgttaagaggtcgtgcgacatgaagacattgatagcaatatgggggaagttcccatcaggcaacaacggttctgcctgaccctacaaaagcatgcatatgttgtcagtgaagattttgtgtgaagccttggagacgacgtacccggggctggggtgagctgaggggggacagcgtaagtgagcgaatgtgcgtaagcccagtcaaagattcctattctaggcggggcgggccatcaaccttcgaatggtgttggtcctacggaccgtgaacggattcgcctctggcctctgggcacgtcggaaccgcatgagttcaccggggtggagcacggtccgccaaaatcggcataggttaggtgctattgatggaacatggtaagcccatctttccccatatgaaagtgctgcgggcacatagagatgtgggtagaggaagtctcaaaaagcgaaggccgagctgtaggtcacgtgacctgcaccgaaaaggtggctgactgggctttctcctggatcaaagcagatcagctcgccaaattcgtcgatcgaatccccggaacgtcgaatgaaaatacgtggtctttctacaaccctatttatatgataggcccggcccctttccccctatccctcccttatgtttaggagcgggatctgcccaagaacgacctgtggtggtacggaaggcacggactccgcaagcgtcccgcaccctttgagaaagaaactcctcaaccattacaagataaagaagtatgacgctctgtgtctgactctattggtcatagttccttgctgtt

SEQ ID NO: 42734 - DNA, 6551 bp, Oryza sativa
  unsure (1)..(6551): unsure at all n locations
agcgaagcgctgtagtagcgtcgnagactatgtgctataatgctgaactaaggacgttccgccttatctatagaagcagtcaactgagttctgaacgaatgggatctttggtgggtaatggctcaatcaatctatagatggaaagccttatgatgggaaactaccacgttaggtttggagagagatgggacctgttatagtttaaggggagcagatgcaagctttttctttccatagccggccaaatgactaccggatcatcggtctactctacctcaattcaccatttcgaactttatacagaaggtttttccgtaccagctccttctacctataccgcagttgaagcacctaaaggtgaatttggtgtctttcttgtcagtaatgggagtaatcgtccctaccgttgtaaaataagagcacctggctttgcccattcacaaggactcgattctatgtccaaacatcacatgccagcagatgtagtcaccatcataggtactcaagatattgtgtttggagaggtagatagataggacgtagtcttgctcgatcaggaccctagctttattgcgagccaaaacagcctgaaagaaagcaagtgtgccatgtaaagccatgcctgagtttcagcctttcaggtgatagaagggccatccacttcaactctcgccctcccttttaggcatttttttacagaggcgtggaattggcaaaagaaaaaactacaatttggtaataaaatctacatggttagaattgccataacgactatattgaggagtttctgaaacgagaattctcatagatgatactaaaagcaatgtactaaaagcaggaaagtagcagttctgggaaagtgagaaagcaaagagaggcacgtttgttaacaaagcggaaccaaagacttctgcctacagccaaacaaaacttgcaactatattcaataatgcctgaaatgctagtaaaccaaaccgctccagatgggcttcctaccggcagatgttataccttcccgctatctaacgtgtacggcccaatagatagatgatgccaaaaaaccggacttattacaagagcttatgctccttccacctcgttcttgatgtaattgcaccctctgtgtgcctttcctctgctggtcaaaaagtggagagattgcgtcaacgtggatttttagtttatcttgggagtgttcttccagcttgtcctcttccctacggttttcttgcatgcagtctctgggaggactaaggaaagatcctagtactccaggtagggctctagagaagattccctgaaagagctaagataactaaattgatttacgctttcctctttcttttttttttcatatatagaattggaacgatttccttgcctgtgatgggccgcaaacgtaagttggttgttagcgccaactgaactgcgtaaccaaagcgattccccttattggaagatagggttaacctatgtcggttcgactccggcgagtcgccccccattattagttcggcgtgctgtcagtttcacgggcctaatatatgatatttagcatatacgagtgctggtacaacctactgttatatgcaactggatctgtatacctatcctacgctaaggggcaggtaattagacgggagaatgttctctaacataggaaaaagtttacactccacgatactcaacgtatgcggaagatcgagctctcccggtagagaacgccgcaagagatagctaactaaactcacttatagggaatggtttaatccaagtataggttgatacacactctttgaacaaaagagagcgagggtttaacacgtatcacgaacgttatgatccgatagtataggttgaggagtaagtaggttactaaggataagtaaatcataagacgatatcttttcttaagccttcccatttcttccttgttggagtgtataaactactctgtttttgacagtgtgattcacggcctaccctagaggttgtattaaacccgggctgcctaacagcctgctcctctttcccagaggaggggacggataggcttgagtttgacttctttccccctcttagaaattcctgaagagtgcttcaagctagagagtaagttgggattcttacttattcagtaagttgaatacaggcctaaaagatacatatggaggtacaaaagagcatcattggaaagttaatacgtgaacaaccccttggcggtaccagaaacagaaccctttggaaaaaaagtatgtgagatactcagatctgaaggaaaacactatccacggatagataatccggtatagcatcacacctattacaggtgaaaggtaagaatagcaaggagggaaagccgtgaggaatgaaacagttcatttcccttatttacccggataaatactttaagacaaacccgaatacagaattccctaattggtaagggatcagatgctaggattaacctgttggagaaagacaaagagaatggaatgagtagtatagaaaaggggaaaatgaatcagcattcccaaaacaaaagtaagatagggttggcaattccactacttcaaaaggtttgtgccttcctcggtaagagaattctcaaaagctatgaaccggtataggtaggatagggtagtattgttgggataaaaccaaggaatccatcatcagggaatgtaaccccctccttggaatcgtaattcgcgaaagacctcgcgccagtcaaagctctattccctttcatccagcccggaacagagtgtaggcgagcccggattcaaagtaagatggtcgaaaggaaaggaagaataagaaaaggaaaaagcaatttcgagagctattctcttttctattcagttcggaaaagaacaaagataagagaggaaatgatactccactcactagacaataaggtcttacctcgaagtgaaatgaaagccaataagaaataaagagttcttttagacgccttcgactgtcgggttctagctaatggaatgcaagcactttcgtttttgtttctagcccggagagagaggcctccgcttttatcgcattgagtggaaattggggttcacgcacgattttaaaccacccttgttcacggcattctacttttctggcagctttgctctctttctgaaaaaacagacacctttctttatacgacgataggaagagcacaatgcacgctttctacgatgaatgagctcgagagttatggaaaacgaaactctatcaatcacctaacaaagaaagcagtcatacacttccactaactttcatgaccggttggaacgagattttctgactatgcagatccggaacgaactgtccaactcacaattgaacatgatgccccaaatcaatcttggcccaggagaactagtagcggagcgaaggaaagacctcacattacgtacgccagaagaagcttgtgaacgcgatatcaagtgaataccgcccatggccaggaattcctgaacaaggaaggatacccagattaggaatatggctagcagaaagcagcctcgaagatggtcgagtgtaatcacttctctcactacggaaaggaagctgggccgaggcgaacaagacaagccgcttagcaagcaggaaaacaagtaggcgaaagaagaggtttaagttaatgagagcttgagaatctagttatttagtcaactttctcttcataagggaataaggcgggtgggtgaaaagcctataacaacatcaaaatggaaaaacaagagtctcagggacccagaaaaaggattttttgacatgttttgtttcttactaggatgctttgaatattccacttctttctatccttcccaggcccggtgaaggaaacttcccttaaacctcctcgctagttaagaggaagtcttgtcttgggatccagagctgttcccttacttgttcagaattttaatggagtatcttccccaaatgttcagcctagcacagcaaaatggtcaaatcagtggtataaagctggcaccgacagcaccgtgcattactcactcaatgtatgcagacgatttggttatctttggccaaacaagcaccggctgcgcgaaagcaaagcaattcaaagaattgaaagagagagaccgaagccataagttacgcatttcacggtcgtatttaataattcaattgaaagataactcaacgtgcttcgtttgctttttcctctccatggactaagataagactagttgttggttgtaaatctgggaatagtccagactgagaatatgcatcatctcgttagcaaaggaaactcactctagtaagatcaggcaaggcagcatatgatccaaacattcactcgctctaagcacgggaatagaataaaggtatgggtcccccaccttaccatccgttctgtcagaccaattgctaaagagttttattcgatttgagacaatcaggagatgggcctttctaaaattgaacagccggtattgtggcattcagatctgccttattgaccggctttggtcgagcaacctctacatttcttgaacggctacttccttgcttaaagcacattcaattagcgtatttagagattaatagctcggtttcggcctgggcgtggaccgaagacaatctctatttcagctctctttttcttcatcaacaagctcagcattgaggggatccatttggatcaagtcttgcttgaatagaattcatttactttatttccgcacctaggcttgattggccgaagctccatgtcatgactgaataaagcaagggagtctctgtccggttcattacgtctttctcttactgatctaggatcaagggctcccttctcggtgtctaccaataaaaaaacgactttgaaggctatgtgccgatcgtgtgtgttctctcgtccatctcacgcttcgcgcctcctctttactcagattagcctgtagagcatagaacaagtatatgcgagtccgagcaatgagctcatccagaagattgttgacattatcatcgctacgcgccttcgctacgcccctattcgttttctttgttttctggggatagcttttcatttcgaaatgcatattctcgtaagtagacaagtcgatctcgtgagtaggaattctgctcagctttctcttcactagtctgcttacgctatcctccctctggctataagcttatacagcatgactccagccattagcgtgactacctcgaaaagtggtacgactataagcttgctttttctatagtaataggccctagcccagtctacttgacatgagaacttctctatccttcttctctgccaagcctagcttgccctatgggaataagaaaaccttgccttatcagtctctcgtgccaaaagagaaagttgtccttccctggaaaatcgagttcttttttgtttcgtagtagtagaattgctagaaaatataagatttcgttgtagaatcctaaaataaagtaagtactttttttaagtacataccaatctagttctggacctctacatatcaaagtcaattttattttttttttcaagatatttaatgcaatgaaaaattaaagaacgattctccacagagatatgtacataagggggatccatagataataatgctgttcggacctggagtttacctatatacggattaggcataaatccattgtcttttattatgccattaaatggcaggctttatcttatggaattttattaccggaggataggggacccatttttccgacatttagacgataaagtaactgcttttctcactattctcagaatgagggattgggattgaccgggacctattctctggaaacttcctactccttagccaatccaccttattcaggatagttcggtatgaatggtattctttttagtcttaatcctaatacttctatcatgggctttttcggtgctctggggaactgggggaatgaaaacgaagcactggtagatctcattagggccttcctgaagacagaaatcctagacaaggaggggaatagttacacgtgccgagagaaggggattgcttgtgttatgaatgggctatcgaacttgttttgacatattatcatatcatatagaaatagagtttttagacagaatgaatcaactcactcatttttccttggtcatcattttttgatatctatgttcggaaaagggaagatagccctgttgagaaatgcaaggctgacagatgtcccactgtgccatgacacaacggatagcggacggaagcgaggaagggggaagtagaccctatcgaccgcatgccgaaaatgcatttatcctttgaattactcattgaatggaatttcgcaccggaaacttttctaggagaagttcgaatccgttccgttcggatattgatcggtcttggtttgacatggtttacgcgttactggttctcggacgagtcaatttctccattagctaaaccctttcttaccctacctttggactcgtattttgttcgtacacaatcaacggacgcccatccgacatatgttgcaac

SEQ ID NO: 42735 - DNA, 943 bp, Oryza sativa
ccaaacagttgtccatgtaccagtagaagattcggcagctactgcagcccctgcttcttcgggcggaacccccggctgaggagttactcggaatgctgccaagatatcagtatccttggtttcgtactccggggtgtagtaagtgtcgcgtcccaaatcgactctaaaatctatcctcaaaattgtgcaaaagaataagtaaaattcaatgtgaaagcctccaacaattaaaatgtgcaaagataaaagtcaaatgaggcttggaggatttttgtatatttcctaaaagcctaaaatacttaaacaaattttagtggaattttcagagcacaaataataagtgaaaagaaataaacaaagttaaaaaggttttataaaaagaaaaccctaaaagaagtcttttccccctcctcctcccttcttgggccggctcggcccattccctccctctctctctctctctccccccggcccatcggctccccgcgcgcgcgcgcgccgctgacaggcgggcccgcccgccgctctcgctgacgggtgggacccacctgtcatctccctcctcgcgccgcgtccgccgccgcgcccgtgccctagcgccgccgccgccgcggattgcgccgcatcccgccgtccccgcgcgcattaaagagaggggaatcactccccgtgattccctctcccgtttcccccgatttcccctctctctctccctcggattcgttcgaatcgtgcccgcattcgtcgccggcgcaatcaaggcggccgaaatctccgcgacggattcctccctctccggccgctctttccttcccccggcgctatttaaacgttgcccgagctccgctctttcgtttccgccgctcgccgctcactctcgccgtcgaaatcgtgctcgcgccgtgctcctccctctccgccatcgccgccgagctccgttccg

SEQ ID NO: 42736 - DNA, 1732 bp, Oryza sativa
caaaattctcaactccgcctttagcttcggtgtactttgtgttgctctaaagtcacactttacctcttcatatcttttatctcccaccaatctgtcaaagtgctcaaaaaaagtaagcatgtcatacttcacactaatataaccctttaattcattattcaggctttcatttctttgggtggtactcatatccgcagaaaacgtgttccggccatatactaatgcccattgctcccttttcttaaaaatccgttgcaaccatgtattttgctggagcttatatttttcaagcaattggccccatgcacgtaaaaattcttcttcctcttcctgatcatatatgcagttctgaaagtcagcattaaatttcttatagtccttaacacacccagcaaggtgcttgcaggcattctgattcatgtgccatacacatatccgatgatgagtttatggaagaactattttaattgctttagccatagctgcatcttcatctgtcaaaattgtttttggcttctttcctgacatgacatttagaaaagttttaaataaccagacaaaactattagcggtctcatcatatagaagagcagcaccaaaaatagtagtcttcttatgattattcactcctacaagcaaaccaaaagggcgtccgtcatccaactttctatatgttgtgtcaaagcatacaacatcaccaaaatcttcatagtcggcaaccattttagagtcagcccagaaaatgtttgtaattaagtcatcctcatcaacctgaatagaataaaaaaacttgacatcttctgatgctttcttctccatatattctaacactcccccagtatcaccttgtttggtttgtagtgacctcttggagtataatttattctttatgtcaacacgagtaaacccgagattctcaaatccacaagcttgttttgccatcaaatcaatagctgctttagtagaaatccctatggattttgcgacttcaatgcttgcaacttgagcttcatttatcttcctttgtgatcttaactgatgagcctgacttctagtggcaagattatggttatgttcaggcacaaagtgatagatagaatagaatccatctatgagacttatcttcatacatgcttggcatttgcatcgagtttctggcttactaaaactatcgccatagcctgaagcttctgctcttttgtcaatacctctacttcctgttaatacagtgcactaattgaaacaaaatgtctctaattgaaagttaatgtaactataaaaagaaacaaagaatttaccttgacgagaacaacaaaatgtcatgttttttataattttagtatttccaatgtaatgatagctgcttcttctaatgctgaaacctttcttaagagcataagcattgtagaaatcataagcttcttgttcagagctaaatttcatgccaatctttggcaccaagtcttccagatattttgttgtatgagcagcttcatttgttccttcatcctaattttatccgtggtaatagtttccatcaaaaaattgcaaaaaaaaaaaaaggaacgatgaatatagttgttcatatgcacgtgcacatgtccggatcttacagtttagatgcaactaatttaacaaaatgtaaaggagaatagatagggatcttacagcttctaattgatttcttctcaggccatcagagggatctgtggactcagcaggatttgatgat

SEQ ID NO: 42737 - DNA, 13475 bp, Oryza sativa
ggagagttcttgttagtgtggagacgcaatctgtgtagatgaaaataaaacaactgtgtatttgtacttatgtaccgctctaatcctttttcccgccactaattttatttgcttggcgtcatatttttgttagcgcttaaattgcgttgtttccaatttaattgtgatagtataacatgggacgatgacgccgtttaagtgaaagaggagcgcatgcgtactgacccaccagaaaaaacccagcgaataagaaggtgacacgtcgccaggaacagggaagggaacaggtatcgggacaggaagccgcatccccagcgagcagtgcgccgcgttgactcttgctttgcattgcagggccctctactttgggcagaggaaacacccggctcacgaaacacaccgtcctgaacttccatgcatggcagaaatgcaataatgtttacctacccggtgaatcaaaaacgtagtccgtccgtattttaatttatgacgtcgttgactttttaaccaacgtctaaccatttattttatttaattttttatgcaaatacaaaaatacttatgtcatgtttaaagaacatttgatgataaatcaagtcacaaataaataaatgataatttcataaattttttaaataagcagaaatgtcaaacgtttattaaaaatgtcaacagcgtcatacattaaaatatacggagcgagtattaagttcggaggtggagttagttgatggcggtgtgctggtgcgtttctaataactaggagatccaggctggtgatcattgtttggggtcattgatgtgatggctccttctctaccggctaattttataactcgtttacacccttttaatttacaggagcaatattttgcatgcgtggtcattacatcgattaattatagctagagcatgcagctgttgacatgtcattaatctgttggtataggttactgaagacacaatatatgatgttgtatacatatagtggcatactccctccatattaaatatatgattatgttaacttatttggttaaacttctgaaattcccctcatcaatagctctctttagtttgaaaacataaaaataatatgagtaggttttatagatttttcgttttaagtacgtttgcaatattataattttgttggatactatcactatattctaatagaaaaatagtgcttaaacttgcgcatcaaagacaaagtaaagtctccccttcaaacaataaaagatagactaaagtcaacaattttatatatttaaatacaaaaatagtacttatatatttagatgttgaggcctatatgggtgccaatgctaataaccttttattttgatacatgggttgtatttcataaacctataacttatttattatgttattgaaccgcactgtatcagcagaccactcatccaaggacaggtaagttaaccaatcagtcgacccatcatatttatcgaaaaaaattccttacgcggtaatcccttctatgtacttaaattttactttttttatcccctttattttgatcattttttgtagataatttcttgtatgcccctaacaatttagccaatcccttccatggcgttgagttttatttactcccttagtgtcatgtcccttaaatattaatttaattccttccatgctcatttcatcagttgaccatttaatgtataagaaaagttagttttaccattgggcatgtaaggccattcccaacccaatgactaggatgatgtctacagcattaaataaggcaacatatcctatgcacacaggccctcatgtgtacacacgtgcacaccaactaaaaaatgtcaccaaaaaatctagaaaaaatcatacacatactttcaattgtattacacctagggttaaaatcttaacgtcaaattcattatattttagccgtaacaaaaaaacaaaaaatctgacagttttaaggttgtaattttgtcagaattttatcttttttgttattctctatgtagaatgaatttgaagatgcgactttgcacgtagatgtaatactattgaaagtacatgtatgaattatcctagaattttttgtgataatttttagttggtgtacatggtgtgtacacgcgaaggtctgtgtacataggatacgctcccattaaataatatgccaactagaatgaaaaatgatgtggcaagtgaatacatgaggaaagagaaggaaatcatgtcttgcataagacatgtcttgcatgagacatggtttctacacaacatccaagacatcatatgagataagtagcattaaatttaagtatgaaatagtggtgtttgcattggaagaatagtgtctagtactagtttcttgataattcttgataatgtggagtttatagaaactatgtctagtgtcttgggttgggaatagcctaagttatttatgaaatctaccgttggaagtaagtaatttattgcataactataatattcataagtttattgtgtgagaaagtattaaatgcagaaaatctaacatatatttaaagaaatatatttagcattttttaaaggataaacatgacaattcgtcttgtatagtagcatttttagataatatatacaaaatgtgtcaaatcttttgtgctactgtcacaaaaatatgatacatatgctttttaataaatagaaatatactttattatcgtctaaaaaattttttgtcgtgataatacctcacataatgacactcgtaaatataactgtctcatacaacaaactgcaacacatccaacaatatactccacaaatttagaagggatcaaaccaaaatagaggtacacaagagagtgagacatcatggtaagaaaaacagaatgctcaacataaaaagttcatttccaaaaattgatgggatataattataggcaaatgttgctacatgatagtcaatgtttatttaatttacatgtggacatccaaaaacgtgcgatgactagaggacacctacagaatggtaatttactgaacgacaccacactcattgttttaatattttagatccaatcgaagggatttttttttcaaaaagacaagaattcccctcaggccacaaaattataagctacgctggagaaaagaaaagaatatgatgtatggtagcagtgtactttgggggaggatagattgagagttgcatgatgtgtagtttgaaaatctaccagaaaatgtatatgaaaatttagatttttctgaaaatctagaaattatttttaaaaaattcagattttttattttttattttggaaaagttgcaaaatgtaccagttgctgctgctctagggttttggagggggttaagagcatgcccagcagatactctaaccaatcctccatcccggtattggcgtatatgggtgaaaaaaatgccctccagcagatgcgctacccccacactccaaaattggcggatgcgccatagtaggagagagaagaggcaaaaatagcgtatctctctcctcacgccatttcgcacccgcccccatccagactttcgcaaccaccacccctccggtgtgccttcccctcgccgtcgtccccaaccggcgtagatgagttccccgtgcccctttttttgcttttttttcagcgatttgtggagcgagccttaccagatctgggggcgtgcgcggggccttttgtccgccgccgtctccccacgcgtggccgccgctctgcgcccgccgccttcctcctccggcgtgcgcggggccttttgtccgccgccgtctccccacgcgtggccgccgctctgcgcccgccgccttcctcctccggcgtgcgcggggccttttgtccgccgccgtctccccgcgcgtggccgccgcccctcgcttgccgccgtcgccctgcgcccgccaaccgccgtcaccctgcgcttgccagccgccggcgcccctcaccagctcgcccagcgccgtctctgagcagcccgccgctcgcggcgccccttccctcgtcgccctgctgccctcaccgcccacgctgccaagccgcctctccctccgccgcccgtcgcctgcatggctcggggatagaaaagagcaggagaggacaaagaagcagagaaggatagagaagaatagagaaaaagagagataaagacgaaatataagctttaaaatataatataaatgtagggtggttggaaaatattattaaaacatagggagggtgtaatatggatgatctgttggagtgagtagggatatagaggaggaatctttttggatggccatctatataggcatatgaaggattaaatttggatgagctgttggggatgttctaagggagatatggcctggtttggtccaaatcaagccgagtaatatgtgctgcttcgaggacaaatttgtcatttcaacgcactgtctcccattaggtatgaaataatatggtaacggttgtggtgtccttcacctgtagtaagttttttgtgatgttcaccaacaaattacgtaatttgagtgtcggaagcaaaattttccattattatatgaccacaaattaaccaaaaatacattttaaataaattttagaataaatttgatgaaactcatacaacattttcaccaaaatttaaacccaaaacaaaaaaaaggggttttcattcacagtgaaactcgtttatggctgtaaccatcttttgaaatatttgtttcaaaatttaaattttgtttttcaaatttggtgtaaaataattatgccctattgatttattatatttttttaaaaaataacattgatattttttaagtagcacattagtatatatgagagaggggtaatataattattttagagaaacataacggatatctaatgaaacgtggccatgtgggtatatagggataaatgtgaaaacctatgaaacaaaattcaaaggtataaaagagcttgagtaaaactttttttttaagaattacacaatacaacacagacactcacaacgcatgcacactcacccctatgaacacacacacgcaaactctacccctatgagtatcttcgaatactactcaagcacgtgtaagtagttttctgcttttcatactgtgatacaaacctaataaatctcgctatatccacaattcccctacattacaatgagtcatgtccatgcagtacagagcaacctgaacttcatctctttttgcagctaagatcaaaacaactacctgggtggcccgcgcaattgtgcggctagcacctaaacaaaatcaaatattttttagtatgattttacttaagatttattaaatagctatcctcgtatttctagttatataattttaaaagtcacaccagctgctaccctatatttctgtcatattcttctttatttgtttgctcggtctaccactatttctattcattctccttaaaatctttaaaaaatgtttcttatagctttttaagtttattatctcgttgggttttatttttataatttctagaagtcccctcaaatgctgccattatattcctctatgacccatccactgtcttttctctttattgtcattgggattttacaaatcgaacataattatttttttacaaatgaagtcccgccaaaccgtcagcggctttgccattatacttctttatggcctgaccgctgccttccttcttcattgtcattgagattttaaaatcaaacatgattatcattaatttttttttactttttagaagttctgaacctttaaaaattggatcttgtagtttttagagtttattgtctcgttgggtttcttttttttatattttttagaagtcccgtcaaacgatgctactatactcctctacggcctatccgctgcctattctttattatcattgggattctaaaaatcgaacataactatcgttggaattcatttttttattttctagaagtcctgccaaccgtcggcggctctgcaactgtactcctatacaccccgcacgctgcttctcctttttattgtcattgagattttaaaaatcgaatatgattatcaatggggtttgtttttcttactttctagaagtcccggcaaccgccttactcgtttgcttcactgcctgcttgtcatccctccttttaatcatcattagaattctatttgatgttttactaacagcttttatatgtcgtatcaaccgccagcactctacttttttataggccttttacttaatttatctcgtcatgtgttttagatggtctttttttaatagtatttatttttatcatcattttttattatttataaattgtattcctaattgaatttttttatttttataatttatgaatttattttttttcattgtaattaataccgtatagtgttcttttaatatttttaatttttattttttgaatttcagttgtttcaaaattgtattactacttaactcttttaatttttttcattttggatattattttattattttattttgaattttaattaatctcgtattgggttcttatatggatttttctttcaatattgcttatttttaattccgaatttcagttgtttttaaattgtattcctacttgaactcttcttttctttttgctaatttcggattttatttatatttttattctgtatattaactaatctcgtattgggttcttatatggacccttatctcaatattccttatttttaattacgagtttcagttatttttaaattatattcctacttggactctccttttattttctaatttcggattttattttatttttatttcgaattttgattaatctcgtattgatttcttatatggagacttctttcaatatttcttatttttaattctgaatttcagcaatttttgagttgtatttctacttggactcttattttctttttctctaattaatgttggaatttctagcccccacaatgaacgtggagcctcctttcaaggctgttttaataatataatagatagatagatttacccttttatgattgacgtattttgactcttccgagtatgatgggttttcaatttgaacaccaaaactaaggtaacccgcaaatgtggccatgaacaagcaaacgggtttcacatgtttattttgtcgtatcagtgtatcaccatgaagaaattaccatgtcaatgaaggaaatgtaaccactctggatcagggattataaacagagcaccctgaacgcgtgcacataatattgtacagacgcttacctaacccgctctgatatattttttttccttatctgaatatgattgtacacatgccagcctaaccagctaacacagaattgctgcctaattgccaactggagtaacaacagaagtacagaacccaagtaagaaatgtttttgatcgagtgattgattctgtgttgtgattactgaaacaataggtgatcaaatggatttaaacacgcaactcctaatacgtatcctttatccagagagaacttcttcaatacttgaaattaattaggaccattgatctgcaatgatctaacggacagaaagagaaggtacctgaaaaaaggtattaaaagggtgggccaggtatggaaggtgggagggtaaaatggtaattgtttttcattaattttttttcagtaaagggcaaaagcgtattcttacaaattcagaacttttgagagaagcaacaaacattttcagcaggaggaagaaaaaaacgagaggaagaattagaacgctcgcgtgcgagaggaacctacatgatctgctggttgtcgctgccgtaaaaggccgccgcttgccgaggcctcacacgcccgccgctcgctgccgccatacgcgcctacgaaagcagcagctggacaccgtcgccgccgccgacgcacgcgcccgtagcgcccgccggtcgcagctgacgtacgcagcagaaggtcgccgtcaccgccgacgagcccgtcgcgccagccggtcgccgccatcgcacgcgctggctcggttgattagggttaatcttgaatcaacggtgcgacggcttggttgattgggtgacgggtgggatttgagcaattactaagctacccttgttaataaaaatttgtgttcctaaattaccctttgaagattaacgggggataacaattcgttaaggaggtacctggggtacctttcaagcaccgtaaaagatctcttatccagatcatcagcaactgagttttatctgtagaacttgcatacgaagattggagaattagatgagttcgatcggcctacgtatgtaaacacgcaggctgataaaaatctgcaccaaaaatctgaacctgtatatatgctcgcattgtgtccaacctttcgcatcagaagcatcaaatggtaagccgtccggtacaaactgaaaaatcttcagacgcagtacttcagagaccatgaaaaatctgccacgcacgaggattaacctggtatttactgaaaaaaaatatccttggtatgatgtgccctgcatttactgaagattttgccgccgcctcttgctggtctcttcaagacatgaggcctgttttgacaatgtgacatgacaagctacgttgcgaccttgcagcctaacacgttccttgatcagatttccgacggccaacacgtagtaaaatcgtagttttacgatctcagctaggccggcgtctgaacctcgtggcttgcagagccgcttctctctgacggatctgaatttctcggccatgaactgcacgagcgtctacaggttagcagcacacgctgcacgttactgtaccagaaacctggcatctctcttcgatccagtttctgacgaaagatacagcacccagcagctgcttccgattgacaacggctgaattgcagtttcgagcccctcctgagattaattgcagagatgttcaagaaagtttgcatctcctcttcgctgccaaccctgaccgaccactgctgttaggtcaggtgcctgtcacgtacactcctttggtcagaacaccatagcggagctcgcactatataagctgctcgccatgagccataatggccaacaagaaaccacacataatagagcgtattgctcggaggcagccacagccatcgccgtcgccgtcgccgtcgtcccctgcatttatcgccgggccaccgagatctcgcataagtacagcggcgccggtgagagggaggcagaggctgtaggtagctagagaggaaaaatccacgctagctatgccttctccttcctcagctcattggctgagcttggtcggaagcgtctggctccagaccatcaacggcccgaacgccgacttcccggtgtactcgtcgcagctcaaggaggtgaagggcatctcccaggtgcagctcaacttcctcgccttcgcctccgacgccgggaagctcttcggctggttcgccggcgtcgccgccctgtacctgcccctgtggctcgtcgccgtcgtcggcgcgtcgttcgggcttgtcgggtatggcgtccagttcctcttcttggagaggcccgggctcgcgtactggcacctgttcctgctcacctccctcgccggcaacggcatctgctggatcaacacggtgtgctacctcctctgcatcaagaacttcccgtcggacagccgcgtcgcggtgagcctcgcgacgagctacctcggcctgagcgccaagctctacaccaccatggccgagaagatgccccggggcgccacggcgaggtactccaaggagaaggtgtacctcctcctcaatgccgtcgtgccgatgctcgtcaccctcgtggcggcgccgtcgctccgggtggtggagctcaccagccaccgccggaccgacccggcgttcctcgccatgttcgcgattaccctcgccaccggagcctgcgccgtcgtcggcagcatcggctccaagtccatcgggctctcgaccagcgagcacatgatcagcctctacatcctgctcgccctcccggtgctcatcccggcggcgctcaaggtgcgggagagcatggacaagctacgggaggcgaagcgggagaacagagtgcacgacgtcgccgccgccaccgacgtgccggagacggccgtgtcggtgctcgaggtggccgaggcggcggagaacaaggaggaggacgacgccgccgccggcgagagcggcggccaagacgaggtcggcggcatccggctgctgcggcggctcgacttctggctctacttcctgagctacatgttcagtggcacgctggggttggtcttcctcaacaacctggggcagatcgccgagtcccgcgggctcagcgacccgtccactctcgtctccctgtcgtcctccttcggattcttcggccgcctccttcccgccttcttggattactacaccgcaaagtaagcaaccaagctgcatgcatgcatgcatgtgccgatcaaatcaaatcactcgtgttttttacaacttgtttaaatgttggagtctttgtttatgcatgtcctgacaggggatgaatttttggtttgggttttgactatgcgcaggagtggctactcgctgtcaaggacggcgtccatggcggcgctgatggcgccgatggcgggggcgttcttcctgctgctggacccgagggacatgttcctgtacaccagcacggcggtggtcgggacctgcaccggcgccatcacgtcggtggcggtgtcggcgacgggggagctgttcgggaggaagaacttcggggtgaaccacaacgtgctcgtcgccaacatccccgtcggctcgctctgcttcggctacctcgccgcgttcctctaccagcgggaggcccgcggcgccagccgctgcgccggcgccgcctgctaccggggcaccttcctcgtctggggcgccacgtgcgccgtcgggacggcgctctgcaccgtgctgtacgcgaggtcgcgcggcttcgccgggaggctaccgccgccggcgaggtcgacgacgatgccatgcgccggccagcggccagcgactaacttaggagatgataacaagggaccagaaccagaagtttctagtacagcagtttaacaaattaattaggtgccacgtaattaattaagtggagaaaaaaatctacagctagtgatgtggagtaggatttgatgatttgcctttttttttcctctgggaaaaatattttgtttcattagtttctttttctaatctttttgagtaatcccatggtggattgagaagctcaacttgtgtgtacgtatatacgtatatggccaaaaaggaaaggataatacacagctcactttattactagatgcgctgcaaatcactgtgactggacaaagctttttttttttttacatggacggttttaatatatccagcaaacttttagtggatgtaccaccaagaaaggcaacttacaggctgaccattttagggaaagttggtagggaaaacttttctactcagtataggataatattgtcccttttcgggtgtatttaagatcaaatgtatagaatgtatctatgaattgtttttcttgtggccaatggattttgagacagtttgtgggattgttttatggaagaaaaaaatccaacatactccatccgtctcactcaaattacaggacgcttctattttttaaaaaaaaataaatttggtagcttttgactaatgatcatactagctatatctatgctaagtattatatatgttatatcattatatttgtatttttaaatacttcatatgatactaattttatattcgttaggaatataataacgaataacttattgaacaaattatgctattaaaaatcatgtaaaaatataggcgttacaattttgaaggaagaagtattattttctatggggaaccttgaaggagctctaaaaagaaaataagaatgtcatggtattactgatgctatggaactatcgccgacatccatcacttattgatggttaggatatttttaactcctagccatccattcatctcacgtcatttcatcttacccattcgttcatttccattttctaattcaatccatcataactctttttttttgaacggaaaaaacagcacagtagtgctttttcattgaatatagaaggagaaaatacaacccctaggggtaaaacaaaaagatctttagactatacactatacagagtgcgggatgagctcgcgcaatcttttagccccagctaaagcccacaagctggcctcctctttgatttttgctaggagaacacctgttgccatctctttgtgatcaaagattcgccggtttcgctccttccaaatttcccaaactactagcaggataagggaccgaaggcccttctttggaatgccgggtgtattagctaggctctcccaccactgatggactgaccgggcttcctcccattgggccggttccaactgctgatatcccgcccatgtagcaacgaggcgccagattctcttcgtgtatctacacatggcgacgaggtgcaaggctgtctcggtgtcacaacgacatagggggcaatgtccgttattccgccagccccttgtcgcgagtcggtccgacgtccagactctattttgaatgatgagccaggcatgaaatttacatttccctggcgcccaaactttccagattagggagttgaagtttgtgtttggcgcccccaaacattgggcatgataagccgaggaagctgtatagtggccgctgcttgtgaatttccaaacaatctgatccggctcctcgctgtctaagtgcacattccgtaccgcctcccataggcggactagctgatcgaggaggttgattgtgatagatgaacccgcatcgagggtcaggtcatgcacccaggagtcgtcttctttcccttgccgtagggatttcttcctatttttggagatctcatagaccaacggcattaggtcttttggtcttcggccgttaatccatgcggagtcccagaagcgcgtcgtattcccatcgcccacagttatctttgttgaggcggcgaagaggtccctatccacaccatcacaaggcgtttccaaacccacccaaggcttgcttggatctctccattcgttccacaaccatcgcaatctcagagctcttgtaaatttgtccaagcttaggacaccaaggcccccttggctggtcggcaagcatgtctttgcccagttgaccttgcatttccccccggtgatatcccccgtaccagcccaaaggaagcgacgtctctgcttgtcaagctgctccagggattccttcatcaccttcaaggcagtgaggagataaattggctgtgctgaaagcacagactttacaagcgtggttctcccggctgctgccatgtttttccccctccaacttgcaactctccctgatattttgtcgaagaccggttgcaagtccgtttttcgca

SEQ ID NO: 42738 - DNA, 6226 bp, Oryza sativa
agcatcatccgcatacattgagatccgcagccgagttgttcttcctcgtaattttgaaattgcacccaactctgttgccttggaaaggatacgctgtagaggatcaatcgccaagatgaagagaagcggcgagagggggtccccttgccgtagtcctcttccatgtttgatccgttgccctggcgagccattaaggaggacttgggatgtcgaagacgacagtaaagcccctagccagtctatccatcttgtcgggaagcccttgcgctgcagcaaggccagtaggtaatcccatcgcacggagtcgaaggcttttgttatatccaacttgaagagcaacattgcccgtcttaggcggtggtatcttctgatcatgtttcttacgaagaggtagttgtcatgaatacttctcccctttatgaaagcgctttgattgaccgagatcaactcatgcatgtggggccttaaccgcagcgctagcatcttagcgaagatcttggcgatgctatgaattagactaattggcctatagtccgaaacgctttcagccccatccttttttgggattaggacgatgtttgctgagttgagcaaattcaggtgcgcacatctcaggttatagatggagctgaagactagcagaatgtcatccttgatgatttcccagcaaactttgaagaaggccccagtgaagccgtctggtcccggtgctttgtcggctggcatttccttaattgccctatgcacctcctcctcagtgaagggttcccccagcgtggctagatcaatcggtgtgatgtccaacgtctcccagtttagctcgtttggcctcggccccggcctccccatgaagcttgcgaagtgatcatggatcgtcaattccttttcaccgtgcgtcaccgcccaaccactgtcctttttcaatctttggattgtattccttctccttcgcgcattaaccctgaggtggaagaacttcgtgttcgcatctccttcacggatgtgagttaccctggaggcttgctttttccttgccctttctatagaagcgagtcctaggactttccgcttgagagccgccctcagtcgcgtttccgggggggagagttctctgtgctcttgtgccacgtcgagtctttggatgacattgagtgccatatggaattgcaatttagcctctgagcagatgccttttgtccaatctctaaggccgaccgccgtacgttgcagcttttgattcaggtggtgcataggctcagtgtgcgaagaaggttggctccagatgtccttgactttgtccttgaaccccgggacccgtgtccaaaagttttcaaacttgaaggtcctcggacgatgtgggccttgcgggttggacagtacaagagggcaatggtcggatggccctgtaggaaaggcatggagaacatggtgggggaaagcaagatcccattcctcattgcaaaagcaacggtcaagcttgacaagggttgcctttcgacgctcattactccaagtgaacttcctgttttgcagggggatctcatgcagctcacatcgatcaatgactgcgcgaaaacatgatcataactcattatccgaacatgatcatagtgtgtacatgtcttcaatcgttctgtgtaaccaagaaaaaaaaatctaatatcataagaggcaataatactttagacaacagatatgggcatatatattacccccatttgcctgtcataaatcccgttattttcgaacggccaaaattcttcacgatgcgtgcactagtcaaatcacttaatcagtcctctccctaatcacctaaagttgtcatgattcatcatgacccatcatcgccaatgagttctctctcctctaggtcctctatctccatcacttcgtctgtgagactgaatatgtctggctggaggctgaagacaatatatacactgtctagacagagagatatcatcacaacagggttagtatgtggtcaaatgacatatatcaacatatgtttataactttatattattgtgtgctgattgctgaacacacatgtcgcttttctggatttcctcataagcgatcaacttacctgtctgtatatgtcactgcagtgttgcgcaggttaagtaagattcaatgtacggtccaaagcaatcctgagacaacgaagactagccaaggaatgatcggagaagacacggtccaaattaaccgtgtgcatcacggtcagggaaaatgtgtcttcaaaagagaattactctggtctattctccgagaccactgtcaaaaaattaaaaccaaaaggccaagcttctgtcgtggctcttgacagagccacttactgagaagagttgccgtgatctatggtgatcaaaacgctcgtctcacattcctcagtcgatcggcgatgatgcagttaatattgacgagacatcaaccgttgacagttacaccatggcccatgcttgatagatccagcggaagaaagaagacgttcttgcgccagattctctcagctgcggcagtggacacgtcgagatgcgtctcctgtccggctagccgtctctgtttctgagggtcttgccgtcttggaacagaggaactgctatttttactcggtcattaattctgggagccaagtgtttgatgtttcagagtcatattgacctccttaattagatgcctttccaaccgtgacaatactccgaagaaaaacaatgctgcatgctttcgaatttatggtcggtaaaacgtgcatacaagtttatcgctagtcgtactttggcctaacattttggcatatacttcatcaatttctccatggcgagaatgaattttaaactctcgagaaaatatctactcgagaaatatctacttgtgtatgcatgttattcatatagttatatttttttctaaaataatagattaatacatatacatcacttcataaacatgcaaaaaaaaacaccttctacaagttgcaaaaaaagttatagctagttaaattcacatttaaatttgttttcctattttaactgatagaagttaaatttgaatttgcatgtttgtgaaataatctatcacatattaatctatcttgttgttttttattaagaaaaatcataactctgtagaattgtttctcctcgacggctgataactcgtgaaaataatgaagcaaccgaaaataatttatggataaaatttttatatacgtgtttcttagacattttaaagtcaactagaaaaactaataattattagaataataaaatatatgatatattttatataattgtttaaaaattatacgagattttactaattattaaagtgccatgttgcggcttacaagcatttgtatgagtgttgtgtggcggcttaggagcgtttataatatgctttacggattttttttaatatatataatagatagatgctaaaaaataaactactataaaaacatcaaaatcaatttaaaattaagtctttgatatttacttttggctatgaaactgataatcaaaaggcaaatgagaggcaggtggaaattgtgtgctctacctggggtagatgtgataaacacgaggcagttcggttgagatgatatggcccggacggccggtcaaatcctctgctgatcgacagggaggattacaagcgtttccatcagcaatgctctcgatcgattcagcaacttcggtctctttccggtgagctggtttagtacttatgtggttgcttagccagatcggtctaccgtgaatataataagcgcagcatctacatgatcaatccatatatccatcccccatgtctcgtctaatccttcaacgcgaacatgcacgcatgccctgctcactttctatcagcgaaagcttggcatgataaaaccataaaactctcgttgcgtgcatgcatggacgatggccggtccgaatggggctaagtacacgtgagccaagcgagcaggcacaatggccttccaatcctggcatgatttcctctcctccacaagagtgacgacggaaccaagaatgcagaggaggagaggggcaacgatgacgacaaatcgacgatatctgtcgcgtcaggtccaaaaagatggcaaccgtcggcatgcatgctgggaaagtgacggcacgccacgagttggagcgtgacgacgggcgaatcctttggctcgttgttgctgctgctgcgagccccgatcgatcgatcgaaacggatggtaacttttgttattagtttcggggccggggttacttgacgaccacacgtcgcacatacgtccgcgaaatgtttttgcatgcgagtagaaagggtcaaggaaaggagaaaggagaaagtaactaataaccaaagtgccgctttctttacgctactactactactactactactgtgctagtacatgcctgtgctttactacaagtgttagtgcatcagaagactattagtagtagtattagtcagctagcaacggatcgaagaacgctttaataaattctttggtttattttagccggcacgaggtgtagtggagtgacaagtcaagaacgtcatatcgcgagcgagatcaggttcgttcagaagcattgcactatgcagtgcagtgtgcacagcgagcgattctttcttaggacgtccaaacaatactccttttaggagtattattggaggaaacggatcgagaggggctaagctaattaagcaaacctccttttagcacccgcaccgcgcgcacgcgtgataggggggcgcaggatgaaagagatggtgatcatgatcactagcgctagcacaattgcacaaagcaaaagaaaaagctataatagcatcatcgctcgctcgttcacacacaaaacacgaacacgattcacacctccttcggctcaattcagcagctgcaccacggacaggggggcagtgtgccgcccggtcggccgggggagctgaatcctgtgaaagcaatatgcgacgtgcgcgtgagggcaccccgcgcgcgcccgcggccactaccgaccccggaagagacgagcgcgcgcgctgatcgctacggccgccgagacggaacgcgcgcgcgggggcctcgccgtggtggggaggcttgaaaacgccgagcgatcagatcccgcggtggacgccgcccccccgcgcgcttgcgcttgcgtgcgaccgccggccgtgccgtgccaatgggtggattctaccgttcgtagggaactggggcgcagtagaaaattaaactttattatctttacttttttgacatgaatttccgccaaagcgatcggaaagcgaagattctaacgagcagatcagggcacaattgcacaaaactactacgtgcactagcagggtgcataatcattttccggttacgaggagaaaagctgaccctgacagtccattaaaccgccaactgatccccaccactgcaggattttgcatatacacgcttagcacactgcccacccccaagtgctcgtggtattctagtgtgggagcgtcacggtgacgctgccctgatgccataaaccacacgggggaatttataatcacatcgccgatcagttttcagcattattattccacgtcttaattctggctgtgtgccttcgctgtggtcctcttgtccacgagcgatacggccatacgggggcaaattgcaggtacgcgatacaaatccgatcgagacatgagcgtcatgcacgcacgcatatgcacacgatgcagcccccgatcggaacacttctggattatatcggagctacgcgcggcgccgcggagagctcggatcatctcgctctcctagtagcttgtagcgtttttgcggcattggatatttgatgatatttttggaatgaaagggcggatgactggatgtcgtattgcgcatcacgctgatgcaggcagtgatgccatgctgcttcgatcgatgcatgtgtgcttgttactttacattgtaaaagtggccttgcttgccctgctcagtggtatactaacctaattaggcctttcgattctagaaaaacgcattgtcaggcaacagttaattaagaaaagagctgggtatcgtaggtctggtttggccataccatgaacttttcaaataaaagaaaaggtaggtatttgcagtagtgaaggggagcaagaggatatgcatatatatgcgatcaatgatgtgtagtatgcgatatacgctttctgatgagatgatgtg

SEQ ID NO: 42739 - DNA, 2078 bp, Oryza sativa
agaggagtgtggccgctaacttgtgcttcgtgccggtgagcgtgagctggctcgttgcgcgaattcggattcggaaatggagcgtagggcgtgcggtgcagttcgtcacacgtcgttcggctgaacatgttagcccggcccactggaataggccctggattccttgctgccttcaactttgttgcatgaggctggcccagtataaatatacaacttgggaagcttcgtcagacagaagctgaggcccaactcacgaacacagctcagccaggacatgttgcctcttttctgagttttgctgatatctctcgaacgaacattccccggttgtttttatattattcaattagctataaaatttttaaaaaataaatatatattaacatgtgatatatcattcataaacatgtaaattaaaattcaatttgtacaagttgaaacaaaaaaataaataaactatagctagctaacgtatatctatagttaaatttgttttttttttgcaacttgtcaaagctaaatttcaatattgcatgtttgtagagtagtctatatcacatattttatctatcttgttaatttttttcataatcatttacgtaacatgcaaacaacgggaggatgttctcttgagagttttgaatagtttctgataagcccggtaaataggctacaatattagtagtcgaactttgctatactccacatatacttggacctgcagctttgagctatggctgtgtttacttcagcgtaaagtttggattttggttgaaattggaaatgatgtgactgaaaagttgtgtgtgtatgacaggttgatatgatgaaaaagacttaagtttggatccaaactttagatttaaacacagcctagattctgataggcaggcaaatgatctgcaaagaaaatttagtagcaacagaggtacagatatggtcacctactgcccaactcgaaccaatctccattattaatttacatctgcgtatagcctttctgtacgtctttgagtgtcggaggtagagatgacattactagctacagtaggctagcacatccactaaacctgacacctaccgctgctattgtgtattaatgagagatcaaatcttctatctatgtatctattatatactaaaagtctattaaacttcctacaaacgttcctaagccgtcatatggcatcctataaacactcatgtgatgccacatgacaaacaaaacatctaactgttgattttcatttaatttggtggacccatcattatcttttatttttagccattagattaataatccttaaaaggaaaaacaaatgccatctacctccacctccctcccctacgtccgtacatacatactccaaagtcatgtacgtacagtcactatacgcacatcttccctctatctctccccttctcacatcttcctatttaaaaagctagatgtaaatattgcctaaaaattaaatggaaattatattatttaatttataataaaccaaaaatttaatatcaatattgctcacttaaacatatcaatattattttatttaaatttaaataggtggacccattatctaaaatagaaagagctccattaaaaaaatccctccgtcccacctccgtgtgggatgcgcacgtacatatgacattgaaagcacgtatatgcacctccgatccttttgttttaggtaaattttgctacaggacactgctattgcgtggttttagccgtgggacactaccaaactcacttttgggggaaaatactccataaacgtgctaatttgccaatggacaccgcgccgattaaaataatgatttccggttgaggaggagagagaaatcacgtgaaatgtcaaaaatgcccttaggcccactgtcgacgagtggtactcgcggaccggaagaatatggtattggggtatgttggaacagggatctacgtagtacgacatcaaaacagacaaaagacgaggattatactggtccaggccccttatcaggtaatagccctagttacttctagtaatggtctactactaatagatatggactgtgtttaggtggtg

SEQ ID NO: 42740 - DNA, 14681 bp, Oryza sativa
  unsure (1)..(14681): unsure at all n locations
caccaccttagttcacaccaaaattgaaagtttggttggaattggaacgacgtgacagaaaagttgtaagttgtgtgtgtaggaaagttttgatatgatgaaaaagttggaagtttgaagaattattttggaactaaacacggcgatggtgagatagatctggtgacgaagttgccagctagctcgatcgagcacttgcagattatcagcccatctcctgccatttttctcggccataaatctgatttttattttcaaaatttagcctaagtccacgatataaggatctgaaccactgcatgaagcctaagggtgcattcttttcagcctatagatttcgggtgattatacactaaacaagaaacatgattagcatatacttcctctatcttataactataatataagggattgtttctttttttttaaggttaaacatagtggtcaagtgggtagttaggggttaaaataggtagaaatttgaattggagttaacatgtgcgacaaatagtacaccaaaatttcttttactgtgagacaactagaagggatgaattcccttatattataaaatgaagaaatgaagagagtaattaattggttaattattaaaaccttttaaaataaatttatttaattctttaaaagcatgttctatgtagaaaactttagtacggaacaaacattttagtgatttaaaaagcatgtttacgaaagcaaagagtagctaacttcaattagctttttagaacatgccgtaagacatgtgaatttttttttattcaccggaggggagagtttcccacctaaatttcgttaccaaacttagggaagtaatacaaagttttacactgggtttagggattggagaggggatgaaaatatttggttccacactgggagtactattgtgtcctttctaacaaccttttggctcaaaggttggcatcctcgatacatcttctaaggacactcggtatcgatgttggcgcgtttctgaagacaatatcgtgacaatggtttcaaaattcccagaagcacaacagaaaaaagatttggtgatgcagcttaggcggtcttagaacttgccctaagagtgtaagacatgagaaaaagtttttattcaccggaggggagagatccccacctaaattttacaggaatgctagggaacggtataccgtccctccaacaagatgctcctcttttccacaacttgctcgttcgatgtagcaagatatcgcaacgtggtgatggaagcagtgccgacgatgagctccggcgtggaggacgcggccgccggcgagctctggcgtgggacatggtcgcatggacggcggaggatcctgcgtggtgatagagacggcgctgacgacgagctccggcgtggggcgtggataacggaggatcctgcgtggtgatggtgacggcactggtgatgagctccggcgtggaggacgctgccaccggctgaggtgtggacgacggacgcggccgccggtgatgagctcctgacggaggacgtggtcgccggcgacgagcttcgatgtggaccgtggacgagagaggaccgtggacgggggaggatgcggctgccagcgacgaggttcaggttcggtgtggagcgtggacgggggaggacacggggccgccgccgccgacgccttgatgcccagctcctgatatctagcaggtatcatctgatacctcgtaagtatcacccgatacgtcgtagaaatcgcgctatatctgagaggtatcatatgatacctcgcgaatatcacctgatacatgataggaatcgtctgcatgatacctggtaggtatcacccgatatcggctatctatcaggacctgataccttgcaaaagtatcacctgttacgtggtaagaatcgcatgatacctgatagatatcatctgatacctcgtaaatatcatctgatacgtggtaaaaatgcatgataccggttaggtatcaggacctgatacctaaccggtatcatcccgtttttgaacggaattccggtatatagcagccctcaaattttattaccaaacttaaggaagtaatacaaagttttacactggatttagtgactggagaggggaagaaaatatttggttccacactgagagtactactgtgtcctttctacacacacaacctttcggcctaaaggctggcatcctcgatacatcttctaaggatactcggtatcgatgttggtgcgtttctgaagacaatatcatgacgatggttccaaaattcccagaagcacaccaggaaaaaagatttggtgatgcagcttaggcagtcctgacggaggctgtaagtgtgcaaatgttgctcatctcctgaatgattggttggaagccgatcgcctcctagaatggttttgcgaatgggcagtgtaggcatagatggctagctgtttccgttgtatatatcttcgcacagatcacataccgcagtggggactatcactttttttattcaggttttgtttcgttggtagctgttccttgagatgcgtccttttcttccagacaaactcccagttggggcattgatctagttgcggacttgcggtgccctggcattgtaaacttgcgtggatgttagttcgtttgattgtgacagctctctgtttcttcggtcatctactgatttgatcggaacgatcgtatttgtagttgcgcttgtgctgttgaggacagccgcggggagatgattttaatctcggatggacgttcacccgcttcttatatatcatttaaatagttatgaaaaaaaaattaaaaaataataatatagattaatgcaaaatataccactgcacaaacatataagtttaaattcgacttaaaaaataaaaaattaaattgtaactagtttacatatatttgcagataaatttattatttttgttacaacttatagaagatgattttgaacttgcatgtttatagaatgatatatttcatattaatctatcttattattttttaaagatttttcatgactatttaggttgacatgcaagaaacgagtggatgtccgtccgagtgtttaaaaaagttttcccggccgcagagttagtggcacacccccttggaacacagacttcactatgacgtcttgatccgttgcatgggaaaatagggcttcgaacttttggtacaacgtcgggttgatggcccaggtgtcattccagaacagaatagcagttctatatatggaactcaattgttctatctgtaatggattactagtttttttctgttgacagaaaatagggagaaaaactttagaattttttactgtcagatttgcctcaagattcgtgctgtccttacagaacggagtagtagttctatttgtggaactcagtaggtctatctacatgtaacagatttactagttttctgtcgacggaaaatagggagaaaaactttcaaatttttcaccgtcggatttgcctcaagattcatgctggcgtgtgtagggaaaaaaatctgcgcacctggaagggtaacccaggacctcactttgtctcaagattcgtgctggcgtgtgtagggaaaaatccagtgtgagaataaatctgtgcacttggaggggttctaaccgaggacctcactccggcaggctgtgtgtgctagtcactagggccttgtttagaacccaaaaaatttggccaaaaatatcatatcaaatttttaacacatgcatgggacattaaatatgaaaaaaaaaaccagttgcacagtttgcatgtaaattgcgagacgaatcttttaaggctaattacgccatgatttgacaatgtgatgctagagtaaacatttgctaatgatggattaattaggcttaataaattcgtctcgcggtttacaggcggaatctgtaatttgttttgttattagtctatgtttaatacttcaaatatatgtatgtatactttaaaaactttacacccaatgaactaaacacaccctagctagatctgttgcaagtttttgaaaaataaacaagttacatgttagttgtactccatttacacttccgttacaatgcaattacgctatagttatatttgaaagattttatagaatttttctttcgacagttttataggtagtcccatgtgtaaacattgttagctggatgcgggcatgcggccaagtcagctcaccaaactggcagaatcgccggtcgtcacctgcgcacacaacacaagccatgatcattgatcagcgatgtgatcagcttcgatcggggaacgtgaccaagttggttggtgcctttggtcagagtgcgccggcgaaaccgatccatcgatccacacaccccaccccatcatcatcatctatcgcccacgatccgatgcccgtttaatgcagcagcatcgagaggcgcaaaccgcaaagggtgcaagggattgcgtcccggtcaagagactattcctacttgagtctgctgctcaccctctgatcgatcatcaggcgcagttcgttcgcgcgcgccgtacgtgttggttggtcgacgacgctagctgtcgtcgcacgctacagcagcgtggactctcttgtcgcgagtgaaagcgtcgacggccggggtggccaccgccggtggacaggcacggcggaccggccggtgagagtgagttagtagtagctagctgggcatctgcgaagattgcgattcttatacgtacatgtcggagatctatgtgtgcataatgcctctgccttacgttcgtgtgtacgctcgccgccattgattgatcaccgcgagtagcggcgccgttaaccgtgtagaagttactgctcgatctccggatgtcggatggccccgacacaggtacaaaactctgaccgtgtacaactatcagctgtacatgcatatggcctcataaagttggcacttggcagtaaatttggtagctaggctagattactgatgtcaacgggttagatttggtaattggtactgccaatttatactaattaattaatagaagcgtacgtgaatgcagctacacgcccatggcaacttgctctgcatatggaagctgtcattgaccgtacaacgttattttctgagttactccatttcgttaattagcacttctgcacgagagaaatggattgtctcgttaacacgggggcttccatagcacttctgttttgttggcatgcatatacatggatgcgagatagaacagataaaaaaaatgagttgtctcgttacacggggacttatagagacaattgttgcctcaacctgcacatacgtacctgagtttcatgatcatgatggtatgtgttttgttgtggaatatatatggatgaatatataagttagtacggagtatattttaggacggatggagtaagcattatacaaatgatgagtaaatatgttaaaatactatgaaaacgatatgagagatcaccggtggaggagaaaccatcttaggtcggtcgaccaaattacacaataatccggttgcaaaaaaaaagactaaagatcatttttagttccggttaaaaaaattttgatctttagtcccggttggtaacagatcatttttagtcccagttcaaagaagttggtgggtcgagtcaggctccaattatctttaatcccggttggtataaacaactgggactaaagatctatttttagtctcgattgtttataccaaccgggaccaaaataaactgccaagccacgcgctgaacttatctcctcggtatcccctccccttttttctctcttcattaagactcggtatcccctccccattccttctctcgaagtctcgatcagagagaggccctctccccttcccccccccccccttcccctctcctccgatccccctcccggcctcctcctcctccttcccctctctgttgcggccaggcggcggcgatggagcgagccgaccgcgcggcaggtggccgtgcggcgaacgggtggcggcagccgggtggtggcggagcgaggcggacgcgcgacaggcggccatgcggtggacaggtggcggcggcggccggtggggccgcgcctggcggctgtcggggccgcaggcggtggccgtggcgggcagcggcagcggcagcccgcattgttttcttttttttattaatttgtgattatctgagatgtacttttgtatgcataattttgtgattcattgcacatttgtatggatctgtgatgtatttgatttgtttgtaatttttataggatttgtgatgtatttgatttgtgtgtataagtaactttaagatttgtgatgttgatttgggatgttactttgatttggggatttggggtttgatttggggatatgtatcccacttgattcgggagaaaataaaaaagaaaaaaagaaaaggagacctctcactgccgctaccctctctttagtcccggttggtaacaccaaccaggactaaagataccaaccggaactaaagatcgatctttagtcccgggtatttgaactgggactaaaaatagcgatctttagtcccggattcttactctcggttggaaaaccgagactatagagggttaccaaccgggagtaaaaagggtttttgcaccagtggatggtgattagatatgtttgcatgttgatatgtataattcattaatttgtgatatatgcatgtataagttttgacatgtaataataattgatagggcatgatgacgtggtatgtttgtatgttatgctttttaagtttagtgggttgtaggtatatagaatttatagatacgttatggtccgaaatccccgctagggatggtaattttgcccatgggtccgggtatccgcggatacccgacccaatgggcacgggtgtgggtgtgattttttacccgtgggcacgcccgcccgaaacccgtagacatcatgggcaacagccgagtttcatttttttcctgtgggtaatacatgcccgacccgatacatatgtattagctaatttcaacttatctgttaattcttataccctttcttttggtttatttgtgatactaactaatataagttgtgatgtaatttaaattattattgataactgataatttggtaaattgtcgattttatttctctttgttaaattatatatctttcgagttattattcatatgagatccatgggtacccgccgggtatatccgtgcccgtcgggcatgggtacggacacagagttttacccgctaaccctagtgggtagggtttgggcgggcgacggcgggcatgggttcgggcatggttttgctctacccgtgcccgacccgacccgctgccatccctgatccccgctacaaggacctcatctttatggactactgctgatagcctaaaaatgtccatctttgcattcaagttcaatcataactgtggacgttgacatccacatgatggttgatgtgtaccagttgattgattccgcatgagaaaacaagaaaaggattcggtcattccattttgtaggcaaaaaaagaatcatttcgccatgaccaaccattaaaactagaattatttacagcgctagattggtaccggacagacaaaatctctgaatttatttcatcatctaaaaccaattatcttatctggataagacatcacagacgagattaatttttattgttttaacaaagaaaacaaaaagaaattgcagaggagatgagaaaattgagcatgttgccatgttcatgcatcttgatgtgctgatatcttaactaattcgccatgcttaactagcaaggaatgcttagtcaggtagagagatgaccaccgttcatagctttctttttcactccagtgacctgatcactacaccagagcttcagaattagaccaccggacacataaacacgtgaactgtcagttccattcgccatcgacaaaacgcattttccacaatccaatcaccggcattttaaaggcaaggcagaagaacaaacgttccagccagagataaaacgtcaacccatcgatgatatgcttgtgtgtgtgtgtgtgtgtgtgtgtgtgtgtgtgtgtgtgtccagccatccaggcacctagcagcagccacacaatacggcacaaccaaaaaaacgaatcatgcaaatccatacacttaatattgagaatttcttatatgttgtacattatcaggacacagcagcagacactggatcgaacagctagctaattaccaatgcacacaaatacgtgacaggaacgatcgatgtcgtgtacaccaatctttctatagtaggttaatttaaggaggcccaaccactgcatgtgacgcatgatggagtacgtctgtgtacgtggacgacggtgtacgtgcatttctgttactgttacacttactaccgacgccgacttgtcgccggctcgccggcggcgaccggcctacgcccagccgtgcgtagcccagctgctgccggtgtcgaccctcctgatgctctggacgccgcagagctgcaccatccacgggctcggccggaccccgaggcagaggaggcctccctgcttcgtcgacgccggcgaaatcgccggcggctgcggctcgtcgctggtctcgacgctgccggagccggagaagagccagcgggtggacggcgagggctgcacggccgacgaggaagacgacgcgcgggatggcttgccgagcgcgaggcggcggaagacggcggcgatgaagccgatcttgatccacttgagcctgcagtagccgcagtacttgccgcgaccattaacaacattcctgcggccgctacggccgtgcggctgcggcgacgacgacatggcggcggcggcgcggaggtggtaggacggcggcggggtgatggccgggacgccgccggcctcggcgaagggggaggaggcgtcgaccttgggcgtgcccgggtgggactcccagacgaaggggacggcgccggtgccggcgccgtagtagcggaacgacgggttgccctgggagctctccttggtgagcagccgcgcgtagaactcgccgtcgtgcgtgatgcgcagcgggctctgcggcttgctcgccatctctccctctctcactctcactgtctcggtctcacacacgaactgccactattgtgtgaagtggaggagtggatcggtcagtgtagggggtgagagagagagtgcggtgtggcgcgaacgaacgatccgagaagacgagagatccgatggcgcgtttttatacttggcctccagatcgatcggcgcggtcacttgcgactcaaggtacttagaggcacttttctcacccacttgatgacatgctggcgtcttaatttcagaggagtggacaagttagcgggataatctttgctcttttttactaagttgttttactagttcttgtagcttagcaaaccatatgttccaaaatataaagatttctaggttatttagtaactatataaaaaaaaattagtcacttcagttgctaattttggattactcagatttagagcatatgtgatttattttggaattattgacatgatggaatcatcagaattagtgtattttgatacaaaatttgaatcatgcaaatttttatatttcaatagcctaagagcccgtgcattacaacggaaaacaaattaagttactagcttattaaatcaattaataaacacttattcagtctaagtagtactatgattttttttattgaacaactaaataattttgaaatttggtgagccaattgtgaaatggggcgacttattgaaaagtggtgtaataatacagattgtaaatctagatgttagtggtagaggtggtgtgagtatgaacatcaccaccaacaacattttaagcatatagaaaacgttgatatatatgaaatgttgagagggatagagcggacaaggtcgtgagttctctgcctgagcctaacatgcttgatcgaacatgcctgctgtctgtttgagtgtaatataggtgcagtgaaacatgcatgaagcctgcctgccgattcagtgacatactggcgtgcagaaacatgcatatgcatgctccacacacttgcttacaaaaccattcggcgtcaccacaaaaatgtgttggtgggactcaattcaggttcaagtgtctgattaggcaaaaggaatttttgacacgcgaaattaatgccagttggaatctgacacaggtttgtcgaaatctggcattctggctgtcaaacttgggccaagaaaaatagatggaaaaaaacaagtaaaaaacagttttcgtgatatacagcagagtacaagtttttttaagaggaatacttatacaggcaacatagtacatgtaaaatagaaagtgaggtgaccactgaccaagcatggtccgacctggcccatgtacagcccatagcaaggcccagtcctcgtaggaatcctctgaaatggaccgttagtaccctactgggctaattaatttgtaaagcccaaccaatatccaggtcacgggctaatttcctatgtaggcccaacccactgtaatgggcctcttaggcccatctgtaatgcgttcagttcacggcgaacgtgagaggacgactcccttattcatggcaccgttccttgtgacaaaattacagatttacaggaacgaatgcagcgcagctgctctcactaaaacagcatgaccaacaaagacacaaacatgcatcatgcattcgaacactgcactagttattacttcgtccctacacagagagaagcgtgcgtgtatgtgtatttatttaggctccgtttacttcccacacaaaaaaatttcaccatgtctcatcgaacgttggaacacctgcatgaagtattaaatataggttaaaaataactaactacacatattgcaactaatttgcgagacgaatcttttaaacttaattgctttatgatttcaaaatgtgttgctacagtaatcatttgctaatgatagattaattagacttaataaattcatttcactgtttactgatggattctgcaattagttttttttattagtgtccgaataccccacacgacactctatataatacctaatttaatgttgaaaatttaaaatttgggtgataaacataagcgaaaaaatgaaatgaggtcctgtaattaagcatgcttactaaatcaaaccaatcacccttttccagttcagtgatgaggttttttctttttacagcggtcaatgtatgctccagtactccgtacaaaggggcgatggcaagaagagggtactctacaactgtacaaagacagtagtgagacatccatcatcacggtgacggcttcacgggcaggtgggaccgatgcactaccatgatcagcctcatactggtcatatgccccttcctgtctcctgcaggcgcagcgagacgtacgtacgagaatatggaacctcgaggggtttccgatgcgccgcagtgaactttttaccacacagccttctactgtagttctcgcgaacagagtgcagagacagtcttgcacttgcagtgcagcattgaggctagaacacgctcattacttctgtttttaccttgttgcttagtaccgtagtacgtgtctacaggataaaaataataatttaaaaccatgtcattataatttttcaaagtttaagatatgacatcgatatctcaataacatgtagaacccatatgagtcaatgatatgtgggtcaggatgacatatctcaaatnttacaaaattataatggcatggttccaattttccaaaaaaaaaaaggatcagatctaagagcaaaaggtcaatagtgcagcccactactagctccaaatcatataaagccaatgtaatagctaattcacacaatagttgcttactatactatttatacctggttctacctgtcatacacacattatatctatctgtagcccactgcccttctcttttttttaatctctttaaaatatgtttatagccggtttatagcctgctattgtacatgctataagtgcccgggaggataggttaaaaaaaacaaccataaaaagcgagatactccaattaaccattgcatgatgattcaggactcgtattagaaactgacaaagccctggtgccaccgactgcatccatgaggtaagccagattccaaacaagggcccacatttgacccctcctctcatgtgatgcggtctggcaggtgggcccggcgctttctgggcaccggggcccactgtcagggtctggtctctttagcagtgcagcttttggtttggattagtgtaagcgcgcaccgagtctgagtaggacaaaggcgtacaggacacgtcgttctcacgagtgcgcgcgtgcagcgcagggaaggaccgaagaggacgagtctaagattcaaaaaaaaaaaaaaaaggacgagtgtgaaattggtggatttcgccaactcaagattaaacattcagggattgtcctatgactttgctgggatttaaattctaaaagcttaattttaaaattaacaagcatagtggcccgagcagattacgtggctagtatcattatattttctctcatataatagcatatagtatcattatattttctctcatataatagcatatatgttttctcattatattattcaaatatattaaaatgacaatataattttaaattctgcaataactttacaaaactactaatgtgtaatattcatattatattttatatatgtgttagttattaattatttttaatatcaaattttagttatttgtaaattatatatatatattcctatatggactctagagtcatcttttaatatttcttttttaaaattctgaattttctgtaaattgtatttctatatagactatatgttcttcttccaatattatttatttttatttctgaatttttattatttctaattgtatttctatgtggactctaaacttaactttcaatatttttaaatttttaatttcgaatttatgttacttctaaattgtattcctatagatgtattcctttattgaccttaaactcttcttcctatgtttttcttaatttcgaattttagtttttttgtaaattgtatttttatacggactctaaactctacttttaattttattaaattttagttagttttaaattcctatatggactctatactctacttctaatattccttattttttaattccgaatttctatttttttttcttaattgtatttctatatgaactctatactctattatttcctaattgtatttctatatggactctatattctacttctaatatttctaatttttaattctgaatttcagttatttcctaattgtatttctatatagactctataccctacttctagtattctttatttttgattccgaatttcagttatttcctaattgtatttctatatggactctatactccacttctaatattccttatttttaattccgaatttcaattatttcctaattgtatttctatatggactctagtctcctcttctaatatttcttatttttttaattctgaattttaactatttctaaactggatttctatatggactctagtctcctcttctagtattacttattttttaattccgaatttcagctatttctaaattgtatttctatatggactctgctttttctttttctccgattgatgtgagaatttctaggccatgaaagcgaacatggaggctcctttttctattcctttaataatataatagattttgacattaacgtagttctttttaatattgacttttaaattgctaaaaacacgtatgtaaaagttttatgcatatattattttttattattaataaatcgcatgatttataatctgccataggtaaccgacgatggagactttataatgcaattttgacagcagtacgtgctgtacttcgtagtattaatgtggagtactatttatggagtaccctgcactgtttccgatttcgtttttatctcgccgacatttcatgttgcgtaacgtgtctcggtatgataatcacacaatatttggagtgctcgatttaagattggcatttcagcagtgccaacttaattgtgaacgagagaaataccaaattattaacattttagtcctcatataaaacttgttttgaaacataaacccttgcaaaaaaaaattaacacataaatagaccatcctcgaagaaagttgaggtattgtctgagatgacatgaattttcgttgtcacaatagtactctattgtacgagtagttgaaaatgtgtacgggcggggtctgtttgggaaggagggacttattccaagttcttgtcacatcagatgtttggatactaatttgaaatattaaacatacactaattacaaaactcattccataaccttggactaattcacgagacttttgagtctaattacgccatgatttgacaatgtgatgctacaataaacttttcataattatggattaattaggcttaaaaaattcgtctcgcagattactctcatttatgaaattagtttttttattagtctatgtataatactccaaattagcgtccaaacatccgatgtgacatggactaaaaatttagccccatctaaacaccccctagctagcaag

SEQ ID NO: 42741 - DNA, 1875 bp, Oryza sativa
gacgcatgaattcctgcctttgcaatcgtcacagtttgctgttccataacttcatgaatagccactcggtcctgatcattcatcttatcaaactcatcaatgcagacaacaccacgatcagcaagaaccatggcaccagcctccagccttctctcacctaaccacaagaaatcgctcagacctataagaatcaaacaaatatgtatgaaacaagtttcaataattaccagtctcttgatcagaagtgacagcagcggtcaaaccaacaccagatgaaccccttccagtagttgaaatagccaaaggggcaatgttcataaccgctcttaggagctgggacttggcaactgaaggatctcctaccatcatcatgtttatatctctgcataccacataagtaagatatatttacactacaatcattgaaagcaagttacaacagaagcaatgatacgaagaaacagcactgaccctctcaagtgagttccattcttcagattcttctctacaccaccaagcattaatagaactactgctttctttatccacagatggccatatatagatggagcaagtgaatttcctagtaagtcaaatgtgtcatttctccttgatatttctttcatcctcttcaaatcctcccgagtatagacaggtgcatttgcttctttgttcataagtgaaacattgtttgcaataaggacagtcctataggcattgtataatataaaggatttcagaaaacaataaagtttagttcaggaaagtttaaggtcatagaactcacctgaacacaccactaacactgcccttgcttttccctggaagagccttgtaaacaccaacaattgatactcggtcacctggcttgcaagaatctactaggtcatcttctacaataatgtccactgttcttgggagctgtccaggggcagaattttcaggcacttcttgcatggagagtgtttggtgatccttgtattcacacatcccgtactcagtgaccaacaagttaccattttcatcctaagtattccaaattagcagcattacaaacaaaacaacaaataggtttcattgaatagagtagcaaaaggatgatcaaaagaatgtacccttgttggataaaccgaaccagtaggtaggcctacgaaagatgtgatgtccctgtattcacgtgagagagtacctccatagcagggcaatagtgaacactcttaacaactttcggccttactagtgaacctgaattttttaagtaaaatagcattagcaatatatctttaaatgattctgaactgtgaagtagcaggcagccaggcacagagtaatgatgtgataggcctaatgagctatcaacttaatatatggaatatgcacaactaaattgaatgatcagttgaacactaaactaaacatagatacacatagtattacttaatcaagcataagcaacaggtgaacattcttatccctaaatttttcgctgcctcagccagagctaatattcgcaatttctagtcacattcttagctatgctttaccatcactactaaccgactggactgtgatatatactttttccaccagcaggatcaactgtagaacattataacttaacttgaacttcttaaatcataaagaccacaagttaaacccagatcagccaactgcaaccggaaaatctatgaacaaactagattatgtccaaaattagggagattcaattacatttcgtgacgatgccctcgacgcagaccatagtcccgatgaaggacgacatgaggtccctgggcgtgaccctgtggaagccgaagggccccgagaatcccaccagcacgcgctgcccttccttcaagaacttggggtccaggt

SEQ ID NO: 42742 - DNA, 814 bp, Oryza sativa
tgcatcaaagtgcatgagcttggatcgagaaggtccatgatgtgatcgatgctgacatcgtcaagtattacgccaacctgtggatccaatccagcccgtgtgaggtattggttcagtaagatcccaatcccaatgttgttgcctttgtttttcagctctgttcaatttttggcaacttctgaatgctatgcatgatttagagagtatcttgtggcctgaagaggattgctgtatagtttgcacatcgtttattcaaaatctgaccaaaaacacatattactactaataagtaaacttcattgcagtgttcagtaaattaaaaatacgaaatgttgttgcactaaaagaaattaatattgcaagtaggtcaggggaacatattgtggaaatcagtgtcaaattgttgaaatggcctcccttggtgcagcccctgactttctggagtcactgagataggagtatgaaataaagggtgtgttgacgcttccagagcagcatagtactgtgatacatgtaaaaaagtttggttgctaggaacctccagatggccctaacataacaaaaaaaaaacagaggaaaggtcagggatgataacaagagcatgcgattttggagattaattatgtgagaaatataccattactgtagcaggtggttgtgactgcatctcaggttgtggttctagcacatggtccggaacatcgtcatccttcttctttctcttcctctgcgatgatgctttctctaagccaccaacacgtctagctgaaccatggatgcccttttccttgagcttaatgcctcttggcttttt

SEQ ID NO: 42743 - DNA, 15498 bp, Oryza sativa
aacttgtcctttctactgtagtattataattctgggaacagttttatctcattgttttgaaggatagaaaatgcagggcaatctaatgaagttgcatttatcttgcattgcacgttctaaaaactgacgttgaagctgcactgcaagttctgaattttgcaatataccacaaagagttaactgagatggaagagcgtgaacagagagagatggaaatgaaacaacaagctgatcatgatgcaggtgcaagtggtggtaatgcagatgagcatagaaggtgagcatagtgcctgtcttcttaaaaatggtcctttaaaatggaaaagcatttgacactgatttctgcagtcctatttttaatgtaaagcaatgttctcataatgcattctcgttcctttttttcctcaataaatcttgctcgctttgactttgcaaaaaaaaaaaagagccacatttaactgacataatgtttattttgcactaaaatgcatccttctccattgacataaaagaactgtttgtagcatgaaaatgaaaggtcaatttcttttagaaatgaatggcgtgctatggaaaattgtttgtcaccatgcaaacatgtaaaaacatagaataacaactcaacactcaaaactgcagtattttcttaactgcaataagcttattttctgcaaattaaaatgaatgcagttttattctccagattacaatacatcgtgtttagctagttgctttcaatagtctcacatgtttttatcccctttcaactcctgccagttctggaaacgacccaatggatgtggatgtaggaaatgcatcgaatgatcaggatgttcctgcggagaggttactacatgacatgacctcaaattgcaaaatctgaatctttagcttaggtttctttttctcagctaattgtattcttcctgttatgtcatatttctgcagaattgaagcatttgaggcgattcttggtcagcatgtgttggcaaatcatctcgatcaaatatcaattgacgaaattgagcaaactgttaatagagaggcagctgcaccttacaatagacgtcaagtagaattcattttggaggtacaaacaagaaccggctatgctttcagtattgtcccaaaattaactatgagatgccacttatttttggttcagttgtatttagtttcatttccttgttttttcagaggatgcaagatgcaaacaggataatgatacgagatggcatcgttcggataatctaacttcaaaaatcatgtcttgcattgtggacaagctgattactgtgcatcatccttgtctttttcatctgatacttagccagtttggcattgcagaatgtctgcatctgcaccggaggttgatgtacccgtgtatcttaatttttaacagcgagatttatgatgatcatctgtgtctttgtactttaaattcatgtaccgtaacgtaacaattctcctgatctagtgatatgtagtccctgattttatatggtcaccattgtgtgctgatagatagtctggttactgtcttggaatggcttccaattagatgcaactgtttcttcagaccacctgaggttacaaactataaactcgtttcagaagaaagcaccggtcgtaaaattgcatatactacaatcagctttatttccttaacggttataaagctcgttttcgcctttctttctttttctcttttgatgaaaaaaatgctcttttttcacatttgccagactgcagccagacgatggtttctctgagaaacaccaaggcaagttctaggctataccgatttaatgatagtatgtacttagtacggtaccgatcaatcagcttcagtgtaaagtatccgtgttaccgtgtggaccgaggtgcaagcagacatttgcacagtttcacatcaacttcatacaacgagttcatatttatatagcttggcttgttcgattgggaatttgggagacgacttgctccgtggacttgcaaaggtgaagaagtactactactagttggcgtcttggcgatggccagggatcgagccgctgccgctggcatctgatgaggaatctcccggcaaatccgcggtctctgcagcttcccgggtgagtccgtgtacgcccaactccgccttctctagcattatcacctactccctttttttttgcttgctagctagagttcaggctcgcagtcgtcgtgctagtggcctcgccgctcgccggccgatcatacgcacggccgtcggtcggttagttcgctcgccgctctcgatcgggctctgtacgtcttcggatctatacatgctactgcccgtcccgtatgaattgtactgctacgaattttaacgtgccttctggttctggttcaagtcagggttccaaaatgcagccataaactctcggttatcacaggtaaaatttgatgattttaaactattctttttttatttattgtaatggcacttgcgacaatgatacgtgggtcatcattttgacgctgcacaaaataggtttcgattatttggcatcctggtccattgttattggctcatatggctccacatatcgtcgagtgccaatacaatgaaaatggtaacaaataaattgtcaaatcatcaaattttacatagacgcttagaagaaaagagaagccccctccgtacaaaactcgggaggtggctccacagggtctctcggaggaccgacggggaggagcgcggcccttttgagggggctccgaagatgtctgaagcgtggactaactggaccttcggaggccggacaagatcgtggccaacggattctagagggcaggcgaagagctgagaagaaaaggccggagacaacctctgaagagaattaatgtgagaagacccgacctaccacaacgcattcaatacctcaccaaccagctgacacactccgccacagggcgcaggtggggcggatgatgaggcaactttaggggcatgcattagcctgactggtcacacacaagatccacgggtttccgaatgcctgaattaattgggcttgatctcctaggtttttaccattctgccccaagggctagggccacctgccagttggggtgcccttgtaacattccatacgattcatggggctatataagtgtattccgcttcccgaaggaggcagaagaaacagaaatagagcaatctcgttttcactctagactctcatcaatctctgggtgtatttagtttacgtcaaaattggatgtttggttgaaattggaatgatgtgacggaaaagttagaagtttatgtgtgtaggaaagttttgatgtgatagaaaagtaggaagtttgaagaaaaagttgaaaactaaaccatgtctctgttggattttgttccaacttccaacggatcgcattctgaaaccctacttgaaacccggtccattttgagtctcatcatgcgtgtattggaatcgatgacaaaaatgactggtaaagaaaatagcaaaatcccacgcaaaaatggagatcgctataactagtatactctacaagtagcgttacttaattaacgtgcccgaagtagaaatgtacaaagattttgacaaacaaagggatggcgatcaccaacgcgaggccggggaagacgagcgacaccgcgccggcggccaccgcccaccaacccctcgccctcgaccgcccgaacggccgcagcatctgcctcaggctcgacaccacggcggtcagcatcaccagcatggccgccctcaggtacacgtcgtacttcttctgccctaggtacaccgcgtacgtgcccgccatgagcgtgaagctcgtggtcgccacggccctgaaccccttcgccctcctctctctcgcccccgccgatgccgctgccgccgccgcctcaacgctgccgtcgacgacgtttgcgccgccttcggtcgtccacgccatgatggcgacgttgagcgcgacggcgatggcctccgggaggagggagagcatgaaccaccactgcaagaactcgacggcgaggatcgtggccatcgagacgagcgcggcgagcatcgcgcggttgaggtggccggcgaccgcgacggcgcgcgccctggctgacgggaacagggtgcgcacgggcagcgcggtggccgccatggcgagcacggacaccgtcgaggcgaaggacgccacggcgaggtccacctgcgccggcggcgagcggccgcagccatcgagcgacgaggggtacttgaggtagcccaggatgagagccccttcgatggcgaacgccgccgtggcgccgaacgtcgcgagctcggcgctgctcttcatcgcctcctcgtaggcctcgtcctgcgccaccgcggccgccgtgaccgccccctccgtcggcggcaggtcggcgccggcgagcatgccgagcacgagcacgacggggaggacaaggatcacgagcatggtgtcgttgtccctgtccatgagcgcgacgaacatcccgttggtcgcgacgaggaggacgccggtgagcgagacgagcaccgccgacgagaggtcggcgcagcggctgcgcggggcggcgggcggctggtgcatctggaagtgcatcagcacgacggcggagacgaacgtgacgagcagcgagaacccgccggccttgaacaggagggtggtagcggcgcccttgccgatgtccttgtagccggagacgccggcgacgatggcggagccggtgatcccgatggcctccttgccgaaggcggtggctcgctcgacctgcgtgtcgttgcgttgcgggaggaggtgtgcatgtggctggttttccatggatgctctcgatcgttgccgtattcgtgaagacaccgtttggtttgtaactttggttatatagcaaacatagccaaactaaacggtgatcatcgcgtcgcgagaaggttcagagaaatagcagggaaaaacgaaagaaaagtagaaaaatggaggattctgctgccatagcgtttttgcagcggttgctgttcagaccattatgcctgcctgacagtaatttccccttgctttagaagaaaaagaaggcacactatatattgttattggagaagtttattcatccctagagggaacgcccctcgctaaaaaataagtcataaataattttcagtatgtgatatataactctaagaaaaataaaaatttaactccaaataaaacacgtaattttacaaccatttttttatttttgtttctaattgtatagactgaatttgaatttacgtgcttgtggagtagcatatcatagttatctatctttatgacttttagagtttagacgacatgtgtaaaacagatgcacgtcccctagagaaaaaaaaaatccatctctgttattatttggttatgttgatacttatctatgtgtatgtgtatagccaaaaatagttatatttgagaacggagagagtggatcttttactttgatatactgcccttgtttagttcacgaaaaaattttttttaggtgtcacatcggacgtttgaccggatgttagaaaaggttttcggacacgaacttaaaaactaatttcataactcgtctggaaaccacgaaacaaatttattaagcctaattaatccgtcatcagcacatgtgaatcatggactaattaggctcaaaagattcgtctcgcgatttccatataaactgtgtaattagtttttcattttatctatatttaatactctatgcatgtgttcaaagattcgatgtgatgtttttaggaaaaaaaatttaggaactaaacaagaccctataccaggccctatatggtatgatccttttcaacgttctctaatttttaatacagttcagcttaagtcaaggtgccctttataatcccttgggattgccaagtcatgtctttcctctcaaaacacacaaaagctcggcacgttaatctttagacactaagagataattttacaaaacaaccatgcagccccagcccacaagaaatgccagtcatcattgtaacaactctgtagtttatcaacatagctgcattcagccattcagtgctgaacacatttttcatttatcagaactgaacaaaatagatagtaccttgtacataactttctaagagaaggcagaaaagttgaaaacaatgttgtgtaacggcctgttttaaagtgaggatcggcttaactactttctcgatttccgttagtacaccttttaagttgctaaacaatgtattttcgtgtgaaaacttttatgtagaaattgcttttaaaaaatcaaataaatttattttaaaaaaaatcaaataaatttacttttaaatatttttaataattaatacttgattaatcgtatactaatcccatttctcgttttgcttgcggttagtcagtcatttccaacctttctttaggacggaacctatcaattagtttacatctccggcggtccagcctatcaattagtttagtcatctgatcatctggctctagcaatttggcacagacctctgtaatgatgtgatcatttatagtaaaagaaatggggaacctcaggctctagttcaagaaaaaaaaatctggttctagcaatgttgtgcaaggaaatttctatgaaaacaaccttcctaatgcaaaccatgtacagatctccgcagagttattgaaatttcaaagaaacgggatggctgaacgaaatgacagttctccgtctagaaggctgcccttcgtaatatactgggcgtatgtgcactggtgctatagttcttttacacccaatttgacactctacacggaaggattctcagttttgcattgagaaataaatacagtactaattaagttagcttataaattatttcattccttctgcacgcaatgcgtaaatctggattccttttaaatcaggtgagctgaagtgaaggcctctactatcatcacaacagaaaaagtgagaggtgtctagttagtagctgtagagtgtgtggacttaccaatagacctcctggagacacaatctgcattgtaagcctcgcctttgattccatttttgcttgcattcttactgcagtttccgtgaccatgagtccatgaccaggaagttctactagtggaataagtaaccgtgaccctgtccagaaaattctactagtggaataagaagagtgttattgtgttaccaaccactatgctgagaaaaggccaacatgccattatcaaacttgacatcggtcagatttgctgcttccgttgagatagccgcaattttcaatacaattttctactagtagttggccatcttgaccacacttgattaacacaagtggggagattaaatgcacaatagaacacctaaccttgatgcttggtagccttgattgcttctgtacttcaccttcactacattggaccgtcaattcatcatttggcagctcgatagagtttcctgacataacagaccagccgacacattttgtagtgctcaaaactgcacaaaatatacaacaccttctgtacatgcctccccccttcccttagggggggggggatggataagaaagatgaagctgcaatgttactcatttatgtaagaactacagataaattatttaatctatggccaatgtcaataggacaaaacgtgccttcgattttattgacattccatgattctagcttggtttgtgatggacattgaggggaataaaacaaaacattcacaattagtcctattttttctttgtggagatggtaagttggtgatagaggtgcatgatgcagcatgctgtgactactgttgatcaccttgccatgtccaaataatatccttgagtgatggcctaatgtcctctttcatcatcctttgatactccaatgtgtcaccattagttttcttcaactcaactaagagaaaaggagcaacctcagaaacctctgcatcaagctcaagtctgcccttccttccttccttcgtcgtagccaatttaagcactccattgtcagtttttgtaactttgagattcaaggctttggccagttccttcagcttcacaagtacagctgcagctggctttctggatgtaaacagtgactctcttcggccatatctttcaccaaataaacctgatagatcgaatccagtagagagagaaatgatgtcaaatgcattcaagttgtgtaggtttggtggctcttgatttctctcagaactgatgcagattgttgggccagagaaaggagcctcacttgtacaactcttctttcctgtttcgttgttcaatgcagatatggcgatgggtttcctgtaccaagcacttctctttatccttgagatagacatcctagtactaggatcaggatcaaggattccataaaggagctcctttagctcagctgaaaaatgacgagggcatctatactcagcctttgcgatcttcctatacatttgtatgatatttctatcatggaaaggaagataattggccacaagcacaaacagaatcactccacaagaccacacatccgcctttgagccactatagcctttcctactaagcacttctggagcaacataagctggagttccacatgcggtgtggagaagaccatcttgtctccttgattcagctaacgcacttaatccaaagtcagagactttaagggtttcattctcatccagtagtaagttttccggcttcaagtcacgatgataaacacctcggctatggcaatagtccattgcagagatcaactgttgaaaataatttctcgcagactcctcattgagctttgctctggccattttgtggaaaagctcgccacccttagcatactctaaagcaaagtaaatattgctcttggtagccattacctcgaagagctggagaacatttggatgcctcaccaatctcattatcgagatctccctctttatctgctccatgaggccaaccttcaagatcttctccttatcaatcatctttatcgcaacagactgaccagaactaagattacgagcataataaacctttccaaaggttccttgccccaattgtctcccaattacataccgttccatcaacacactcctctcttccattatatcagcaccgcgctgaaattaaaaatgggtctactatctatagagtgttactgactggcacatatctctgcatttccaggtgaatcactttcagtcttcaccaagatgctacctgcaaaatgaacaggccaagaatggaagattagtccaacatctataacgcaaatggctgcatcacaggtattatacgaactgggaacatcaagaagacatttttttagacgttacaattgtggatcgatggcatctaattccagaagaatccaattttctcgcatccgcggaaaaatgcaatacatttgatttaaaatcactaacgatccaataggaagggaagaggttcccatagattcagtacatggggtgtagctgcgatcaaatatcagaactgaagcttcaccgaacgagacagctacaactgcaatctatgatggctagaaactcctctgacataggacggaaaaaagaactgaagagaatatatctgtgtttgtgacaaaaatggatgtccaaatatttgatgcgagcaattgaatcgcatcgggatgcatatattgttttttggctccttccaagtagcagcgaaaagcaatgctcgatagaaacactgaaataaactgttcttttgtcgacacatacggcatgaaatttaatgcttatgcatcattttttttttcatattgagtataccttcctttgagtttgttttctgttctggtggcacttggccgtgagattttatgggacacaacccaaggagaaaaaccgttaatctcgcaacagaaaaactaaagagaagttcccaatcaacaagaactcgaatcaaatcgagtgaagccggcaacaatccaacaacagatgccctcaacggagactagcatgacagatcacaatcgaattagactcaccgactcagctgctgatcgaggcagatccgaggctccgagcaccggactccattcgactcgatccggccgcgcggcaagcggagggcgatgattctctgcatcacggtcggggaggatatgccctcttctcaccctgcattacacggcggctggcctgctcgccctcggcgaggatgagggcttctgctccaaattcggctgatcggctccctcctcgtgccagtcgccgctcgtcggcgtcgagcgggtcgccgcggcgatgtggggacgaacaggcagaggcaggggcagaggcgtttttccggattggcccctccacttttgggtatttctgcatctcgccacatcatgtgtgggatgggatgccgatgggctccactaggcccatctaacaatccaatcgaataggcccacatagagaggccttgttcttcaaggcccaactccacgtctccgtgtttaggcccatttagcagtcacacacagccacatgacacactgtgtcactgtgtctggacgacctctcgatccagagagagagaaaaaaaagggccaggaacactgcacaatcacactgttggtgaatgcataaatcaggcatggtaccatcaggccgtgactattcgtctacactgttgatggttggacgggtcggcggccggctggtgccaccggggttaggtccatgaacagggagcgccactgtgggagcgtgagttccccaggtttttaccgcttcgggagaggtttttaactcgggcggggtgaactccgctgcgcaacacacgcgctgcccacttcacagggccaaccgtacgtgcgtgtggtgccaattcggcctgcgtccatgtgtgtgagctcagtaaaactcaccagcaacgcaccaaatgtctgcagatcagcagccatggctgctgcagctgacctgctgtgtgtgtgctgcctgctgctgcacagctgcaggacatgtcgtggcacgaggactcatgcccatgttttcgcgcacatattcaaacattacaatcggactatatgatagacgacgatgagtcttgttacaaatgagaaatgtacacttgatcgatctgttgcatgccccgtgcaggcatgatgcgagaactgaaagcaccgggagataactaggagtgaaaaaaaaaaggggagatatatatatgtataacatggcaaagggactcggccggtggtggtactgtgtttttcagtttttcactaggtagccaagaatgatgtgcgcagggatcacatgaagaggcgcctggggcagcagctttcctcctcatctctcctctgcgccatcgcctcgtggtaggcccaaccaaaagccacactgcaatgccacagttttcagagacgatcacgctggcccaggccccggccccccagctgccgccgtgcatgcgccgtgccaccgcgcgcgcgtggtaggccagtccaccgcgccaccatccgtcacgcgccccgcgccccacctgcaccacccatgcacgcatgcccccacgcgcgcgcgcgagacggcgagagaaagagagagaaagagaggcatgccgcaccggacgcgatgatgcagcggcagagacgacgggcggacggtgcgcctacctgttgtgtcacggcgccatctcggtggtctcgtgcggttggatcgagacggcgtacgtagaggggtggggggtgtggagtcgtcacggcatgtagaggcggttgcggcacttgcagcgccaggcctcggggtagtactcggtggtgacgaggacgccgggggggacggacacgtgcacgggggagcacgggctgcagctgccgcacttggacgtgcaccgcggcgggtgcgaccctggccctcccgacagcagccgacgccccaacccgacgtggtagtgaccaccaccttcctgcatgcacacacgcaacaccagttaatttaaccagccatatgcgtcgtcgatctatgcgccggccaggccaccgccgtcgtcgtgagcagctgagattcgccgtgctgctcgtgttgatggttgtgcagggaccattgagatctttgcatatgtataagcatctatagatgaatctacatgaactgatgttcacattcatagttataagattgagacacatcctaagttgctactccctcattttagaatatagtaacctagaatcggatggaatatattctagtaatacgaaactggatatgccctttccccctgtctggatttgtagtactagaatatgtccaattcgattttagatgctatggttccaagatagagggagtatattttaagacgtacgggtggaggatggagtatatgatagggatctgtttgaacctttcagtcgtgtaatttgactcgtcatcagcatgtagtgtatcatcagctattcagctgctggcgtcaaacgactagcgaagcacagtgcaagatgcctagcctgtgaggagactgacacggtggttttctgctactaccgctgctctttagctagtaggggagatgcagaactcaccagaaggtcgccggaatgggctcctgctccttccagcctcccgaaatgatctgttcagcgagaggcaactgaaacgagttaactcctatcgccaaaacgtgctaaaaagacgtagagttctgtgcagcagcacaagcatcaacatatctctagtggggttcttctctcagatccgcagagatcagttgatacttgattctgcagccaaaggagatacaccaaacaccaaaaaactcgctttctagctagtacagaatctttgcacgcaaagagcaggagagctgccaagaatcagctctcaactctcaagtgctagctacatctcacacagcatatgcttaccggagtaacggcgcacgtcgtcgtcgtccctgccggcgccgccgcacgcagcgatgaagcagccggagaggcagcacagctgcagggaggtcaccgcaaccgccgcgaggcatgcgacggcgagtttggatccgccgctccatctcctcggccgtctcgacgaccccatgccgcaggccggcatcatcagctagctagaagttaagaaaacgagctagctagctctccctagcttccacttccaccctttggagtggtagtaagccagctagtggctgaggaaggaagagatcgagatcagcaaaatggcaaaggtgatggcggaagcggccgaccggctggctgggctggccggtttgttgcaggcgcggggaggaagaagacacggagacgaggggctttgtacgtgcgcgcgcccgtgtgtgggtgggtgcgcgtgcttgcctttcgtcttgctctcggcgactgtagctgcgtcacaactgggagtgcaggtgcagctcccccccctgagctatgtaggagacgagacggtcaaatttaatatcggcgagcacaaagtacggcgtagggtagctgcatttcagtcgttcacctaagtactctctgatctcgatctctatatatctccttgttttttggttctagaaacagagatggagagcgcgagcgtgtacgccatacgtgcccggccattgcggcttatatatatgtattttgcacatgttgttgacatgcaatcttgttttgagcagcatatgacacgatgtttgggaggcccggttttcacgtgattgtcatataagataatgagaatcagatcgattgtttcctgatgaaatcaggatggggccggcaaaaaaaatatttgctggagtggtgagataaaaatatgcagtataaatcattgtgttctcataaggtctagtgatggcgtaaaagattgatctggttatatattttgttggagatgtcaaatgaatatttataatctatatacttcctccgttttacaatgtaagaatttttagcattacccacatacatatagatgttaatgaatctaaacacatacatatgtctagattcattaacatttaaatgaatatgaacaatgttagaaagtcttacattatgaaacggataaagtactttaaaaggctccaatggtgatggtgacagtaatatatctgttaccacccactaattaacacgtgagtaaaattaacaatttatctgttagagaacaacaccctccgtcctaaaaaaacaaacttctagggataaatctagacaaatgcgtatttgtccaggttttttcccagaagatgttttttatggtaaggaggaagtatgtctttaagaaaaaaaagtcatccttaaaaattcaaaagataatcttcaaaaatttgctctctaagtaaaatacaaaccaagcaatctaatcatttatgtaagaactacaaataaattctctaatctatggccaatgtcactaggacaaaacgtgccttcgattttattgacattccatcattctagcttggtttgtgatggatatagaaggaaaaaaacattcaaaattactcatgtcttttcactgtggagaagttaaggtggcgacataggtgcacgatgcagcatgctgtgactactgttgatcaccttgccatgtctaaataatatccttgagtgatggcctaatgtcctcttacatcagcctttgatactcaaatgtgtcaccattggtcttcttcaactcaactaggataaaagaaggagcaacatcagaaacctctgcatcaagctcaagtctgcccttccttcattccttcatcgtggctaatttaagcactccattgtcagtttttgtaactttgagcttcaaggctttggccagttccttcagcttcacaagtacaattgtagctggctttctggatttaaaccgtgcctctctttgaccatacctttcaccaaataaaacagatagatcgaatctagtagagagagaaatgatgtcaaatgcattcaacttgtgcaggtttggtggctcttgatttctctcagaactgatgcaggttgttgggccagagaaaggagcctcacttgtacaactattctttcctatttcgctatttagtacagatatggcgatgggtttcctataccaagcacttctctttatccttgagatagacatcctagtactaggatcagtatcaaggattccataaaggagctccttcagctcagctgaaaaatgatgagggcatctatactcagcctttgcaatcttcctatacatattggaaaggaagataattggccacaagcacaaacaaaatcactccacaagaccacacatctgccattgagccattgtagcctttcctactaagcacttctagagcaacataagctggagttccacatgcggtgtggaaaagaccatcttgcctccttgattcggctagcgcaaataatccaaagtcagagactttaagagtttcattctcatccagcaataagttttccggcttcaagtcacgatgataaacacctcgggtgtgactttaagagtatcattcttggatgataaac

SEQ ID NO: 42744 - DNA, 5524 bp, Oryza sativa
atggtcttatccacactgcatgtgaaactccagcttatgttgctccacaggtgctcagtaggaaaggcagcaatggctcaaaggcaaatgtgtggtcttgtggagtgattttgtttgtgcatgtggcaaattatcttcctttccatgatagaaatctcatagaaatgtgtaggaatatcacaaaggctgagtacaaataccctcgtcatttttaggctgagctgaaggagctcctttatggaatccttgatcttgatcctagtactaggatgtctatctcaaggataaagagaagtgcttggtataggtagcccatctccatatctgcactgaacagcgaaacaggaaagaagagttgtataagtgaggctccttgcatcagttctaggagaaatcaagagccaccaaacctgcacaacttgatgcatttgaaatcatctctctctattgggttcgatctatcaggtttatttggtgaaaggtatggctgaagagaggcaagatttacatctagaaagccagttgctactgtacttgtgaagctgaaggaactgaccaaagccttgaaactcaaaggtacaaaaactgacaatagagtgcttaaattacccatgacgaaggaaggaaggaaaggcagacttgagcttgatgcagtggtttttctgaggttgctccttcttttctcttcgttgagttgaagaagaccaatggtgacacattggagtatcaaaggcaggtgaaagaggacattaggccatcactcaaggatattatttggtcattgcaaggtgatcaacagtagtcactgcatgctgcatcatgcacctctgtcgccaacttaccatctccacacggaaaagacatgactaattgtgaatgttttgttttttcccctccatccccatcacaaaccaagctaaaatcatggaatgtcaataaaatcgaaggcacgttttgtcctattgacatgggccatagattagagaatttatctatagttcttgcataaatgagtaacatggaagcttcatcatttctgatgtttctttcttccccatcccccaagttctgagcactgcaaaatgtgtcggctggcctgttatgtaaggaaactctatcgagctgccaaatgatgaattgacagtccaatgtagtgaaggtgaagcacagaagcaatcaaggctaccaagtatcaaggttaaggtgttctgttgtgcatttaatctccctacttggtgtgaatcaagtgtgatcaagatggccaactactagtaggaagttgtactgaaaattgcggctatctcaacggaagcagcaaatatgaccaacgccaagtttgataatggcatgttggccttttctcagcagagtggttggtaacatagtaacactcttcttattccactggtagagtggctggataagattgaaactcttaaattttctgactttggattaagtgcgttagccgaatcaaggaggcaagatactcttctccacaccgcatgtggaactccagtttatgttgctctagaagtgcttagtaggaaaggctacagtggctcaaaggcagatgtgtggttttgtggagtgattctgtttgtacttgtggccaattatcttcttttccatcattgaaatctcatagaaatgtataggaagatcacaaaggctgagtacagatgccctcgtcatttttcggttgagttgaaggagctcctttatggaatccttgatactgatcctagtactaggatgtctatctcaacttctcaaggataaagagaagtgcttggtataggaaacctatcgccatatctgcactgaacagcgaaacaggaaagaagagttgtgcaagtgaggctcctttctctggcccaacaacctgcatcagttctgagagaaatcaggagccaccaaatctgcacaacttgaatgcattcgacatcatttcactctctactggattcgatcgatcaggtttatttggtgaaaggtatggtcgaagaaaggcacggtttaaatgatgcatcaacattaaatttcatgttgtatgtgtcgaaaaaaaaagaaccgctgtatttcaatgtttctatcgaacattgctttttgctactacttggaaggagccacaaaaacaagatatgcatcccgatgcgattcaattgctcgcataagatatttggacatccatttttgtcacatgcacagatatattctctttagttcttttttccgtcctatgtcagaggagtttctagccatcatggattccagttgtagctgtctcatttggtgaagcttcagttctgatatttgatcacagctacaccccatgtactgaatctatgggaaacctcttcccttcccattgtatcgttagtgattttaaatcaaatgtactgcatttttccacggatgtgagaaaattggattcttctggaattggatgccatcgatccacaattgtagcgtctaaaaaaatgtcttcttgatgtttccgattcgtgtaatacttgtgatgcagccatttgcgttatagacattggactaatcttccattcttggcctgttcatttttccggtagcatcttggtgaagactgaaagtgattcacctggaaatgcagagatatgtgccagtcagtaacactctgtagattgtagacccatttttaattttggcgtggtgctaatataatggaagataggagtgtgttgatggaacggtatgaaattgggagacaattagggcaagggacctttggaaaggtttactatgctcgtaatcttagttctggtcactccgttgcaataaagatgattgataaggagataattatgaaagttagcctcgtggagcagataaagagggagatctccataatgagattagtgaggcatccaaatattctccagctctttgaggtaatggctaccaagagcaagatttacttttctttggagtatgccaagagtggcaagcttttccacaaaatggctagggcaaagctcaatgaggagtcggcgagaaagtattttcaacagttgatctctgcagtgaactattgccacaactgaggtgtttatcatcgtgacttgaagacggaaaacttactgctagatgaaaatgaaactcttaaagtctcaactttgaattaagtgcattacccgaatcaaggaggcaagatggtcttctccacaccgcatgtggaactccagcttatgttgcagtggctcaaaggcagatgtatggtcttgtggagtgattttgtttgtgcttgtggccaattatcttcctgaaatttcatagaaatgtataggaagatcgcaaaggctgagtacagatgccctcgtcatttttcgactgatttgaaggagctcctttatggaatccttgatcctgatcctagtactaggatgtctatttaaggataaagataagtgcttggtacaagaaacccatcgccatatctgcactgaacagcgaaacaagaaagaagagttgtataagtgaggctcctttctctggcccaacaacccgcattagttctgagagaaatcaagagccaccaaacctgcacaacttgaatgcatttgacatcatttctctctctactggattcgatctatcaggtttatttggtgaaaggtatggcggagagaggcacggttttcatccagaaagctagctgcagctgtacttgtgaagctgaaggaaccacccaaatccttgaatcttaaagttacaaaaactgacaatggagtgcttaaattagccacgactaaggaatgaaggaagggcagacttaagcttgatgcagaggtttctgaggttgctccttcttttctcttagttgagttgaagaagaccaatggtgacacattggagtatcacaggctgatgaaagaggacattaggccatcactcaaggatattatttggacatggcaaggtgatcaacagtagtcacagtatgctggatcatgcacctctgtcaccatgttaccatctccacacagaaaagacaggagtaattgtgaatgttttctttttgagaacttttacgatacgatgtattgctaatatatactggcagtataaatgatccaatggtatagattaatttgctttctccacttaaattgatttcagtgtaaaattaaaaagaatatttttttctttctactttagaatgtgttggcgttttgtgtttccatccactccatccaatctcgtcatcagcacgagtgatggcgtcgctccggcaaccaactctactgaccatgctaccgccagcacgcagcaccgtcgcctctctgaaatcaaattgattttttctcatcaccttctccgttcctcctcctgtcgccctttccatctgcccaaaatccttgctaggtcatttacatggaagtagaagcaaccatggcagttcacctgctgcaccataattagtttgatcagatcacccaacaaatcattgttatgattagttaattactgtggtttaatttctaccagtgaatattgctaccaccgagcacgtagccggtcgagaagtccttgttctcccagctggcgtcgcagaaggaccggcttttgctaatcctgattggattgaatctaatccaataaatcactagaaagctcttttcaattttctatcgaattcctagtatacccttttatatactgccagtatatactagtagtatattgtactataaaaattctattgttttccccctccatgtccatcacaaaccaaactagaatcatagaatgtcaatacaatttctttgttccctttatcttccatatatctatttgcttctctagttgtgtatccatgaagagacaacccctcttcttaattgtcactactctatttagctgatgtgtgtgaaaacagagatgacttatttagctgactaattgtcactactctatcactagggataaaaacggagcggatacggacggataatgctcataccatattcgttttcatattttttgccggatacggaaacgaatacggatagctcgaatacggaaacaaatacggactatctcgaatacgaataagaatcgaatatgatcggatacgaatacggaaacaaatttttctcggaactcgaaaaccaattcaacttctaatacaaacaaatatcaacatatataattagctcattttatataaaatgtagtataatttataaatatttttaaaattttaaataatattaataatgtggactagtgttaagagatgaactactattaaaatctaaaaaggtatattgaaggtcatagagttataaagaaatgggatatgtcttgtggcttctgcggatatccgaatagcactgttcaccggatatccgaattattatccgtatctgacggaaactctgataccatattcgtattcgtatccgagagaaaatatccgtatccgtatccgaactatccgctccgttttcatccctatctatcacacctccatgtaaacccccct

SEQ ID NO: 42745 - DNA, 2555 bp, Oryza sativa
cattttagtggtccagacaacacacacgagacgaggagtcgacgggggccaaaggtaaggtcttgtcgtcatttctgtggccaagtgtttttccagttgttcgatttgcctaagattcctgcacgagattaattatgcatgcccctgcatcagttcatcacatgtccactggtccatttcttaatcaccagtaaaataattcaccgagccatatgcatgcgatcttgttttttaatttgtttttgtggcatatggtcgtgtttgcacaagccgcgtgttctacgcttaatcacaaccgtagaaacgacctatgatgaagtactcttctaggttttctctcgtttggtgtcatgtgctaatgcatgctagtcaaagtggctcgttcgatcgtggatttaatcttgtttcctctcggtcgtggggcccctgactgtttggtctctccgacaggcagatctggtgccgagacagtgatagattttggaccatgttttgacgcagcacttgccgatgtcaagaaccccctttaaggggcttttacctactgatcgatacgtgtgctttctgttcaggtcacggcgttacgcagcactttcacagtccagtacgtttaccgatttgacttaaagcgttgcattgccctgcataatgcgatctttggtaagttttggttgctgaaatgaaggagcaagatgccacatcacgtcttgctggaacgaattcgcaaagctttgctcttttgcaagctttcttcggtgagccaccctaatcaaacacatgcatacgtagtactactccctccgttttacaatgttagtcattctatcatttctcacatttatagtgatattaattaatctagacatatatatctatctaatatatctatatagattcattaatatcaatatgaatgtgaaaaatgctaaaataatttacattgtgaaatggatggaggaagtagtaaacatagtatagctagctagcgtagcatgcactgcagatagcagcatggaggggcaaaacctagctaggcttgcttcacttctgcatccatcacatcaagtgacctgccatttcatcagctaaactggccgtggctccatttttcggaccgaccacaaggatattggcctgatcaaccccatggaggcagctactacctgatcaatggccaaataattggccagctccaggatgatcagggaggaagaagaagaagacggagatcgacctgaaacaaaccaaaacctcaaaacccttcgatgtgaaatagatgcagccggctatagtacgtacgtacagcagcagagctgcaggctcgtcagtctctcagccatgtcgccgtacgttctcagggcatcccgatgcagtcactgacctgtcccttcaccggccatgccctgcagcacggagcttcttctcccgtaaaaaccaccactcctccatcgatctttgaattgagctcccactgcatgcagagagacgacgacgcctcgcctgcgtgcatgccggtgactagaccacttgcgtgactgcgtcgatcgagccgcgcgcccgcgtcgccgtcgatctgatagatgctgcctcagcagcaaacggtagagactagctagcgcgtatgggaaactgttttaggtggtgtttgggaaaaagggacttaccaaacaccaccttagactagcagaacgtccacctatttctaacatgtcatctaaatggttataaaatttttttaaaaaaattaacatgataggttatatatgtaatatattacttcacaaacatacaagttcaaattcgacttctataagttgtaacaaaaacaacaaatttaactatatatataggcaacatatcctatgcacacaggccctcacgtgtacacacatgcacaccaactaaaaaatatcaccaaaaaatctagaaaaattcatacacgtactttcaattgtattacacctagggttaaaatcttaacatatatatatatatatatatatatatatatatatatatatatatatatatatagtcaaatttgttatttttgttacaacttgtagaattcgaatttgaatttgtatttttatgaagtgatatagtattaaatattaatctatcttgtattttctttaaaaaaattataatcatttagttgacatgtaagaaacacgtggacgtccacccgagagattaaaatccatcttctagcgcgtatagctcttgccttcttggcgcattggtcggctcgggcatctcggcatctcgttacctcttatctgaaaccctctcaactctgaagctagagaccatgcatatgcatgggcaagacatttgatccggccgcgcgcggctagcccgaccgatcgtgccgtctcgcgggagcagtaaaattccggttagtaacagcgcgaattgaacactggtggagaaaccatctttactcggttagacaaaatccacaatagtcccggttgcaataaaaaccaggattaaagattatctttagtcccggttcaaaagtttagagctgctttttaatctttattccc

SEQ ID NO: 42746 - DNA, 30652 bp, Oryza sativa
aaccgggaaaaaagatgcctactatctttagtcccggtgttaccaaccgggactaaagatctatttttagtcccggttggtaataccaatcggaacaaaagatcgtggcggagagtacgaggcatctgccatctgcgagatcgaggaggaggagacgggcagccttatctcttcacctcttcctccactgaccttatctcttcatcccatatcttcctcttcctcctcctcctctcctctaactcctctccttccctcccccatcatcccttcctcttcctcctctctaacttctcctctaactcctctccttccctccccatcatcccatcgggcggtgggcggcctcgcggcggggcggaggcccgggcggtggcctcgcggcggtgggcggcgctgtggcgcggcggcggaccgcggggccttgcggcgggcggcgcgctggcggccggcgcggcagcggccaacagcctgtgttttttttctttttttttttaagaatttgtgatttggatctatgtatttgatttgtgtgtgatgtttgtgaatatgtgatgtatttgtgatgaattttgtagaagttgtgatgtaattttgttttaagattttgtgatctatttgaatatggccgatttggggatttgaggattggggataatttatttgggattttgggatgggtatagagtaaaatcaatatattaaaaacacaatgaagaaaagaaaataataatagagcaatcggatatagctagctaggctagctctatctttagtcccgattggtgttaccaaccaggactaaaaaggctctatctttagtcccggttggtaacaccaaccgggactaaagatgtatttttactcccggtttttttacccgggactaaagatagtgatctttagtcccggattggtagtcccggtttgaaaaccgggactacaggggggttacgaaccgggagtaaagcccctttctccaccagtggaaggcgaggttgggtcacatcagatcagctgcctgcatcctgctgcgtacgtactcgatcgggatcgtgtccgtttcagagagactgtgtttagatccaaagtttggatccaaacttcagtcctttttcatcacatcaacctgtcatatacacacaacttttcagtcacatcatttctaatttcaaccaaaatccaaactttgcgctgaactaaacacagccagaggacatatatcgatttggaaacggaaagggctcaaagcatctctgcctcctgctatagctatcactctatcgtcgatctacccggtctctttccagctgctcgatcgatcgatcgatctttcgccgatcatcgtggtctaggctcagtgcgtggtcaggtcatgtgcttcaacagtggcacatgattgctgtgttctctctcatgctgcttccgtatgcgtgtttgtgggagcgacacactgtacgccttgttcgtgccactactgccgtttgctattggagtacttgaccagtgatgctactactcgggcgctctagcttgctctacatttgtgtgtgtacactgatctcatcgaagagtaaaaagctcattaggatagaaaccaatggagttacaaagctgcaagagttaagatcataatgaaccatcgtattattggcaccgatcatcatatcataaccatcgtattattggcaacgacgttgagtttccgttgtcactatgctagggcctaacgtcatgtcctccgtttggatggccaatcaatggggagatccatcaagggcagccagcattaattgtgtgcctgcgacgtacgacgtcgtgttgggccacatgtcgggcagggaagcgcccggctgattgagctccgttgtgtccacctcttgcattcattgttgtcctgataatcttacgaaatttgttttttgtcgtcctcgtgtcacactgctcaaaaatcaaaccgtgcaccgctatatataactagaccataagagaagagtcgcaatgaagcaacgatgaagaggatggacacaatgatgatatatatgtcgactgtttaatttcaagtgaagtagctagattgcttgcattttactccttttccgtctaaaatatttgacgttggttagtctggagtactttattttcagtctctctgtaagcatatatcaaccaagcgaaaacacatgcattgatatatccaagaagcattgctgcatatgaacagggcacaccactatcactatacgtggcccatcagttaagaaagtaccaggtgctatacgaaggatgcatcatgcatgtggctgcttcatgtgagatttgtgtacatcgcagtggcgacgtgcgttcgttttcaagcagacagattttcccaaatgggccagtccatggggtcatggccactctaattcaaatcaccttttctgcgttgtgtgtggaactgtgagcttgtgatctgaagtctactcaagcatgtgtgatatctccgtccttgcccccactcgcaatcaattgattttgcaaaacattgttctattgcttggggcttgcttcatcagtcgaactgctgcacggccgcacgggcactgacgctactgagtactgaccatgcattcttctagttttttttctgtatatatattcccagcagaaagtatgaatgcaattaggaggtacagctctctgtagctaattaatcactcttacgaatacgtacagtaaatgtagcactgtagatatatattagtactactccgtcccaaaatataacaagatagaaccaaattagatactacatcttagaacgatgatctaaacatggacatgtccagattcataaatagtgggttatgtctaatacaatactaagttggtatattttaggatgaacagagaggacacaataattgaagattgtatttgagtgtgtagtagctaagagcctcattggctgccctaataagtcaaagcaaaaactaaaatttagattttcaaacttaatttcaaaactgattttaagatattttaacgtagtctttttttcaatattagcttttaaatcaataagaaaattaataagaacaagtacataaaaattttatctataaaataacttttattccctaataaaccatatatagccatataggcaaccaatgaggctaatactgcatagcctatatagctataggaggctttaccaattgggataagttcactttagtccctcaatttgtttccgagtctaaaattcatccctttatagcgaaaccggatacaacgcatcccccaacttataaaaccagtgcaaacgagatcccttaatagtattgtccccggttttggccgatgtggcgcatgcatggtttctttgactaggtcgttgtcctaggtggaaatgacaagatgattatgtggcagtttgatccaaaaaaaataaaagagcaagattgaaaataaaaaaattaaacaaaatatgtttggcccatatgtcagtcaaacacaaaacaaaaaatagtgggacctagacccacatgttagtgggcccacttctgccaccccaccctctctacctctatcgcctctctccatcgacaagccgaagatagctaagcgcgcgcggagaggaaggaagcagggaggctggcaagcaggatgggaagggaggaggcggggagggtggacttgggcagtggagagaagggtgacgatgggtgttggtcgaccaggagagagatggggctgggcatgagaaaggtggggcaccgacaacttcttggttctcttcgtctttgtcgtcaacatctcttcacctctatccttctcctcgcctactacctcttccttgtcatcccctctacggtaaggtagcaacggcagtgggcgatcagcaaggaggagggccacggcggtttgtggcgacggagaaggtgagggaggcgagggagccagtgagctcaagctcgccatcccttccacgttaaggcagcaacggcgaggaagggcccggagctttctgatcctgcctaaaccaatgcttcgatgtcgtcctcccccgatgcgccttcccttcttagccatcattgtccgtgggcccaacacatttacgactccaacctctccatgccacttgctgcgcgtcacctgaagatgggaagaaaggtgtcgatggcgaagggtgtgcccgcggtttgggagggggagggggtcaattctggcactggcagggcgtacggcgacggggatggtgctggagctgattgtggcaacgctgttgctgatgctcttaaactccgtgctagtgtttgttgtcgttgcagcgtcgctgctggcagccaggtttgcgtcctccgtgcggcatgatggtgtggatgtaccactcgccagcctccaggcctcctcctcctcctccttgtcctacttcttgcctcctccctctccgcacacactctctgccctccccactaacttcggttggcttcagctcactagcagagagaggagatagaggtagatatggtgaggtggcggaagtgggacccactgatatatgggtcccactaatttttttgacagacatataggtcctgtgtactttgttttagtattttagttttcgattgtgctcatgttcttttttggatgaaactgccacgtaagcgccacatcattgtcacgttggacgaagaactagtcaaaggaaccacgtaggtgtcatgtcagtcaaaactatgggataatactgctgagagatctcttttgcgcttgttttgtaagttgggggatgagttgtatctggttttgcggtcccaaatataagaatcggagacaaaatgaggggcccaatgtgttcttcccagttcgtgtccacagagcgtgaaggcccatagtgcgcgagcgtgcgcacctgacctgactgccagagcggctcgctagcccgtacattcggcctggcccatctaactgcctcgcgctccagagagatgggccgtctacgcattgcagctcccggctgaccaggccgctcacactttgggccgagccggcgaatcaggctggcctgggccaagactggtgagtactgggctatgggctattgctccttcaggccggcgagtttgttccggcgaactccactggaccaccttcatcatcgacgaagacgtgaaccagtgcacgtacgctcaccaagcatgctgaaaatgaagggggcgaagggggttgtgcaatcaatgaagatatgaattaatatcaagattgatttttcatatcctaattaaatatatgtattaatatcaagatcgattttcatatcctaaattccttattaagttgtttgattagttcgagtatcttacaagaccactggtacatctccttccaacaacatgtattctgcatactactgtctgctgatttgtaagattttttatcaagttttttttttcaccctcagaacattaccccgtttcccgatctaaaatttgaactcagaaccaggcaagaagccaagaacactctgaacacctgcacaccactccaagaatccgagcccaaaaccacgggcgagaaatgatgatccgtggatggaaggaccagctccatcgaccggggagcacgccattgattggccgtgtgcccacgtcgccggctctgaaactgaaatccagcaaagcgatcatatcgccagcgccagcgattcagtcggccacgatttggcgcagaaatctacgtgcccaccacggcagccaagccagtcgggccggcactgaatttttttggcgctccgatcggctgctgtgtctacgctgcgcgcgattcgcccacaaatctggtcgcatccgcgcccaacttgacaacttgctgcaaggattgctcgtctcgtcagatggctggttccaattcaaccgttccagccgcccgttgccgtagcctggacgactgattcccttctgttgcaaacaagtactccattccaatttccgtgggagcgcgggggcaggtttggctgcgcgtctggaacagcggtggacgcggtcgatcggttgcagttagcgaatggcttggtcgcttgtgacggtggattacacgttacagtaccggattgggtgccgctctgcatgttgatgttcccagatgttgggatcgatatcagattttacggaagcacaacgttctttccagtttcgctttggaacctgggatatcaggtttaaacaaatgctattgacaccagcagggtgatggaagcaaacccttccgtttaaattactggacaggcaggacagccgcagggaaacgaaaatgggagagaagcctggcaaaaagagatggaaaagaaaattggagtaaaaaaatactccctccatcccataatataagtaattttgactttttcttgcactgtttgaccattcgtctaaccaaaaaattttagaattattattttttttatttgtgacttactttattatccaaagtactttaaacacgactttttattttttatatttgcacaaattttttaaataagactagtggtcaaacggtatcttttatattatgggatggaggtagtagcgattttcgtagacactttcgagcaaatgggtggttcaactgcatgaataaatagggtttgatcgtctgaaaaaatgtttctttcttttgtagtgtacgtatttttcattatctacttctagaagttatgctgacattactggtactggttgcgtgcttagtatattatggactatggaccgtcgatccatcattgacattgctagttgaagtgctgacagagctaatttactttagtccatcatttcccgttgaatattatattgatactctctcttacaaatgcataagtactataattgacacatgagacttaagctcgctctgcactctgcagtagtatgcagcactgtataagtgtatatatatatactacatcattgtacatttctagttttctactctctcgagccaagaaattaaagaacgattccacgaaaagttagactcagaatctcatactctgatcccagacacttgtactcaatattgctggttgaactcaaccatccacgtagtactcaatagtgaatacacaacgtagtgcgtatcatgtatacgcacatgcgtatgtacagccaagcatatccatacgcttgtaataccgcggtatcatgcatccattaaacacacacgtaaacgttaaacctcacggtccctcaaccgacggactgtaaatctggcagaagcgtcttacctctctcgaggccgcgttgcatgttaatatagatgagaatagccctcaccgagacgtgtacagattggagacatattacatcttgcaatacaagaaagaaaaccaaaaccgattctatctctaaccatagatacgacatatacactacattaacatatgcgtgtatcattgtcacatgtacaaggactcttgtaattctaacactccccctcaatcataacttatctaagttaagattgtgtctaaaatttcttagcagctgaaccgacaatggtttagtaaaaccatcagcaacttggtctcctgaagatataaattttatcaccaattgtttcctggcaactctttctctgaaaaaatgataatccacttctatatgcttagttctggcataaaacacaggattaactgaaagatatgtagcaccaagattatcacaccataaacaagcagcttgagatgtattaactccaatttcctttaagaaaagtttgtatccacattacttctgcagttgcattagctactgccttgtattctgcctctgtacttgacctggatacagtagcttgctttctagcactctaggatactaagttggatcccaaaaacacaacaaagcctccagttgaccttctatcatccacagatcctgcccaatcagcatctaaaaaagcactcacaagcatagaagatgaatgacatattttcaaacccaaatcaacttaagactttatatatctcaatatcattttcactgatgtccaatgttcaactgttggactatgcaaaaattgacaaaccttgttcactgagaaggaaatatcaggtctggttaaagtcaaatattgcaaagctccaactatacttctatatttagttgcatcattttcacccagaacagtaccactataggctgataatttctctgaagtagaaataggagtactaactggtttacaatccatcattccagctttcttcagcaaatccgtagcatatttttcctgttttagtagtataccatcatgtaacttacgcacctctatacccaagaaataatgaaaattccccaagtctttcagtgcaaactcttgtctcaagtctgccaataatgcaatagctgccccttctgtagaacttgcaacaattatatcatcaacatagataagcacaaagattgtaacatcccctttattataaaagaacaatgatgtgtcagccttagatgccttaaaaccaagatcacataatttcatactcaaccttgagtaccaagcacgaggagcctgtttcaacccataaagagctttgtctaacttgcaaatataattaggcttacttttatcttcatatccagggggctgtctcatatatacttcctcctcatgataaccataaataaaagcattctgcacatcaagctgtcgaagacaccatcctctagatacagcaatagacaagataattctgatagtagccgctttaaccactggacagaaagtatcttcataatcaattccatatcgttgtttaaagcccttagccactaatcgagctttataacgatccagacttccatcagacttccttttgattttatatacccacttgcaatctataatattcttgccatgactaggtggaacaagatgccatgttttattattcaaaagagcaaataactcaatatccatagcattcttccaatcattattagctaatgcttcacttaaattatttggttccccgttagtagcaagaaaagaataccgcacagtcccatccgtgtataccttttcttttcttatccctcgttgaagacgagtagtgggtcgagtctgatgtcctgtctgttgtacatcttgctgttgttgtattatctgcatgtcctgctgctgcacatcttcctgcaaagacgtgactggtgatacaggcgactcaacaggcgatgatgaagacgacgtggtggcagtggcaggcggtgattggctctcttgctccccttgcgacgcaacactaacatcctcgtcagcatcaaaccgcacggcatcagaaaaaacaccatgggagtcctcgctattagactgattatttgcatcatgatctggattttctgtgccaccaggatcttctgtatttgcgccaaaaattcttgtatcacccgtatttatatgctccccataatctgaactttgcccctgctgatctgtaacattctcatatacaccattagaatgttcaggagtattaagcatatgatcattactatattcaaccccagaaggacttaaaaatgaaggtaaaagcaatatttctgatctcaacctagctcctgcatttgaatgcagtttagagaaaggaaaaatattctcataaaaaacaacatcccttgaaatataaactctgccactggatatgtctaggcacttgaaacctttatgtatgttactatatccaaagaagacacattgctttgagcgaaactgaagtttacgcttattatagggacgaagattaggccaacaagcacacccaaaggttctcaaggcagagtagttgggtttttgattaaggagtcgctccagaggagtatcatattgtatgactttgctaggtaggcgatttataagatatgtggctgcaaggaaagcttcatcccaaaatttaagcggcattgaagcatgagcaagaagagatagcccaacctctacaatgtgtctgtatttgcgctctgcggaaccattttgttggtgagcatagggacaggagacatgatgagagataccaatcttattaaagaaagaatttattttttcatactctcctccctagtcattttgcatagagatgatcttgcgattaaacagtctctcaacacgttgttgaaactcatgaaacttggaaaacacctcagacttattctttaacaagtaaatccaaataaatttgctgaaatcatctatgaaactgacatattattttctacccccaacagaaataggggcaggtccccacacatcagaaaacactaggtctaaaggatgactcgacacactagaggatttgggatagggaaactgatgactcttagcctgttgacaggcatcacacacacctaactcattaatttctcctaaacatgggagtttattgttgctaacaatcttttgaacaatggctaaagatgggtgacccagacgactgtgccacttagaataggtaggcttgacgactccgaggacttgcttggatgaggaaaacgaagatgttggcaacgggtaaaatccattgcggcatggccctctaagaagaagattcttcgtgacctgatccttgatggcaaagaaacgagagtgaacttcaacaaaagcattgttatcaacggctaatctatgggcagatatgagattctttttagccttaggaacatgaagaatatttttgagataaatattgcgaactggggtatgaatagtagaatgaccaatatgcttaatattcatacatgctccactcgccgtgtggatttgatctttgccattgtatttctcatgagtcgacaatttctccaactctcctgtgatgtgatcggtagctccgatgtccatgtaccagtttgtatctacaccataggaggcagctgctgctgttcggaaatccggaacgaagctttcatcatatctgtgccaacaatcagccactacatggttgatttttccacaaagctggcaggtaagacgaggtttgttgctgaaaccgcgcgcgccaccatttcctcggccgcgaccgccacgatcgccgcgaccaccacctccgcgcccgcggaaggaattggctgagttgctgttgaagttgctgttgaagccgccattattcttccctccatgcttggcgctgttgacagatgaagagctcgcctgctgccgcaatctagctctgctttcaaagcttagaagctgagaatagatttctgtgataggagccggctctgcccttccaaccagattggacacaacaggctcatagtcatcatcgagtccagcgagaatataagacatcatctcctcgtcatcaagcggcttccgagcagatgccatctcatctgccaatgatttcatcttcccgatatactctgcaacgctgaggtcacccttgcgagttgtcgacaacgcgagatgcgtgttcagagcacgcgatcgagactgggaggacaacatcgttgtgattgccctctaggcttcagcggttgtctctatattgacaacctgagtcagaatctcctttgataccgatgccaacatataacttagcacctgctggtcttcagcaacccaagtctcataggctggattggaaaccttgacaagcttatcaccttccttggcgtcaacttctgcagctggagcttgctttgcgccggtgatgtaaccttccatgcatgcacctctgattgctggtaagatctgtgtcttccataacaggaagttattcctggtaagcttctctggaataggttgtcccgagagagggttggcgccgctggaactagacgaactcgccattgccgtagatgcaatctcgtcgtggctatcctgctctgataccatgtaaatctggcagaagcatcttacctctctctaggccgcgttgcatgttaatataggcaagaatagccctcacagattggagacatattacatctttcaatacatgaaagaaaactaaaaccgattctatctctaaccatagatacgacatatacactgtattaacatatgcgtgtatcattgtcacatgtacgaggactcttgtaattctaacacggaccacgtggccggcatggatggcccaggaaagccgtgtcagtgtgtgtcaccgcaccggagtagtgtgtgtgagcgtgtcaccgcaccggatagatcagctagctagtagcgatccactcgatcgtaaatggcgcatccggatatgtcacgctcgcgagtcccaggcgccccggccccaacacccatctggctgctgatggccatccccatcaccatacggtgtgcgagtgacaccgccgtacgtgtcgccgctagctagcaggcgctcaatcgtgtatgcgtatatgcatcgcgtcctatgatttcgttcgaggtattatgtttttttcttttttttatgatttttataggcagtggttgaacaatctagcttttgagtaatagcgatctgcattacgtccttatgcaaatacaagtgatggtgattaatataattacataagctctttccttggtccgcttctgagtgttttcattatctacttctagaagttacgctgacatttggtactagttgcgtgcttagtatattatggactttggactgttgatccatcattgacattactagttgaagtgctgacagagttaattctttaatccatcatttcccgttgaatattattgatactctctcttacaaatgcataagtactataattgacacatgaaacttaagctctgcactctgcagtagtatgcagcactgtatatatatacatcattgtacatttctagttttctactctcgagccgagaaactaaagaacgattccacgaaaagttaactcaggatctcatagcgttcaaccctgaccatccacgtcgaaaattcgacgccacgcacacatctaccttttccaaccgaagaacacggagccaaacaaagcaacccgttcttcgtcagaactggcaggcgtggggcgaggggcacattgggagggggcatggccccatgcgacgcccccatacccatgcaacggcggcggcggtatagggagaagaagagaagatagcaactgcggtggcgtagggcgtaaaaaggaagatgccggcggcggaggaagagaaggtggtggatctagcacctaacttcatcgttgtcattgttccgcgccgcctccaaacgcaacagtgacagatcgacggcgtcgagctatgccgcgtagtcccccgcaagcgcgctgccgaactccgccgcgctgtccgtcgcaggcgcgtcgccgagctccccccgcgtcatccgctaatagtcggaggaggaggagaagcggcgccgcgcttgggctaggccgccgccgagctccgttgtgccgttcgttgcgggtgcgtagctcagtcgccagggagacgctcactttctctccgccaggcaaaattgctaggagaggagagagatggggagaaaaagtgaaggagaaataatgacgagacccactacaaatgatttgtattgtggagcatatgataaatacagttcttagtctacgtgttatgtagggttcggtataaatctgtgacgcactgctattgtcatcatactctgatcccatacgcttgtactcaatattgctggttgaactcaaccatccacgtactactcaatagtgaatacacaacgtagcgcgtatcatgtatacgtgcgtgcgtacgtacagccaagcatatccataagcttgtaataccgcggtatcatgcatccattaaacacacacgtaaacgttaaacctcacggtccctcaaccgacggaccacgtggccggcatggacgatggcccaggaaagccgtgtcagtgtgtgtcaccgcaccgggtagtgtgtgtgagcgtgtcaccgcatccgatagatcagctagtagctagtagcgaccactcgatcgtaaatggcgcatccggatatgtcacgctcgcgagtcccaggggccccggcccccatctggctgctgctgggcatccccatcaccatacggtgtgcgagtgacaccgccggccgtacgtgtcgccgctagctagcaggcgctcgagatcgcgtatgcgtctgcatcgcgtcctgtacggttccacacgcatacgatggcatcaccgcgcgcacacgtcgctctcccaagctagtaagccgatgcacctcgcgacgagccgctaccgctcgctactcgtcgcgattgcggcgcccccacgacgtcacgcccccgcgcatcctccccgtacgtacacgcaatcctcccgcgcgcgcatcttatcgcgtcgcgtcgcgtcgcggaaacgtttcggcgatttggggcggcagaggcgtgtggcctggtgttattacctggttaatctccaccacgtcgtaacgtggcgccgcccacgcgagaacggccgctttgctcgttggattagtagctggagcttaccgcgctccactaattaccagccgggccggcccggccggtggtcagaggttgacgccgctgctccgctgccgccacgtgtcgccgtggccgctaattcgcgagatcgtgcgtgtggtttctgatcaagtcaaacgttaatcccggctagccgcgggctaccaatcacgcatagattactcgattggattaggacggctggtaaatatgtaatcccaccgtttcaggttataagatattttaaatatagtcaaagtcaaaccgtattaaatttcactaagtttgtaaagaaatatagtaataatatttatattaccaaattagttttattaaattaataattaaatatatttttataataaatttatcttgggtttatttaattaaacttaaaagtttaaaagtagtttgagtttgatcaaagccaaaacatcttatcacctaaaatggagggagtattttatactactagtttaatccgcatgtgcgtgctcgatctatctatcgcgcgtgttcggtgacctgtataacttgatcgcctgtttacttttggggcggtcaaactgggatccttttcatttgcccggatccgtgaagaaaactttgaccgctacgtggcgttggatgctgatcgtgcgatccggttttggccggtttgtttattattctcgccttcgtctggcgtgagaatgagatgagatcgttcctgccttcattgctgccgtactgcgtgtactatactgtgtggaattcggcctgggcagctgttgattttagccatcggcggcggtggccgacgtgaatgagccgtcgccgccatattttgttcctttcggttgctacttctatagtaggattatgttgttgggttagtacagcgacgggtactgtaaatttatgctcgtttcttaatttcctactctacttttgattttggggattccttgtctatctgtttggatcaacgtgacattagatttgaatctagctagctggaaagctctcaaggcgtggtgcatgacaaatcacagatgtataacctatttgcattcaacaaactagtgtaacagtagataaagtttccccgcgttaagcaattcttcacaaaaggaggccttagcccttaagcttcgcgtaggcctgtgagggaggaagcatttagctacagtccttttacattcttcttttttttttttgaacgaagtacttttacattgtgttcaccaacagatcgaagaggaaatggtcacgagtgaccctgccgccctgcacacacatgcacattggcacgagcttagaggaatatttccaacccttaacccggccttctcataagaaagcattgcttggaagcgatccgatcaactcaaaaccaaacccagccggccagccagccccaagctgagtcatcaaacacacccccaccaaaacacacccatctcacccgtccatcgaccacaatccagcggtcagaaactcacaacatcttcttcagtctatcaaaccaaaaaaaaaaaataataaggagaactcaataaaataagcacacgatgggtagccatcacatcaaggtaaacaaaagtcaggaggattccttccaggttccacttccaaccccttcccagctctcgaacaactcaacgcgctaaacgtctctctcgcacgtatatatatactacggcctcacgccttcgtctccgcaaccatacaaatttttttctgagttccaattcgatttgttcgttcggttactgcaaaagaaagtcagcaacaaaatggccaacgcgaggaacgcggctgccgcgtcgccgccgccgccgtcgtcgtcttcttcgtattcctcgtcggcgtccgacggggagatcctccgatcgctgcaccgcctggcgagggatctggctgcggcggaggcgccggcgccgttcttggagacggtgttcgcggcggtgtccaggcgcgcgaagcttctcgccgcggtgttcgacgacctgctccggtgcgggaggctgccgcggtcggcgtcgctgtgcctgcgcgaggtgctgctcgtgctgcagcggttcaaggcggtggtggccgactgctcggcgcgcagccggatgcggctgctactgcaggccgacgaggtggcggcgcgggtgcgtgagctgcagcatgacctggccacgctgctggatcttctccccgttcccgagctcgggctcgccgacgacgtggtggacctcctcgcgctcgcgtcccggcagtgccggcggagctcgccgtcggcggacgccgcggagcacgagctgaagaccggggtgctggcgctgatccaggaggtggagagggagatcgtgccggagagggagaggctggagggcatcctcgaggaggttggcatcaacgacccggcgtgctgcagcgacgagatcgagacactggagcgggagatcggcgaccgcgtggcggagaggtggacgtcggccatgattgcgctcgttgggctcctccggtacgccaagtgcgtcctcttcaccgcggccacgccgcggccgatggacaccaaggtggatgttgacgacgatgacgatgacgacgacgccgagccgccgtcgccgccgccggacttccggtgccccatctctctcgatctgatgcgcgacccggttgtgtcggcgagcggccagacgtacgaccgggagtccatcacccggtggttcggctccggcaagtcgacgtgccccaagactgggcaggtgctggccaatctggagcttgtccccaacaaggcgctcaagaacttgatctcgcggtggtgccgggagaacggcgtcgccatggagagctccgagccaagcaagcccgagccagcgccggtggtgaccgcgaacaaggcggcgttggaggcggcgcgcatgacggcgtcgttcctcgtcaagaagctctccgtctccttctcccccgccgcggccaaccgcgtggtgcacgagatccggcagctcgccaggtccggcaacgacacgcgcgccttcatcggggaggccggcgccgtcccgctcctcgtgccgctgctccactccgacgacaccgccacccagctcaacgccgtcacggcgctgctcaacctgtccatcctcgacgccaacaagaagcgcatcatgcacgccgagggcgccgtcgaggcgatctgccacgccatgggctccggcgcgacgtggcgcgccaaggagaacgcggcggccaccgtgctcagcctggcgtccgtccattcctaccgccgccggcttggccggaacccacgcgtcgtcgagagggtcgtgcacctcgtgcgcaccggcccctccagcaccaagaaggacgcgatcgccgcgctcctgtgcctgtccggcgagagggagaacgtcgggaagctcgtggaagccggcgccgcggaggcggcgctgtcggcgatcagcgaggaggagaccgccgtggcggtgctggcgtcgctggccaagcgcggcggcgcggaggcgatcgtgaacatcgacggcgcggtggtgcgcctcgtggccgagctgcggcgcggcacggagtggtcaagggagtgcgcggccgccgcgctggtgctgctctgccgccgcgtgggcgccgccgtggtggcgcaggtgatgtcggtctccggcgtggagtgggcgatatgggagctgatggccaccggcacggagcgcgcgcggcgcaaggccgcgtcgctcggcagggcatgccggcgttgggccgcggcggagcaaaccgcggagtaccccgccacctccgacgtcacgacgacggccattacagcgtcgtgaaattccaccacggccacattgattaattcataggagcagataaaatttcgattttttttcccacgcacaacgaatgcttgtacaaaaaaaaaaattgtttcttgccttcaaggccttcacgattctttggttcatgggaccagtttgagtaattgataaactgcacatacaattatacaaagatccatttctctccaaatcttgtcacatatttctcttgtctcataagtaacacaaagagaaaaagagatgtcaccaacttgtacaaatgcttgtgaattgtgatcatctccacttcccccattctataattctttaatttctgtatccacatcgacgcaacaactgtacgatttcatttcattccagctaccaatatgaaagatgtgaacaaaagcatcacaataattgtgtagttgatggcttgcaactaggaggcgcccgtgatgagtgctcactcacttagttgcttgagctgccggggaccaaattgccagccattcccggccatccaatttggaggagaaaaaagaaaaaaaaagaacaaagcgagcgcacgctacctaacgaaacaacgaatatgttgctccgcgcgagagagtgcagcaaagcataaaacagcttgcaaattcaccggcttttgggcagaaaaaggccgtagctttagtgccagcaagagccagtgtgcatccatactgttgatagattgtaggaatatctcgtatctttggatgcatgtctcgctgttccggccattgacatcgcctgatgctggccatatgtgtttccctttgaccaaagcaagatggtagtattatgttcttctttctactactactacttgtctactagtagtctatgcaatgttaatgttaaaagtagtaggctcccatcggatagcataataagctaaaaaaaaccaaattttaaattttcgagcttaattttgagatatttttaacgtagtttctttttaacattggcttttaagtcacaaagaacatatttataaaagttttacccacaaatttatttttattttctaataagccgttttaacttattaggaaataagccaaacgatggagaccgtaaaggcgtctgctgaatttgattagtgtgacttgagacgggtgttgttcttcctcttgctgttgcgtggctggaaagatgggcgtgtggttccttcctgccagggaactaagtgtgtcattattggtgtaaacaatctaggttttgtttgttataatcatacggcgctatttaattacattgcatgccagtttaaacacggttgacagtagctttctggaccagccgtgttgtttcggatgctctctcttcgtctttaattgggaggttattctgaatcatagtatgtatgagtggatcgtatttggacttggaaaatttgtctatttggggcctgttcactttgatgttaaaaaaaaacttaccaaaattttagcattaccgaaattttggcaaatatgctaaaattttggcaacttaccaaaattttggcaggatttcttatatagttaccaaaatttggcagcaaactaaatgtaggtatttttttggcaactttactaaaatttagtaaattgaaaatggcatcaaagtgaacaggcccttggactgcacctgagcatggaaagggttgaagttagcctattaattgacaagtaaccagactgaatcaattcaggactcatcaggtggtgttattttctaataacaactacatacttttcccccaaatgcagcaacacaggactgcttcttctttgcatacttgtgctactattaaggagcatgtgctatttagacgtactagttcttgataagtcaaggggtgtacttgttgtactacatgcagctattgatcctcatcaatcgatcacttatgtcttccagattgatctgcaaggttggagaaatggagagagcttcatggttgccacagtgtttttctgttcggagagggagaattgttaggtgacatgtttaacacgcctgcattttgatgacaaggacaaccggcgttgggtctcctcttttaaaaaaggtttggtaatcgggtaaccatcgccaatggcatgaagcaagagagcaatataacgtcagattatgttcttcctcttcttctttttttttaacctggcagttggccagttgttacttgttactgaccaactgaggaaggaggtaaagatattttaaagtggcatgctaattagtaactggatgtcatgaataagaaatgtaggagcatgagaaacacatggaactggagttgtatgtttagttgtactatatgcttagggatattgcaagattagagagaacaaaaatgtttgaatatactccctccttccctaaatgtttgacaccgttgacttttttaaacatgtttgaccgtttgtcttattcaaaaacttttatgaaatgtgtaaaactatatatatatatatatatatatatatatatatatatatatacatgaaagtatatttaacaataaatcaaatgatacgaaaagaattaataattacttaaattttttgaataagacgaacggtcaaacatttttaaaaaagtcaacggcgtcaaatattttaggatagagggagtagttgattggatgatttgagaataaaaaaatgtaggattttggataaatgatgtgaattacattaaaaaaatcctaaaactatattgacttattcgttattctaaatggtcagacaggagaagtttccttagaatttcaaatctcacatagattcctgaagactaaagagagccactgttccaaagggcacatggttcccttccaaaagatgggcgcagtgcctaattgctcagtgcagttcagctggcaggaaagcaacgcagcaggcataacattagacggatttgtatgatcttcagataccaattcagcatttcagttcagtgatttatttataactgactgtcacccaacaaaatctcgatgtaaagcaaatcagaagtgtttttttcttgttgacaacttgacattatgcatcatgatacagacatatgtttttaggtatcatccagaggatttctaatcggtccattcggcttccagaaatttcaattcagatcatgttgttgtgatctctgatctgtactccctcttgtacagttgtactggctgtttgcttattcaaatcttcagacatgcagtgcaccactgtcatcaggtatccccattcaacttgatcctgcagaccatgaaagtggcagatttatcatgactatatcagatttcaaactcccgtatgcaaacaaggtaccgcactcgcaaaaaggaaaaatcttaatgcagtgattcgaatcacgtcctgttctccctctccctttgcgtctctgcttgttgatattgatgcttaatgctatattatacgctttggtatctcccagacgatttggaaactggaatcaggccattcggcttagggatttcaatgatcagggcgtggattttttcgaaaatgctgcgcgtcgggcgccgagcggctgaagaaaaaaatcggacgcctccaaccacgtaataagtattttaaatagctttaaaataatttttcttctcaactaattatccaatctacgatccgatcacaccgttatattcgttgcaattaaatctttataacaagatcacacatgattatatttcgataaaaaaatattttagcttttttattgatattgttttagaatgctgcatatggttttttttatgtttcgaccagtaattttacaatgtttcagctagtgtactcgtgatgtttcactatgtactgatcaaattttgcagtggattttaatattatgggacgcgtcgttgcaacaaatcacacatatattttggaaactctctattaagagaatttgtttcttttttttcactaaaaagtttcacctagtgtactcacaatgtttcactttatatagatctaatgttgcagcaaactaaaacattccattgcaacaaaaaaaattcacatattttggaaaccccctattaagggaattcgtttcattttttgttccaccgaaaaatgtttcacctagtatactcacaatgtttcgctatgtatggatcatatattgcagtgaacttacattcttttgctatttgctgaaacattgttttttatataaggtgaaacaacacccgatttaaacgagtgaaacattttcactctacttagtgaaacaattccgatatacctagcggaacatcgtgtaatctattatatactaaaagtccattaaactttctacaaacgctcctaaaccgctacatggctcctagaaacactcccataccatcacgtggcgctctaacaaattatagaaattccaagaaaaaaacaaacatccgatcattgattttcacttcacatggtggacccatcgttttacaacattagatctatcttatatattaaaaatatattcaaaaaacccatccatatcccctccgtcatgtacatacctaggtactcctctctcctttcttccatttataggaagcaaagttttttatattaaaatatcaatctattattatatagtaaaaatccattacacttcctataaatattcttaaatcacgtggtgttcctataaatactcgtacgccgtcacatgatattgtttaatctcacggtcgattttcatttaaattgatagatccgttattttagatcactagattagatgtattatttaaaaaagtaataattccctcgtgtatattgtgggccggaatataagaaaccaaacaaaatactccgtgtacgtacgtacgtacgactggaaaataaaagatgaagcttacctactgttcctagaagaaagaaatcatacgtacggacttacgataaaaacgataaaataaaaaaaaaacatacgtaacatacgtacgtactgccattgaaaaaaaacaatggtctataacataggattttctactatttaaaaaataaaatataatactctataaacttgcgcaaatatatgtagttaaaatagatcttcaacaataaaaaaatatcctatcattaaacatcatttaaattattttaaaattatatatctaatgtgtgatcaagtcggattcctataattaaataaatattgatgtatatatacctaaatacatcataacacatgagaccgacatataataaataatgttatcataatattttaaaggaaaaaggacaaagtacccccgaattattatggtcgaccgaattacccccataaacccgaaagctacacatctttcaccctcaactattaataccgaacgaattactagttgtcttaacccggggtggttttgatcctacgtggcagtccagtcagtattttctaaaaaaaattggtgggacccacctatcatatctccccctcccctcttccccctctctcactttcttatccctccacgtttgtcaatcgacaaggctggggacgacgagcggcggggcgaaggagtatgagtggtgagtggcggacgcggctaggggcgacgagcagtggaggcggctcctcctcagcctccgctggtgcgcacctccttgacgaccgcgtggcttctccacggcctccaccggcacgcgaagaggacaacaacggcggggcggaggagcttgagtggtggaggcagcgagcggtggaggcggctcctcctcggctatctcagccgccacatgcgcactccgacggatgccatcgtctccatcctttttgtcacatctcatcatcacatgacagtcggcggagcgagcaggtgcgctggtcctccattgccaggttcggttgcacccccgccatcgagaactcccctaaaaaatgcggtcgcagctccatctaccatagcatgccatcccaccacgtttcttaatcgatccccaccaccaatgcctctctcctgacgagacaaaaagcaacaatcaatcaaagaacaacgaggtggatcaatcgtgagagcaagagcagggcaatagatgaaggagaaggacaagagagttgaggcggtgaagaccctgcagcaaggggagggagaagaaagacaggctggggaaagggattgaggaagagagggagagataggggagaggggagagagatagagagggtagagggtgtgacatgtaggtctcacctattttatttttttaaaaaaataccgactggattgtcacgtaggaataaaaccactccaggttgagttagggggtaattcgtccggtattaatagttgagggtgaaagatgtctggtttcgggtttagggggctaattcatacttttttctattttaaataatttcacatcatatttcaggtgtcaaatatcacttgatgactatatagcgctaatttaaatttacgtatgtaaaataaatgaaaataacacaatttagttgtgtatttttaagtaaatctgatttacttttaatttgtttgaaaacaacacaattttggttgataatctgtttgattttttacaactatttcattagtatctgataagtgggaaacataaatgttacacatatgtaaaaaatatgaaaaatattttaagccaatgatcttgctataatacaaccacttaatccatcataagatttatggtcatatatgtatgtttttgtctttttcaaatagttttgataacaaatgaacaatcaagtaacatgcacaataaactatttatgatatattttctaatagttgaggaattcctacacatcagacataatttgatggatgtatgttatacaccctattgacgtgtctataaagtattcttcaataaattatttattgtaaataagtttaggaaaatagattcattcatcaaattaattagtaaaagtgtctcatataattatgaacaattaataggcgttgaaaaaaccaaacgcaaaagtattgatatttatcaaaatataacaaataatatggtgctttggagattatcgtggtagcatttaaaaaacatttatcctgattaaaaaaatcacatatagtataaatagatatgaaacaactccagtattccattattattccattatcatgacacgtgtttaaaaaaacatgtttaaaatagagtcaagatctattttaaaaatatcaactacacgtaaacattcataataaaaaatcaatcaacattaaataagtgcccgcgcacacatgcgcgggctactttcctagtatttaaaaataattcaataatatgctaattttttttcgtcggaatataccatgtgtggttttgttttgaagatttaattgcaacgaatttaatgttgcaatcgaatcatgatttggataagtaatttaagagaaaaatcagttttaaagtagttttgcacgtaaatcgggcgctgacgtcagcgcctgatttccctagcccggatcggtaggcgcgtccggattttttgacctacttgatccatgcgtgtttgcatctgcaaacgagttgattaagattatcactcggccacgtgcaccacatggctcgaacacagaatatagatgcagaggaaccaaaactggggaagacattaacgatgtaatcgtcgatcagcttccaaattcactgaaatttggcgacgtaagttcagagaactgactgtacaaaaagcctgaggcataactccggtcaggattcataactgtacaaaagttgattttctttttttttttttgggggggggggggcggggagggggggacagatgaagtacacttctacaatatcagcaaactagtttcaaaaccagaattagaactgcagccggtatatttcagtatttgttcgtgccgaaaagtttagtgacatcgtctaccgatacgtgggagcagctagccttgcagccggagggaccaggacgagctcacggcagcacgggcaggtgcgtctcgtcgtcagccactcgtcgacgcaggcggcgtggaatgcgtgccggcagcgacccggccgccggcacctctcgccgtcgcgcatctcctccaggcatatgctgcagctcctgccgccgccgccgcagtaggcgaaccacggcagccgccgcagctggtctggcgttaaaccgtccttattgtcgccgccaacgtcgtcgtcgtcttcgtcgctataatctgtgtaccaggaatcagagtcgtaagagtcatcgacgacgccgtcgatgtaggtgtcgtcgtcctcgccgacggcgcaccaccaagggaggaccaacatcgcgactccagcgacggcgccggtgaagagtaacagggagaacggcatctgcacgaagagaaggatcagtttgcgtatcgccgaaggcgaagcagcgtcgtgatcggatttattggttagcaactttgcattgtccgatatcggaattcgaaaccgaccatgaacatgaagaggggttgcgaatcagaagggaagaaggatagggaggaggagaaaggaacggggatttgttgagttcgaaggataaaacgacggcccatatacgcttaggtgggcctacggttgtagggccctttcaccatcttcctctttagtgggccgaggccgaatgggctggcaggcggcgacgcgagaacagcccaatcttttaccgacggcgaccgacgaacgttcccgtgtgcgaacaaggcgccacggccgcgttctcacctcgctcactggcttctccggcgaggtgatgcgagaatttttcttaatgcagcggggcgtactgcgtgttctcccccgaccttttgcttgctatcactagagattttctagggatttttttaaaattttaatatctcgaatgaatgtctctttgtttatctataaatcgtctaaatagttatagaaaatatttaaaaatttatagcatttttacaacacatatatcatttaaaagattttagatccaaacacaactcacacattgaactaaaaaaaagataataatgtcggaaaaaaaccctagggttcagggctttaagtttggaaggtggtagaggggatagggaggtggaagggaggctttagaaagatggtcttggacggctattggacctaccatgcagagccgcacgtatgaagcagggtggcaggcaggatcaacaacaatggcattggatctagagcggttaggagaaaagggggtgagaactgagaagggccagtgtggcgggcctcacattttgcattcccttgtagagtggggttttaaatgtttacatctctgcgacaaagccccatgaaaaaaagggctaaatgagaatgatgcattgataaaagtgaaaaaaaatattccctccgtcctaaaatataacaattttggggttggatgggacacatcctaatccaatgaatctagataaaagattgtccaaattcgttggactaagatatgtctcatccaattctaaattattgtattttggaacggatatagtaataatgtttgggagcataaaagatggtcaaagagtgtggtgctaactcaatgggaagaatcatttgttcgttcgtctgtactgaataacatgaacggaacatatgcatcgcattgaccatgggaaaaattccaaaaccccccatcactgtagacgtcaccttttactccattttgattagccatcacgtacccgacccctagacgacctgagcgatcgggacaacctcacgtcaaaccgcaacccgggggcacgcacacacacgccgcggagaccaactggcgagccatgcctgacgcgcgcgcgcgaacgtggcggccatcctacgaacctccaccgtattcccacgcctcgtctcgctcccggcgtcagccgtcgacacacgcttggcacagcccacgaccacacgaggagcaaagcaaagttaagaaagcaacgcgacgcgacgccctggcccctgcatgcgtgccgcgcgcgcggctgcgggggtttctcgcggtagcgtacgcgcgtcctcccggctaccagctgccgcgccgcgcgcgcgctttggctcagaccgaatcgagtcgcaatcgcatcgcatcccgcgcaaacctgtgtgtgccggggtggtgccgtacgtggtggtgagcgcaacgcaagccgcgcgcgtttgcggggagcgatgtgcatcggagtttcacgggaaaaaaacacgtacgtcacgtacgagaagcggtgtgcgcgcccggtggttcgttcatacgagcagcgcacggggcaagcgatcgatcgaactccgagggagaagaaaactgtcccgagtctcataagcgattctcaaatactaacagtctaactgttgtcagtttgttaaccccgtttgagcacgtgagtgtgtatgctcagctcgtatgacacgaccaaacccggccggagagataaagaagagaggatgcgtggcacttattacgacctgacgttgcaaaaggcacctttgaaaaatcgtgtccggaaatagtaacgtgcatgggtttttttctgtgtcagttttgtcttgcccgtgcaccaaaacacaagagttaatacagggtagtctattgtgtgtctactcctagagaattactgtagataataccccacctcaaggtgaattaaccatcgcccgcctccatatgagttgtgacaaaataaaaaggatatatgtaatgtaactagctagttgtcgaacaacatcgatcatcatcatctcgcgcagtcggccccaagatgtgcaacaagcacgggatattaccggaggacgctggttctctgtgtgcatcatttcggactcttaagcattacacacgtacgtcaagaatgcaacctgatcaatagaatgcttccttctcaaccctatttctcacatcgtacttttaagctaaagttttgttcgtgaccatggaagccttgggtggactgacttgatcttccattgattacctgaaaaaaccatccatgttaattggttcctgtctagttttgtcacagcatatcttaggtgtgctacaattttatacatatgtgtttatcatacctcacgtgtcgtatatagactcggtttctaattaaacatttgcatacttgtttgttgtgacactcgttttctttgccacatctttttatgcatggtgggttacactttgctgaaatttacgtgataaacttcaatatgttaaccaaatagctctagataccgcggaatagacgtgagtagcaataataaaaaaatagacactgatatttttaaatggataacgttgtagaatacatgcaatatatgaactcttaattctaaaatcaataataaatgcaaaaaaaatattatttgatatataaacatacaattaatagtttattaaaagagtgtgtcatgcagatacagtattatatcgtttttttatgatataggagtatgttgaaaaagactacaataaaacatgaagaacgagatgtatagagaacacattcggaggtacagaagggtggtgtttttttaggaaataaaagtatggtattgtgtgtgtagtgatgtgcatgtgtgtgttgatttggccgtgtaataaaaaaagattatataaaaggttattaaatgaatgcctttttatgaacaaagaaaatgaatgcttggaatagtagcttatccggtgatcctactcaatgtagtcatcccgtattaacctttttctgcaaaaaaccatgcgagccccatgttgtccagcgaaccaggtgtgctgaccggacggtatggcccaccgttcagcgagacaagaaaggaacaaaaagagcagcgaaacctcgctccgcacgctctctcccgccgctacttatcccgcgcgggtcacggcgtggtcgcgctctggcctggccccccattcgatctctccctgctcctccactcctcctcctcgtacagcgccgaagaacggaggcggcgccgccgccgcgccggcgagaggagagcgagggaggacatgggccggcggaagttcaggctctccgacatgatgcccaacgcgtggttctacaagctccgcgacatgcgcgcgcggggcggccgcggtgcaactgcgatgcagccgccgtcgtcgtcgtcgttgatgagggggagcagggcggcgcagcagcaggcgggcacgtggaggctggggacgtcgtcgtcgtcgtcgtcgttgctgccgcacagggcgtcgtactactacaccacccgggacagggaggtcccgccgctgccgccgccgccaccgccgaggggcgtggatgatcaattcccttccctcacgctgtcgccgccgttgccgacgaggaacagca

SEQ ID NO: 42747 - DNA, 3287 bp, Oryza sativa
  unsure (1)..(3287): unsure at all n locations
agctcgtactagcgccgtccgacgaccacgacggctgcagccaccaggagccgccagtggccgatgcgtccgggagctcccggtgccgtcgcgacatgttcatcgggagagatggcggccggggcgtggagttccggcgccgggcgacgacggtggatggtcctgaggaggacgccgccgtcgatgtcaaggtgatcacgtcggacgcggacataatcatcgacctcggcgctgacgacgacgacgacacgccggagagggtgctccggcctgtcgtgaccaggcccgcgaggagggagctcgactggtgcgagccggcggaggtgaagcacgtcgacctcgccgagctgatgacaccgagagcgagctctgcctctgcctcctcggagaagagcatcagcacgggcaagccgaggcgttcgtccgtgtcgtctcgacgccgcctcaagacgcgcaccaacagcccgcgcctcgccgcgtgcaggaaaggcaagccgacggcgcgggcaacgacgacgacgccgacgcagccgccgctcgcgcacagcttcgcggtggtgaagacgtcgtcggacccgaggagggacttcctcgagtccatggaggagatgatcgccgagaacggcatccgcgacgccggcgacctggaggacctcctcgcctgctacctctccctcaactccggcgagtaccatgacctcatcgtcgaggtgttcgagcaggtctggaccggcctcgccgctgcctgtggcgtcatgccatgagaaaacgccaagagttcatcgctcaccaaagcctccatgctcattgattgctgcttggtgaatcgctgaatcttgccatgaattattatagtagagtagtttagttctttgatttctagtagatgatggttaattagcagcaagaaattagccataaagcaatagaaataaaatcgatcgaaaagtttggttcttttcttgctaggtgatttgcctgattctcctcgcctgtcagtttgctttcctcagtgtcacactgactgtagttatgagctgcactgcactgcatcaccgctagttgattaatacagctaatgatgaatcaccagtacattttcagctactgcaaatcttccaaggctgtccattttctgaaaaagaaaacgaaaaatacattgtcttagcgtacgttctaaacatcaatttggtatattttgtgcaaaagttttttatatagaattttcttaaaaaatcaaatataaatgcattttttaagtttgtaacatttaatactcaattaatcatgtactccctccttccctaaatgtttgacgccgttaacttttttaaacatatttgaccgttcgtcttattcaaaaacttttgttaaatgtgtaaaactatatgtatacataaatcaaatgatacgaaaataattaataattacttaaattttttgaataagaggaacggtcaaacatttttaaaaaagtcaacggcgtcaaatattttgggatggtgggagtattagtggtttgacttgtttttagtgttgccgacaatcttagcccaacctctgttccgaacaaagccttaagccttgtacgatcaggtgctcaggacagtaggctgaagtaaagcatgctaggtacaggtgctgaaagtcaagcaagcaactgaatgtctggatccaatccgccgtagcacacgttttgacatgattaaccgacgtgtcgctgttacttctgacatgataatatccaagtgatttgtacggcgtcagatagtaatatgtcggcgatcgagggtagtgtaaccacgtctcgaaatccttgtgttcttgtggatgttgaacgccgtagcagggatcttggtgaccagttacaagtcaccaactgttgctacaagctgggagatgtagtggtagtaggacgacagggatgcagctgcagcagctagctcctgacaagaaaagcctagcatgtagcaagacaagtatcgagcaatcatgcctcatatgcgtttcaactcgtacagggagtaacctgtgtagcaaatggagatgccactactgactaggagtagtaatttgcttagctaatgcaggccaagtaggagcaattcagctcaaatcatttgagaagatcatatctgtgattgtcctcatggttagtatatatatgaaatgatcgagatgccattacatattgatcaaaacatagggacccaaggcaacaaaggagcagtggtgaaaaacctgaaattgaaagattcttttcttttgtgtggtcagaaacatggggtgatactccttgaatggtccaaggagtagccccttgtcgagacactggagtaagcaagacgaggccgattttggaagcccagcggttgctgatccactggcaatgctggctgcagcataagaacggtaagtcagtaactaactcaagatttgtgcaactgcctcacataattggtaggacatactctgaaggtttcaggctgaaattacccaatccaattcattcatactaccacaattgaccgttggaggaggaatgattttacattcattaataagaacatactagggaatactctgaaattttacacacacacaaaaaaaaaacaccaagtacgtagtacaataaaatttctcttggagaatacagtatatgatatttgctgctaaattgattcagaaaaaaaaaaacattgactgcactaggaaaaaatagattcagagatcgtgctaaagtccaagaaggaatcaaagaacctcttcatttctgcaagtcaattactacatgttttctttttttcacttcagacatactgctactgtattaacgtatccacaatgcagaggctggatgtaaattttgttgtatctaaacatttctgcaagctgcatgtctcaactctcaaagatctcttgcccctcgtgtcccctagccaaatcaccccgtcacctcacactgctccatcttttgtcccgtgctcttggctgggctcccaggtcaacacacatgtacgtgcacaggagaagctatagcctcctgtgatcttcagatactgccctgtgcctgtgtctttctcgcccagagtgcaagacagcaaaggcatcagctgctcatgcaatgcaggtcactgttggccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42748 - DNA, 12638 bp, Oryza sativa
  unsure (1)..(12638): unsure at all n locations
aaatggtatattcaaaggtggttagaaaaacatctttctcccctttcaccataatgcatgacgttgagaaagagtacggatatgagatatcgtacgacaaggcttggagggcaaaacagaaagcattggagatgaggtttggaacttatgaggattcttatcacaattttcacccactattggaggtgatgcaggcaagaaacccgggcacacacatggctattctcgatgaggtgaatgaatatggggagaatgttcttcgtcgggctttctggtcatttgggtgcatgatagaggcctttagaaattgcattcctttgctctgtgttgatggcactttcatgacaggcaagtacagaggaacaattctaaccgcgatcggagtcgacgcggatagccatgtcgttcctgttgcttttgcatttgttgaaagcgagaacacatcaagctggctatggtttttgtggcacattaaaatgtgtgttgttgaaaacagaccaaatgtgtgtgttctgcatgaccgacacaccggtttgctatcagcgatacagaagcttcaagaagatgtcacacagtccgttccatggccagatttacatagcagatggtgcatgcgacattttggggctaatttttatagacaattcaggagtaagagattgatggacctgttcaagaagttatgcaagcagaatcaacaaagaaagtttgatgccatatgggatcaactggatcgtttgaccactacacacatggaagaggttaggaaaaaacctataattgccagacaggaggagccggagggacttgaacccattcctaatgaagcaccaagtattactcggcgcaggaagcgtggaagggccacgaagtgcttcacggagtgggtagaatttgagccaagggagaaatggtcgttgttgtacgatacagatggatcgaggtatggtgtgatgacaacaaatcttgctgaagtgtataactgggttatgaagaatacacgacctctaccacttgttgctatcctggagggcatcacgaggggtacacagaagtatctctgtaaaaggtattccattgatagtcttcataggttagttcacatcacagttgtttaatcctacattttttaaaataaatcactgcacaacattttttctgatgtgtgaatttgttgttgtgcaggtactccagaaaggggctcgggctttcctacgagctagttattgtgaccacggttcagccgacggtacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcaactagttccttttcttacataaatgtggaactagttcagtatttataaatgatgtgcaactggttcattatttctaacaaatgtgcatcatgttaaatactcttaataaatgtgcaactggttaaataattttaattgccttgattatttgtggaacaggcggaatttgttgagcacgttcacgtggagtccgacaccctgctgcaaagactagaggcgagacctccagtcgtcaggcctgacgacgtggcgagcatccttcgcaacttccgtgcacgtgctgccgcactactacgtcgtgtctcctgtcggagcgcggcagatgtggtgcagacgtcgggccgacggccatcaccaccactaccccgacgttccagcgtggatcggagtggtccatcctcttcacgtcgcgggtacgaagcggcccacacatctcacggtcgtccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtgcaaacagatgatgagtacggttcggcgtcgacgcatcacggaatgcctgcttactcccctcgcacagcattcattgaggacttcttttccactgatcctccccagggggaagtagcgatggattactggcacgcagcacctcaggtcacacagccgacacaggagacggaggccggtcaggggccagacgtgacaccacagcaggcagctagagataggcacccccctgataatttgacatatcccactgagcagattaggcgtaggaagaagggaggacctagcaagcgtgcgaagggcactgatcgtccttgacttatctatttgtattaaacttttagtcatttatgttctgtccgtactatttgagaaacattttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcaaaaccctaaatcatatacatataacattacaaaaatattttcctttcttacacactaaaataaattacatattattaaaaaaaataacttattacaaataaatggagaacacgaccctgtcgaactgcgccagttcgacggatatcctgtcgaacaggggcagttcgacagctgcctgtcgaacgggggcagttcgacagccctgcctgtcgaacgggggcagttcgacagccctgcctgtcgaacgggggttgttcgacaggtcctgtcgaacggcagccttccgatctcctcgccagtcgcgctctggccgttcgataggcgccctatcgaactgcacccgttcgacagggacctactttcgcgattttccccggttgaccactacttttgcgattttccataaaaataatattaattctcaaaaaaattcccgggacatcggctagctgcaagggttgggaaaccgagccaaccgaagtgggtcgcctttgcccgtttcgccatggcgtcgtgtgtgttcccaaccgccggtgcatgcatggggcatatgcccttttccagttagctcgcgttactagacacacccatgagtgaacgcacgcacgcacccacgaggtgcgcgtgctgattgcgccgtggactgcacgcctgcacggaggaatctactccgtccaagtccaatctaatccgccgggaggaatcaggaatggagtacgtgatcaatagtggtctgtgctgtgccgtgcgtgcaccggtggtggtggcgcaatgcacatcaggaggagggacacgacgaccgtggttgcggcaaaggtgaattcaccgtcacccgtgtccccgtcaccgtggtgaaaaaatttcaccgtccctgtccccgttcccgtcaaccacgacgggctacaatttcttcagccccgattaccacgtggtgaatttttccccttggtgaacccggttaaacaacaaattcatcaacaaatcatataaatgcaatggaacacaaatcagcagtacaccacattgatatttttccaaaataatatactcaacaaactgctggtcatatcgacggcgacgaacggcggaggaatccatggcggcggatggcgtgctggccggaggcggagggtgccgcgaccatggtctgaggcggcgagcgcgcggcgacgacggccggaggcgccggtcggcgcgatgacgtccggacgcggcgagcgcgcatcgacgacggtcggaggcggcgagtatgtgtcgacgacggccggaggcgccggtcggcgtgacgatggcaggaggcaatgggcggcgcaacgacggccggcggcggcacgcgtgcatcgacggctgggggtaggatcgcactcgcgcgaggggagacggcggccagcggcgctatgcatggtgccgtggtggctggggagaaatttggagatggggagggttgattagggttagaagatatatacatggttactaggcttcatttttatgggccaaaataactataaagtctagaactggactctagctacattacatgcgggtcaccgcggggacggggatggtgaatggtgcaccgtccccacccccaccatccccgatggtgatgagttttggaccattagattcaccatgggtggtagatatcaaccatccccatcctctaatatgtgaattcatcgtggggaatcggtgatcgggtccccattgccgcgattctttgggggcggtgcgagacatgccagcccagtcgaaacgatgagaggctctcgggctctcggcacgcgacggcccagctaatagtcgtctggtcggtccggcgcgggggacacgagcacggggccgggagcctgctcttctgctcaaccgcgcgcgtgccgagtcgcgcgtggcctgccttggtgagcggcccacgcggacaatgggaggcgtcagcgtggcccgtgcacctgccgtgtgcgtgtgtgagtgtcgcggatcgccaaggagacgtgagaggcggctttgatttgaggcccacgagagggcaaatgtcttggccggactaatgagatatacaccgctacacgcgactacgccgttggttcgtagccgcacagctggttcgggtagttcgctgctcccagcctccagccagccagcgtgtcatcggccgcatcgggtccagacaaacgagcgagccatcaatctccatcgagagattcctcgcacaagtcatgcatgacatcagctaatctgtctccctttccacccccctctactcgtgtgtcagtgccagatcgccggctggcagtacattcagtaagacgcgacttgatcgcacgattggccctttccttccaaacaagagagtgtacgaagcggttttccaacacaagaagagatttcacgcatcatccggtgaagctccggttactccccagttcacgacttcaagatttccaaaagtttggtactatatctaattttgaggaaacatgatgcatgtctcgtaaagaattcatatggatcggtgcctcttcatattttggcgcacatttatcactttcaaaacttgaataattaaagattaactgatgatcaaaacttaaccctattgattgcatgtattctaaaacatcgcttatttatggtaggcgaagtataaaaacgtaacccatctaagatggccgacagatcgacggacctgctgagcaaacttaagctgagttcataagcgaggattaggaatcctccttcccaacatgtaaaatagagcagtagattaacgtatgattaatgaagtattagctaaaaaacttcaaaatggattaatatgattttttttaaaaaaacaacttttctatagattttttttcaaaatacgcaccgcttaacagcttaaaaatcatgtacacataaaacgagggatagaagttgggaaagtgtaaaaaaacacaaccttaggttgagttcgttccttatgctcccaactccactctgttgattcccgtgcgcatgctttcctaactaatactgaattaattatgggctaatatgccatttcgtttttcttgcgtgggggattagttcttagcccacaataaagaaaccttaacctatctatgggaggtcgaccatctttccttgtggtccaccacctaccccaagtagccggcttgccatcgttgttgatgcaccagatctgccacctctctttttccccgagcttgctccatctccccttgtgtcatctagtagcacgtctgtcactgtctcctcctctgtgcacctcctccttaacttgcttcgccattcgctgttgagctccctcaaatgcctcccctcggtggcgttaagcaacatggccaccaatgtaaactcccgatgtagtcatgctcactctaacacttgctagtgagctctctcagccacctccaccttgtgccgaggctttctcatacttggccaagcttcgtcaaccacccacaccacacaccacctcacatgacatagccagtggtatgggcaatggatggggtagatggataggggagatcataagagtgggtaaagaagaagggaaagagaggatggcatgtgggacccattggagaagcagtaggagtcagaaggaaatatggatatcgactttttctagccatatgaatatttggagtgccaaaaatagtcagaatgctcttagacaagaaatgatgaaatatatgcattgggggtactatgacgatgttcaaaacaataaagtactacatcagtttcgaaatgtagctttttctagcacaatagtatgtcgaaaaagaagttatttctccactcacctttcatataaaccattcacaaccattcttcatttaatttatctatttactttttcttctcaatcaatcccaaatttccccaatcatttctacctattttttttaacatatatgtccgatttaagaaaattcttatattttgggacggatttattaaaaaagaacggggtagtattttgaaaggtttatgacctagaaactctgccaaacaaacatattgttttcactgcatagaattttacaactagaatttagtattcccatgcatcggaatcactactacaaaaatcgtttttctgtacgaggaggtcggtaggttccatgcgggccgcttgtggtggcgcctgcaaaaaccaccccccgggggcgggttgatttgccgcatgcgaagatccattatcgcatgcggctgcttaagacagccgcatgcgataataggtctattttcgcatgcggccgtcttaaggggccgcatgtattagggcatgcggctccttatatggaccgcatgcgaagatctattttcgcatgcggccgtcttaagtgaccgcatgcgaagatcgatcttcgcatgcggctgcgacggccgcatgcgcaaatggtgatatttgcagaccatttcgcgcatgcgggccggccaaccgcatgtgaagatcgattccgcccgtatgcaaaaacgctttctgtagtagtgaatgctgatcagtactgaagaagaagttgagaagttccaacgcccaactgtcttgtgaagttgaataatttctgctgacattgaaatggatacgctggacggctggaggtgttcaggttcaccaacctcactctaagattcttaggtacaatagcaagctataagccagctataaacatattttaaaaaaataaaggaagagagaaaagagcagcgggctacagatctatagccagctgtagcacggactccaagacgtaatgtgtgtatgacaggtgggaccaggtattaatagtatagtaagcaactattgtatgaattagcaattacatcggctatagattatttgaagctagcagtgtgctatactattaaacttgctctaaaccaacggtagaagagccagtggcaaagcacgggacaaccggacaattaagttgttggttatcgatgcctcgcataaataatcacaatacacgtcatcacttacgtttcacgcacgaccaacttgactgtagcaagctactccttgctaggacaagcggacacatcagctcgattggatcgggagggtgactcagcaccagtttaatttgcctctggacaagccaagcacgccgtctctgatcgctatctgctaatttagtcactacagcaagcaagctagtgactgacgaaacgcagaaaaccttatcaaaattatctcccaaagctaatgtacatgcagaggtgaactgagctatcttgagcaagagatccccgccgtgcagtcgtgatctatcaacatgtaaatatttggaactgaataaaataagattcggagaggagaaatggagggagaaatgcaggagaggtagatagaagttcagtttaatttggtgacgatcatcgcgtcgccatctcgacatcgtacaagctcaatcagtgatttaagatcgtcgaaatactcgaatgcatcaaccaaccaaccaacaacaataccagctggttagtagtacttcactagtactagcattgataaatatataattaaggttcatatcagatgattaagcagcgtagtgtttcccttaaaaatgattactgaagtgagttctttaacatcgtcttcagaaggtgcttacagagaaccaacaaccttgactgcaggagacaacaccatcgccggccgtcgtagtcaggattgccccacgacgaggtgtccggggacctcaatcagtcgatccatcaatctccatgataaggcaataggataagcagccaatagacgtttccagaaaggagcaaatggcacactcagccaatgttttaagtactgaaactctcaaagcttacataaatgaaaaggcagttttttttttggtgaaaagaggataaatgaaaaggcagtactatctgacgatgaatcgatgataactccctgaactgaaaggttaactcagtgattaatttagttgtgttttcctatcagacatgaaaagatggcgacctactatgctataaagaacatcgttactacatgatacctacatgatacagcacatctctcttgcaaaggtaaacaagttgtcttttcgtcatgaacagcaatgggttgttcattcgactgatcggacttcgttgggagcagtttcttgacctgcgacacagttagccagttttgtagctagctggagcagaagttcagaacagttcattttgtttccttttttccccccttcttcttcatttgcgattaagcagagccgttcattcacgagggcccgtgaacaactttgctagtgcgttagttttgtccatactgtgtgctgtgctagggacgctaattggcagctattgaagctgaaatttactactcctaccagtaagaaaccttggatcaactgattattaccaggttgtactgatcttcttttgaaagaaaatggcaggaggttactaaccagtaagaaaacggtaggattaccaggctgtagtgatcgtgtttgttgataggattaccaggttgtagtgatcttttttttttttgtagaaagaaaatggcaggaggttactaaccagtaagaaaatggtatatgattaccaggttgtagtgatcttttttgttgataggattaccaggttgtaatgatcttttttgttgaaagaaaatggtaggagattactaaccagtaagaaaatggtaggtttacctggtttagttttttttttttgaaagaaactggcaggattaccaggtggtagtgatctatcaatatacaaggatttgagggggtgtgaatgcgtgatcatgcaacatggtacaaattgggtataatcagacatgcttttgtaaaagctcagcgagagcgattttaccgatttatcactggacttcatctctttgaacgtacctccagtaatatgtacccataaatatgtaaatgggcgttatcaaatgaaaaagaaaaatactccctccgtcccataatataaaggattttgatggacgccccataatataagtgattttactcaccaaaatcccttatattatgggacatggtgtgtagctgagagaacttgtaggtgagcctctcgacactaagaccctccacgtctcacactagcctggttgagtaggtgataagaatatggccctgtttggtgcagcttgctgcaccagctgcaactacaccaacaataccagtgtgtagaaacaatatagtcaccgtagcagctgcagctgcgcaggtacacaaaagttacaacgaatagaccctacaaaaaaactaagttttctaatttctgacttatacgcattcgttttaaaatatagaaatctagtaccggattaaatatatctttatcctgatattagatttgagacggagatagtagtttattttttaaattttataactacaaattttgagaatatgaactattttggagcagattcttcagctgctagtctcattctcacgagggatttagatttaccactcgaagtctatcatatgtggacctcatgtgagtccaggataacaaatccttaatttcattaattattcccattctgacacgcgcccaaaggagggaagggcaagctcgtcatttcaccctttcttcctccctgccaggctgccaccctgccaccccccgtctatttataggcgcggccatggcctccagtggcatcaaccacttcacacgcgcgcgccgcccgccgggaaggaagccaacgccgacgccgacatgcagcgcctcgcctcctcccggaggctcctccaggcggcgctcgcccctgtccgtgcccagtccagcctctccgccgcggcggccgccgccgcgcccgcgccggagaatgccttcgccgccgccccgaagatgccgccgttcgactacacgccgccgccgtacgacgggccgcgggcggaggagatctcccggaagcgggccgagttcctcagcccctccctcttccacttctacgaccgccctgtacgttacgccacgatcttttcaccgctcccatttctttggaacgatttggggggaaaacactgtagtattacagatcggattcttgattgtttataccttaaattagaaagaaatactgcaattttgtctctataacaagacgcatttttccattttacatccaaatgctgccacaaatgcatcggcgttcggcgatgttcagagatgatcaggctcgtagcttaaacaaatctccttaatttgtttgcaaaggctgttgttttctctgtttttttatgatctcttgctggtggcttattagtgtatcttgttacaagaaaaggcagcccttttggaagtgcaacgtctttttctgtcgctattggataggtttggttggaatgccattttacctgttcttacttcttactctgagcatttcttacttcttaccgtttggagtgggcttaccgccacccgcggtttggcagttatcgcgattatcacaaggtatcccgtggttttaaaaactgaaaagattaccgtatactgtttggtaaacctcacaagatgctctgcagaatctccaagatagtcgtactactaattgtagtatggggaattgtgaatctagtacaaaaatgtagttgtcttttctctttcccataacatagatgttctgttctgcttagtaaaaacgtcagcctctatgttcttgtctgcaaatatgcatagttaagaagaaataatttttttttatcttgtgaatagtagtaggtcagtttgctcaactacgtcttgtgctagtagtctgctagatctcaaacatatgtggctgcgccaataacatatgcatatgtctctctctaaaatagcttcataactgacacctttccattttaaaattgcacatgcattgccaagtactctataaacaatgttaaagattggattcctgaaggaggatatagcaccaaccaaactgtgcacctaacattgtgtcttgctgactcctctcatcactggagatcatgcacattgctaaactcctcgtgaaccatctgaaaaatactttttgacagggacgtttatctggttgataaaattggtaggaagaaaaagaaaacaacaatagctctttgagatcaccttgaattctttagaagagggttattaaaaattttctaaaaagggaaaattctcgttctaaaacatatcaatatgtgataaagatatggtttttggagatttcaagttccaaaaactgaccatttagtatgtaacaaacatttcagttgaacatagtcgatgggaaaatgcagtacctgttcgacgaggatggccgccgttacctggatgcttttggtggcattgcaaccgtttgttgcgggcactgccatccggatgttgttgaggcgatggtcaaccaagcaaagaggatacaacactccacagttctttacctgaatcatgctattgcagattttgccgaggcattggcagccaaaatgcctggtgatctgaaggtagcttgagaaaactggactttctctatccgaatattgctaattgtttagaaatacatgaagattgttttgcctgttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42749 - DNA, 1444 bp, Oryza sativa
tccctgcatcatacccctattccggtatgacttgctgggtacagtgggtagtactcagtcttgctctatttttccccaaaccctagagtatgagtatgcgtcagatggtggtttctccgaggagtaggcttcgtcctgccgtcgaggatgcctgtggggtggtgttcccgctgcagatctagtcaaggcttagccccttttatcttttgtttttccgctgcatttatgtaagacttttataatgtttgtaagacgtggatctgtatgtcaactttgtcgcttgtgtaccccacccagtcctggacggggattttaatgcacattctgcttggaattctattcgggaatttctgggcgtgacacgcatgggagaggtgtgtgcaaagctagggccacctatcggcacggaaaagaagcgtcgtatgggcgtgggatcggatggtgactttgcctgtccaagtagacatttaccaccttttagttgtagtgaccttttagttgcagtgacagagattttgactgttgcgcctcgtgagccatgtgggccacacccatcacccacccgcacgcactcgatcgattaaccacccaaacaacgccaatgcaagcagctcgttcccaagttgccacaacacaccatgcatcttcgagttcgactcgcgggcgcacttgtggagattatgggtaccccatacccacacggcacggttatccgactagttataggggataacttatatatatgaaatatgtaacagatcatgacttgggtattacgtttccttgtatattacggaacggcctaaagtcctggtttgataagattgtaaagtagatttaggaaaccgataccgtattggataaggtttctatcttgtaatcatgtcccccatcctatataaggtgggcaggaggccctctagggggcatgagacaattagatcgtcagatctatactacactcggcggattcaaatccccaaacaggagtagggtattacctctcattgagagggcctgaacctgtctaaatccttgtctctgcatccatatacttttaggtttcgtgcgctaccccgttttattattgccgaattcatgttttgacagctggcgcgccaggcaggggatgcgtcgagtttcccgtcgacgagtgcgatggaatcaattcaagcattgagattaatctcaacgagttcgacgactccaaatgttaatcggtttgtcgtttcaatatattgttatcagattgatctataatcacaattgattttctgttgtttttcctctctggttacatgtgccgccgcgctgtgaattcttctgatcactgcgggttgaaaaaaacataagccatggggaaaacggccggagttacgcggggtcatcagatcggttctgtccatgcaagcacgggatcaatcaactgaattaatatgaatgg

SEQ ID NO: 42750 - DNA, 720 bp, Oryza sativa
ccgactggtgtttccgcctgcacggctggcctattatgccgccgttgctgggcgtctacgtcttcaccgaccggccgcctcatccgccgccgactggtatctccgcctgcacggctggcctattatgccaccgttgttgggcgtctacgtcttcaccgaccggccgcttcgtctgcagccgactggagtttccgcttgcacggccggcctattatgccgctgttgttgggcatcatcgacttcaccgaccggccgcctcgtccatcgccgactggtgttttcgcctatacggttggttggtcacaccaccgttgttgggcatctacgtcttcatcgaccggccgcctcgtccgccgccgactgatgtttccgcctgcacggctgacttattatgccgccgttgttgggcgtctacgtcttcaccgacaggccgcctcgtccgccgccgactggtgtttccgcctgcactgttggcttattatgcctccgttgttgggcgtctacgtcttcaccgacaggccgcctcgtccgccgccgactggtgtttccgcctgcacggctggcctattatgccgtcgttgttgggcatctacgtcttcactgaccggtcgcttcatatgacgccaactgatgctatcttcttcacggctggctacgtcgtcgtcaccgctaataggcaccgtcatcttcaacgcaagctgtctacgcctggggctgcag

SEQ ID NO: 42751 - DNA, 1500 bp, Oryza sativa
agtgggcggacttcaaaatgcgcacccaaaatccctttaaataggcgcacccccgacggtgcgaattccaaggaactgagagaaatccccgccggaaatttctaggtccattacgcgcggcagtttttgacttaagttcaaaattcactcgtgaccgttgggcttcaaacggcatgttcgactacacgtcatctccgtggttctcgtacctggaatgataacgttctcgacacccgaagtcgcgaatggtcgcacgagttcattttgagcagaagtcgggagctactgtcagggttacgggtcaggcataccctctacccttcgatatacgttacgtatcgacatggcatacccacgcgtatgcggatatttcctttatgatctaaggaaacctttcacgaaatcaatagacgggaagagtccttctcggataagaactgggttacctacgtattgagctgggtctgggtctggtgtgttcgagtcctactcggagaccaccagacctgcgatataaaagggacccctggggagggcatagaggatcgaatctcagagccaacacaacccacacagcctacgaagccggagcctgcgaggggccacgtcgtcaagagctagtcgaatcaactcgactacaatctcgccggattcgacaagttccatctttcctttgtaacctgtgttttccaccatataatcccatatcaactggattagggctattacctgtcaaggggcctgaaccagtataattcttgtcttttgattacttgatgtcgtactacgtagatccttgtaccagcgtaccccaataccctctatatccagtctacgtacagtggcgcgccaggtaggggcacttggtactcaaggttctactactatgccatcaagcttcgtcgacaacaacgtcaacaccagctccagtcaagcactctcagcttcaataatgctggtatggactcaagtcggcgaaatcgtcttcccggtttacaccacgatgccgatctcaaccggtcctccaatgactggaaacgagaacgcagtggctatgaaccaggacggctccatgtcgaaaaatccacccgttgaaacagagaacggattatcgactacatccaaactcgtgaaggattctgatgcggccaagtcttgtccctccgacataaaccacgggccaacaaagatgacttccgaagttatctggtctttgtgtcctatccacaaaaccaagaaacatacccttcaagattgctaggtattcatcaatgtccgtgctgaaattcgcgcctgcaaagaacgcggaattcagcgtacttctctaactcgggatgtctattgtcctatccacaagacaaagaatcacgacctctcgagctgcaaagttctcctcggcgccgtgaaaactccgtctcctaagtcatacgtccccgttagggataacggcaaggaacaaggagcgactccagcctcagatcgattcgttggggtaatcga

SEQ ID NO: 42752 - DNA, 1739 bp, Oryza sativa
ttcgatacagcttataacgccatcatcgggagaactgcacttgtgaagttcatggccacatcccactacgcatatcaagtgctcaagatgctgggaccgaagggaacaatcactatttaggggaacgcaaagctggcggtgcagtgcgacaagcggagcctcgacatggtcgagcaaacgcccaccccacccgccacgtctgagccacctaagaaagtgagcaagccaaataagacgccaaagccagacggcaccatcaagatcgttccgctctctagtgctaaccccgacaagactatcaaaatcgggactacactagatgagaaataggaactcgcgttcatcacattcctccgcgataatgccgacgtgttcgcttggcagccgtgcgacatgccgggggtccccagggaggtgattgagcacaaacttatggtgcgacccgatgccaagctagtaaagcaaagactgcggagatttgcaccagaccgaaaacaagccatacaagaagagctcgacaaacttttgaaagctggcttcattagagaagtacttcacccagagtggctagccaacccagttatggtgcggaaggccaacggaaaatggagaatgtgtgtcgacttcacagacctcaacaaggcatgccccaaggatcactttcctctccctcgaatagatcagttggtggattcaacagccggttgcgagcttctaagcttcctcgacgcttactctggctaccaccaaatcagcatggcaaaagagaacgaagagaagacagtgttcatcacgccgttcggggtattttgctacgttaagatgcctttcggactgataaccaccgggaatactttccagcgtacggtccagggcgcacttagcaaccagcttggcaacaatgtcgaggcttacgtcgacgacatcgttgtcaaaaccaagacaagtgactcattgattgacgacctgcgggaaacgttcgacaacctcggacgatatcgcctcatgctcaatctagagaagtgcacgttcgaagtaccgtcgggcaagctactcggattccttgtttctggcagaggaatataggcgaatcccgagaagatcaaagcaatcgagaacatgaagccgcccacatgactcaaggaggtgcagaagctaaccggatgcatcgcagcattaagcagattcgtcgctaggatgggagaacgaggacagcctttcttcgccttattgaagaaacaagacaaatttgtatggacacaggaagccgaagaggcatttattgcactcaagcgctacctatcaaacccccctgtactcgttgctccccaacctaatgaagaattattcctttatattaccgccacgccatattccgttagcaccgtcattgttgtcgagacagagaaaatacagcgaccagtttattacgtcagcgaagctctccatgacgcaaagacaagatatccacatattcaaaaactgctctacgcagtcatcatgacatcaaggaagctacgccactactttcaagcccacagagtcacagttgtctcctccttcccccttggcgaagttgtgagaaacaaagacgttgtcggccgcatcgcgaaatgggtagtcgagctaagccaatttgatatccactttgtgccgcgaacagccatcaaatctcagatactcgccgacttcgtggccgattggaccatgccagataataagtcagacaaccaaggtga

SEQ ID NO: 42753 - DNA, 1818 bp, Oryza sativa
tcaaattcatcagcagcgaggagttgcccgaggacgatacagaggccgagaaaatgacccgtaaagcaaagatctactgtatgggcggcaacgatttatacaaaaaagcgccaaacgggatacttctcaaatgcgtctccaccgacgacggcagacaactcctcctcgacatacatgaaggcatatgcgggtcacacgccgccggtcggacattggtcggcaaagcctttcgacaagggtttttctggccaaccgaccttaaagatgcatgcgacatagtccagcgatgtgaagcctgtcaattccacagcaagcacacaaagctacctgcacaagcactccagacaatccctctgacttggccgttctcgtgctgggggctagacatacttgggccattcccacgaggacagggcggctacagattcctatttgtagcaatcgacaaattcaccaaatggatcgaagcagtacccactggggaaatcaaggccgataacgccatcaagttcatcagaggtatattatgcagatacggactaccgcaccgcatcataactaacaacggccctcaattcatcagcgccgatttccaggattactgcatcggcttgggagtcaaaatatgtttcgcctcggtctctcaccctcaaagcaatggacaagtcgaaagggcaaacggcatagtactacaagggataaaaacccgcgtctacgacagactcatgtcacacgacaaaaaatgggttgaagaactcccatcagtactatgggccatgcacaccacactgacaacatccaataaggaaacacccttcttcctcgtgtacggctctgaagccatgttccccggcgagttacgacatcaaagtacacgagtacagaagcattccgacgagaaccaggagaaacagcgagacatcgatgtaaaccttctcgaggagcatcgtgagcgagttgccgttcgagcagctagctatcaacaagccctccgccgttatcacgagaagcgcatccgagcatgcatactttcgatcggcgactatgtcctcagacgagttcaaacccaagcagggcaaaacaaactctcaccaaaatgggaaggaccctacacgatcacacaagtcttgcggccaggcgcattcaaaatcgcagacggcgacgatcgcgaactagcaaattcgtggaacattgaccaactacgtaaattctatgtatgagtcaataccactgtacctgtaagcacccttacagtatcaataaagcctatttctaagtcacatgtcacgaccaaagtgttttcacccaatgatcccttactctgacgacacctagcgttgaaacctgtccttatgtccctttacgccgtcttgacaaggcctccgaggaacctaagggatcttcgactggggacgcctagagccgataaggccttgtcagatcctttagagacgaaagaccatgtaagatctggtcgtgtaagagttctcgccgtgcgtattaaccaagtcgtgtaatcggaaaccgagctttccaacttcacggctgggtgctaggatcagagcttattcaaccaagacaggtcaagggtccaagagccttgtcctccgagaaaattcctccgacgacaaagctgggggctagggagagtgtacgactcaaacggctaactaaagtcattaactgagaacacactcatacacacgacatccagagtaagaaacatttgttaaagatagatttctttattcacaaaatatttcttacagtttgtacataaatatttcgctgcattacatcttcccctaagatatctgg

SEQ ID NO: 42754 - DNA, 1396 bp, Oryza sativa
aaggtgccccattttgagttggagctcctctcaggtgaggacggcttctggcagaccacgacccccagcgggatcgctgacggggccgtttggcgtcgcctcccgactcccgaccacgggcacgacatctgttgacgccgtgacaggggacgcgctagacgttcccccggacttggcccgagcaacgttcgcccgcgcctccctataaaccgccatgaatcaaaattccactcaaacagaagacacgagaatctaaaagtttctttacttacttctcgccgatcgtcacaatgcgcttacgtcgcgcaggcggaggagacacgtcggaagcctacaaaacaaccaacatagagtgagaacaaaccttccttgctacataacctgacgacaaggtgaaaattactgagggagtcgccgccttgcggcggtgtccgagcacagacgagaatttcctcgccttagtcggagctttgccaccactagtggtggcagcgtcagacgccaccttgacgaccttctctttcagagatgccgccacctgatgatccgcgagcggaccgacgacatcagtcaaaggaagggcctacactaaatcatgtcataagctgattttgagcaaagaaggcggacgcttatcgaatgaactcacattgattgcttcgtcgtgctccgtcactcccctttcacaaaagggtgcggggatgtcgctcgccgtagtcgggccgctgatcatcacctgaccaacacgccgctccacggcttcgctgctcagacctgtcaagaaggaatcaatttttgataagtcgaaaaggaacgcgagtacaagcatatcaaaatgaatgcgagaaagataccccgaggagaaacccgggtcgcgtcatctggcccggaatagttataggccgggtgggcccgagcctggagcggctggattcgcctatcgacgaagtctgcaacgacttcatatcccgataagccccgttctcggagatcatcgatgatgtcgataaacgattggagagagggggtcaaggggggcttggcggtccagaccagaatcttgttgttcctcgggaacaacgaggatcggatttgaatccttgatttcaaggtaaaaccacctgttccgccatttactacgagaagagggacactggaaggggacatagcgcgacttcatcccgtcacgaagtcggaacccgacgcaaccagacaccctattgggttccatccagcgcaactcgtaataaaagcggaacagatcaagaaagggctctaccccaatgtaggcctcgcaaagatgcacaaagacactaaggaaagcaatggaattggggttcaagtgcataagagaaagcccatagaaattcaaaaccagcagaaggaattcggaggg

SEQ ID NO: 42755 - DNA, 1088 bp, Oryza sativa
  unsure (1)..(1088): unsure at all n locations
cgtgactctaacatagttatttatatacttatcgctcacatgatttcaaacaaactcctaccatttgtttctcatgtacttcctccgttccataatataaggcacaactacttttttttatgttccataatataaggcatgcatgcatgcatacaattaattaggacctcttctccattaaattattgcttttttaagtcctccaccctcaagatctctaattctattggatgcatgcattatatttattagggtgatccaaactatgagatgataataattatttcttgatctttgggttaagggtggttgtgccttatattttggaacggatggagtataaagcattacttgagtctgttcaggtttgggttataaggcataagtattctatgaaacctcacacattttaggctgaaaatgcacgtgtggccatggattatgaactagaatgctattatttttcatgttttacattgttgagcatcttaatttagtatcatatatattcaccagttgattattttagcatactttttggaacagttgtttttgttttttcccatgtgatcatgccagtcatatgttaatctatggaaacctggccattgtgcatccatatgtgctcatatcactcagttgattcattgtgcaattcaagttggttgacatatttcctgcccattgacttatttatatcagctggcaagacatgacaatgatgctcgatcaaaagcgctggaagaagattcttgagaagaagcaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42756 - DNA, 703 bp, Oryza sativa
cgaccactaagacaagctggaaatccccaaaacaacacaaaggtagaactcgaaggtagaatggctactcacttgaggcagttgtagtcacttcgacctccgcatcaagagtttggtcctcgacgtcatgtgggacgtgtggttcaaactcgaataccggaattatcgccagtgactcgggctgcccgcgctgctggacatcctcgtcatcagcatctctacagtcgacaagaaaaaacttccgagatcaacggtgaacaaggatgataatcacacgcacgaaggcaaccagagttcaagatttacaagtcacaaaaaatacaagaagtcctactcttcaaaaagggggaggacagactcccccaggtcatcgacttcttccatcaccttcttacgcgtgtcgcttgccgccccctgatccaagatctcgcgcatatcgagttcaggacgcgacaacctcacacacgcgaggacatgacacgccccggtatagatgccgttggacgtctcctccgcgatcctggccgtatgcttggaggggatttccccatcgccgtcgccagctccgcaagagaagaggtcaacgagaactcgtcggggttcgccgggatcgtggacttgatgccgcactcctcggcaagctggtggagaccggtgtaggtgacccgcagcgacccccggatctcggagaggtcatccccca

SEQ ID NO: 42757 - DNA, 2902 bp, Oryza sativa
gtgatgagttgttcctctcaaaccgctcctctcttctttgaagacataatttccatttgctgaaatatatacaaatattgccatcacagcaatatgaaaatatgcgtaaaactaaatccttgattatttaaggtagcttgtttcatacaagcatatgataaaaaggaaacatcgttttctaaaaaaataaaaaataaatttcatgatatataatctacacagcagaagcaactggaactaaacgacagactaacctcaaaaaatgtatttccgccgcttcttattacttggacaagataaccctcttcattgccttcttcattcaatcttacagaaccaacaacaatactgtcatcgcgcacccacccaatcgaatccactgataaaaagaaaacattaataacaaatcaaaatgatcacctacttaacacagtccaatgcatttgactgtgtgcctgcaatgatggcaatagaataataaaaaaatgaataagatgaccttgaggaaaagagcataaacttcatagagcatggaacaaatcttgaaacccatgttcaccccattagtcatttttattctataagtggcgatcatatttgtgggttgtgtttttctcacatatttttggaaaataagaaacgggtatgtttagcatgtctgtgtactgtgacgctaagagtaacaaaccatgtgctgctcatgaagtttaggcctgagtaacaagcttacttgtttcatttaccacagaatagaaaacaattttacgagttttacgcactaggacgtagtgagccaatcaatatgtcctagtgtgtaatagtgctaatagtgctaccaaattaagcctggtgatgattgtatctgttctaatagtgctaccataaaccatttcgtttaaaaatgtgtgaataataataactgcgaagaacttggagcaattcaataattcatcctgtaactggggaatggagatacaggccacaaaagaaaaactgaatggtgcttacctttgatgctagcatcatctgaatcactatcatcagaccatagctggaacaagaggggcatgcaacatatttccttaaaatctgatgataatatgttaagtgtattcttttttgaaagaacaatgtgagtcccttccttgcagcagtcaactgtatacatttcaaaacgatgggagaattcagttcagaaactagtatggtggtgatggttaacttcaattacaacaatgaatcattgatcaagaaatatgctatgctagcacataatggccaaggagtgtgctaatgactaaaggcaggaatgcgccaaagataagtactcaatatggcatcatcctttttatacagcccacaacaaaaatcaatctagtttgtctagctgtcttctgtaaagactaagcattatagaaaaaagatgactcatagaaacaaagatctgtcgaatgaacttgcaatacccacagagagatatatgttgcaaatgaacgatgttcttgtaattttcattcacaataatataggctatagcatcaataaattaatggttcttaccatctatgatccaaatatataccatttacaaaccaatgcatgtttaacaactgtacagatgcatttctaaaacaaaactacaaaaaggatcctagaacatgatctcctatccaaaacagtaacacgacgaaataaggttttcaagtattgaacttcacaacagccaataacaaataaaatttactttataaggtgtgaatattgaatatttgaaatatattggtgtatgctatatctcacatctgcttcaagaaagtttcactggaatttgtaacagttagtcattgcataacattgtgcctcaaatttattaggaatagaagaagccacaaaccagcatcaacattttccattatgtccttcagaccttcccccagacttccttgagacagcaacccgtctttcgagagtacaataaaggctttggaagcatgatttagccacttgaaatctttcacagtgctggatccttccaaggtacatgatgacagtggttccacatcctatgtagcataattgtgaatagcatgagtagaagatacatgagcaaaattactagatgtataagagatccacgaggtcaaagtgcaaatagacatgggatactgaaaacattcactgactataggtcattatcgcataaacatttctgtcagatattgttatgtaaaatgcagctcagtaggatatatattaaaaaaaacaattctccggttctaataagttgtgctggccctgtggttgaaatttatcatcgacatgagggaaggagatgagataaccttgtctgtgagcagggaagaagccgagaagaagtggatcacactgcctgcgcaggcagcaagcaccgattcatcacgggagagttcgaggagagagaccccggggagagggatgtccgcgacgcagcagtcccgtgcgcagcgggtggtcgacttgcccttctcgcgcgcctccttgctggcctcgatcaacgccttggtcgtcgcagccataaaccctggaaacacgaggggaaacccgaagcggtgagatcgagatgggaatgccctggtccgtcgcgacttctccgtggcttaccgttggggtgggcaaggaagaccgcggcccggcggttggagacggcgagcgggcgcgagggaggcgactggaggtcgaagagcgggagcggcgaggaggtggtagggaggagggggatggggtcgccggcgaggcggaagacgaagtcggtggtgccgtcctcctcgccctcgacctcgtcggagaggtccagctcccgcggcggcgccatggccccccaccggtggtcggaggagcctatggttttgggcgggaagcggga

SEQ ID NO: 42758 - DNA, 36120 bp, Oryza sativa
aggcgagaaaattccggcgatgtcgcgacggtgacacggcgaccgaacacaaagatatcgccggcaaactcacgcaagcaccgcgcgaccgacgaacggcaggcggaaccgcgcgaacagtcgctgcttccttttcgtctccacctagcgacgtggagcaacgccatacacacgctcccatccgcacgcgcatttccagccttactactctctcgcaccatcgtcttccatccgcccatctacctccctcctccgtccaccctaactacggcgggtcgccggccatgctcgcgttcgcggtcatcgtctcgccttccgcgtggccgagagccgtctcctcagctttcgcggcggccgtcttcgcgttcctggacgtcgtcgacgtgctcctctgcttcgtgtacggcttcctcgacgccgtcttcgaggacagcccggtcagctgctactgccacgggagccacagcgcggcggcgctggacgacgacgacgaggtctccgacacattgtaccaccggcggagcgctctccgagacgcgctgatggggctcgtcagaggcaggagcggcggctcgccggagacggagacggagcggcgcaaggggcggagcccgaggtggtcggactgcggctgcgattcgtgccgcgcatggcagcgccacgacgacggccggctgcacttcgtcgccaaccaaccgccgccgccgccaaacggtctcaaccgcttccgttatttctgttacaatcctttcgctttgccgtgtcggcgacattaacgttcgcgagcttagcttttgcagatggagcagtgacaacgacgcagcagagtggagaagaagacgccatcttcatccacggcttcacctcgtcatcgtcgttctgggcaacagtgttccgcgaatcatccatcctcaacaactgcagaatgttggcggtcgatctcctcggcttcggcaagtctcccaagccggcaaactgcatgtacagactgaaagatcacgtcgagatgatcgagcggagcctcatcgatccactcaacctgagctccttccatcttgtcagccactccatgggctgcatcatcgccctcgcattggctgccaagcacccagaacgagtcagatcaatcacactgattgcaccggtaagtacagtacatatatatctgaagaagaatcagtgagagctctgaatttaattaaggaaatatcgatccgttgctttggttgtagccgtacttcggagcatgcgaagagaaggcgagccaagtggcactgaagagactggcggagaagaagctgtggccgccattgcagttcggatccgcagtgatgtcatggtacgagcacattgggaggactgtctgcttcttggtctgcaaaaatcacctgctctgggagcgcctcttcaggctcatcacaggaaagaggtaatcacatactaggattaattcagagttcagaaaacaaagctccttttaactaagattgattttaaacaaaaaaaaatgttgttgcatgctgcagggatgtggactttctgctgggtgatctgacgaagcacacgcaccactcggcgtggcacacgatgcacaacgtcatctgcggtggggccatgctgcaggacaggaacctggaggccgtcgaggcggccggcgtcccggtgcaggtgatccacggcggcgacgatcaggtggttccggcggagtgcggccgccacctcaaggccaagcttcccggcgccgagctccgactcatggaaggctgcgaccacaagacggtggttttcggcagggagaggggatttgctgaggagctcagagcattctggtccgcgtctcatcagaataagcagctagcagcatctgcatcagggtgggcaggttaacggatgttgattgttggtgtgtagaataatgtctgatatgaaatcatgatgtagcatagagaaattcagtccacactttgaaattactggtactacaatttttagagattaaagactagggtgaatccatcgacacgtttctttcgtcagaacagtgtccgtatattggaaaatccttttctagctcgtggattggcagattaatctttgaatttgcaaaggggacttgactgtttcagatataagcactcactcttgttttcatattataaatcataatataagtcggttttattttttttctattcaaattttatttaagtttaaccaagtttatagaaacaataccaaatgatttaatatttttttgatagtatatttgttttgtgttaaaaagaagttactatatctttctacaaatttagacaaacctaataaaaattgactagaaaaaaaagtaaaacaaattataatatgaaactgagggagttgatactatcgacgacatgaagtttggcctgacaaatgttcatacccccatgtggctgttaactgggagatatagattcctttcccgattgatcaaagcgcacagaaattaagtcgtgcatatagttcagctacatttattctccgatcgctttcatagcttttccttttctcatcgatcgagctgattgctgcttcgcgtacgcgcctagaaatacagcacgccccgtcgacccggggggttgcagatcgatcggaagctcaaacgcacgctagctactgcaggcacaccaagctgacgaacgacaacatgagcaccaccggaagggctctcctcgtcgctctcgccgccgttcttctcgtcaccggcgacgcactcctcgctcccgccggtggccaggagcagtacaccaaggcgccggcggaagcgcacaaaggctacagcatcgtgcctggtgagcatgcaattgaatccatcctagctatactcaaactcccaatgttatcaacttatcatgtgatgatgatcgtcatcgtatatcgtatatactgggccacgagaaatattgcataatgggcccttacagatcgcattacgggggcaggatgtcaaggcccatgaccacgagaaatttagcatactgggccgttgcagacctagctggtagcccatgccaagaaatcagtcctcgttagttttgtaccacatcgcctaccagagaggatagggagagcacccagggtataagaagaggggttcagcttcgtaccaactcatacctttctcggccttttggctaagatcaagtgtagtatctgttcttatcagtttaatatctgatatgtgggccatgtgcccacttcgatattaaatttattttttatgggggagggtccaccatagtggcttgccactggggccctcgcgtgtcgcccaggcgttgcactgcagcctgggcctggcgcaccccaaccaagtctcaacttaaatttttaattttgtttacaaaatctaatctaagttttaaatttatttttaccaaagctcaatcgaagttttaaatatttttacttcattatttcttcatgctcattcaggcttggtttcagcccaggaatgcaactattttgaatcgacccaaattccttcaattcgtaaattcctgcatcaatatgatcccttaggaattcgatttgtatttctcatcactgtacatatgatggctgtatgaataatctgacagcctgaatatgaactaggttcagtgatactagagatcgcttggatgagttgggtggccgacaagtgttatcctccaacctgtcgccgttactgttcagagaggataataacaaacgagtactattgtagcatagtcacccagattcctagcgtttatacgtactacagaacgtataatatccggcctgttgcttccctcaacagagaacatgaaaggcacatgatagttcagcgttgctgataaaaagagcacgaagattgaaggacacgacgtaacataggcaagcacaactggttcaatacttacttcagattgttagatttgcctttccatgccatgatgtagtactaggccatcacttcctttaaaaagttcagaacttaacctctgctaaagagaagaaagggaagacagataagttcagcaatcagcattcctgttgctagatactagtagagtacaaaactgcatgcatacaatttcatgattaccatatctaagtctggtaactgttcaagacttgaagtgtttatcattccttttgctaccaacaaagagaatttgaggccgtcttgcgatatgtacgattggtacgtactcggtactctctctgaatgttgagcaagcaatgagcacacacacacacgatgacacgagacatctgaaaattggcacttcgagacttgtacagtagcagtaacagtagtagtaccaatccgatgttgagatggattgggtgcaaacgcatgcaggaaccaaatgaggccccaacacctgtatcatatccacgatctccatctccatccatgttccccagtactgcaaatattgcgccagccactgtatgatatacatgcagggggatctatctatatccacagtgttgagagcacccaccaatcgcaggcacgagacgtgtaatcctgtcgagccaagggaccacccacgagcggcagatcagagaatttcactattgcagcggctccatctccatactgcagtcgatcgatcgatcgccgactcgccgtcgccgtcgatgttgctgtcagccgccgaccggcaggcagccgctctcgatccctctctgagaaagtcgagtctgaatttcttcgctggccacacttggcgcgcagctgcgtgcgtcgtactcgctcactgtcctctcctctcctcgcgttgatgccgtgtcctacatactgctagctatcaaaagcagcctcctccattatttttgtgtagctgaaggtggagagaacgttccttcttgaggccttttgttttgttttggccacgagttttccatgcgtttgtcaacttgtcctcccctatttattcctgcagaattcgacgtgtgaggtttttggtcgggagttactactagccaccagtatttcttcactctgaaaatagtaggagtattttttttctagtatatcttcttcttcagattcagcaaaacggctaaggaattcctttcggttggtttcttcaattgactatactttttagttatgaggttactgtcagtttctttgagtctcatctgaagactggaagggtttcagataaaataaacagccatccccatatgttttaaaacagctgtatattagttctactttaatgagtgattattccgcttttgttcttcctcctaccgatttcataattaaacattgaccaaaagtagaggattattggtgaaccataccatgggaatgttaaattatctctagtcacactagccatttttttaatcctgtaaacggctgaaggcatatgttaatcacaaaccaaatcgtgtacataaaaaaattgcaaggacctattttttaagagtcagattaggtagatctcaagaatgatttggagccgacagggcccagatttggtggcatcagcatggtagcttatactcctaaatccatagctcacaactggctcgaatgttcatcggagaggcatcttaattcattcagttataagtgttccctcccctgtttcaaccatagcatctgattaaaaatcttcagacatttttaagcccatttcgagacaattaagccactaaaatcagttatgctacatttccaaaaaaaaaaaagaacctcagttaccttgagccgagtgcaccatgtgctgtattgccgtgtccgtcaggtaaacagtccttatcatgactcaacagttcatagctcctacatgaccatgatatgctcatcgaggattacgagcatgtgagtgaggggtcaccgaatgaatcaaagaaaaagggacaagatgatggatcgatggatgtatcgccaccagcaccggcaccaagctgcagcagatcgagtaaagcacaagattgttttttttttttaattttaacgcaaggaaagactgttgaaagagcctttgtgctcatgaaagggcaacatcacttttctagataagggaaagacaccttttattataaaaaaatattgcaaaaaaatgtttttttatttttaaaaaaggatctttgagctgctggacgagcaaatttgaccttgttcatggagagaaaccgtgcgtatgcatgtcttggcttaatttgcatttcgtgtccatatcgatcgatcagaagatcacgagaagtagctcacgtagtacatctagatcgtcctatcgagtacacgagcagcaccacgacaaagaaaaaaaaaatcaaacatggaaatttccataaagaggtttgatggcgtgaaccgttttgcagagccaactgtgttttgcaagcttgcatagcatggatctacactgaaaaattattaaccaataattcttacaagcacactgaaaattaatcaggcttatgagctcctctaatcccctacagctacaagctactgatcgaatcgaactaggggtggtgattcttttggttcccattcgattcgaattcgtttcagtagaaccagttggatccggcgtacttcgccggcggttgctgcatggcgccgccgtagtccacggcgccccctcctgtcacgttgaaatttgaactgaacctgaactccggcgccgccgccgccgtggcggcgacgtcgcctccgaacggcgcgtcgtcgcggatgaagaaattagcctgctgctgctgatggtggtggtggtgcatctgcgtggcggcggcgacgtcgttgtcgtacatggtcatcagcccggcgaggcatctctggccgtcgacggggaggtcgaagtcgaagctgccgagtggctcgaagatgtgcggcggcggcggcttgctctcggcggcggcggcggcggcgttgtgcttgcaggcgtactgatgggcgttgcgttcgttgcggtcgaggaagccgagcgcgtagttgctgtgcgggcactgcacgttgccgcaggtgtagacgcgggcatggctgtcgctgctcagcatcagctccggctcgctcctcttctggatgaagtcgacgtcgatggcctcttccttcatcagcggcatgatcaggaacttgttgttgctcagagcagcatccatggtggtggtgaggtccatgaacgcggtcgcgtcgttctgcgccttctgcaggttgttgttcccggcctcgtcgccgtcgactccttcgacgtcgtactcgccggagacgctggcgttgaaggacgcggcggagagcggcggggggagggcgccgggatggagcttgagatagaggtcctcctcctgcttgaggacggcgagccaggtgacgatctccttggcggtcatcttgtcctggaggcacttggactgacgcacgaggcggcggaccttgtcgacgtcgggggacatgtgcttgatgacggcggtgagcacggcgaccttccacgccttcttgaggtcgtgcggcttcttgtacggcggcgggccgagctccttgggcacgccggcctcgggccaccacgcctcgctcccctccggccaccacggcggcggcacgcccttctccagcgggaagcggcgctgcggcgggtcgcagtgctgcatgagcgccgagagcagcgatcccagcgtggtgtcctgcagctcgtgcagggagtgcggccccgccggcgcggcgccgccggcgtcgccgtcgcaccccggcacggcgttgtcggcctggtacttggcgatggcggccgggccattgcggtcgaagcggaccttctccttccaccatgagcggaggttgtcggaggcgccgctcaccggcttccccttctccgggatgatgccgtacacgaacccctgcgcgttgcacacctccatcatcttgagcatgtacttgaggatcccgtcctgcgcccgcgacatcttcttccgccgcgcctgctcctgcgactgccgctgctgcctgcctccgccgccggcgtcgcccgcccggctctccctcccggcgcggctctgctgaagctccttgagccgcttgtgccggacgcggtcgcgccacatgcggcgctccagctcctcgatgtcgtccacgtcgtcgtcgtcgtcgtcgtcgtcgtcgccgtcgctctcgtcctcggcggcgaatccgccctcgtgcacctgctgctgctgcggcggcggcggcgccgggttgaccaggtcgccctcgccgacgaagcactcgcctccgaagaatccaaaggcggccttgctatcaacgtcggcctccgccgcgaacgccatgcgccgatccaccatggtcaccgctgctcccatcatctcctcgatcgtagcacagactgacttaatagcagcagcagagcagtagctatctatagatccacctgcacgtaagccgacctcgaattagttttttttccccatagtaattactttgctgatcaatgatcataagcttttggtaactcaaatgatgatttcattaacaaagagaaatggtttagcagaagtgaaaacaagctagaacatgcgcccatgtgccaaatgatgaacaaaggatcatcaaaggccatcatcaagtaagaagacaaaaataaaataataatcgggccgtatacagacacgcatcaaaatcagggaactcaaaatggaatctttattgaatgaatcctaggagcatggaacacacacatacctctctctgactctctctatgcccttatctgatctccttctgattactctaccactctttccataagcttggcactcagctagtagaaagagaagaagagagagtgcctttgtgtgtgtggactggagaagaagaaggacgacaacaacaataaggagaagttaaaaaggataagaagagaggagaggagaggagacgatgctgccagccacgagtccactgtaggaggaggaggaagaaaggaggaaagaagcaagtaggggcgggcgacgacgaaccgagcgagaggtgctgggaaacaacagcgacaactaccatttataatgccctcttgactaacgcctttgcccaaattcaatccaggaaaatgcagtactacggtttttaataccacgtgttgagtggtatctctcctcgtgcgccgatgaacaattgtactaccaaaccaaggcggcttctttcgctcaaaaacaaacaatttgccttgcaatacacaatactgctgcgtacactccgtcagtgaccaagcaaatttaccagcatgatgcttgtaaaacatggttcaagctctgaaaaacagtttttttaattaaaaaaaagctccgaaaaacaattgcggagttctgaacttttttgttgcaaaagggaacacactgttcatcggctttaggggtggttcctagttcctgctggaaattaaaagcacaataattagacaaggtaccttcatttgctacgtggcgaactctgtgctaatggccaaaaggaccaacacaatcagggccctaccataccacccacaccacatgtagtagcagcagcagtttacaagaggcctgcaaattctgttggggagaggtagctaggtctcctccgtctccatggagatggagaccacatatttactcattagccttatcgcacagctattgttttggttggttcctctaactctgagattaatttcaggatttcaggccccatgtaaaggctggctggaccatcatgcccatcttcttcttcacttgtgtcattctccctaccatttctccatgtttatctgtaggtgtcggcaggtttggccagcttgctctctctaacttcatctgcaaattaaaacccagcaccttgatagcgatccacgcgtttactaaaggatcgttgaaagacacctctttcatctgcgctgctcttaattcatgctgttgtatattcattctgaaaaatgttgtgttgctgtgctgtagtcagtaacagactaacagtaacacgcctcatgcacattcaattttggagaggtcaagttgtaacataaagaatgaattctcaggatcagatttcagaagacagtgaatgagagagagagattttgcaccatgtttatgcctgatgctttgattgacaacaaaagcaagtcaactgtattagcaacttgcaagcgtggagagtagtactagtatatcgaatgctgctgggtcgaccatgtttccggtagcagtggcaatgattggcccaagtattctagagagttttattcagttatcgacatctcctccccaatcctttgatctgatacaccacgttgtacgcaatgtttgccaacttatttaatccagtttgatagttctatttcaggtcgttatcgctgttagtttattttgcttctttcttcaagtctccaataggagggatcactacatttgcaaatgccgactgaattttttgaaagatcgccgactgaatttattaacttttttttttctgaaggtcagtaaacttggtgtgacaatttcttgccaaatttcggcacaaaaacaagatgattcatactagtactaagaaaacaagatgacttgctttaactttgtgaagcacatgccatctctccaaaacccaaagtgaacaggttctctgaacaacgaacaggtagcagaatagctcgcggtgttgcatgtgtaggatgtcgcacgcagcagcaaagttttacaagagttgcagataattgacgatgacaaggatgtgctccctcctcatcaggcaaggatctccttggatcatctcgaatctagatagatactcaggaagatctcaggagcaaatctcgtcgtcaatggtgttcagttcactgaacagggctgtagaaacctgcaatgatctgaacattggagttccaagtcattgcttggacttgtgtgcaatcatttgtccatgttcagatcactttgggcgatggtctttctgaatgacttcagaaatctaactctatatcacttatatagcatgaaacatatgcgtagtttgcttagaattttttttgtcaaagtttatgaacttttgaatcttgagttcgttgtgtcttatatcactttcataaattctgaaatttaaaatgcctaaaaaatttttgagcacatctctgttactcaaagcacttgaaaatgttatactgccacatcatctatatatccaaatcagtttcagcttaagcaagcattggcaactgtgaaaattctcattttattcctccatattctgaacatgtttgacttcgaatttcagtaggatgccggaaacccatatttcgcacgctcttgattttttgggggattttttcgtggtgatttagtgggtaaaaatggggaaaggttggtcagggaagagaactccgaccccctaatgagtccgaataaagctgaccgagtgaccggttacctccttccgttgaagaattttgagcacatctctgttacttgaaaaatgctacactaccgcacagtctatatccaaatcagctgcagcttcagaaaactccgaaccccctgataagcaatgcaaaacctgtaacttaagcaaaagcattggcaactgtaaaatttctcattttatgtttccatcttctgaacgcgtttgacttcgaatttcagttggatactggaaagccgtaccccgcgtatccttaacatttttaggggaatttttcgcggattaaaacggggaaagatttgggggtcggagaagaaaacaccgaacccaaccccaaaaggagtccgaataaagcggagcagtcaacgccagcggcccgtcatctccttccgctgaaaagtcaaatcagtcttcgcctacgcagactcccgtcgcgctcactgccatgtgggcccaaccgccaacaaaacccggctccgccttccgaggcgagcacggtcgtcgtctacggcgccggcggcagtccagcggcggcgcacggagtcacgatgccggtcgtcgtcgagacgagattgtgcctgcagtcaagatcgcaggcgacagtacaagaagacctaacgcaacgtcttgtggttaaaaaaaaaagcctacaatgctgtttaattagggtttagtccattcagtcatccaccgaaccctgcaaccccaagcgccgccgcttccctccttttttgtcgctgggccggcgggggcacgccggccaaatattttaagcaaaatccggcggccggcgcctcctttcacgcggttatctatccaaagctgaaggtgcgatggccgccgccgccgccgccgcgagctactcatctacttcttggagagtccgacccgggcctaaccccatttcgctcccctctccagccacacccgcagggacgactccagcggatagccatcttcgccacccgcatccgcatcgcaacaccctcggcggcgatgcagtcgtcctcaacgcggcacaggttgcgccccctccccccatttcgttactctgataggtctgcttcactgtaaaatgctgtattcctgtccatgctatacatgtctgaaagtctgaaattatcctgagtgcatgtctgaaagtctgaatttatcctgagtgcagagcatttcataggttgcatgtttttctaagtatttattagctactcacccaaaaccctcatgttgttttcaacataagcaggtagaaacctccttgttcaagtaaataactatattcagtactctatatgtcgagatatggataagaggggcagttagggcctgtttagattcatactatcattttaaaccatatcattgtttggtaaaatcaacaaatgtatggcggtgtttactttgttatcaaatattggtcatgtctaaagaatttgacaatatcatatttaatctatattttagcaatgctaaattttggaaaggttgaaaatagctataaagtgaacaagcccttagtatattgttccacggcaataaaagctattgcctgtttattcctttctgctgcctggttggggtaatgcatagatgatatctataaatactctttattcctactatattcaaagaaattggcacacctggtgccggttcgtttccccaaaaaatagtaagctggttaggtgcaacagttagtctgaacttcttcttctttttttaggatcagctactctaaacttttgaagaaccgtattttgttagtttagcagcattcagtttaaccattccgctctcatgagacgtcaagttactcataaaaatcatagagtttttgcatttttctttctgcaccaagaacaccaccctgcgccaccagtacttttcagcacaaaagagattatagtcatttttactattttatccaatgcaacagaactcacactgtttgttccacaggcttgaggcagtgaatcatgaccatgaaacaatacctgaaaggtattactatacatacaaaaaataggcacttttagtcctcaatgaacaggatactaaatttttgcctgtccgatttaggcttgcagtagtcactggtggaaacagagggattggcctagaagtgtgccgccagcttgccctccaaggtgtgacagtcattctgacagcaagagacgagaaaagggggaaagatgctgttgagtccctttgccatgaatctaacctctccaacataatcttccatcaacttgatatcctagatggtaacagtcgtgcctcattggcccgatacatcaacagtagatttggaaagcttgacatcttggtaaaaatacagctgtttccttctctttactacaaagtctaaccaatctgtttctacaagaacgaacatatactgaagatcgcgtgagaaatgcaggtgaacaatgcaggtgttggaggggttgcagtagaccaggatggcctgagagctctcaacattgatcccagggtttgggtatgtagatttatgttagctttttactttctctggattgataatacttattgttttggacaaagctattttcaaactttaaaaactttaactataaataacatctaaaatatttattgtagaaatatggtgaccatatgtatagattggtcttaaaaggtgctccaataaaatcatatatttattgatattatatatatatatatatattataataaaaaatagtggttaaagttgttttttgcataccgtgtctttgttcaaaacaacaagtattatcagccagtaggaagtagcatatttgcatagcttcaaatgcctcccctattttgttctctaatttttcccttggatgatatggccccttacagttgtcagtagttttagtgtcagatatccttgcgttattttggtgcgtagtgttcattgcgaactttgaacactggtgtctattcaattaaaaattctctttttgatgcacaaatgaatagtcagcagcaaccatctcaaccactaaaaaatgtgtttgcaattcagctatccggcaaagcagtcaatctgatccaatcagtaattgtacaaacatacgacgaggcagtaaaatgcctcaacaccaactattatggattgaaatggataacagaagctctcctgccgctactgaaacaatcgccgtcaggagcaagaattgttaacaccacctctcttcggtcagagttgaaggtacaaattctttctattaaaaaaaagggtacttctgtgcttcaactagcttacctaacaacatgatagttcctgtgccaaacttgccacagagaattcccaatgagaagctccgcgacgagctgcgcaacatcgacatctgggacgaagcacggatagaagcgatgctgaacgagttcttgcttgacctgaagaacgaacggcttgaggaggcaggatggccaacaatgctgccggcttacagcatgtccaagaccgtcgtcaacctctacaccaggatcctggccaagaggcacccggagatgcgcatcaactgcgttcaccctggatttgtcaacacggagatcaactggaatacagggatcatccctcctgaagaaggcgcgagaggtgcggtcaaggcagctctgctccctcaggatggaccaaccggttgctactttgatcaaacagagttgggtgaagcttggtagtaaaatatagcattataaaattattaagcatgtttaataatcatccttccatgctagcttagcgatcagagctgtgtaaacatataccactacatgattcatggatgtttcacagactaaatttgttatgcaaggatgcttaataatcaaccacttttgaatcgttttgcatggatgttcagagatgctcagggagtggggaacgttgatgatgtcatttttttagaagggtattcttttactctggatatatacaatctttttaaattagaaacttagcctattaaaacttagccctcaaataatccaatccgaatattcgatcttatagagatttgaactcaagatcttaaaatgctactcagaaaacttcaatcactagtctccgtaccctttcatggtaatgctggcatatgctactcgtcttctcggagataaggggcacacttggccctggccgtgaccaaaatcctatcaaacgtgacacgttgcaatacgtgtccaccctctaagggacgtgtcgcctagccgtcgcacgtacaggtttatatatgttcatcatcagaggcgctaccctacgacgaacaggaaaccaccaatttagcagtgcagtgcgcgatcatgtcgtcgacgcaggagaagcgaggcgagcagatggcgcgcgcgcgggaggcggcgcgcgagatcacgcccgaaggcaccgagcgcgcgcgcgtggtcggcgaggaggaggccggccccgagcaccaccgcgccggcatcctggaggcggcgcagcggggcgcctggtccctcgtgagcgccgtcggccgcacgctcggcgtcgtgagggacaccgccgcccagaccaagcccagcgagtacggcgacgcggcggaagcgaaggacaccaccgtggagaaggcaagggagacgaaggacgcatccaagcagcagaacgaggagctgaaggcgacggacagcgttgcaggcgagcgtggaggcgacgcggcaacaagcggacgcgggcaggtggcagggaaggaggaagactagtacggcccgcccatgtgatccgtcttgggccaagtcggcccagaaacgttgacctaattattagacttggaataagtacactttgggtccctctatttgttgcccagtccgattttcgtcccttgaccgcaaaaccgggtatgacccagcccccaacttaagaaaaccgggtaaacgtggttcctcggcgttttgaaggcagtttggctgacgtggcgcctacatagcttatttgacttggtcttcgtcccatgtggcattgatgtggcgcttacgtggcaattatatctcgggaaaataataaaaaacgtggccccacatgtcagctgcacaaacaaaaatagttttaaaatggtggggcccacatgtcagcctcactcatctcttcttccctctcccttctctctctcttctttcctttcccctctctctctccttcccaggcaggggacggcacgggtgggcggcggagcagcgagctccggcggcggcggcgggcgtggttggcgctgctccccgaccggagcgccgccggtccgcgtgaaggcaggtccggccgttcggggggtctggcagctagcgctacggcggcggcgatcggcggcgggagcgctgggcgggaaaatgaacggggcggcggcgggaagagcggcggcacgaagccgaaggggtgctagcctcgtcgtcatcttcttccggcgcatagtcgtggagcggccggcggagcgacgacgacgggcggcgggcggagggcggagtagaggggcggttgacggagcgacgacgggcggcgggcagcgtggcgagagcactgcgagggaggaggcgagctcgtcagggtggtcggcgggaaaagaggtagcgcagcgcacgccggtcgatgggagggagggagaggaacgggggtcggcagccggcgggtgtcggcggtgcgtgggggtcaacggctggtggaggtggccggaggaggaagaggcagaggaggaggtcgccggcgagcgcgggctccatgccgtcggccgctccgcccgagatgcccagcagaacggcgccgcccctcctcgctcggtcgccgagcgccgccttcctcctcgcccggtcgccgagcgccgcctccctccttgcccggttgccgcgagcggcccctcctctcacccagccgcggcgcgccgcctccctcctcgcccgaccgtcgcgcgccgctccgcccaccgccccctgctgcgccgccgctcaccattctgtaagggagagaggagggatagagagtagagggggctgacatgtgggaccacaggggccccaccttttcttattatttcttgtagctgacatgtaggtcccatgttttttatattttcctgagatcctattgccacgtaagcgccacgtcaatgccacgtgggacgaggaccaagtcaaagggagccacgtaggcgccacgtcatccaaaaccggacacaatccacggttttataagttgagggacccgtcatacccggttttgcgacggagggacgaaaatcggactggccgacaaatagagggacctaatgtgaacttattccattagactttgtgtaggtctaatagcccggaaatgttggcccaaatgttaatggaagaaggtgcaggcttccctgaggaaaaaagtccatatgtatccttcaacttatggttcgtgtctgattttgctcgctcaaccacaaaaggaataagtttatctaagttcccttaacttgtcaatgatccaattttcgtccttcaactgaaaaatcagatacaatgggtccccttaactaccaaaaaccggtacaatataggtcccatggtaatttggatggcggttttcgttaaggtgtagcctacatggctaatttgactagtcttcatacgatatggcaatgacacggcgcttacgtggcaatttgatttggaaaataataaaaaatatcggcccatatgttagttacaccaaaaaataatttaaaaatggtgggctccgtgtgggcctcacatgtcattctcacccctcctcttcttcctcctctctccccaactcacctttcttcgtctctctctctctccaagcccgcattgcagggagatggggatccatgggatgttgcagagcagacgaagcgggggatttgggtttggtttatgctagttttggaacaagaccaacagtcagggggtggccagtgcccggtggtgagcacagtagcgacgccctatggaggaaggcggtggagggagctcatctatcaactccggtggcgagtgcttgtggcggcgctgcctccctcctcaccctgctgccgcgtgccgcccctcctcactcacacctagagagagaacgagtagagtggagaaagaaatgattagaggggagttggggtgagaggaggaagaagaggaggggtgagaatgacatgtggggcctatcatttttaaattatttttttaactaacgtgtggggccacaaattttattatttttcaaatcaaattgccacgtaagcgccacatcatataaagaccgagtcaaattagctacgtacgcaccacgtcaacgaataccgccgtccaaaccgccatcagacctatattgcaccggttttaacagttaagggatccgttgtatctgattttctcgttgaaggatgaaaatcagattcgttgacaagttaagagaactaagatgaacttattccacacaaaaccagacatggaggctctgtcaaatacgtaaatcggcccaatatcatgctgaattgctgagtagcctactcaatatctagcccaacctttttccccctttccgtgatgaattcatatgcgtgcaaaatttatgtgatctctcctgaggcattcgctagctgtcacgattggatcctcgattaccttccatacttgagctatgatttactatatatgctgcacctaggtgtcatggcacctatcatttgcatgtgacttaaatagttatagaaaaaattaaaaaaattagtaacatcgtttgtgatgatacaagtctatacacaaacatgcaagactaaatttgatctacaactagagaaacaaaaataataaaatcagacattcaatagtacccgtacagtgcagataaaatttcttatttttgtttcttcatatatcgatcgaatttagacttgcatgtttgcatagtgacttatattatcatggattatcttatcaaattttatgtattttttatataattatttaaattacaggcatacacctaggtgccatgtcacctaggtgtaaaaaatactttctgttatagtgctggactcgataattttcatagttaagggaggcttataatatgtttttttgcgtttatgggatcaaaatggcctgtagttaaggcaggcataataagtgatgagttcatatacgtgcaactgcaaacttatctgatctctcgcgacattcactagctgtcacaattggatctccgattacctcccatacttgggctatgattttcctacaatgaattaaggtgcaaacgtggaggatgaaactaaaactcgtctagattcatgcagaaacatagataagtgttgcatttgagtcgctggcagaggatgaattccaacccaaatctgctgagatatcaattgccatgatacgtcgggtccagatcctctagagttgggtataactctatcgggtggagttggctaaatctgtgccattcggcatacttcaagggctaggcttaagccacattaatttatacttaaaaaccagtaactgaccatgcaacaaataatcttgtatcaacagcttgtcacgagatcatttttactgtataattagcacaaaaaattcaagattcatctattatttaaaaaaaatcatacacattaatattgatatggttcgctgtttgcatatatgtgaaagcactatgttgatatacactgactgccgctttagagttgatcgactatatctgttgtttggggaataacaaaacgttattctgttacatttttttgggggtgagaacttaatcaaatcgctattattgagcaaacacatgaaaaaattaagtcataaccattaatttaaggagttaatttattaggtgaaaattccttaaaaaaaacttattaggttaaattgacgaggaatgatctcagccgtagaaaacaatggatagcacagatttggccaactccacacggtagagttatactcaactccaggggatccagaccctgatacgtccacgaaatgcattcctctcaaatcccagccggatttggcaccaactaatggcggtgaattggataggttaattcatagatgaaggtaattgattgatacgggctaatatcatcttgccaaaacaaacatgccatccaggcgtgtataacaacacatcaccaccattgcaaagcttcttcatcgatcgccatcgtcttctccagtcctcatgcaggctatggcgtccttactcccaattctgttgctcaccgccttcctatcgtctaaacctgcactctgctacatcaatccaggtgcaacgccgccacagaaaattggcacgaaatcttcaggtggccgtgcaacctacatcgtgttcgtcgagccgccgccgccgcttggccacggcgatggcgaggacgaccactgccggtggcatgaatctttcctgccactgagtgagctcgccggctccgacgacgagccacgcctcgtccactcgtacaccgaggcggtcagcggcttcgccgcgaggctcaccggcggcgagctcgacgcggtgtccaagaagccggggttcgtgcgcgcgatcccggacaggacgctgcagctgatgaccacgcacacgccggagttcctcgggctgaggaaggacgccggattgtggagggactccgggtacgggaagggcgtcatcgtcggcgtcctcgacaccggcatcgactcctcgcacccttccttcgacgaccgcggcgtgccgccgccgccggcgaggtggaagggctcctgcagggacaccgccgcccggtgcaacaacaagctcatcggcgtcaagtcgttcattcccggcgacaatgacaccagcgacggggtggggcacgggacacacaccgcgtcgacggccgccgggaacttcgtcgacggcgccgcggtgaacgggctcggcgtgggcacggtcgccggaatcgcgcctggcgcgcacatcgccatgtacagggtgtgcaccgtggaagggtgcaccgagtcggccttgctgggtggaatcgacgaggccatcaaggatggcgtcgacgtgctctccatctccctcggtagcagctttgctgcggactatgacaaggaccccctcgccatcggcgcgttcagcgcggtgtccaagggtatcgtcgtggtgtgcgccgccggcaacaatggcccggcgttcgcgacgcttagcaacgaagcgccgtggatggtcacggtcgccgccagctcagtcgaccggcggttctcggcccccacgcggctcggcgacggcagggtcatcgacggcgaggcgcttgatcaggcgagcaactcgagcggcaaggcgtaccctctgtcctactccaaggagcaggctggtctctgcgagatcgcggacacgggcgacatcaagggcaagatcgtgctgtgcaagctggaggggagccctccgacggtcgtcgacaacataaagcgcggcggcgccgccggcgtggtgctgatcaacaccgacctcttgggctacaccaccatcctccgggattacggctccgacgtggtgcaggtgaccgttgccgacggagccaggatgatagagtacgcggggtcgagaaatccggtggcgaccatcacgttcaagaacaggacagtgctaggtgttcgtccagctcccaccctcgcggcgttctcgtcgcggggaccgagcttcctcaacgtcggcatcctcaagccggacatcatggcaccaggtctcaacatcctcgccgcgtggccctcgtcggttgctcgcaccgatgccgccgccgcgccgccgtctttcaacgtcatatccggcacgtccatggcgacgccgcatgtgagtggcgtggcggcgcttgtcaagagcgtccaccccgactggtcgccggccgccatcaagtccgccatcttgacgacatccgacgaggtcgacaacaccggcggcccgatcttggacgagcagcacaacaagaccatgttgttcgggcccttcaacaccggcgccggccacgtgaacccgacgagagccgccgacccgggcctcgtctacgacatcggagtcgccgaatacgccggcttcctctgcacgctcgtcggcgagtatgtcctgccgatcatcgtgcgcaactccagcctgcagagctgcagggatctcccccgggtggggcagtcgcacctcaactacccgtcgatcacggtggagctggagaagacgccgttcacggtgaaccggacggtgaccaacgtcgggccggcggagtcgacgtacacggcgaacgtgacgctggccgcggagacgtcgctgaagctgagcgtgtcgccggagacgctggtgttctccaaggccggggagaagaagacgttcgccgtgacggtgagcgggaggttcacgaaggcggcgcaggcggtggcggtgctggaagggagcctgagatgggtgtcgccggagcacgtcgtccggagtccggtggtgctctacatccccgtcgcttccgcaccgccgtcgccgccgatgccggcggttgggactcggcgcggagacaactgggcctgaagttcttcatgggctatgtacatgggtcgtacgctttgctgtgtgaatactaataactgggccgattttttactataatcctaatgggcttttgggttactctcgcacgcagtttcagcccatcagactgtactggaaaggattgagatactctacctgccactttgccttgttaataacgggttggtttggtttgagtcctatattggccttaccaatatttggcaatttcaatagtgtttattgtctatttggtttggagccaaattttggcatgcctaagaaaataggccatttcaacagttaatttaggctattttggtttcaatccaaacacaattttacctttgccaaaattagccatgacaaaagttaccaaaatttaacattgacaaaaattggtaaggccaatttaggccacgaaccaaaccagcccaacatgtgtgggtctagggttcatcgggcttacatattagtgatggaatcagtttacttcgaaggttgaggatcttgatccgtactataataacacattttacttagcttttgcaattgaattcaactgcatctactactagagtaagtactctagttttgctattttgcaagcttcacatcttccttaatataagctcgacagaagggcaggagaaatggaaagaagaacaggacagacagaaagaaaagcttgagctcggcatgaagccatggggatggagatcaggatggcacgagagcaccttgcagcttttatggtgctcttgctagctgaataacggccggtggaaggtgagctacaggaagattcgtccttatagcaataaacaatgtcagcatcggtgcacagaacctaactgttcgctgttaaacgcaaagcagctcttcagttcagttcagttcggttcagctcttcagttcagttcagttcggttaggttcagttgacagcaacaggagcatcacttactaaaccaacacaaaagtagataggacactacctctatccagattcgttgtaacatgtagtatctcatttactcataggttagttttttcttatgggatggagggaatactccgttccttttaaaatacagtgacctaaaatggatggggtaaattttaacccctatttatattcgtagtattaaaacgcgtctcatactattgtatattgttacattttagaacaaagtaaggactccacttggatggttcagactactctacaaagactgcgttgctcgccttcattcaggtaaggagagagagccttctctaatctctacaacgaactgaaccgtgtgagcgagatcaatcttaacgctctgaacattggaaatgcaggacaggaaacgaatcgaatccgatgaaatttcagacgccagtaaaaagggtggaaggtacggtgaaggtaatatcaaaacgtgagaaagaatctgctgcgaattggacagcagtagcagtgaaaggtaagatcacagtagtagtaggaggagcattttcaagaccaacccgtttacccgcgtgcatttccacgtcaggcccgtacgaaagtagaagccgcagttgccacttgccactgcagctagctggaatagcttaccgtacagcattcagctggatcactcaaaaaaaaaaatctgtaaaacatcacaccaactcttcgtttgcactacccgtcccaaaataagtgcagcattagatatctgtatccaacatttgaccatccatcttattaaaaaattttaaaaaaattagtcacacacataaagtattattcatgttttttcatctagtaccaataaaaatactaataaaaaattcaaataagacgagcgatcaaatattggacataaatattgcaaaattgtatttattatgggaaggaggtattactgctacttcacgtttgcgtacgggaaattcgtttgtactccattgtcgagaaaatctcagggctcattagggtcaaccttcatttttatttttgaaaacaatgttaaataaacaaacttaaaaagtaagacatgattgatagttagacttaagagtagaatcaaatgaacaattgtattttttctataaacttgtaaagatgtttgatttaggataaacccaaaataacttattacataaaataagtttcaaaattttagtcaaataaaatcaacaattttggccgtgtttagttcccttcaaacttccaaaaattccatcacatcaaatgttttgacacatgcatagagcattaaatgtgaacgaaaaaaaacaattacatagtttgcatgtaaattgcaagacgaatcttttgagcctaattacgccatgatatgacaatgtgatgctacagtaaatatttgctaatggtggattaattaggcttaataaattcgtctcgcagtttacaggcggaatctgtaatttattttattattaatctatatttaatactttaaatgtgtgtccgtataattaaataaaaattagccaacgaactagacacagtctttatacaatatgcggatggagtacgtacgttatagggcaagcactgcctcttcttaggtttcttctgttttgagagaggggttgaacaattgcaggcaggcactgcagcgtctagaagaattagaagctcggtttttgaatcatgtacagttctctctctttttctttcctggaataaggtagagctagctctcgagctcaatcttaattaactcgtctgttaaaaaaaaatctaatcctaactatgtatttagacacacatgtatttagattcgtagctcaaagttagctttttatatacgtcctgatgaatgatgtatagtggcgtgtgtggtgctgatgatgattagctatttaaatctgggcgtgccgctccctgatgctgtgattatgaacttattttggctcttcctcttgtagctctcaagagtgtctgccatgattgagcagggccaggggcatggatagtttacaaacaagtctaccagatgtgtccatggacccgccatcttcctatacaaacgcaccctttgatactcaaaagattcagccacaacttgtgctattaaagaacgttggttacaaacgtttacagctttgcacttaggtcctgtttagatcccaccctcaaatttttcaccatatcacatcaaacatttaaacacctacatgaagtattgaatataggaaaaaaactaattgcgctgattgcgactaatttacgagacgaatctttttaagcctaattgctatatgatttgataatatggtgctacagtaaatatttactaatgactgattaattaggcttaataaattcgtattgtggtttactgatggattctgtaattagtttttttattagttctgaacaccccatgcgacacacatcctatataatacccgatgtgacacgtcaaaactttacacccctaaatctaaacactcccgtaagattactataccaacctgaatctatctctgtttttttttctctttcacagaaggatgctcccatgaattactagctgatgagtatggtactatggtgtgtactcattcaggccattgatgatactaccaagcaaagttatcagccgtttattttttgcttgatgcattactgcattatccctttgtaattttactttgggacaaataaagtagaaaaaggtggacaggggaatagaaaacgagtagtacaaacgttggaacttgaactcttgactgacctatcaccaaccatctcgtggtactagcacaccacttagggctgtttagatacctcgtaaaatttttcactctgtcgcatcgaatgtttagacatatgtatgaagtattaaatatagaaaaaaataattactagattacgtgtaaattacgagatgaatcttttaattctaattgctccatgatctgacaatgtgatgttacattaaacatttgctaatgatagattaattaggcttaataaattcgtctcgcagtttacgggaggattatataatttgtttttgttattagtctatatttaataattcaaatgtgtgtccgtatatccgatacgacactccaaaacttttcacccatatatctaaagacagttttaatctccatccattctccaaacatcgagatctctgacgagtataggccaacaaataattcctccatctcaaaacaaactaatctcatattaaaatataatgtatactagtacatcgaatctgaatatactctatatccagatttattgtattaaaatgtatcgtatcttagtatagagttgttttatttttaaggcggatagagtactctaaccaactcaacagtcaattaccattagaaaccacctgcgacaacactactgccattagtttatctggaatgagacagagcaatgagccatgcgtttaacccaggagaattctgaggcgtgctgacgaaaatgggaactttccttacacttcctctattttcttttatatgatgttgcttagtatgattttctatactctatctattgaactaaccaatattaaaaaatatttactactgatactttctccattttataattcttgaggtttaaataatgacaaataaactaaagaaactggaaattaaaatctagtgtggtgcaacttgatagtaagcagtgtagtctacttgaagtggaatacttcctccgtttcaagttataagactttctaccattgcccatatttatatagatattaataaatctagacacgtgtcttataatctgaaacggtggtagtagtatctttgctcggctatcaaggtgcagggaaagttctcattggcatagagcgtatctgacagcaagtctttttagcttttggcaacatctctcttcgctcgtcgtaactaggctttcgatgcaatcgagagaaaggaaaacttcaaggacatatccagttgtgttacagaaagatcagtggagttcacttcccctggggccatgcaatacatgctgagttttcagttcagtttcagagaatatataaaagacttttggatccgtagcactcagcaaaactcttatgtctcggaaacatctgtgctcagtttgatttgaggtcaattttgttttccttagagcaagttcaataaaagaattaagttggtggtataatatcgaggctagcaaaagcaatgagcttgagaaataatctttttaacttattaattttccaatcatccgtttggaggaaaagagtagtattattttttcacaaaagctgggaaaagaaggtgggctttattcttcaccatgccgtcacatgaataggggatactccatgccaccatcactaatcaatgtcacatcctgctaatgcaaaactcttgcacaaatccactaattaaaaccgtgctagtcaccctaagatgacgccaaatcaagatcttgcacatttaattaaactactctaagatagaagtatgctttatgctaaagcaaatgaataaaaaccattaagagattttagagtatccaggtggccgaatttgctaaaagaaagggttaagagaatttgttcttgccatttctgctaaagccgagcatcttcgtactcctacatgcatatacatgttctgcctgccggaatttcttttctactctccatttaaaaatgtaagaacctataaccgaatgatacgttttatagtacaacatatcttgatacactcctatctagatatattatattagaaaacgttttatctgattttagattcttaggccctgtttagatcccaccctaaattttttcaccatatcacatggaacatttgaacacatgcatgaagtattaaatataggttaaaaaataactaattacatagattgcgactaatttacgagacaaatcttttaagcctaattactctatgatttaacaatgtggtgttgtagtaaacatttgctagtgacggattaattaggcttaataaattcgtctcgcagtttactaacggattctgtaacagattttgtaattagttttttattagtactcgaacactctatacgacatcatatataatatctgatatgacacgtaaaaactttacaccctgaatctaaacacccccttatattttaggacagaggtgtagtagcgttttcttatgactgctggaatttcttggtgaagggaaaacgcacactggactgccacgtgtcacgcacaattagctgttaagcatcgggcagtgagcgacgcgatctgctttgcccttttgttaagctttggtttgacagccaagccatgtcggggaggcgccacgtggcgtgcacccaacaaagccctttcttttacctctccttttttacggttcacgattggttgctggtggcaacaacagtaaaaactgtactgtagtttggtcagaggggtgacgagtgagtccgaaatggagtcagtggtcaagtcaataataggagtagtccaaccacgttacctgtgacgaaacaaaaaagacgcattgcattattaatttattaatggtaggagtacataaacatttgggaccaataatcgctacagtttctgcacatacaggagtaccagtactactcctacgtgggtgttttttttttcttcattactacccccattccatttttaaacgtagttattagttttcgttttcagttttaatggtttgtcttatttatttattttttaaaaaataaaaaatataagtcatgcataaaagtactactcatattttatcatctaataataataaaataattaatcataaaaatatttaaataagacggacgatcataattaaacactgaaacttatagttgcgcttaaaatgtgatagaggaagtaataatagtagtagtggaccaaccaaactttttgttgttcacgtccaagtgtacagtacttctgaaatttctgctaatggttgggttgctggagagactccggagacatgggaacacagcaactgtcaatatccaacacatgaacaggacattatcagataagtgggcttgcaccattaatattatggtccagctagctgctggtactcctagataagacattatctcaagtacttaagtagcattagtagtacttaattatgagttaaacggcttgaagaaaaaatatatgtgacctttggtacttagtacaaatcaatgacgttacgcaataattaccatcattagctagtactaggagataagctcgccggctaatcaacatgattaatttgcttagaaatcttttttggtgcatccggcgatctgattgggccaggcaagatgttttcggattctttaaggcaaagttgacgttgtttcgctaaaccggagccggtgaataattaaacaagctgccgaagaagatgtgatgcgctgctggttaatggaattaaaagggaatcagactaacatcatctagttacatgatcgagcgacatttccagcatcttgttaattagtaagcaattatttcttccatgtcgatcgttcaagtgagctagacaacatttttaacaacataatatggctatactcttagggccatcggatttgtagatatttaactatttaccacttttagatgtgacaaataactttttgccactggattcacatgtcatagatacatgtggacccacatatcgttgaaataggggcaacaaatagttaattgccaattggaaaagtggcaaatagttaaatgcatacatgtgtcttataataattaagacaataaagactctaatcattaacctaaaatatattttttattttctattctaaaaactctaaaatcctgttgagtgagactaagtgccttttatgaatgattattgtacatgccatattaattagtgatttgctgaaacatgcataatgaaaacccgtgaattaatttttgtatggtacaaattccattccttggctgatcttcaacggcgatgcaaagccatatagtcctatatgcaggcaggggcaggcatgaaatgttccctcgtgacactttttttttcctttgctctatgcctttttctgtaccctagcaaattaacaagtttttgttttctttatcctgtgcctttttgtgtagccttggaaattaacaatgacaaataaatatatggagtatgaaggacactagatagtgcgtcatgccgttttcggcagcttctttttctatctttaccgtgtataggaaagaaggaatcggattccttcctgaaagacagacttgatgagagaaatgacttgaccaattttcttgcatgtttactagtagtatgccggaaggagtcaacaagttcaacagattgcatataatcgagcgagacacactgcattacatggtagcacaatctgtagcttgcatttgtttggtcttaaacgacaaagtgcattaatagtattttctcctttcagttcagtaagatgaagattttcccttttttttcggcatgttctttgtaactgatagataaaattaaattcatgacaattatttgaggacacagcataataaattaaatattagaaagctgaaaaattgatttgaattttttttcaaagaaatgttgattaagaaactttcttcactagaatttctttgaatgttttagagcttagaaactatgcccgtggcaatccataatctataagggcatgtttagatccccggtaaaatttttcacgatgttatatcgaatatttggacacatgcatagaatattaaatataaacgaaaaaataactaattatacatattacgtgtaaattgcgagacgaatattttaaacctaattgctccatgatttgacaatgtggtgctacagtaaacatttgctaatgatggattaattaggcttaataaatttgtctcgcggtttacaggcggattctgtaatttattttgttattagactacgtttaatacttcaaatgtgtgtccgtatattcgatgtggcacagtaaaaatttttaccctggatctaaccaatgtctaagacaaaaagaaaggacaaccctgagttcagaaccggtgtgacaggttaagccaatccattcatgtttatttcagggtagttaagaattttcatgcaatttccagttgatcaggacatcagaagaaaactttgatccgatttctcccgtaatagtagattcactgagatacctaggatgatccaatattattcctttccatccatatcgtttgcctgttgaagggaccccaccaaaactgccctaaaccccttgagccaatcaatcagtttgaccgtccgagtactacgagtacgagcagtactagtagtatttggtttgcatagtcacacactaaactgtcagatgatcacgttatccacaatagggtgttgtgtaggtcactgcaattacatagtaggctgtgtttaaatccaaagtttggatccaaacttcaatctttttccatcacatcaacctatcatacatacataactttccaatcacatcatcttcaattttaatcaaaatataaactttgcgctgaactagacacagccgtagtagcagagtgctatgatagccggcatcttgtgctgctcttctcttctccatacgtttgtttgttcatttgtctctgcctttatcggacgtccaatccatcattgactagccatagcccatggccagccagccagccctccttgtgttgctcatccaatgcccaaacgatgcaaaagatgtcagactatgcacagtgtttagtacatgtcctccattggcatgcttcctttgctctgggacggttactgttgtgcttctattatccggctgcatttcttcactatttttgaattcaacatgtaaaagcctgtacaatttatgttacaagcacttttacaaatattggtacgagtacgtagtactggatgttaccagctatagagcttgattgagcaaactcacggagatagcaaggacaaagaatgtacttcctccattccacgatgcaagggcccctttgaatcgcaggattgagaaaacgtaggaatataaaaaacgtaggattttgatagaaatataagaccttatttagatgggactaaaacttttaagtccttatcacatcggatgtttagacgctaattataaacattaaacgtagactattaataaaacacatccataatcttagactaattcgcgagacaaatctattgagcctaattaatacatgattagcctatgtgatgctacagtaaacattctctaattatggattaattaggctttaaaaaattgtctcgcgaattagctttcatttatgtaattagttttgtaagtagtctatatttaatactctaaattagtgtctaaatacagggactaaagttaagtccctggatacaaacaccacctaagtgtaaaacataggattgcaaaatgcaggaaaaacacatgaatgaccgtttgattgaaccgcgggaaaaacacagtaattggatgatagagatagactcgaaggaaagttaccaagaggttctacctcattgttaaattttctctaaaatttgcatgggaagaggcattccataggaattttataggatttcataggatccattcctttgattcaaagggctatataggaaaaattcctataggaataaaatcctctaaaattcctatgaatttcctttgaatcaaagggggcctaagtcattctagcatttctcacattcatattgatgttaatgaatctagacatatatatcaatctagattcattaacatcaatatgaatataggaaatgacagaatgacttacattgtgaaacggagggagtataacccatggtttagagtgatgaatcatatgtactgttaggccgtgtttagttcatccccaactaccctaaacttccaactttctatcacatcacatcacatctaaaactatcctacacacataaactttcaactttcctcaaacttccaactttttccagaaattaaacacagccttatatgtcaacattgggttttatagcagctgaagagctgcatagtgattgctttataacttatgtcttgtattacagaaacacatagatgatagagattttcttaaatctcaaccacctgctctctagccatggatcttagcctagtaaaaaacattgtcttcaatctctagccaacagagagagggacgtgaatcctgatggagcttagaactcaaggtgatggaattatttcctacgattgtgacgtggcagtagtacaagcaaggcggtgaaagcaacaacgcccagagggaggaaaggagggatttatgtctctttttttttcttccaaaatatcttcctctactacatgtccatctacattggcatgcttcctttactctgggacaattgctattgctgctattatcgacctggaattcttaactattcttgaaatcgcatacaaaatttatgttaatggcacttgtacaataactggtggatgttagtagggcgagagcttgattgaaagaattcagaggtagcagggacaaaagaaggtataacccatggtttagagcggtaaatcatacttaccgttatatgttaatgttagattttgtactagcaattgaagagaagcacaacgattccttatataaataaatatatgttacaaaatatactatagattgtgattttcttaaatctcaaccacccgcccatctcccctctctagcaaacagagagagggacatgagttgtgacagcattgaactcaaggtgtggtggcggagttttctcccgcgactgtgacttgagagtgatataaggaagtcagcgataacaacatcgatgaacgggatgaaaggaggaagaaattatgggctttttttttccttccaaaatatctcaaatttgttatttttgtgttagtaaaaaaagttctacagcagaaacactaaaatatcccaaacagaaagccccaaaaaacttcttttgagattgatgaggcaccttggggttgggcccagccagcccagtggaggtggagtactctgctcatccccacaagccacagttctccctccaaaaaccaaaaaaaaaaagttggaaaatactgcttccttctactaccccagcaatacctacagccctggaacattggccatgccaaaaagttaggctttctttccattcattcattcattcatcagctagcaaagcaaagcattttctcagctcaagttgcttgctcctcttctttctttcttcctcctccccttccctttcaggactcctccccccacatcagtagctttcactgcccaaaccctctttgtgggtggcaaccctagattattaatgtcctcctcctcatcatcaccatctcctcctcttcttcctcccctgcttctctctccagattctcttctcatctggtcccttccttcccctgctttgcttgctcaggtaaaacctctcccctccttgcaagattctcccctttcttggcatgctccaagatttttctttcctcctacatcgccggcaagatcgcttctgttaatgtttccgcgccatttttttttgtttgcagctagctgatcgcacgtgggtagggtgagtgtgtgtgcgtgtgtggatgggagtccacgcaatgtcgtgccacggcggcggcggcggtggcggcgaaggggcactgtcgcggcaggggtcggtgtacagcctgacgctgaacgaggtggagagccacctgggcgagccgctgcggagcatgaacctggacgacctcctgcgcacggtgctccccgccgcggcggcggcggcggagacggcggggaggaagacggtggacgaggtgtggcgcgacatccagggcgccagcaccggccggcaccacgcgacgcccatgggcgagatgacgctcgaggacttcctctcgcgcgccggcgtcgccgtcgacggtgccgcctccgccgccggcgcgcattggctgcgtgggcactacccgccgccgccgccgccgacgacgacgacgctgcagtacgtgggcggctccggggcggtggtggacggcgtgtataaccgcgtggacgggcacggcgtctcggggtttc

SEQ ID NO: 42759 - DNA, 10099 bp, Oryza sativa
cccccccccccccccccccccatggattcgtgagacgctcatgtggtggcaacgcaggcatacacgaacgagctcgagaacaagatctcgcggttggaggaggagaaccagcgcctcagggagcacaaggtaacaacaaaaaaaatgtttattagtagcttctcctcctaaatcctactaattgctcactgctagtactcagttccactgatcttgatgtgagcttcagctccactgtttctttgtttgtttttaaatcttttctgtggctcccagtttgcacaaactctgcaaagtcattttttagttaaagccaaactagaaatataattttcttactagttgttaggtttataattgagctggatgctcagtggagagagagagagagagagagagagagagagagagagagaggggtaacgagccttgattagcatcttgtgtgtgtgtgtgcaaatgtggtactccttgggatgctgggtcatagatgggcgagcaaaggttgcaatttgaggttaaacaggtgacattgtggacaaatcatgcacgtagtactctgcaaaaaatggttctttatatcttacttgctctagtatattttctcaatgtactaattcctccagatgcgcacttataggacagattatgactgttcagggtggtacgaatttctaatttgaactgaacgatcgtcttaattaactagggagtagtatatagttttttctacagttcagttgatgcattactgaatctttgtttttatgaaacaggctgttgctgatttctcaacattccctagctgcgtcgatttcctgaaagcattcttgacgcagaagctggaaccagtaatgcagattgtgccccagccggagccgaagcagcagctgcgacgaactacttcggcctctttctaatcaaccaaccacaatgttcatagcgaaatgatttaaactcgatctctgtaggaaaatcaatgggggtttgtacttggggatgctggctgttgtgaacaagagctgaaacgacgaactcttttcttaactatcgatctgcacgtctcttcctcttgcaaatttcactctgtggttaaactttcaacgaaagattcactctgatgggcgtgattcttgtgttgatcgatgtggtgcgaatgattctcttttgcaaggttcgagtaattctcattgatccttgtattttgctgtttgtttcttaagtttcttcgtcttagaaatgctagtactacctctgttttttttaaaaatgttaactttttacatcatgtttgatcaccttgttcaaaaaatttaagtaaatatcttttcatgtgttgtggtttgatttgtcaataaacaaaatttaagcaatacttatatttttaatatttgcataaatttttaaataacacgaatgatcaaaggttgtaacaaaaattaacaactttatatattataaaaagcggaggagagtatagtaccggtatattgtgaagcaacatattttagagctcaggtaacttgggcccttggcccgttttggaattaagaaggcctaggtctcgttccgtggaataagttcatctgagatcccttaacttgtcaacgaatcttattttcatccttcaactcaaaaatcagatacagcgggtccctcatctatcaaaaccgatgcagataagatctcttggcggtttagatggcggttttggctgatgtgactcctacgtagctattttgactatgtgttcatctgacgtggcgttgacgtggcaatttgaccaagaaaaataacaaaacttgtgggacccacatgtcagtttcacacacaaaataaaaaatggcaagatcgacattgggttcgcgctcctctcgtcctgccggagagactgagggagggaggatagagtcatagagataagatgaagggacctctgttgtacctggttttctggttgaaggacgaaaatcagattcgttaacaagttaagaggcctaagatgaacttattcttcgttccgtttgacgtcgcgtaacgggcgtaaggcctgctaatctggctgtctgggcctcccttggcgtggcccacgtgggcttgggtcaggcggattcatgtacgcacgacgcacggtcaccgcaagatccaacggcatgcagtctccggagctaggttagcgagaaaaatccgtgcaacttttctttccaacgaaccaagagggatcaacatagaatagactagattgactctgtatttaaaaagtaaattatattaacctaacacaaacctaataggtggatgcaacatagtacagtggaaaaaattataaaatacttgtcacaaacttgtctggtgtgtgcaaaattaatgacgccaaaaccgtggttgatatactaagttgaaacatgcttagaatggcacatgcacacgtcaggaggtcatgaggcatactatatgtgcaaattaccactatttttttttcttccattgtttttaattcactgcatcactggtatttttttcactgtataattagcatcccctactatgtatttgatcgagtacacatatgtctagatggcatcattctgaaatgtgtacccatgtagcatcctaataaacattcaaacttagtaagattaaccatggcatgcttatttggttctgattcgcatgcatcaacatgtccgtacattaaaacgtgtgttttacaagcttatgtaattcgttacatccaatacaatttactctttaaaaaataggcatccaatttgtcttcaacataattcgaatttgaatggtctaggcatacacccatacccatcaaccaactgagctaagccctagaatccatgctagtgcttactactagcatgcgggcgaagcatatcgatatcgatgccacgaagcggtcaatttttttcgaacagccggtcagaattgactggcgttatattgatagaaggagaaaaagtacaaatagccaaagggctaagaaagagaaaaactgtacatgacaacatgcaaacaagcttgcatgtagccttcctagctcctcattgcaacattctcccaatgtgtttagcgccggccatactccaccaacctaattcctcttggatgtgactaatcatctggtgtactgtcgcctcctttgctctaaagattcttgcatttcgttccttccagatttcccaaacaatgagcaagaagagagttctgagtcctttctgttttgttgcttccgggtcgcttgttccttgtgtccaccaatctaagaggtttctacttgtgttccatttcgggatgatgtgcccttggtgcagccatgtgagaatcccaaaccagatttgctttgagaccgggcattcaaacagaagatggtcgattgtttcgagatttcgaaagcatagctggcagaaataattatttggccatcccctgatctgtaaccggtcagctgtccacacccggttttgaagaaccaaccaactgaagattttgcactttgccagagcccatgcctcccaagacaactttgttgatggcgagagtaccattccattgaattggaattggtacgcggatttttcactgtattccccattagttgtccattgccaaacaatcgagtcttgtaccccctctattagttgtggggtgtcacgggctaaaatttcctaaacatagaaggattcatcaagaaggggaatggtgaggctgtggcggatgtcgttaatccatctttcttgttgcaacgcgtcctggacggtgcgggttttcctcttcgaatgcctataaagattcggtgcttgactttttaggctttggccactgatccaatttgattcctaaaagctcgccttttgtccgtcaccaatttggactctcgttgatgccgcgaaaagatccttatccaattcatcacagggtgtttcagtccatatccaaggcttctctggcgtcctccattcgaaccataaccatctcagtcgaagagctctggcaaacttttctaagttcggaacccccaaaccaccgtaccggacaggtgagcaaactttaagccaattgaccttgcattttccgccatgcatattcttgttacctgcccacaggaaccgccttcttgctttgtcaatttcttgaagagattgtttcgccggtttcagcaccgtgagggtgtaagttgggatggcacttagaactgagttcaccataattcggcgcccccccatgtacaacaatgatggcttccatcccgagagccgacctttgatcttatcctggagaggctggaaatgcaccttacgtaggcggccaggagtgagtggtagccctaggtaagtcagtgggaagctggctcttgcccccgaaaaactacgcaagacgtcgtccagatctacttcctggcatcgaattggtgccaccagactttttccaagattgacgtgcagccctgttgccttgccaaagtccctaagcatggtaataagaacatccacctcgctttgtacagggttgagaaaaacagctgcatcatctgcataaagcgaagtcctcaatctagcatggcgacttccgatgttggttagttgcccaccttcggtcgccagatgtagaagcctttgcagggggtcgatagccaggataaagagatagggggataggggtccccttgcctcaagccacgtctgtgtgcaatgcattccccctggtctccatttaggactaccttgaaagtggtggtggaaaagagcaaacagatccaatttctccaccgggggccaaaacccatgttttgcatcagttcaagtaaatattcccaggagaccgaatcaaaagctctagcaatgtctagcttgaaaaaaagtgttggctttttgctggcatttaggttcctgagcacattccgaacatacaggaagttgtcttgaatgcatctttttttttatgaaggcgctctgtgcaaccgagatcagtccatccatctgcctggcaagccttattgttagaactttgaatatcagcttggcgacggagtgaatgaggctgattggcctaaaatcggtcaccaaggtaggggcgttcctctttggaagcaaggtaattgctgctctgttgagtgctctaaagtttcctcctgacaggttatacaaacactggaaaacatccatgatatcctgtttaattaactgccagcatttcttgtagaaggtaccattaaagccatctggacctggggccttttctgccggcatctgctttaaagcggcccaaacttcctcctctgtaaaaggttcatctagttcatcggggtgaacctgtggtagatccatcgcgtttcaatttagggtgcaatacgtagcggtcaatttgacttcattaattctagggtgcattcatgcagttgacttcctttaatttgttacgggaaagcgatcggttaatccatgttgagggcaaacatccttatccgaaatggagttggaaccatttgaatcattaggcagagtgaatcgaatttcaaccagaaattgtaatacggtgttggagtgtcatttgggactgatcatgcagctccagatcgaacgcacatatacgaaaaacccaccgatctacactaaaattagtcacaaatgtcatggacatactcattctcaggcatcactttggtccctatgcaccaaaacaagttttgggttcatttgataggactctaactcctaaattctactccctccatcccaaattgataatcacacatataatgtttgtgcactaagacaaaaagttatttaaaccgcatcgattaagagtttaagacgtcatgcacaatatacacacattatctcataatgcatgcatcgattaaaacacaattcataattatatccttagcatgcactacattctcctatgctacattaattgtactccgatgaaatccgtgtccacgcgattatatgacactaatcaatttgaaaaattatataatgatcaatttggtaaggagggagtactttagaaggatatattagtcgtgctagcttattttgtgagagcactataatcagctccactttacttcctttttaagtgaagctaaaattatttggttgaggttcagctctatataagagatgaaattgaagctagaactacgccgaattaacacttactctgatactattacgccaacgatacacatgatgacataaaaccaataacaatgatactaggacaggaacatctctcttgtatgaacaacgtataaaatactcagagcacaagatcgatcgatgtacgcgtgttacgtgggcctgcctcatccaacaaaatagaggcgtgggcgatcgagtgatgagacactcggacatcaaccaacgttacgttacgtgcctccctctctacgtggcgctcttctagttctccctcgcacgctgcctgcctgatgccgatcgatcgatgctgcgacgtgatctccatgcatcgcctgcctctccatctcgaacatcaattaggcatgttttagctggtgaaatattttttttttgtcacgttgtacgtttgaccggatgtcaaaagggattttcggtcacgaataaaaaaactaaaaccacgagacgaatcttttaagcctaatcaatctgtcattagcacatgtaagttattgtagcacttatagttaatcatggcctaattagactcaaaagattcgtctcgcgatttatatgcaaactatgccattagttttttatttatctatatttaatgtcctatatatgtgtctaaagatttgatgcgatgtttttgagaaaagtttttggaactaaacacgcccttaatggctagagccaggtgctactgcttcgcaggtacgccatgaacatcaccatgtccgagtccgaatcctcctcgccgtcgccgtcgccgtcgtccgccgccgccgacgggctctgcaggagccggcagcggcagagcgggcacgtggcgggcggccgcgccgacaaccaccaccggtcgaggcagccacggtggaacaggtgccggcaccggagctccctcacctcgtcgccctcctcgatgccgctcaggcacaccgcgcactgatccggccgcccaccatcatccgccgccgccgccgccggacgactactctcgctgccgcctggttgttggacagcactagcggcagcggcggcgctagcgctactgtaccgcgccacgcgcagcagctcgtcgcgcgccgcctgctccggcgccaccttcttggcgatcagcttcctcaccgacgacgaccccgacggccacgcgaggctcggcgcggcgacggcgaggagggcggacaagggtggcacgaggagcaggagcagtgcactcaccaagatctccatcactagctagctatagctactcgatccacaacaatgcagtgagacgcgaggcgacatgggagacgacgcaatatttatatatctgcgcagcagcttcaattcaaagcttaatgtcctctaaataatttatctatttaattaatacccactccatcttaaaatataaaaatttagaatcggataaaaaatactcttatattttagaatggaaagagtacaaattaagatgatcgtttaattaatttatcttcgtctatctctatcgctattgtacacagttgcacaagacgtgtccaacatcgtgatcaataggatggctgaaagctctagtgctgtaaatgtcagcttgtaatagaagcatcaatggctttaatatttgggtctcgttttcaatcggtagctacagatgaacttcatctagatcgtctttttggtttggtgcaaccaaattgggcatttgctcctctgcaagtagctatgccgtcgagcatcagtaaggagatatcatacttagttcgtccttctgacttttcgatgtgtttttgcattcaatatgcaatcctttcaggacaatgacttcaaagagaggtagaataacagatagagatcgtgtcaccgtgccattcaatgcgagtcctacctgttcacaagtcacaacaccatctcatatctaggcatctgtctccctttctccccttaatttccagagctactatacccaatcgatcacacgtctcctctctgtccctggttcatttttttttaagagatggttgatgcttcttcatatatagtccaagaaaccttacaaaaaggagggcaagttaattagcatgggctaattgagaaaaatggaagatttttctctcttaatactactaaacaggagaggaagagactagacatacatgcatggatgtaataatagtaaaatcaattgggacgtccaggattcaggaaattcagacatgagggtagctctccaaatcttgttctggtcaacttcttttttctaatccggattaggcaaaaacttaatgcctatcttaatcagtctgtaccaagatcaacttgaacatactcctcttcaccgatgttcactgaccaaatataaatatcccagagaggattctagattgccaaaaacaaattattcagagttccaatgcaacatacactttcggagtgatgtaatcgtttcttaatgtcaagctcaaaagttaaacagatctggtgcacttatagttaaccactgaggtattccttcacttccactcaataaataatgtatacacagtgtccagacttagggtgcgttcgtttggagaacaaagcgagtgagtttgtttcgttttccacgcgcacgtttcctgaactactaaacggtgtgtttttttaaaaaaaaattctatagaaaagttgcttaaaaaatcatattaatctatttttaaagtttaaaataattaatactcaattaatcatgtgctaatggctcacctcgttttgcgtatctttctaatattctctatctcgttcttctcaaacacacccttaatgtctgtctgacacaaacttataaaaataatgaatgagaggtaagactaccttacgctgccgctgctcacaagcttcaaagccacatggacagagaacaggcacacctatcttaatttgattcttttatactccctccatcccataaaaaatcaatctaagatcaaatgtgacatattttagtactataaatttgaaaacatctgctaaaatatgttatatcatcagatattaagttggttttttattggacggaaggagtatgtatctactagtacttttttttttatggaaccttgcatatctatgtcagacgccccttttcacccttcattttaatgaacagacgaagaccatatttcagcgtacagtccctcagagcattgcaccagtggttgaaagatacctaaaaatcaaataattattcaaaaaggttggacaaagccaaagccaggaaccccaacatattgcttaaataccaaatttgcaggaagcagaatgaaactgtcgcatgcatttcattgaaaaaaaaattgaaactactgcaaatgctagatgctagttgctgctgatctaccacccactaatgcaggttttggtctccaatcgctcccagtgcagcaaacaacaccggcaaaaaggacacctgaattgtctagctacctaccattaggccatcaattcatgcaacatgtgctcactctttgatcatcagtcgataaaacaagataaacgcattgacactggaatatctcattctactttgccacaacttccggattcatgaagagacatgaacaaaacagaaaaaaaaaatggaatagtcgttgaagcttccgaaattaagatagaagtacgcaagctttacaaaaggtataagctgggtaatgggttgcataacatatcggtatggagtagcgaagatattgtagaagcatatgaacactgtattcacaagcatctatctttgtcttcagaagtataaactattgaggctatctgacaatctctgttctaaaaccttttctgtgtatgcagttttcactccaggccaaactccttcactgatctaggactgcagatgaagtcaagttgaggattcttgatgttatcttgtagtattgatatctgaccctccttaacaagta

SEQ ID NO: 42760 - DNA, 12342 bp, Oryza sativa
tggttcatgcaagatagttcgtcctgaactctctggatctcatttctcatgacatcctgtatacgaagtgaagatgccagatctgactctaattgttcaacatcaagttcctttgaaaggagagcctcctttagcactctattgagtatagcctcttctttcagcttgagttcaggaatatcctacaataagaataagatggtggtaaacaaaggctcaaggagtcaaggttctgcacctgctgaacttataacacatattatactacactaattatttttccagctgagtgctcccctgtcttttcttattccaaccaaaaaggaaaaaaaacttgattgaacagaaaaagatttacagtaaaacataataggtgctcataccagaggtaactcatctgtgtgctccctggaaggactagatccaactacagtctctccagaacttccctttatattttccttttcagtgaggacagaactaataatccccaaactttgcttcagactctggattcgtcctttgatgctctggaactccaaagtgtagtcagtgacagttaatgcagctatgccattgccagcttcattttcatgccttttgcatttcattagttccaacaatttgatgcacagttggctagtcttatcaagcaatgacaagccatgtatctgcaagttatccactctggctagtagctcctggtcaagacgaattgaggacaagcgcggtccatttccagtactttgtatacgatttaaaagtgcaatgttctcttgccttagggactctgattcaagatgacaagattgaacttcacctcttaacttctgctcagagctcctgtcagtgctaataagttccatgttgacattctcattctgttatgcttgtgcagctgcactacaacagatttcattatctgaattgcagtactgtatgccctgtcttaagaccactgattgttctttcttgttcattgcatatggtttgtagccttgaaatcactttatgcaatgctttgttctcaccatccttatgcttccaagaatttcctgagatgatctttttcctccacagccttagtaaaacaatcatgtaactctacagatgaattctggagattgtcacaattgtttctgactttctctagctcatcaattagttttttgtttcccatttccaaacaagcaaccttattagaagcatcaaccttttctgcttcaagaaaagtaacctctcgctgaaaggagacattctgctctgcaagttctctcacccgatcacgtaatctctcttcctcgcactgaaatcttgatagtctgattgaccaatcgtctgatcttctatccatctctttctccaaagtagtttgcacttccatcttttccttctctagccttctagttctgatgtccaactctttcttcaaatttttgcattgctctttggcagcaaacctttctgtaaggcgtgccttgatctgtgaagacaattcatatgctagttgtttcctatcttcagtcaaacattggatcatctggaacatgtcatttgcgcttagcctcttgtttttggacatgttaagctcatattttttttcagaagagaccatgaactttgcctcaacctcttttgccctttggagcaacttgtcatcagtttctacatcctctgttgcaaaatacaagccaatatcagaaaaattgttgggcaatcatatatagaagagtatggtaatatagcatcttgagttgatacctgaagtaggatcgatggagggatgattaaagtcttgcaaatcctcatagatatcttcaacagaagtaacactttccgatttgtaatcttctaaatgtgaaaatctctcagaagcatctagcagacctgcatggtttctacttgcattgcacagtgttgtaatcttgcatgtgtctcttgtatcctcttgagctagttggtggagatgttcatcctttacatcctcatatgggtaagtctcaaggatctcttttgttagtcttggcaaagatggtactgtagactgcggtcgaggcggccttcccaaattcgaaaccgcagatctggtgggagagttttgcttctgtctctcaccaaggatggtggcttcctgctctccatcaatgtatcgatctagaacttcattcttgttcaataaattggttagtcttgttgacctgcatcgaatggcaatgggagaactaacaggagagtgccctgttgagcatgaatagcatctcgaaccaggagagtcactttgcaggactgaatgtgcttttggatcctttattgtgtattctcttggggctggacgcctttttggtgaccatgcatagcagctgcaagtcagtacgcactgttaggaccagcaaaaaaaatacacactttattatcatcactcagatgaaaggaaatggtagagtcacaattgcacataattcacttaatgagtgaggattgcaggtccatctaaaactattctagttgaaatgagtgaagaattacattgggaaaatgggatttacaagtaactgaaatgcctaaagaaagctctgagtgcattggctgaacaatttataaggagggcaatcaccaccgtataattaagcatttaacaattatagctgataagctgaaatgagtaaagtttgcaagtgcacaatacttctccttttcttgtttctactaatatggataaaaaagggaatagggtgttgctaccatgtattggtttgatgatggcaaaaacatcctaggtttcaatgcactattgaactgttgatggtaatcaaaatgtaaaccaatcacttacttagcaacatgatcgggtgcatcagattcattaaacagagaagatgggacatcacccgagaagctgaagctccgatccttcaagaaactgttgccggctggtgatgagaaggacatagacctcctgagctgcttcggattagatggttcctcattgttcagatttcgacgccggctctttgatctacacacttttgtgacaggggaattggaagcggaactggagctgccattgctgtcacctccgtccaatgccttcttcttaatcctgctatcatcgtcacttggtgttttaccaccattcccagtgcttgcggtggatgatccaaagaaaaagaaccttctcatcttacaaatgttcagaacatccgcagatccccacaattgaatcagtccctacaaggagcgaatcttgatcagcaaagaagtagcaacgagaataaatcttgtagcaactactgaatgacaccagatgatctgcaaatatacaatagcaaacccttgtgcgagggaggaatagccaataataataattaaacaggagtaacgaaccaagcaggaaaagcgatatctaaatgaagtttcaagcaattccacgtatccttttgcagggaactctgcaactaaaccacacatcaaactagtttgggccaggaaattgatcgagcaggtgacacgcaaggctaaatgaaaccaaaacacgccagcaaagcatcaacaagccacaggagacaaacctaaccccagaattcagaagcaccaaccccttgatttggcgcttgatcccggacgcaacaccaaatccaaaccccagaattgagattcgcaaagcacccgagacaccaaaaacgaacccaaaacgaaacgaagtcgcaggaagggagaggaggcgaacctctcgcggcggagggagacgaaagggaagtggaggagcgtggtggctttgccctaccaacggtcaagaaatttggggaaaaatcaaagcaaatcatacgcattgattgcgatttaacgatggagacgcgaatccgggggaaaaggaaaagggaaaaagggttttcaagtcgaggtgggagcgggacgggaagaggaagaggaagaagaggagcgtcttaaatgggccaggccgagccgaatcgcttctgtgggcttaattggttagatgggccgtagcggagtaatgatgcgtcgagagggaataagttcaccagaggtccctcaacttcacagcgagatttttcgaggtccatcaaccacaaaaccttctgcccctaaattcagtcaaaccgttcaccaccggaggtcctttggcagtatttttgcccggttttcctgacgtgacatactagtcagcaaaaaaattaaaaaaaatcatacggctcacatgtcagcttcacatatctctttttctcctcttcagtcttcttctcctcttcacttttctcttcaccggcggagcagcggtgggcgagaggttcggctgctggcggcgccgaccagcgacgcaagagaaggggagggcgtcggcggcggcgggaggtggccggaggaggaggtagacgactagcgcgctcctggtcctgctctggctgttgatgcggccagggaggtatcgccgatataggggctcgtcgttggtcgtcgtcacgggaggtatcgccgtccgctggggatgtcaaaatgcagagagttcgtgtcttagaagacggccatgagcttggcttctcccagcacatgcccctcgatggcgtccatcagcttatccttgatcacctgtaagcaatcaagaatcaatcacagttaattaatccttaaacagcaaagataatcgctaaaagattgttcgatcgacttgccttgttgccgaggtgcacctcgtcgtcgaggacgtagagcttgaactggatgcggtggccgcaggagggagggatgacgacgacgccggccgcaccgccgaggccgcgacttgcgccagggccggcgccacgctcgcgccgagcggccgccagccgcgcctagccgcatcggcgccgccgtcgctcggccgagctcggctgcatcggcgccaccgccgccgcgcctgcgcagtagcagccagagcaggagcaggagcaggagcgcgctcgccggcgacctcctcctccggccagctcccgccgccgacgacaccctccccttctcttgcgtcgctggccggccccgccggcagccgaacctctcgtgacccgtgggccgtggctccgtgctcgttcgccgtccgcttcgcccgcagcccgcccaccgatgctctgtccgccgcccgctccgcccgtagctggccgccgctccactgccgcgctcgcccaccgccgctccgccggtgaagagaaaagtgaagaggagaaaaaagatatgtgaaggtgacatgtggtttccacgaaattttttttttttttctgtctaggatgtcacgtcagcaaaactgggcaaaaatactgccaaggagctcgggtgaacggtttgaatgaatttatgggcgaatatttctggttttgtggttgagggacctccaaaaaatctcgctgttaagttgagggtcctacgatgaacttattccgcgtcgtgagcgactcggcaagtgggcccgtggcgacgcgccacacacacgcacatctgcagttactcactcctcttcgccgtcgccattgctgagctgctgctgttgctgtggctggctgataggcgacggcaatggcgccctcctccactcctcctccgccctccccgagccgccacctccttccggttttctctacacccccgcgtacccttctccagtcgccgcaactcacacagacacagtactgcatccaagacggacggccgtgccgcgcaaatttttcaccggcgaggcggcgacgctggattccttcgccgtccaagtccagccatccggacgctatccagacaggttctttcttttctttttcagattttcttgtttatattggagtaatctgctagcagaatggatgagaactggttggcttcttcctgatccctccaaaccctttcttttggggggagtttgcttgacaatatgtatatagtctcttgtcgacttcaattctagcacatgaattaactatggcagttacaaaatcatgcagaaggtgatcctaccaccaacctgtggtgattggtctcaaattttcatgccctagtaatctctgcacagctttcagtgctgctgctgcccttcaaaatgggggtggcgccttctaagattgaggatgatagggccctcgtgttatgccaggagaggaagcgtttcgtcagagaagcaatcgacggaagatgcgcacttgcagctgctcactgtgattatattcggtcactgagagacactggctttctgctaaggaaatgttttgaacatgaagcatctgaagaatcgataccaaataataaatcgccgtcttcttttcaggccagtcatatgaaagctgccatgaattccattagaacttatctggagaaggtggcaactcctgtgacagtgactatggtcagtgcctcatctcaagatcctactggtacttcaccattggaccattttgaccaaattcacccaggtgacaaccagttttcacctaaagaaaaggatagatctggccaatgtttggacaaggtggatgatcctagacccttcctagaggagggaatcccagagctcgaagaggaaggggagagaactccttcgaatgaggaggatggttttgcagaatcaaaagatgattttgcaaatgaggaagagaatttctctgaatcaaatgatgctttcctcagtccatccattgaaacgtttgtgccagtgtcaaacagcaacgacgtgtctgataaaaatagttcaacagacaaggcacctgagcatcatggtcatggaagtgtggcatcaaaagatattgctttaccaaatactggttgccaaaatgataacccccaaaatgagaggagaatgactgacattcacacaaatgaaaattatagcaattctgctgtgtccccagttaatgtcgtaccaccttcaggtgctgcctttcctatggtctcaaaggaaccgtatccttatttaagcatatctgtgaagggcctatatacaggcatggtagagattgagagattattttccagagcttgtgattcgggaaaagaagtcacaagggttctcgatgaagataaattacagtttcgcgccctactaccacaagaaacaggttagatatcttgcaatgcttttttctgttgcactatttcttttcatatcttctcttgtaatttgaggtgcacaataatttctggcagcgcgtggatcagcatcatctagttttctgtcaacattgtttgcctgctgcagggaggatgtccctcttcctgaaagtaagcttttttttccatttattagtatgaaattctatttcctgcactgctcagccctatgtactccttttttttatagacatatgacatatcacatggaacttgtaatgtttctgtgtaattgttcttattgtcatactcctctattgtaatagatgatatcatactctgctattgatctcatttagttttgttttttttaatctctcagctattgcattttccttatattgtaacaaatggtgtctcatatagtcatatcttagagtcaagattgtccgtcgtaatttgaccttgctgtttctttagtgttctattttcctgtgtaaactgtaatacctgtgtgttcccactgtacaatgaatttaatgtaccatggtataatgcagctccttctcaagctgaggtaaaataccttacctggcataggtcagtgtcttcacagttgtcgctgtctagaaatcctcctggggctattactgtcatgcatacctcaacactagataaactgtatgcatgggaggaaaagctttatgatgaagtcaaggtaattagcttttttgtggctactctatgtgaaatacctaaatcttttaattttggctgacagtttaatccattttgatttatgttccacatgtctgattgcttgtcacaacatgactttcttttccccgcctttcagaaaccatcgaatatacattgattcttctgattaatcccttagctggaactccctacattgatcgctagaattcatagatagattacttgcttctttaatcatagaggtttcagatattgtattagtcagagtttatgcagtttatgactagtggtagtgattttttgtcaagaatgttcaaataaaatctgataattcttctgaagtttcacaccaaatgattatcatgattctgctttcaggtcaacagtgccatatgcaggagatatgatgagaaatgcaagcaactgagagaccaggagtcgagagggaaaaatcaaattcttgttgattttacccgcgctactgtaaaggatttgcattccagaattctagtggctattcagaaaatagacttcatttctaagaacatagaagacataagagataaagagcttcaaccacagttggatgaactaatcagaaggtatatttgccgattcagtttttatagaataatttgtagtttgatgtgcacaagaagagagtattgtgtgcttgagtgtcatgcattgtttcaggattttctcagactgttttaacagaatgcaccaatcacagtatgcagtttgcattaaactgacagctatataaatctgacagtgtctgcctgtctttactgtagtttaactaggatgtgggaaacaatgcttgagtgccatcatcttcaacttgcaatcatgaagctagtatccagcaaacggagtgtaaaattatcatttcagtcagagtctgaatgccaagatgcccttctcctctcagctaagctaattaaattatgttcagacttccaaaactgggtggcatcacacaaggtttacctgtctagccttaacttatggctgcacaagtgcatgaaaccgctgaagaagaggaagggctccaggaagcaaaatgttgttgatgtttctctaacagaatgtgctgttgcacccatatttacaacttgcgaaatctggattaaattaattgacgatttactgaccaatgagttggtgaaagccattgaaaatctcgttgcagatgtcggccgttcctttccgcaccaagagcaggtgctaaatggtgaaacaggaggagaaatcctgagaaataatgcccctgctgatgtacagtcaagtctgatggcattcttagagaagcttgaagccttttcagcagtttcactgcagaagtatattgatctgcagaaaaacatcgacgaggcaaaggataggttttcgagagaagattaaagtacgattgcaagtagctcaagtgagctcttagtaatatggccccccttgagttggatgagtaaaatgttccatatgtaaattcctggttgtgatgatattgtgtatcgagtcgttttgtcagttgtaaatgttttgtgtagtctctggtgggagtatggggctacagttaagttagaaacatgagaggacaatacgctgtaagatactgatatgaacatgatgtatgcaccatttttccagaacagttcagtgatttgtcaatgtagcgttgaaagctaagtctccaatctcatgaatttgacgaagtacaaatgatcagtatgaagactttatgaaagaacaagtcctcttgatgcatattttagatgataccatcatcatccatgtagggaaaaagttatttctgtcaaatactgggtacctgttccaatgccccagcacccagctgggcaagtgatgtgagctgaaagcctgaaacattcaacttgcctgacagagcacacggatgcctaactagagtggcattcaactgtgatgcagattgctgctttctcattataatacgggaagggaatcagaccatgcatctgacctctaggaaacgaacaaacaggtcgagcagattcctgcctgtttaccctcgagaaaggacaaagccaagctgatccatggccaaagtcaaaagccatttgcactcaccatgatgcagatgcagtgttccttccctttgtttctcatatatacaaacaggcagcttgattgtcgagtcccctagctgctcaaactgaaaacaaaagaatactggtctactgtttgctgttcccaatatttattttttttcagcatatgagaaaatggattaggagatgtcatgctgttgcttaatttaataatgccagtgttttaatagcataatgcaggagagaggcaggggtttagaaaggtacaagcaacaaccatgcaaaaaacaaagctctgggccgtacccagcagctttccatgttctgaatttttctgatgaggcattgacctagggatagggacgttctcgcagcaaatacattacatgtcaaagggaattatgcgacaaggagatggtccaagcttaattgctttataattcctagggaatccggcatggttaggtacagttattttagtttttgtgtacagatgattatatatcttatatatactcctagctagcaatctttgttaatctgaaggtgttagttcagtatattctgaaacatgtacgactgatgctattacaaggaacaagtggatgaggagcaggtgtgataagtcaaaacagcctagtgtatcatcacatgaagagagctctctgatgatgtgcatggaatcctttaaataatgcacagtggatggccacagcatggtgatctcatcatgccctcactacttatgtcatttcttttccaatctaattgccacacattttatcttttgctgatgaaaatgaagaggactgatgagagtttcaggctgtctctgaaaacggttcaagtcagaacaatcataccgtaattttctcccttttctgcttgatcagcattcaacaacggatcgcattctggatgacttggattacgtagatcattgaacaagtaaaatacatctccgatgtcaaagtaggttttcagctttgcagttgaaactgacctatgcaagatgtgctgattagtgaggtaatactacgagctagtggaagtaatcaagtgtttgatggacccaatgacacacacaaagtcttcgaaagcactcaatcacaagggaatgcctcatgggatgtcttgattaaactaatttagccatgctcctacctctcgatcggtgcaaagctgctgcaacttgtggatttgtagtagtgttgactgctagcttgtgggttcgagattaattggagtgggtggctgctgaactgttttcaacgctgacaactgccggaaaccgtcaaacttgttcagttttgtgtaggagtaatctataagcctccgtccatgctgtcagctcgcctgttcatcctgtgcgcctctcgtccctgtgtgctgccatatgctgctggtcagctactatcgcattctcagaaacctgacgaatggcgatgcagtttgttcagagaacatctgtccacgccttgtttgagtgttcagactgatttccgtagtctgaatcacagtgttcagaaaacgaataaggctgtcagaagcattaccaaattgccctttcctgattactcatctaataatttcctgattgatttacagccttacgcaaatatgcacatgacagcagagcacagtggtggttattgaagaaggggcatggaagatgtgcagtcgcattttgaacacacatttggacttgtgcagaggtcaacgaatggtacagcatcgatgaggattacgcaatttggtttgagctcaatgtcgtcgtcgcctcacgagaccgattccatacagttgcagggtttgattattactattgttttttattcggtggacagacacagttacagaatacaacatttttctttttctgaaactgaagattatagtattaaagagctagagctggagatactccatataggcatcgtggaatcattcaaatcgttggccggtggtccttttcactggataggtgaaaactgcaagctcactcatttacactgatttacagtggacgcatagaatcaccgtcagaaaagaaaaccaaggaagaaacgaatattcagagaaacgctttcaggtaaagttggcaccgcaccatggacagaacgaccgatctcctctagatcttggcagaataataatctggtgcagtagtgagtaataatatatctcatgcggttttgtttggtgacgttacggcagccaatataaagaagagatctttaaactttttctctgaaagaagaaagaggaaatctttaattaggtaatactccatccgtttcaaaatgtttgacgccgttgactttttagcatatgtttgaccgttcgtcttattcaaaaaattgaagtaattattaattcttttcttatcatttaatttattgccaaatatattactatgtaggcatataattctacatatttcacaaaa

SEQ ID NO: 42761 - DNA, 42465 bp, Oryza sativa
  unsure (1)..(42465): unsure at all n locations
catatttcacaaaagtttttaaataagacgaacggtcaaacatgtgctaaaaagtcaacggtgtcaaatatttcgaaacggagggagtgtggtttaggtgctagagctagcatcgatcggaggtggatagatggatgaatggatgcagagtgtgatggacaggtggattgtgattctgggtagggcaaatttggccatttttgatgagcgaggttgatcgagaggggtgtaggggctagctaaggcaagctaagctaaggtggagtgtagagagagatctttgatgtttgggtgggtaagggagaaaaagaaagaaaatctggtgagagcgacaaggagcccaccccctctaccccccgctattcccgcgattgtactgctgattagccgggaatggatgctcgatctctcatggataatttgcacatataatgtgtgctactgctgcctttgtttgttacttacatatgctgctgattgctgctcgatgaaaaggatggaagaaaataaaaaaagtttgaaataaattgtgtagtattagtggattcgactccctgttccttctggtctcttggcagttgtggaagaagcggaacttctgcagcctcatcttttcgcttatacttatgtttatcagccaaaatttgaatttttaacttcaattttggagttgattttgagggtttttttttcatcgaagtttatttgtcaacctttacttttagatcgttaagaatatgtatataaaagttgtatttcacaaattatttttcgtttgcaaatatgttgtttcgcttatcccccgataagtgaacgatggggctacagagttttcgactcagccgtctcctcggtctttgtgcgtgcttgtagtgtctgtccactcagaaggtcgtatgcggtattccgctggtataacaacttttaggggattgctgtgagtgtagcgtggctccgcctcctatctctcgtttgtttggagtatcctttgtttcatagtagcctcttggtttttcgtccttcccccatcccggcataggcctgtttagtcgattgcgttgtgtaattaaacttaatatattaacgtgtaatcttttacgcgttcacagaaaaaaaaataatattaagtggatgcataggtgagacgttggcaagcatattgcggccgacagacagttgaaaggtcgtgcatggcgaagagaagagactgttgctggcttgctcgcttggccagcagcacagggatcgagcgagttatacctattccatgctcgctacagttagtacgaaacacttggcaattaatcaattaatcagcaactagtactccacatgcatgcagttgagttacctgaaatcgcgaaatggcacagcatcagcatgggctcccaaaccaaaccaccaagcgatatccaataggcgatggatggcatatgccacatgccaccgtcgcgcgtcgacagcgccaccacgcgatacggcgcggcgcggttggcggtggcctccgacacccagacaaaaagcctcacctcaccctcacccgcacacgccgacaccccgacgcgttttccactgggtcccatgggccatggcctctctctatatactcggcccatccccgcctcctcctattcccaccttccacctccacttcctcctctcatcgaagctagctgatctgccatggacgctctctcctgcctggcgccgcacgccgcgctgctgccgtgcgcggccttcaccgacgccgacatcacgcgcgcgctccacttctcctcctccatgcccgacacctcctcctcaccctcctcatcctcctccgcggccttcctcgccgacttctgcggtggtggcgccggaggagggttcgtggtgtcggcgccgccaccgacgatgccggcgatcacctgcgagtccgttctcgtggccgacagcgcgcgcccgtcgccggccgggcctgcgcggcggcaccagcagcagcagctggggctgggccccgcgggtgggcgcgccgggaagcggcggtcgcgggcgtcgaagcgcgcgccgaccacctacatcagcaccgacccggccaacttccgcctcatggtgcagcacgtcaccggcgtccaggccgaccccgcctccctcgccgacggcgccgccggcatccttcccaccaccaccaccactgcgccgttcgacgcctcctccggcctccacatgctcgacaccttcgccgccgccaacccgctgctgcaagccgagcaagcggcggcgcttcagcagcagccgtgcttccccacgctggactcgtcgtggagcgccgtcatgtacgatggcagcgacctcctctgagcattccttcattcccagctgctgctgctgcactgcagtgccaacactagttaattaggacgccgccgccgacgacgacgacatagctagtagatttcttgctctcgatcgcagtggccggcctagctagctctacatcgatcgatcaatccactaccatttcttacttgattagtttgtcgttggagccaagatcgtatcgatgatgctcgcttgatcaggttaagttgttgagttactgtagggtgttactactagtattattgtacagctagcgcattatgcatgtcatgtcgtcgtccgtcggtcaaacggagtgtggctgctatatatgcccacattttatgcagtagtagctgtctatagctgatctcagttaatttaatttgtactacgtgtatgtcaaagctaattagtcagcagtaaaacatcagtttctctcgcaattaatctggtgaattctagaatgcatgctaaccatcgtactactttcgtttcatattacaaaactttctagtattatcaatatttatatatatgttaataaatctagatatttatatatgtctaaatttattaatatctatataaatataaatataagcaatcctaacctgaaacggaggaatcacatgcatagacaacgacttgctccgtgctggagtaattcattggctcgcaagacctgcgtgttggaggtagttgcagctagcttccaaacccacgatctggacatcattttggatttaagctatatatctgcaggttaattaattattattagtcgcaagaatgaaagatcgagagagatctgttaaagaataaaatatacggtaaacgagcgtactcaattaatattgccgcctttttgataattgaaatgagcacgtcgtgggtcggtggaattgacctggtcgcaccatggatgctgctgcttcgtcatcgacagacggatcatgtatatgatccgatcgagtggagatggaaggccgaggggtttgggccaggcccattcagtctcttgccgcctgtactaggcttttctcatcgataatatatgtgggcccatactaactaaaaaggaattttgcactatttatcacaaaacttcatgtattttacactatttatcataaaactacagatttaagagcttgtttcacaaaattatagatttagtgtctctatttatcacaaaactatatgtattttgtacaatctatcacaaaagaacatatttaagaacttgtttcacaaaactatagatttagtgtatttgtttatcatagaactacacatttagtgtcttgatttatcacaaaactacatattttgtgtctccattatcacaaaactacatgttttaacctgtagttttgtgataatgaagacaataaacctgtacttttgtgataaatgaagatattaaatctgtagttttgtgaaacaagttcttgaatctgtacttttgtgatatattgtgcaaagtacctgtagttttgtaataaacaaagacactgaatctatagttttgtgaaacaagttcttaaatctgcaaactttaatcagcctaaaagtacagatttaacaccatatttttcataaaattgtagattatagcattgtataaaaaaatgaagattaaactcatttctgttacaaagctacaacttttataactttaatagggctatggttataaactctaatatcggtagttctttcataatttcatcactaaatatataactttgggatacgattccttaaatatatatagttttgcaatagtttgtttgaagtacttgtacttttaaatttactcttttacctctcgccgaacaacacggccccggcccatgataattccatcaaacgaccgctttacaccggaattgctatttagtgcagcagagttcttaactcattttttttccattcataaaagttttcgtgtgaacattttttgaacaaaagtattcgagacgaaagtttaaagaaaaaagaatgcgctgggacctgggagcctggaaacacaatcgcgctaaatagcaatccccttcacaccgagatgaaaaagtctgcacattaccactgagaaggcccacaaataggaagcccaaaacctttttgggctcccgccaatttagcccatcggcgaagctgtctccagtccacttgaccacttcccagaactgattttattttctgggcgaaaaagaaaaaaaagaaaaagaaaaaaggttcgcgtttctctctcttgggcagccatggcgtccccgcggccgccgccggcgagcctgcggagcttcctggacgcgcacttcgcctcccccgaggacctcgcctccgcaccggcgctcgctgagctcctgcgccgcgagtgcgtgggcctggatgcatccctccgccgcctcgaggcgcagctcgcgtccgtatccgcctcctggctcgcgcgctccgccggcgctcgcgcatctctccgccgcatccgctcccgaggttcgcttctctgaaccctagtacggtttttgtcccccttttgtttcgttctggatttgtagggacgctcactgttacagtattattgcttcggggattccgctcgggtttcaacggattttatcggtggtaggcgggggattcggagtggaggaggatgatggcgaggagacgctgcggagcgcggagctgccggcgcttgtgcaggagatccatcggatcgacgccattcgactctatgcgggtcagccttccttcgtctcttcgtgctttcctattaacttgaaaattccgatattggatagttacagtgctaacttttgcaagttaatttggattatggggtcactccgattttagaaaaaaaaaagctcttagaatttcagtggtgttttacctgccaaatcagttctgagttgggcaatagcaagttacgcttgtgtcgagtaactggaatgtcccaatcttggactagttacaatattaaatttgcaaattagtttggtagatgtagttgttacctactaccatattagcctgtatgcttgagcattgagtaacttatctatgcattgcaatatggatctcttgatgaattgtttcttcatacttcactagacactaagtacttccctgaaataaggcactagctacaataacctggcaatgcacttcacgtgcccacggcccacccaccactcaatctcaaactactgtaacttgatgatgtcaatggagaatatctgtgttaaacaaagctattatcaacatcgagtttttttctcaacaattgttacatagagtcaggggcggaggcagcattttagctagctgaaccatatagctataaattttttgtgcaaattctacgtaaatttcagtgtttctccattgaaaatttttgccacgtgtggggcccaagcccaagctgccccacacgtggctccgcccctgcatacagtgcaatgttgaccatgacctttaaactgattaacgcggattacctgccagtgatctccatgggaacatgccatttgcgctaaagaatttgtttggtgctgcaaattatattatgtctcctccatcatatccggcatgatgtaggaatttgtagtaccttctgtaacttttctatgctgacattccagaagctgctctacagttggaagcttttgttggtaacctagaagatgcaacgttttccatcgttagacaggcctcaaagttgaacttgtcctcggtatttaggccagcatctaatgtgagaagctgagaaaccttctctttcctttttcttccttaattgttattttaggtacaacctacaattattggtcatgccgatatgacgtctgttagcagtatgtttgtttgatatgttaatcacgcttttttttctctctccaaatgtaggaaatgcaatggaagcaagaaaagttgctccaggctgttgatgccatgagggatattgaactagagttgctacggatcagcacgaataggccacaatggaccaatcttatcatggctgttgattctagagtggacaaaaccctagcaattttgagacctaaagcactaacagattatcgagctctacttgcagcacttggctggccaccttccttgtcttcaccagatgcagcaaataataagtactcggaaattccaaaccccctcatcttaatgaatgaggcaaataaagagaagtattcacaaagttttctagcactgtgtgctctgcaacatgcgcaagccaactgtgaagcgcgtcaatgccaagcgaaaggagcaagtgctagcatgtcagattcaaagtactttgataaaactgctgcatgctttgataatggactttgggcaattgatgagttggttcagcctattgcttccaggttggaatatcattttgctaaatggtctgaacagccggagttcatttttgcccttgtttacaaaatagcaagagattttatgggtggtgtggatgatatattgcagcctttgattgatcgagcaagacttgtgggattgagtgctaaagagtcttgggtaactggaatggtgaaaatgcttctaggttaccttgagaggcaaattttcccagtccttgtcacatcttatcaggctactgatgacaaatttgaagtacattcctcatggatgcacttgaatgacctgatgattacttttgataaaagaatgcagttgcttgcagattcaggaatacagaagatagcttcaatttctgaaggcctgtccaggtccttatctgtcttttccatatatagcgagcattctgattggcttcacatgtgggctggtgtagagcttaattctgcacaacataagctcaaatctgagatggaggatgagataaattggtcatatagtattaaagagcttggtctacaagagatcactagtaattttcttctgtctacaagagaagattacaaagctccaacaatttctgaatttgtggtcaaaactgcatctgctatgattgaaagaggccatgctctgccaaataggggattaaggattcagtataacagatcctcttcagtccagttcctgagtgatttctttcttgtcttacgtgaacgatgtgaagccctacaactgacaaatacagctttagaagatgattctttactaaaagcttcatttgcaattaatgctgctcgatattgtgaatatgttcttcgggaatgggatgacgacatagttttcctggagatgggtgcccataggaaacatgttgatgaaggccagggacaaggccacaaacacagtgcccaacatccatgttctttctttggcgatgaaatcgccttcttggctaaattggggaccgattatctggaacagattatgtcttccgttctgctcgagtttgaagatctatcctgggactatgtccaaaacattggattgcccaatgagcagatccatccagttgatgaggtcctggatgaagaaaatctcggagtatctcctggatttgttgcctctctagaagttgtgagagacagaaccaccaaactgatgctacatcttaattcgaaggatttccttgatctgtggaggagtatagcagaaggcctcgactacttcatctacagcagcatacgatggggggagttgacattctctgaccaaggagttgtacagctaagagtcgatacgaaggcccttctccacatctttaggcccttctgtttaagacctgaagccttttttccattcataagtgattccctgaggctgttagccatgagaaagacagatgcacgatacctgttggaagtgctcaagaatgccaaggagaatgacagttgcctgaggcaacaaggactgcaacatgtaaatgcaagccaagctatgaaaatcttaggtagcaaaaggtctgatggataatcttcttaccttagcgtagaagacctgctggagatgatcagaatatgattttgcctatgctgggctgctctatgtcactatgatgacggcaatcttctgcctgtcctccttccaggaaacatctcttctgagaagtttaacacgtggttagtggttaccggctgcaattccaggcccactccaaggataatgcgcctgttggaacgcaggatagcaaaacagtttgcgtttcaagattgaagagacttatctggtgttcgcagcagcttcgcgttgaaactagttttggcatgtactacattctctccagggtgatgagacctgcgagtcttggacgacaaattggagatggccgctttgcaacgcaaaagtccgccgccgccgccccctgtttatcgcttctttgaccggctcgatcgtaatcaacccaaacacatcatgttgcatgcaaagctagcagatgtaacaacaaaatattcaagatctcgtctgcctcaaattctctgagtaatatagtcaatgttcaccgtctcgcagactatgattatgtcgcatatctcatgtatgccgtgttaatcctgatccgtaccttgaaaaaaaagattataatcttaatcttgatctacctggtcaccagttgcatgtacataaataaaaccgccagatcgctctcctttgactccaattgtttgacgcagcgaagatacgaggatccgagcgtacagtgcttgcagatgccaatctatgacacccattaaaactcattctagtttgactaaaaatttgtttctatgtttttggtttcttcccagttcgactaaaaaatgtttttatgtttttggttccattccagttcgactaaaaatttgttttatgtttttggttactcctacttggaggagaggccaacacaaaagaaaaggttgtttttatgtttttggttactcctgcttggaggatagaccaacataaaagaaagaaaatgtcaattagaaataatatttgctgatcaggtcaagaaagatgagcaggagctcatgttgatgcacatgcatctgactttgagcttgcaaaaatgtagtttcttctttctctcgaacacagaaatgcagactattgataatatattttattgaaccttgtgagatccatgccctgaatcctgcattctacggtcaaagcccaacaatctgtagaagatgtgagccagtatctatcagtttgaatgtgtcaaaactgaaaagcaataatcctgtcttggtaaaactaactgcaggacaggagctattttgtgctagttaccggctacaagcagacagatcttcaacaactgaaaatgatgtgatagtgcacattactaacctttttcacactaatgtggatagctactagaggactactgattgttctgttcttgtcctttgtgagcactagtttgagctgttactgaatcacaccttttgtttcttccagcactgtactctgcagttgacaaagtagcaaattttgccacctgtttcagtgttagtgctgtatgatgctactagtagctgctaagcaataaagtttctctccgaaaccaaagaaactatctttttctgccaacatatgtattttttttcttctacccaacatgttcaaagttagaagctgtcaaagacttgcacctaatgcagttcccattatgaaccattagttttattaatggtgaatgccttgcctgcatcaaattaattgatggtgtttaattaacagggaaggctacatctaattagaggtaattaatttatcagcactttggttgactgacaaaactggaggaagcctccaagtaggcatctagtactagacatgtactcgtagtcagtcaactgacagtttgatcagtcatctctatcccttgaattctttgccttcctgtccatatattcttccatgcctcccatcacaacctaagaccatactccattttggagttcgcagcaactgctcatctgggattgcagttgcaggtgatcaaggattaagaggttcatccaaaatggggaactgcatgggctcatccaagtgcgccagtgcatcggctccacttgaatcaagtaagatgctactctgatatatacatcatatttctgttcgtggtttgattagccaagaaacatgatgaggaagaagcaatcaaatagacaattagcagtatccatgctgatctatgtaatatggtttgaaaattattcagaggttacgagaagcagcaactcgacgacgacgacggacaacacctccaaggcatcgcagcgcagctcgtcggcgttctcgtcggggcagttctcgcgagccagctccgacgagtcgtcggcggcgccgtcgctgtcgtccctcaagtcgttcaacatgggcgacctccgcgcggcgaccaagaacttcggttccaactcgttcctgggagagggcgggttcgggtgcgtgtacaagggttggatcgacgagctcaccctcgcccctaccaagcccggcgtcggcaagatggtcgccatcaagaagctcaagaaggagagcttccagggtcacaaggagtggctggtaattaattaattaactaactacacttactaatcatttcaacttttcattgattaattaaccttcgatcacttgcaggcagaggtgacctacttggggcagctccaccatgagaacctggtgaagctggtgggctactgctcggattccgacagcaacaagctgctcgtctacgagtacatgctcagaggcagcctcgagaaccacctcttcagaagtgagtagtatatagtacactgtacactgatcaaatcgaatcgattcttcaattcagaagtgaatgtaatggatgttgcatactgtatgatgcatgcaggagggacgcagccgctgtcgtgggcgatgcgggtgaacatcgcggtggacgtggcgagggggctgtccttcttgcacgggctggagaaccccatcatcttccgggacctcaagtcgtccaacgtcctcctcgccggcgactaccgggccaagctgtcggacttcgggctggcgcggaacgggcccaccggcgacaagagccacgtgtccacccgcgtcgtcggcaccaggggctacgccgcgccggagtacgtcgccacgggccacctctccgtcaagagcgacgtctacagcttcggcgtcgtgctgctcgagctcctcacggggcgccgcgcgctcgacgccgcccgcggcgccaccgccgagatgctcgtcgactgggcgaggccccacctcggcgatcgccggaaggtcaaccgcatcatggacaccaggctcggcggccagtatcccaagaagcaggcgcaggacatggcggcgctcgcgctccgctgcctccaccacgaccccaagctccgccccgccatgcccgacgacgtgctgccgcagctgcgcctgctgcagcagaacaccaagccatcctcctcgtcgacctcggcgccggcgcacaggtcgaggccattccaagcgctagcgagctagctagctaggcgtcttgttaattaattacttcgtcatctctcaattactccagtattatttgtttgtcaatttcatgctagcatagtagcatgtggtgtctatacagacaaaagaatcgatgaacatctagctacctagtttgtaattagttaggtaggagatatatatcattgctgtgtgaaaattgtgaattatatattgctagctgcaaattaagtagataatattattatagctaggttcagaaattccatgcatttgtgtgcatcatcagtatagagacgattgaggatttgtgatttgttttgacactatgttcttgctttcatttccttttaccatcaaatgaaggctttgtttgctcatgccaatctgttgaacttcaattgattaattacggacgctgttagagtttttatcgaatatgtgtacagagtcggttatagttcagtaattggagttgtactaggtatatgaatagagtaagagtcagaatctatcctataatctcttttaaatagagagacggacctgttgtaacctcatatcgacttagcataacgagagagaatagctgccggtgacggccggctgtgagccgttgtaacttgtaactttgataagcgctataatatgctggatcggggaggagcgcctgtaatcagtaccccgaagatataggcttcggctgaacctcgttaacaaatatcatatctcggtatcgttattgtgtttagatatcctatgatgtttcttccgtgtttggtgagccggttttataacagacgcttctccttcatatgtggagtaattagcagcttcaaaatggttcagtcagcgctcaagacgtgcacgctacacacaattagcctagtcatacagcataaatcagacgacaatcagtaataatattcggatttgctgcctcacttttaaccgtgcctaatttcgcatcttcgcgctttcagaaagcaagaactgattaacaccactattacgatatctgtctaactttgttaaactggtcatgatctcgcatatatatagatggtatccacacactttatactttcaaaggacagtacgtattcacacactcaagtttcaaaagatagtattcacacacgaacttggtgatatattgactatttgactagagtcatccatttcatcatgattgcgcgccgtatgttgactaaaatgacaatcacttcctgcaataacatacacccttcatcctaaaaataattaacttttagaaatatatttgaacgttgtctatagaagttgtttttttttttgacatatggaatacgaagcttcttttgtagatcaaaagaggatccgcttcttttttttcccctagacaatatggcatagcgaagaggtagagagttaattcagtgcattataaggaaaaaagacagttaatttaaatcggcgactctgttagggcatcattacgagtaataaatataatgttcagtgaacaagaccactgaacttaactctgtatgatcactgaaaggaggacaattgatcttgagtagagattcgatcaatttaggcccaatggattacagagaggcctaattgcaaaaacgagcccattaggcagtttgcatagacggactgggctttgcattttcgccgggcctattgggcttttcttaggccatcatggactggcccacggaatcactcccgtcactcctcgagtccggcggcagcggcgccggcgctggcgacggccacggcgaggcgtatcggtattggggagcggcggctagagagaaggtggtggcgagatgcggcttggccacctactcggcgtccgccaccgtggcggtcatgcccaagaacaaggcctagggaagcaactgcggcgaccggcagtgccgcggcggcggcagcgagccgtatcggggacgccacggcttgagaggcggtggcggtgagatggtgaggttggccggctgctccccacccgccatcgtggcggacattccagtataggtacggcaaacctatgcacaaacaaataggcaactatcttgaatcagattcagactgatttccttcagaattaagccaagcaatcaagcaccattgatttttcttcttgttttctccgactctgagaatagtttttcgtgcgccatcttatcgaggaaaatgacggcacctggttttgcttccccgcgacgtgcagcagtggatggagaagtaagcttcaaacagaatgctgatgacgtccctatcggttcttatctcagttcctccccttctccttcttgcctagctttgcttccactcatgcaactgcttttgcacaacttgatgatgcatgcctcgatcgtctatctcatcttgtagtgcgtttcggcctttcaggcatatatatggaccgtgcattgagttggtgtgagctgcgagctcattgagcacaatggcagtgcagagaacagatgctgcctcttggctccgtgagctggttcttgtttacgccatgtgctggacagtctcactgggttttgttgcgggtcaaaccgggcagttgaatgtcgatgcctcgccgcagaatgcaaggaagatccctgataagatgttcggtatatttttcgaggtgagactgaatctggatattggtatctgtttagaacaacatttgttttctcactcaaaaagaaaatagaacaagcatttttgttctaaccggtatacgaactaaaagggacaattacttgtataaacttggtgccagcacaaacatttttcctagttgtagaccatattgttcagatagcatttctagttatttactgaatctcatacaattaaagtatgcactgtttggaacacagttattttctcctgatttgcaacattttcctatatatagtacctgcatatcaaatgaggttgcttcgacttctattccatgctgggagcttgaatatatttgtggttctacttgtaggagatcaaccatgctggggctggtgggttgtgggcagagcttgtaagtaacagaggtaaggcaaagcatatctgtgttaatcaagatgatagaagttatagaggagcttgtaagatgataggaggaacagcggtggttgggatatcgtacttttgcttaatgtttgtagtgctcaaatttatttccaggttttgaggctggtggacctaatacaccttcaaacattgacccatggctgataattgggaacgaatcaagtatcattgttgggactgataggacatcctgttttgagaaaaatccggtggcacttcggatggaagttctttgtgattctaaaggaaccaataactgcccttctggaggtgtaggagtctacaatcctggttattggggcatggtatgatgtgtttcttatttatttatctgtccgtctacaattttttttgaagtttccgtaatcttatttgacagtttaaatttgatctggcgtgtatttaactgattaaacatcatggaatacactatatagtatttcttcacattttccagaatattgaaagaagaagggtttataaggtgggcctgcacattagatcttcagatgcagtatccttaactgtttccttgacaagctccgatggtctgcagaaactggcctctcacaccataacgtaatatttatgtttccattaatatcgctgggatgctgcatttttttccctaataattgcttgaatttccatgttgcttccagggctagcaagaaacagtttgctaaatggacaaagatagagtttcatctgaaatctagccaaaccaatactaattcaaggctccagcttacaaccagcaaaagtggggtgatttggctcgaccaggtgtcagttatgccatcggatacctacatggtatactttattcatgtctcattttatttcttttggtgtaccattatctttacttatttcgtgcttcagctgcacagttttgcagactattcatcagtaaacgccagtagacaactatgatttttttaagagcaaacccatcactatactggatggcccatatcctataagggaaattccttttttgccgggtctataagggaaattcctactgagttgccatcagatttacaggtgttttatacttatcagttcccaccttttattcattgttatgttttcattttagggacacggttttaggaaagatctcgcttctatgttggccaatttaaaacctcaatttcttaagtttccaggtttgccaactttacatcatatattttttttctgaagttaggtatatcaatattatcatatagttttgataatatgtatcaaacttaggtggtaactatgccatgggaaattatctgcgaaatgcatttcgatggagtgaaactgtgggtccatgggaggaaagacccggtcacttcaatgatgcctggggatactggactgatgatggacttggattctttgagttccttcaggtaattggaacgtagtccatgacttcaaaactaatatttattaaaatatacttcataagttcatattgatattcatatactgcagctagctgaagacctcggtgcttcgccagtatgggtggtcaatgatggtagttcaaatctccatggattattaggtacaactaacactctgtttcatgttgtgtcaataaactattttcaacattgcaggagcaagccaaaatgaagaggtatctactgcaacaattgcatcattagtgaaggtttgttcttccaaaatattcaatcctttgataaaacgatcaatctagtacatcaataccttgttccccatttccttcgttcttgtaatgttcaggacgtggttgatggcatcgagtttgccaggggagggcccaagactacatggggttcagttcgtgcagcgatgggtcatccacaaccctttaaccttgactatgtttcaatagggaatcaagaatgctggatgctctattacagaggtctgtagctcttcagttgcacgtccttcctaacttcataccaagaattgatgtttgaacttaatgcatcatattcctgtacttcatgttggaaatttttgttaatcgaataatgtcatgtttgtgcttgcagatgatagaccaagagtttccttttccttcttatacatcaatttttaatagcgttttagtcctctataagataatttgtaaaataatttcatctacctttatatcttgtgggtaagcagggagagctcatattatatgatctttcaattaacaggcaattaccaaaaattctattccgcgattaaagctgcctatccagacatcaacgtcgtgtcaagttgtgataaatccactatttctccgtccaaccctgccgatctatatgatgttcatgtaatgtctattcattatgttcctttccttgtttgttttcacaatttcgtgttttttccaaattatggtttcgtttatggctgacaaaaacatcatctataccacaggtttatacctcatctagtgatatgttttccagaactagtatgtttgacaatacgacgcgcagtggaccgaaggtatgctcaaatgttatccctacatctgatatacatagatacttccactttccatgctcagaaattgacttggggagctctatgactctttaggcaattgtaagtgagtacgctgtgactggaaaggatgctggcaaaggaacactggtagaagcactagcagaggcagcatttctcgttggattagaaagaaacaggttaataatcatactttttttagaggaatatttatacttttattttctctccatcatggatttctgctgtgtaagctctgccataaattggtccatgataccaaagatttgaaactgcttgaagattaaagctttgggcatcaaagggcagtgtgaacgaacatgcttccccttcaggctaccatgtctgggctttctgcatcactggttgattgcattgcaaagataaacattccgtaccttgttttcctgcagcgacgtggtagagatggcaagctgtgcaccgctctttgtaaatgacaatgatcgcaggtaaggatccaacaactcaggaattcttatttttcagattgctttctttgtgtcatatctgactgagttcacaaccctcaaaaataaaatgaaatgatgcataccatagatggagtccagacgcaattgtgttcaactcatggcagaactatggatgcccaaactactggatgctacatttcttcaaagattcatgcggcgcaacgttccacccatcaaacattcagatttccagctacaaccagctggttgcatctgccatcacttggcagaatagcaaagacaagagcacttacctgaaaataaaggtgcgaactttgttaagctgctctttgtttcagagagagtgagctatgcattggtttagcttggaaatgaccaagtgagcacaaagcgaaactttttttttttttgcagctagtgaactttggcaaccaagctgtgaatctcagcatatctgtgtctgggctggatgagggcatcaagagctcagggtcgaagaagaccgtgcttacttccagcgggccgcttgatgagaactcattccagcagccacaaaaggttagtacactacacactgactgacagctgatcatgtatcctatcctgtaaattaaacaaaacagatggtagtaactatattgaatgtgtacgaaattgttgtaggtggcgccagtgtcgagcccggtggacaacgcgaatgagcagatgggcgtgttggtggatccatactccctcacgtcgttcgacctgctgctgcaaccgagcaagcactcgaccatatgaaaggagatatatactgtagtagtaatagtcttaagaatatttattagcctgcaaaaagaggggaaaagagaataaaggaatgttgatggggggcttgattgctcaggctaactgcattgcatggaacataatatgcccatcaatattcttattcgattcagcccaagaatagagagatttaccaggtgagggtgagtcatccgactcaagaattgttgtttcaatgaaattcagattagctgacgttgcaccgcatctgggatcttggctggcacacagcatatgtaagtatgtacatacgtgcataccatcaccacctgctagtgctaggaagcttcctaaattccttacagtggcaatttccttggcttattaggtcgcataaagctataacataatggtatattacttgtcaattgtattgctatgcaattttcagatgtttggtgtatatatagctgtatacgcgtcacctaaagtgcacttattgtattgttcgatcgagacacccatatagttcaggctatttaacttactgaaggcgaaatctcctggaaaatacatcatcttagcttgcaatgcagtgcgttgattgattgaactaccgatagctaaccaggctgctgatcggcgaccgctgacaaaaatatgcttaattaattcccttgtggctgacatgatagatgacgtataaattaatgacctgcagaaatgcttaagattaattaacggcaaattgtatatgcttaacctccacagttgactgctccaattaaaattcagacgtgcgcgcatctgagtttactcaagtttttcacatcatcgtgctaagcatgacgtcatgttctgatgtgcatgctgcagatgcctaaaaatcaatgcatttgagatcgattcatgtgacctgaaaaaaatcaagctactccatccgtttcacaatgtaagtcattctagcatttcttatatttatattgatgctaatgaatctaaacatagcatcaatataaatgtgggaaatatatgtctagattcattagcatcaatataaatgtggaagatgctagaataatttacattgtgaaacggaggaagtaacatgctaaaatggagttaaacagcccggcgaaaaaaatggagttaaacaagctagctagctgcaggtcaaggcagttgtgttagcctatattgattcccaaacaattcgcgtcttcaatttcctcgtacctacgggcgatcatcatcttgttctcttgtattgcaaagctaagagagagaaaataatctgtcaatggttaaataaaacctgccatagttgcatgtatcacgcgacctgaagcctctacttgcacttctcaattctcagcgtctgaccatctgatcagtaacttatgaaaaatatccgctctgttcataaatgtaaagggatgatgttggtggtactttcaaatgtaaggggtgatgtattccctccttacagaaaaaaaatccaatcatgagtgatgtgtccagatccaaactcaacattgagtttttcttttacatatatctagatttaaatttagaattgggtttctttttggaagaaagggagtagtatttgacaggaatatgataaaaaaatgaaatgccaagatattgaatggacaaaagagaagaggtgatgtgatacattttttctactcaatattttaaaatcttttaaatttatggataaatgaaagaattaaaatccttatacttcacccgtttaaaaatataacaactcctaacatttaatgtttgtcccaaaatatgacaatttcttcataaatattttctgtctcaaccaattataatcttccaccattcaattttcttatctaccttcacttctcaactaatcataatattcttctatttaattttatctacttgcttaatactcatatttaatttaaaaatattcttatattctgtgatggagggagtatatttttaacggaggaacaaatggctggacgatcggatctaagtacggacagctaaaagttgatgtcagtgcatcattaaccattcttctgttcaacttaaacatattcaattccttgattaaattctgcgggcaagagagaggagtcgtttgctgcaaaaacaaaaccaaacaaaacagctacgggcccctgtctcttcccctgtcgtctccacctctcactctctcctctccactgttccggcctcctctcctccatcctccctctcccattctaccagttcttctgttcttgaatgctccggactccatagatcacccttcttctcccaaaggtatgtccagttcttcagcattagttcctgttccttctacctctattagttacgccactcgccggaggagaggaatgctgtttctcattccagatgcaagggaattccatttggctcctgactgcgattaactatgtctccagctgcttgcatgtgcagcattctttcggtatttcgttccattctgtcaaggaatacatggaaagataaaaggactcgattttgacctatttcaagggttcgaatatggcttgttttgattgaacatggctctgtgttttcttcctaatacatgaacaatgaacatgatgttttattatttgttagctagtgccttcagattttggtttctttttttaaaccggcgtctacatcctgaaatggatgtacacagccaatactttggtttcttgttttgctggttatattaggtcgattccatcagcgtttaatttctgcacttctgcaaatttttaggagattctagggactaaaagcttgcaccttgcagattagcttacagttagatttttctttcatactatttgatacaatctcagttggaattttcatttgcaatgaaatttcgtatttctactgcaatggattattgttttctccttttgattaatagctttccattcagattcaacataatgcaatatcttctgtttttctatgtgctgaccatcaaatggtcaagctttatgaaaataaatcttgtaatattccctgtcagattcagttgaagtctagtttgaaggaaggattttttttttttgactgaggaaagaattttttttttctggaagatgtataaggctaaaaggactgctgcccagaaagtaaggcgctgccttggaaaatatgagcttggacgcgcaattggtcaaggaacttttgcaaaggttaggtttgcaaagaacatggagaccggtgatcatgttgctattaagatccttgacaaagcgaaggttcagaagcacagattagtcgaacaggttattttcagagtcagataattactcacaatattttgttctactttcctagattttttgcaacaacgaaaatagccaaaagtatctagaaaaaaaatattcctgtgtacgcgccagctgtgctcatgccactctaaagtctaaactctattgcagattagacgggaaatttgtacaatgaagttgatacaacaccccaatgttgttcacctgcatgaggtaaatctaaagcatgagagacaagaatatatctttcattattaccatgttgctagtttgaaactttgtgcagtagtacacccaagccttctgtttatgataacttggattacttttgtggtgttttataacaggtgatgggaagtaaaacaaggattttcattgttctagaatatgtgatgggaggagagctccatgatattattgttagtactattatacctctgaggctctgatcccctgtatgacatttttcctttgcagtagctgtaattgaagtaatctccacttacttttttttttgcatgacaattaagtgaatttcaataacttcataaattataaccaggccacaagtggaaggttgaaggaggatgaagcacggaaatactttcagcaactgatcaacgccgtagattactgccacagtaggggtgtataccacagagacctgaaggtctagtgttaaccccattgctctggtttataagttataactatgatctggcataaacaattggaaattgacaaattgatgttttatgcatgacagttagagaatttgttgcttgatactgccgggaacatcaaagtctcggactttggcctaagtgctatatctgagcaagtgaaggtaatatcacacaactactcgaaagttaaaaaaaaaaggttcctgcacatctatattgtttctatgtcgattgattgccttttttactgtgtgtgtgtgtcaattaacttcaactctgtcaggctgatggattactacatactacatgtggaacacctaattatgttgctcctgaggtaacatttgcttgtacaacttctcttatttttctttatccagaaatgagtttctcctataataaatatctttctgttttgtaggttattgaagataagggctacgatggtgctcttgcagacctttggtcatgtggagtaattctttttgtgctgcttgcaggatatcttccttttgaggatgaaaatattgtctccctttataacaaggtaaatttagaaatttaaccaaatcttgaacaccaatataccaggttatgatacatttttttttgtcattctgatgacagatttctggagctcagtttacttgtccctcttggttttctgctgaagctaagaggctcattgctagaattctggatccaaatcctgctactgtaagttttttgacacttacaaaatgtggatagaagctcttacagaagtgacattttgaagtttgtttaaactttaaatcttttattttttatcactgattgtactgactagataaagttgcaatttggatcagtaatcagtgcccaaaattacttgtttcttcttacttggttttctttgttgccaaccagcggataactacttctcaagtgctacaagatcaatggttcaaaaaaggctatgagtcccctgttttcgatgacaaatattacccttatttccacgatgtttatgatgcttttggagactcagaagtgagttaattaatcaatagtattatatctacaagggtacttatccttttgtgcttcagatgttcataatcttaaatataccgtctaataaatttgccaggaaaaacatgtgaaagaggctatggaagagcagccaaccttgatgaatgcctttgagttgatttcactaaataagggtctgaatctagacaatttttttgagtctgataaggtaaggatcttttctgattgcagcagtatggttaatgagccagtgggcagtgggatcaaatatgcacgtatcataaacatttttcataaattacttcagaaactatgcaattattgcagtggactcacttttttatttaaacatgacagaagtacaagagagagacaagatttacatcgcagtgccctccgaaagaaatcatcaataggatcgaagaagctgctaacttactaggatttaatattcagaagagaaactacagggtatgctaagaatccttgcaagtaatgtttgtcttactagtaccactttcagctcatttgtacaaactatgaagaagttgaatatcacaatgtgagattacctttatcacccctgcgctgcgtcctgaaccatgacaagcatctcactcgtttttttctactgttctatttagatgagaatggagaatataaaggaaggaagaaaaggacatctaaacattgcaactgaggtatagaaaacacaaaattaaagaagatatctgtcacaagaaacatgaggattgatcaaaatattatcccgctgtataggttttccaagtggcaccatccttacatgtggttgagctcaaaaaggccaagggagataccctggagtttcaaaaggtatatgtctatcaatggggttactcttattatggtcaattgatcaccttcagttttgtttaaatgacaaagtaactgagcaaaattattactatgaacagttctaccaaacgctctcgacgcaactaaaagatgttgtttgggaattagaagatgcggctgaggatatgagctaagcggaatgaggtttgctgcagaatagatttcagagtttagtgctagatttctctgtacatatcaaaatttccgagttgcagtaaatccttttgttacccatgtatggatagattcatataagtacccaacaggattaggcaacagcaggtcacggcttcactgctcaccatttgatttgttccttttagagcagaaaatctactcaattttatcttccacagatgtaggttgacataggatcagtataaccatgatcagtgatatgctctgaatatttccaccatgtgtaatttgtagtatcgttgtttttggcactgtaatagtatactactgtatcaaaaaacattgtgaaatgaaagtattgtattgagagggttatttaacaggatcttctggaatggaattgaaggtagatgaaatgcaggtcagaagcgaggaattttatggtccttgagaaagtagcttgaggtaatttagtatcttaagatacttagtgcttagatgtaccaaattttatactagaaaatatatagataccttctaaaggatagtaaaattatccccaaaagcaaaggatggatggtgggcgcttgcatcgagaacagcttcgccgtaagccgccgccactcgacggagatgtggctcaccttctccgtctccggcgcacggcgtccagatacttttcctccttttctgcttcgattggttcctgtttaaattggatctagcggctgaagttggatcgttcgtgtggccaaactgcccaacttggatcttaactcgcggcccaaagttggatgggcggcagaatcaggattgaaatcatttcacttttgtttttgtttttttgccttttttgtttttgtttctgataatggaattcactcagcctctgaattgaaaatcatctcagtttgaacctcagaatgttttgtggacattttacaccaattactctctcaagtagctggagctacagtgatgaatccctgaatccatttggtccggttatgagtcgattcaattagttcccccagagaatacaagcagtacccaggcaaatatatttgtggtaacaaagtttttaaacatcttcgctaaaaaagaaagctcttaaagacttaaacatttggatagatcgagtttcatgacggactaatccggtttaatttgaagcagcaatcagctccagcctccagacagtgtcaagactgtcagttaccatactcaagctgcaatttgctccaccaggttttcaccggactctgccacggtattaccctcagatggcttctccacaattgaagccttggcaacatcatctgcattcttgatgtcttccaggatgcttgagctccactcagaaagctgcttcacacttgcctcatctgtgaatgaacaatttccactcattaatacttaacaagcaagcaatgttggtgaacagttttaagaggagtgaaaagaaaaacaagatggaatgcaagtgctgggtagggtgcatgcataccaagcctagggacagtgtggccctggggatgtcttatgatgacagggtcctcaaaggcagcggccagctcctcggaaggcactttgagccaatccttctctccaatgaaatgcactgatttcaccttgatcggatccttataggctacattgcatatgcttgggtccctgaacttgctcccagctattgagaccatgaacttgattggtggatgatcattcagtactttgccctaagtcattcagcttaagtaagaatccagatggaactagatactgcagactttgaataacatctctcatataaaggacttatcccataaaagaagtaccctgctcaagtccatgttctagtgaatgaaatgttggtgcagcttacaaaagctagcacctagctaaacgatactattcagtatttaccatagcctataggagtgggactttatatttgtactagcatttaacaatttgaagccaaaacacatcaccaacaactgaatagctcatggaaactgctaggttcaaatatgggaccttgatgtcacagtcgtttcatgaatattcacacattattgccctctgttccttcaaactacaaccaaaattgaaaccttctgcaaaattaagagtacaagtgtacctgtgcttggtaacctatcaaaagagcagaaagagttgcaccctggaatgaaaaagaaattaacagatgagctgaaggacatgagcagttgtaaacaagatgttaaacaaacagtaagggatttcggtcaaaactgaattatgatattgttcagtaagtcagtactgattaaaaaatctaaaggtctgaccacaacccatgtcttttggctttcctatgtgagtgtctggtccaatagaaaaacgtgagtacacaggattctgtaaaaaaaaatgcgaaagtttttgcaacttggatatagaaataaaataagagatcgactgcaaggagtgagtgattatctatatacagcagaagcttcagataatctagtgttgctcagtgtgtcggaactgaactcataaattacagcacctcaaaagttgacaatttaaatggtgaatgcacttatctggaatttcatatgcaaattcttggcccaagatctctagcatgcacataataataacactcaagtaccaagtgggtcaaatacgtttcatagctaggttccatttttacctgggagaatccaagcaggccatcaaaaggtccatttttcaccatgtaatcacacaggtatgaaatgcactcatccagatttgtgtattcagtgaagtcctgtgtaggaacatgcacagtaaataaatgtttgtctatctttggtttgagccaaggcacactgtatagtatagcaacaaaactgaaactatagtacaaagtaagatctgacaacgctattgcaagtgttgtttcagtttgggttccatctgaagcatttaaccttgttgaactgaaaccactcaaagtagggtgggggaaatatgccttctatctctgatttccctccagctgggaatatgccatcagggaagacctgaaaaccaggaaaatcatgtaaacaatcaacaaagcaatacaaaaacctgatctttggatccagcgtagtaccatgtcaaattgttggaagatggaaggattccatttgctgatttgcttcttcagaaaactcccacttgtccggaagccgtgcaggcaaagcaccttaaatttcttgtccagctccatgcgcaatcgtgtatgactcttacaagcacagaatacattcagaaaaaggccttaagaaggccaggagcatgtggtagttgctacctactgccatactctcagaggctgcacgcagctatcagtctatcattcaacacttataattactagtagttgttgcaacctgccaggcaaccctctttgaaaggcatgcctgcctttcccatttgctcaattcaaatccaattcaaaccccaaaagatccttctctgcaattgaacaaattcttctgcatacaagcagaagaaacatatgtagatcgaagaagagaccaatggaataaaaaaaataccagatatccaattgatactagactcgagcataaattgatgaaaaaatatataactacatacaggcccaactgcaatctggacataccaaggacaagaattactggttcacataaaacacaagagatctgaaaacacacttcagaggaacatagcaggaaaatcctttttagcgactacagctagtaggatgcttcactggaaattgataaaacaagtgttgcatcttaactaggactatgcaacacacaatctcctctgccttagagtatggttccatggctcacttggccatcatgaccttcacaaactcctcatagtttatctgaccatcaccatcaacatcagcctcacggatcatctcatccacctcctcgtcagttagcttctcgccaagatttgtcatcacatggcggagctcagcagcggagatgaagccattttggtccttgtcaaacacccggaaggcctccttgagttcttcctctgaatcagtgtccttcatcttgcgagccatcagattgagaaactcaggaaaatcaatggttccattgccatcagcatcaacctcgttgatcatgtcctggagctcagcttccgttgggttctgccctagtgaacgcatgacagttcccaactccttggttgtgatgcaacctgtaaagttcacaagcaaccaattgtacaatcaattgctgaacagtgtagtcattataactagatactaacagaaaaactaggcacacactacacttcctaataactaataataatgtcaacatgcgtctaattggatccatacggaatggactgtctgatcctaacactgaagtccaaacgtaattacttgtttggtttgaagaatggaatgtgttggtacatagcaattgcatcctcagaagggcatgctaagaagaaaattgaagaatgggatcatcccaacaaaatcaggggatgactcaacaataaccaaatcattgtaggatgattatcctaaccaaacaggccattaggggatattaacttaaaaaagaaaaagaaaagggactccttattggctcatcaccagttgtaaagagtttgaaatagtacgattatgtctatttgaatatgctgagagtattccgttaaaagttacaaggctgagtgatatttgcatatttggatgcttttaactgggtgattcaccctgacagtaatatcaagaagggattgctgcagtcaaaacatttcagcacaaagtttcaaggtgggtatcgatcaactttaaagccatacttaatcaatcagtgagctaaaatgttagctgttcaacaataactagtccaagacaatttccacgaacatttcagctcaaaatttcaaggtgggtgttgttcaaccttaaagccgtacttagtgaatcagtgagctaaaatattaccaggttaacgagaaaccagtcgaagacaatttccaccaaggtaattgcagggttatggtctttaacaaggtccaaggtaaaccacaaaattatttgcatgtacttgctgtataattttttcaacgtgcccccatgaaatttatacaggatttccctgtggacaaatttctaacggagaaggtattccaagggctaggaatccaattacctaaactgaacagctttcagtagcgatcaagttattgatacaactacagcccaccataaaaaggttgaagctaccaaatgcactaacctaagaaaatgaccaaagttgcatgcgaaagggagcagttgatagctaagctacatccaacacatacactcctctctgttttcgactatgtaataaaccttttcgtacataaaaatcattgtaatgaaagtatattattctttgctgagcttattaacggcatgattaattaactactgtaaacttgaaaattaattttttaaaaagaaaattatatatccgaagtttttgcacgaaaaagaaaaatgagggagtaactaagcaaactagctgaatcaaacagggcctaatataagttgaaaagttattatgatgtagagtaagtgttcccgaaccaaacaggcagcgagacacgattgcgatagtgaagtcgagggaggtggcgcagtcaggaaatggtcaagtcagcacagcagataagcgttgcgtccatgtcggacaattcgccactggacacacaggacgatgacagcgaccggtttccgtccagatccgtgcccggatcggatctgccacccgacgacgcgaggaaggaagggcacccgcgcggtggaggcaatgccacaggcgcgagacggccagcgtgtgcaaacgagagagatcgatccaacgaacagatagagatggagaaagagagaacaaggtggtggtggtggttgttgttgttaccatcgccgtccttgtcgaagaggctgaaggcctccttgaactcggcgatctggtcgtcggtgagctgatccgccatggcctcctctgcgcgcggcgggtgagtggatcaacgaagaagaagaagaagggaagcggagatgggaggaggagagacttgtgtggcgtggcgtccggtggaagtttcccacccccgatttataccgcgtcttccgtcacctccgctttaccttcgaccacctgcttttcccaaactacccctcctcattagtaatgggtataatgtttttcaaaacatagacatgaaaatagtttcattttattacaggatcatatttttattaacatttttttacactttaaaccaccccgaactcttttatccatctacacctaaattgtcatatgtcaaaaaacatataatcatgatagtttattaaggaaccgacatactcaaaatcgctctcatatgtttcagaagagagttgaaatgatctaaaatatatagtatataagaagataaaatggtccaaagtaaaatttacttacttatttggtaaagttgcattttctttagcttgtcaatgtccaaatcatcctatatttgtggtggcatgagtttgctttgagccaatccctcaattggtaggataaaaaaaaatcagtccctggattggcgggattctacctagctattccctcagtcctttcgcttaaaaatatacttcctctgtcccattttaagtgtaaccatgagttttcgcgtctaattttaaccgtccgtcttatttgaaaattttttataattagtattttttgttgttatgagatgataaaatatgaatagtactttacccgtgacttatgtttttaaattctttattttttcaaatgagacagatgatcaagttgggcacgaaaaatcatgtctgcacttaggctctgttcgtttcaggcagttcggaacccaactcccctgcacggaaaacggagcaatccattagtgtgtgattaattaagtatttgctttttttcaaaaatagattaatttgatttttaagcaactttcgtatagaaactttttgcaaaaaacgcatcgtttagcagtttgaaaaacgtgtgcgcggaaaacgaggaatagaagttggaaacctgcccaaacgaacagagccttaaaatgagacggagagagcaactatctttttatttaaaatagaggaagtactattgtacatgttccattgattctctatgtatgcacaaaagcaaattctacaggattttcacataaaaacagttttattctttcagaatttacgtaaaactcatcccaaacgtcaaagtacagcatgtgtgtgagggcatttgtgtaatcttgaatgttccgtcaaggacaagcctctgtgactttacggcatgtgggcctgtaaaacggtggaattttccgatgatggatgctttcttgacatttttaaatgagcagaatgacgtatgtaccctcgacgcggtttggacgcggagtgcattttatcagtaaagtcccccgactttccaagctttcgtgttatggccttgtgggccatatgaaacgtgttactacaacttgggcctttttcctggttggatgctcgtactgggctttgggcccatcgcctttatgtgggctcaatttaagctttctgatatcatcgtatcatgacaaactgaaaagggattggtatgccctttgattagaaatcctctttctccctacaaaatatacatattagagaaaccgaaatataacaaagggataacaaatcttggaacgcaacaagataagagatgtgagcaaacgaacacaactacaaaactgaccaaccctgacacacacacacacaaaaatgtatgaaagagtatcgatcaccatctttattcttctggtagatccttaatatggcgtcagcaaacaaattggtgactgaaaagcacatcaatgggtctgtttttgttcctaacactgatgaaatcatcacggtccacgccctcaagattaccattattattactattccaaaacaatgaatgaacagaatgcatgactaatttgttctagcattgccagctaataaagctatctgtcctctctttggatggccttgtagaggactttggtgacaaacttggactggaacctgaaggtggtgccgagggcagcgaccatgggtggggtgcccttgccgatgaagacatggccgaggacgttgtgcttgggcatggcgcactctccctccttcccgccggagcctcctcgcgagttgagcacgcccaggtggagctgcggcggcagagcgggaggctccttggtgaactccttgtcgtcaggagccaggaaaccgtagctggagtccggcgatggaggagccatcagctctgacacactgtccacgctatccgggacataatcctgcaagcatatgcacaccagttatacattcaggcaatacgcaaacactgaattttcaagaagcagagataggtgatgcattcgtagtgtgtgtttcaaatgctagcagataaatcatgatgtgtgggaatgatctgtgcaatgcccaggctttgtgctccttctttggtgctttgagttgtagtctaatcctaattacattagaattgtttctctcatatatatgtgcctccaagttagactcttgcaagacacaatgaagaacataattttattgattataacgaaacaaggggacaattggttatactagtgcaacgattatttgcatcattcaattgattcttactaggcgagaaatataattttcagatatctgagcttggtccctttcttaatcatcatcaagtacttgagtgggaatctccctagcacattttcttgggtttaaataatcatggtcaagagtaagttttgctgatcaagttcgcacaaacaatcgtacgtgcaacggggaaaaaagttgaatgaaaaaaaaatactcacatgaacatcaataagatttgaaatggtgcccataatgtcagcttcacggggacgatcaggctgaaatcttctttctccatcaacaatgaatctataacggtaaactccagatgcaagccctaacatgacgcagtgatcctttccacatttatggacgagttgcctgtgatacacactaacaatgtcagaacaaaatcagttctatccttaagcttcagtttaggtactagaaacaaaagggaaatactatatgctatctctccaaaaaataaaaatgtactttgatttccagttatcccatgatccttctatatagacattcttccctccaagagtccacacaagcagagtaggaatcagcttgtcagggggaccatcgtgatcctcctcttgttcactcgttaatatctggttaaatactggaggaggtccatctacagctctatgcaatggagttacaggactctgcagtacatttatatcagtgcattaaaaacacaaaacttagaacaatgacatttgggaagaggtagactgacttggcaagaaacaaggtaattagatcatctgaagcgaccgtaagattaaacatgttcgctagtagagcaactgagcaaagttgtatgcctgtactacctctgtttaatacatgagacgtcttatttttttcaaatatatataaaaaatcatgtctaaggaactgataaatcaagtcacaacataataaatgataattatattaattttttataagacgaatggttaaatgtatctcaaacagtcaacaacatcatatactaaaaaggaaaaaggagggagtattattctagataaatctgataaaacaacagtacattattctacaattttaattgtcaaagttgtaacgaatatatttcatattatgaactttctaaagaacatatatttcagatcatgtttttttaaaaaaaacaaattgttagcaaccaaaataaatcatagaatcagcgaggagtccccaaaatgcaacgccgatgaaattgtggcatgcacattacaagtgcgacgcgcgtcacatgcactgatcgatcaagaggatgtatattgcacatggatgggtggaattgaaatcgagatcgaattgagtttagcgtgatctgacctgcggcacgaacatgcgcggggagtgcggccgcgggggggtccccggcggggacgacgaccctccgccgccggagtaccccgctgccgacgacgggggccgcaccagtccgccgcttcccccggcgccgccgtacggcgggaggccagcacggtccatggggcgcagcgaggaggagtagtccccagcgccggcgcggttgccgcctccgccgccgtcatccatttcggcgtcggcgatgtcgtccagcctgccgctcgcgttgcccatctccggccaccggcgccgcaccaccttaccaagattatatacacacacgcggaagaggaggagaggaatgggcctaagcccattttttcacttatgggcccaaatatctgttgggccgaaaatgtggctctgcagtttgggcttgaggaagcttgttggtctttataagtcaagatttacattttaaaacttaaactgattttatgttttttaatcgtggttaatttaataatatttgtttttatcactaagaacacatataaaattttacctataaattattatctattatattattaaaggaataaaaaaaggagcttccacgttcgctctcatggtctagaaattctcacattaatcggagaaaaagaaaaagcaaagtccacatagaaatacaatttagtaatagctgaaatttggaattaaaaaaaggagcctccacgttcgctctcatggtctagaaattctcacattaatcggagaaaaagaaaaagcagagtccatatagaaatacaatttagtaatagctgaaatttggaattaaaaaataaggaatattagaagaggagactagagtccatatagaaatacaattaagaaaaaatagaaattcggaattaaaaagtaaggaatattagaagtagagtatagagtccatataggaatttaaaactaactaaaattcggaataaaaaggagcctccacgttctctcccatgacctagaaattctcacattaatcggaagaaaagaaaacgcagagtccatataaaaatacaatttagaaatagttgaaattcagaattaaaaaataaggaatattagaagagaagactagagttcatatagaaatgcaatttagaaatagttaaaattcggaattaaaaaataagaaatattagaagaggagactagagcccatatagaaatacaattaggaaataactgaaattcggaattaaaaaataaggaatattagaagaggagctagaatccatatataaataccattaggaaataatagaaattcggaattaaaaaataaggaatattagaagcagagtatagagtacatataggaatttaaaactaactaaaatttggaataaatgtaataaaattaaaagtagagtttagagtctgtataaaaatacaatttacaagtaactaaaattcaaaattaagaaaaacatgggaagaagagtttaaagtcaatataggaatacaatttagaagtaactgaaatttgaaattaaaaattaaagaatattgaaatatgagtttatatagaaatacaatttagaaatagctgaaattcggaattacaaaataaggaatattagaagaggcgactagagtccacatagaaatacaatttagggatagttgaagttcggaagtaaaaaataaggaatattagaagaggagactagagtccatatagaaatacaattaggaaattactgaaatttagaattaaaaataagaaatattagaagtagagtatagaatccatatagaaatacaattaagaaataataaaaattcggaattaaaaataacgaatattagaagtagagtatagagtccatatagaaatacaattaagaaaaaaaatagaaattcagaattaaaaaataaggaatattagaagtagagtatagagtccatataagaatttaaaactaactaaaattcagaataaacataataaaatgaaaaatagtgtttagagtccgtataaaaatacaatttacaaataactaaaattcgaaattaagaaaaacacgagaagaagagtttaaagtcaatataggaatacaatttagaagtaatagaaatttgaaattaaaaattaaagaatattgaaagataagtttagagtccacatacaagtacaattagaaataataaaaattcagaattaaaaaaagaaatattaaaagacgagtctagagtccatataggaatatatataatttacaaataactaaaatttgatattaaaaataattaataactaacacgtatataaaatacaatatgaatattacacattagtagtttcttaaagttattgcaaaatttaaaattatgttgtcattgtaatatattttaataatataatgagaaaacatatatgctattatatgagaaagaatataatgatgctagccacatgctagttttactaatataagcggtacaaataagcataagaataaatgaaaaggtggatgttggtttctcatacaaaaccagctaataaaatagagtggaaatggataatataatttgaattctaattgataatttaaaaacctctcataagtgttttttttcataaaattggttggggcttttcttcacaccggcctgaccgaaaaaataatactaatataataatttgcaaaccttcatatacaataattttacagccctgcagtttcaactagacaaaacttaattatttcactatgagtgaattcaattgatttcctagataataatataatttaacctccatatatatacattattattcatctactaattaggagtaatagtgttgtctaccagcggtgcccttgtccgccgtgatcatacgactgaaatgtttgcggcggcaacggcggagtcagcaccggcggtggtacagctgcgacgggaggcgccgccgccgtggccgacgcagcataactggcacagtatgctggaggcggcggcggcggcggcgggagatcaatggtggagtcaacgtagtgacggtcggcgatgttggagtggcggccggtgagctcctgcacgacggcgcggaactcctcggggctcgccgtcagcttcatggggctggctatgtacaccaccctcacggcgccagggcattgcggcggcttgtacttcctcgccgccgccttccccttcttcgccggcggtggcttcgagatgccgtgccgctgccggccatgctgctgcaccccgagcatgttatctagagctttttgtgagcgtggtgtgcagccgtacgtgcaatgtgcgtgcctttatagaaacagtagccctgtttcggaacgatatcctgcagtaacagacgaaacagtggtaattttctgcagtaacagacgaaacagtggaaattttgggagaattggatcagagcattttcattgggcggctggggtgagagacaggagtagatattattgtgccagttaagtttttttttatatgatgaatattctggccttttttttaaaaaaaaaagaactggcattttcttcaattaagatagaaaccacttattacaaaattttgaacgtaatgaccaaagatgatgagagagtaagttcgaacaacaaaaggagaaatcttattcaatcctatgtgtaaactttcatccaaagttaagccaatatctacattaatggacttcaaattccaacatgcagtatgtataaatcttttatccttatcacacatttgtagttaagttcagaatctgagctagtatgctatgctaccttgaaaaaatcctgcctataaaatttagttggagatttgtaccagctagctactgtagttattaattttaaccatagaaaaattcacgcatggaaggaaggaagacaagacaagagacttgttggttcgagttagagggaggtcacccagtcaagtactcttacccaaaggataggttggaattaactgagataacccattcaaagtccagattcataggatgtgtttcatctatctacaaacaagaagttatctaggtaaaaagatgaacggtaaaaccagattgctagctagctagctgtctcacggctattcgctctctccagtcagtctctagccaattggctagcaggtaaacacaagttattctcttcagtcaaaaaatgaagtcgttttcgagtatatatattatatttggattctttgaaagcaaaatcatccagcgcagcattgatcgtcagtgatgaccgtcatcgacgatggcatcgcaaccgctcgacgacgaattgaagaaggtgggtgtgctagcctgctactattttttaaagacttgagaaattcagagctagaaaatcatccattcgttttgagtttgacctgccgatcgattaattatattccttgagatcgatcgataaattgtctcattcacacggacccaaggcgctcgtacatttcaacatccgtgcgcacgcgcgtgcgactgatcaggatatatagtttttggtgatcgataaaattcccaggtagctagcatgcagatgcagatcatacttatgtgcctaatgcatgcctagactagatcaatcgatcgattgctgatcgaggacaaaagcaatcaggaatccagatgcatgcattgtcgattcataattgactaattaagcaaacgcatatccaggatcagatactagtccaattgagtgattattgaccatatagcttgagtacttttatggtacattctagaccggtatacgtactaatagctgctgtttgcagtcaagatacatatagatactagtactacagtcaatgtctatccctttcacgtagctaccgccagtaaaaggcagaacgatgagagagaatctcattgttcatatatgggctttcaattaattcctcgcaatatatattaccagtactgtacgaatactagtattaccagtgataagagaccgatgcacgattaaaggtagggtccggatcaccatatgttcggtgatgctggtttgctgaatttttttagagggagaagttcggtgatttgttcgagtaacggaaatggtggccgcattctaagcgggcctcattcttggtagggaagcaggtggaaggaggacaggaaggcccaatagtaagtaaaatgggccgtcggatgacatgtcaggcccaagttgaagtgagcccatacagcgactccggccttgttgacgaacgaacgaatgatgcggaggtgaggggatctttctcttggcttcactcgtcttccaatccttcttcctcctccctcctctcctctcctctcctgcagcagcgcccaccgccatcggagcctcgccctcgcgcggccatgcttggtctgaggggagccagggcggcgcagctcccgtacgcttccgccgccgtcgctcccacccccacgccctcgttttccggcttcgcgcgccgcctcccgctcctcgcctccgcggccctctcgcctctgccgccctccttctccttctcctccgcttccgccgtcaggagggatagggaccctcccatgcgtcccgtctccggcgccctctccaggtccaggccaaccaccaggggtgagtcctcgtgctactcatttacctctactctgctgctgtatatgtatcgtatgtccaccagatatctagctattctcgcatgtgccatccgtatcaatactaggttttgcttcattttatttcctactatactatccggttactagttagtactagtgttgtttgcatttgtgtgcttcttgcatggtgccacatggtttcatcaagtaattgacatgaacacctgtttgttagttttctgctctgcggctgctactgctcccagggagggcaaggagttgcttgtccagcatctgctcgtcggcgaacaggatgtcaggcttttggtcgatcttgaaaagaacatcattacaggaggtactagtactagtattcatgtggatgctgatatacactttcacataaacatggagactaattaaaaggatattgctcagcatctagcttttttgtgtgtgtttcaggtgcagacttgagcgatttagctgtcgagtactctttatgcccatcgaaagaaaatggtggaatgctggggtgggttcgaagaggacagatggtactccatttacatgcttttctggcatggtagtagcgacttttcatctaggactttacatattgttaattgatcaaagggctgatcaaaactacaaatgagctaatcacatgcctaaaatgtactatggaaccatccagtttctctgactatgcttggtggtgctgataaggtccatactccatacaagatgcagttggaaaccttatgcttggcagtataaatttttactttaccactaaaatttggcttgactttcgttggtcaacttacttctttatgatggttccaatttgttaggagttcccaacctcaccaattggcgaactagaaaaatgtagaattaattgttttggtattggtacttggttgcttgccttggaaactaactgctgtgaattcatgccacaagttttgtcttttcttattaagcgcattgatactgatgtatgtactttatctaattaatttcaggcctttatgacatacacacctaaatccatctgccccttattctactctatgctagctctcttctcacaaccattaaattcaagtgtgacaatcacttgctagcttgatgtgtgaagctccaccaattttgtgtgtgtttttttttccttttctcttttctgtaagcaccgtgaaggcattaacaatgtcttcaatggagtttgaacatttttacttgaactgagcaggttccagaatttgaggaagcagctttcggtgctcctttgaacaaggttgtacggtgtaagacaaaatttggatggcatttgttgcaagtgcttgctgagaggtagatacttgtaacaaaattatgttctatgtatacaaacaatatttattgatttcttttccacctaacttcagagaacaatgcgtagtggaagacattccaccagaggagcttcatgcaaaaatgcaagatcctaactttcttgaagaagctcagttgattgatgttcgggagcctgatgaagtgtaagatttacctgtgtcctgattgctagaataatactcataattacgcatcagtgaaatgatagacatgtttaaccaaaatagtactactaggacctgtccatttcttttaagagctgtccttatattgccatcctcacacagaaaatgagcttcattttgacattttgtacttttctaaactatattccagtgaataactgttacgacatcttcgttgtggttttcaaaatacacattatcaggagtaaagaaaaactgttaagatgatcaaacatgaagtatttatctccatatccatgatgttgtggttacctagttcagtacagttactgttattgttcgcctattcgcatgaagcttatgttgagttttacttcttgcatggcagagatnnnnnnnnnnnnnnnnnnnnnnnnnnnnnnnnnnnnnnnnnnnnnnnnnnnnnnnnnnnnnnnnnnnnnnnn

SEQ ID NO: 42762 - DNA, 1819 bp, Oryza sativa
cttcctttgggattaaataaatacgatacctttataatactttcgggcgaaatgctacaatggtatatccgtgcgcttgtggatcctttctgtaaaccatatatataccaggaccatttctagcgtcattgctagacattcatatttctagtaatattgttaagaaataccaacaggtgttaacagcgaaatttggcaagatagactcggatttcgagttggaattgaaggggaatcaaagaagattggatctttccaaatatggattacgcatcggttgggcattgcatcggttggaaatagagttggagtctgatttagccgatttgacaagtagccgactagcctgacttgggctcggtttgggcctcgattgagatgaccgtcattgtcgtttagagatagagctcatttaaggcaattgtatctattaattaggatatttatatcggtttgagttagagatatggtaagagtccatggtatggacttgtttgtattttatctttaggaaagcttgagtcgtgtccataatggacaagttttgtactcggggtaaaaatataaaccccagaccattgtaataggggagacaatccaatcaatacaactttcagcgtatcgccacccttttcttttacttttcgacgagttcttatttcaagttggggcatcggctacgatctctcgacaacaaaatagttataacacaacaaatttaataaagcgaatgtaataatttaagtcaaaatacatttcgcaaattatgtttcaatatgctcaaggagagcgtgactgaccttagtcaacgaacagttttctgctgccacaaacgatggacctaaattgcgagatgggaacctctaaaatgatagcaactacaccaataacaaaacaagactaaaactctaagaaagaaatgatcacattacataaaaataacatttttgggccctttaagttataaaaaattaagcaatttaaacgggtcaatttggacctcgtatggccaagatacgaccatccaaaatttagctataatttaaatggagacttccaaattatttaatcattattgtactattaaattatgtgtaatacatcagcgctcgaggagagaaaggaccgagcaactgattgtcgagacccatgggtaaaacaggtagttcaccaaggactgggttccccgagatggtccatggtaaaagcagagataagaacattcttcgagtcggtgagggcgacgcaacttcatcgaacgacgtgctcaaaggaggggatggtgttcctgaggtcttgataaaccctgagctgcactcaatacactcacggctatgattggcctgatctttcggggagttgatgataactgtaatttgggagaacttactacaaccgtacgagacgctattgtgttgtgccttagcgatcgatacaccactccgtgggttgttgatcttgctggtgcaaatcaaccttatgactgcaagcaaatcaaataaacaagtaagaacaagataaaaaaaaaggtaatctgaattgctcataggaattgaatacacacaataacttgatatggaggcatgctcaaggaagagatcgacgaggcgtaattgacggcgacgacgatgcagcgggacaatgcttcggtgagtcgggaaaggttgccggaggaggaaggcgatggcatcaccactggtcactggcgagaacggttttctagcttgttttgggctcgacgaaggggagcctggggaacaggaggtggctgcaacaccaagggtggcagcgccggggtgctgcgtttcctccggtcgaa

SEQ ID NO: 42763 - DNA, 865 bp, Oryza sativa
ctgcacccgccttttactgtgtatgtgctgcagatctctaggaactgttgcaggtgtgcatgggcatcttcataagagaactgcgtaagatcataaaagatatgttcaatagaacaagggtgcatataaaggtaaatagctagtcttataccgattctaatcccagatggaaaagtcttacaacaaaatggctacttccagtagctggatattaacataatactagagttgctagtggttctactgctggtcggtaggtccaacagcatgggtaggtccagtagcatgggtatgaagaggaccactatctagcttctgatcttcaccagcgtcgttgtcatcctgttggccccgcgcagctggaattgaattaaacagaaatgagttgcatatggttaatgctctataacaagaatcagccgagaaaattgatcaaaagagactctataataagtcacatcatcaagattcagactcctagcgttacatggtaccgaaccacatcccatgaacgttgacttagtggtggcagcaaccacagatgtagctttgtgcttgagggactctatcagggacagtgcaacctcgcccgcctgctcaagagcttggagaatccttttagcgtatatgaatcggctgccagcagcaagagcagccatccttgtcttctgcacctccgatctggcctcccccgccatctctgctatatcaaacgctgattttgcatcctcaaatatggagagcttcacctcagcctccttgcgcatcctctcaatgctgacatgcaactcatccttgctacgtgcaatttgctgccgggagtgggacagaacctccttgaggcagttggcctctccgaaggagt

SEQ ID NO: 42764 - DNA, 34172 bp, Oryza sativa
aggttgtatcccagtcagcagcagattccacgtagcaaggatgagttgcttgtcagcattgagaggatgcgcaaggaggctgaggtgaagctctccatatttgaggatgcaaaatcagcgtttgatacgacagagatgggggggaggccggatcggaggtggagaggacgaggatggccactcttgctgctggcaaccaattcatagatgctaaaaggattctcaaagaccttgagcaggcgggcgaggttgcactatccctgatagagtccctcaagcacaaagctacatctgtggttggtgccaccactaagtcaatgttcatgggatgtggttcggtgccaggtaacgctaggagtcagaatcttgatgatgtgacttgttatagagtctcttttgatcaattttcttggttgattcttgttatagagcattaaccatatgcaactattttctgtttaattcaattccagctccggggggccaacaggatgacaacaacgctggtgaagatcagaagctagataatggtcatcttcatacccgtgcttctggacctacccatgctgttggacctaccgaccagcagtagaaccactagcaactctagtactatgttaatatccagctactggaagtagctattttgctgtaagccttttccatctgggactagactcagtataagactagctattaacctttatatgcacccatgttctattcaacatatcttttacgatattttgcagatctctagcacccttggttgctgtatttatgggaaagggttcccaaaaataaattagcttgaaagcaattaaagagtttgctaacgataacgatatgatgtgagatgtagttcctagggagatggagccatcaaagaatacgaactgttccggttgccagaaccgaccaagacaccttggcaaccagaacatttcgtcattttttgataactaaggaactttaaatatatgagttagggtaatcaagatatacatgtttagtattgtcttttaactttcttgccgtacaccagttatttaggaaatgtctcagcaaggtgagcccacgtcagcgagaactagtgggacaacatcgagccggaaccctaggatccagaataaaattcctaaggaaagatacacctgcatctcctcatttagttcctaggttatcaaaccatcacataatacgaagtgcatggggaattatgttggtttggtcggggtagtccatagatggaaccgaccaagacaccatagttctccatgcacttcgaaatctgtcattttttttttgataattaaggaacttaggggttaagtgcaattgtctatttatttttagtttgtaggttatcaaaccatcacagaaaataattatattgcacatctaataaaaattcaccttcaaaggatatcaatggaaaaacccatagaagcgcaacccacgggtgacaagggtaaggaaactcaggccgtcgtcgaggaagatatttgcacgcaagtagtcgcggaggaatcgtcgttgtcaagcttcagtgaagcagagagtggatcgtatcactcaccgagtgacccccatccttctcttgcaaggaagagaaagggcgggagcaacaatgaagaagttgactccgactacagccctcgcgaaccggtggtacgtaatatattatatatgtttagttccaatcctattaaggacatactatggattttaactgaagtcacgtgaaatgcaaatatagaagaatgctccacgttgctctaaaaggaaagcccaagtcgcacccgaagctgaagctgaaactagagctgtcatgctcatcacaacttcaagtaaaccaaagaaaagaaggggcgagcgagggaagaacatgttgaaagaagtcagcgtgctgaggcggatgtgagacaggggaacccctatcaccagaagactcatgttccaagtatagcaaccaatgtggggcagtagtcagggatatcgtggagatcacattgaaggattggaagaaagttcccgacaatagaaagaacagctgttggatgtcgctgcaaagcaagtttgaatattcgaagggacagacgatgataaagggaagcactattgttggtatttcttaatgactttactagaaatataattcccagcaatggcacagaaatattcatggtatattatggttacaaaattttgggctcatttggtcgtgtcaatttagtgttctcagctcacttgtccacaagttcgattctcgacaacgttcgattgattgatcgtctgttttgctgtcggttctcctccattttttactgtattctctgcaagaagttaggatccaagtgctagtggaaaatagtttattctaacataaatatgcattgcaagcataactagttctcctttattttagtaatattgatgggcgaaactgatcgataacgactgtcaacaactatgcgctgaagactatgggcaagctgtggcgaaattggaaaacagacctgaataggaaatatgtccagaagggactcacgccgtataaggactacgtaaggataatacaggcccagagggatgagttcgttgccctgaagacattggccgaagaaaaggagaagagccagaagatggctgaactagcaagaaggaatgaacatcctcatcatttgggatcgaccggttaccgtcaagcgatgaagaaatggaaaaaacaagatgaaaatatggagaaggcttggaaagaggttcctatgaaaaaacacaacccacgaagcaggaaatgggtgcgtgcaagaacaccggccttcaccccgaaggggttgtagtcttcaaggatcaaaagctccaggaggtatctgtcaagattaagaacatcgtcacgcagcaacaggccgggacattcttgccagatagagactgggacgagcccacatatgcgttgggcaaactgaagcacttaggctgtgtgcggggagtatcctcgaagactagctggaaggatggattcaaagatgatgctcatacctacaagaagcgtgatcgctataaggaagagagactgtcaggctagggcagcagctcgtgaggaatgtcgtagatattggagcgagaaagtgatgcactgtggtgcggtttcggagcccgacccgagctatccggtcgacgatgtaacgaaggatactccgtgtaagaaaacaccggttggaactaggaggttcataccgggccgtagatttcattgccaagacattccaaacgattatgccaaggtagagctccagacggtcaatgaggctcaccggatgcacgagatcgacattccaacacccgaggggattgtgtaccttgtagatgtcgtcgaccactttatactccggcacaagactaatattcaagtagggtcaacggatggaacagatcgagcactaaggttaccagtgtcaccgtctcgtccaccaagggaccaagaaccgagggatcctccagttgcatcacctccaagattagagcaagctgttggatcgccggaaatatcagagcctcctattacatcacctccaagatcagagcctcatgttgcatcacctccaagatcagatcctgcagatgcatcacctccaggatcagaagaacaatgagggcttttctagcaacaatcagagctagcaattcaagaagtgtctcccacacaacaattagagactgcacaatcagagcctaaaaagcaagcggagggtgaaattgaagaggtgcctgaacaggcaatgcccaatcaaccaaagccatcgcaactagagcaatcgcaaccagaggaacctaagggtgccaatgtgccagtgatggtaaggacgcacaagcacaaagaaaaaagtgcgacgaagaaaaaatatatgttaacgacattccgcggaagggacaaagatatcatagatgttgattttgataacaaaaaattaaaagggttcaaacatacgattatctcaactccccggatgtgccacatgagtttcagaatggcaaaccattcatgtacgactggcaaccaacagaaggaccgtggcaattaaaaaggtggcatgaatggtacatcagggcaagcaccatcaaaggcattacatcatttacagttgccgtgcaggagaacatcttctggagtgggccatgcctattccaagtccatttctccgatatgcattccctcttccgtcggaagaggctggacaccaatttgatcggcatctggtgtctgtaagtgcatgacttgaacgtgttaataaatcgttatatctatttgcgtagctgatttggtcatccattgttgacagaatgaattatgtggaagccgaagtgatgagaaagcctgtcggctacctaaacccgtgcaggataagtaagtcgaaccacacctacacgctagacgagaagaagctaccggcgcacattaaggcgatgactcccaaagagaggaaagaatacataggacaaaggcatcaggaaaagattctcaatgtggctacttgcgtagctatagtgcttgaatctatgcaggacaaggagtgcgtttatgccccatatgcctttgagtaagttttcatatccactacgagtatatacatataatcacggctcaactaacaatttcattttcagcaaccattggatagtatttcttctctatccaaagtacaatgaagtcatcatcttggaatctctcgacaaagatagcaatacatacccggaaatgctacgaattattgatatataaattataccaggaaatgctaagaattattgatctgtaagttatatattctcatgacgtgtttttatctttgaggaatctaaattaattatatcttcaaacagtgcatttaaaaggtattaccagaaaggcagacaatggaaaaactcaagagaacgcatactcatccgcaataagtggccggtaagtacatttggatgccaaacagtgctacttaattttcataaatgcatgtgtgtatccatttaataaactaatataccttataattgatgttgaaagtgtcacaagcaaccgatgggaccgtactaggcggatattacatctgtgagtacctaagggttaatgggagatattgcgcgaattacgacgaggtaagtacaaactgccaatacacttgttaaattaatcgctagcttgtattattgcgaataattgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaactctaaaaagtcccctttccctccctctccctcttgggccggctcggcccatctccctccccctccgtctcctctccccgcgcgcgcgccgctgacgggcgggcccgcccgccaacctcgctgacgggtggggcccacccgtcatccccttcctcccgccgctcccgccgcctcgcccgcgccctagcgccgccgccgccgcgaatcccgccgcctcccgccgtccccgcgtgcaataaagagggggaaatcactccccgtgatcccctctccctttccccccatttttccctctctctctcgcgttcaaacgggcggatttgcccccgcaaatttcgccggcgccattgatggcggccggacctcccgcgcctattccttccccgccggccactctctcccccttccaaccctatttaaaccctccccgcacctcctccgtccgtttccgcctctcgccgcccttcctcctcgccggaatcgagctcgcgccgtcgctctctctctccgccgtcgccgccgagctccggtccaccaccgtcgtcgccccaaaccacctcccacctcggcgccgcctccttcggcttcgctgcatgctcgccgacctcgtccacccctccgtttcgctcgtcgaccgccggagcgccgccgtccccgtcgacccgagccgctccgccgccttcctccgctccggctgccttttcgtcgtcgccgtcgacctagggtgagccgtggaccgccgcctcgtttccctctttccctcccctctctcggccgccgctccgatgtgcccatggccgccgccgacgaccataggggcgcgggcgcgccgcctcccgccggccgcgccgacgtggccgccttcgggcgcaccgagcggctgccgcgtggggcccggccgtcagccgcccgcgcccttgggtgcggctgacgcgtgggacccacggcgccggccggtgtgagcccgagtgcacccggtccaccgtggaccgtgaggctgccgcgtgggccccactcccgtggacccggtccgcgcgccccttcccctcggctgacgcaataaacccttttaaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaggccttttcttttccgttggttgtgtagacgctgcagcttcggaagatccgctcttcgtggaagttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggttggattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacagatggagatggacgaagtcgggggtcgatggacatctctaggacaaatgaaggctacacgagctgtggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagcgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctggaatcgtgtttacaaaatagctttgagcaactaagtgtcttttaatgctgtttactgcaaaccctaaccctttatattataacccccttgtactcccttgcatttatcctgcacttgtgggtgtgtcttgttgagtacggtggttgtacttagtcttgctcaattttttccaaacccagaagaggagcccctggaagatgaaggctttggtgtttagctcgtgcctgccgtcaagcgcctgtggtcgtcgccctagtcttccgctgtttcccgtttgtctttgtgtgtgctgggccttcgccgcccatgtaataaattaactatttacgcttccgcttgataaactctgaaatgtatcaacttttggtgtaccttgcctcttgggacaaggaataatacacgcacgtaaggaacgcccgttgggttaattccggtcgtgacaataatttccttaatttgtcgtgatctggatgcagcttccaaaatttcccaagtttgaaagagagctcgatgataaatccatggagaacatacaacgggacatgtgctacttcatccactatgagtgcgcacatcagcttgggaggtttttcgacaaggacggagttttggacctgccggagaacgaatccctatctaactagagcaggagtttaatatagctatggtttgtcatgatctggatgcagcttgtatatgtcatcggtaggttttgtaagacattcaaatatttgtatatgtcgtcgatcgaattttgtcaacgtacatatataggtgcttcgaaattatatatgtatattattctgcttcatactccacgtgttgctctaaaatacgtgaaagataacatactctatcgatagctcgattagttatatcatccacgtgtgactctgaaatacacgaacaaacaaaagaaaaaaaatataatattgtttcaatttgttttacaaaaatattacatcttcacaggtaggccacatgtcagaagtcggacggttcctatcttcgctgtcgggccacgtgtcctttcccagaaccctttgggcatttttcctagcgggccaagtgtcaaaaaaaatcaataagccactagcgaagaaatatcttcgctggcggctgtcctaagactaccacaagcgaatatatttctttgctagcggctggcctatgtcctccgctagcgaagaaatatcttcgttggcggccgtcctaagactaccgccagtgaagatatgtctttgctagaagctgtgccttagtcggccgccagcgaatatatttatttgctggcggtagataactgctagtgaagatctacatcttcactggtctttactttgtggcggctgcaatttctgccagcgaaaacccaaaatggcttccacgaaagatggtttcatcgtaatgacggattaattaggcttaataaattcatttcgcagtttcctagcggaatctgtaatttgttttgttattagactatgtttaatatttcaaatgtgtgtcgatatatccgatgtgacaaccaaacccaaaaattttccccaactaaacaaggcctaactcaattgttgaattatatatacattggtacacagatactagctaatggacaagtagatgtcagatatttctgtctctatttaatttagattaatgaatggatatttgattatagagatagaataaatatttttaaaaattacccgtatatatagtttaaaaaagtggtctattactagaaagatgctttttgattattttttttcacaacatataacaaatgattcgtttcaataatctgaattgggcccaagtcagttagctgtgtttatttcctgaaattggggagaagtttagggaaagttggtagtttggaaaaaaaagttaggagtttatgtgagtaggaaaattttggatgtgatgtgatgtgatggaaagttgggagttcgggggaagtttggtatgaactaaacagggccttaaggcttcatcgaaatgcagcattctcaatttatagtaatagcaaaaatatagaattgaagtgccatcgcacttcacaaccaatggattgaaaaagatacagaaaaacatcagtaatcactaatacgagaaagattttcgcgtgcggtcaaaaccggttttcgtgtgggtgggccgcccgcacgcacccaagggtctgcaaatatcgcaatttttgtgtgcgggtgcttatgtcacctacacggaaaaacaaaaatccaaaaaaaaaaaaatttcaaaaaaataaaaaccctagaatcggcgctgccgccgcacctcccggccgctgcctcctcctcctcctcctcctcctcctcgtcggccgaggacatcgctcccaccctcattgtcatcgctggccgaggacaatgctcccgtcctcgttgtcatcggtggcggcctccgcgccgcccgccgccggatcctcactccggccggcctccacgctgcctgctgctggatccgcgctcccctccggccacaccgccaccgacgcccctcccctccgccggatctggggagggaaggaaggggaggggaggggaggggagccggatcctgcgcgtggggagggcggccggctgccggatccgtgcgggggttggccgccgcccgctggatcccgcgcctccactgccgccgcgtggtggaggccgcgcgtgccgtcgcctacgcccaccgctgtcgccgtcgccgcgcgccgccgtcgcctacgtctaccaccgccgtcggtaggagaggagaggagtgaggagaggataggccgcgcggagaggagaggagaggcgccgcgcgtagagagaggagtgaggagaaaaagagatagatagactcattttattgtgggtaagagggaaaagagggagtgggtatttttgcgtgcggccctcttgataggtccacactgaaaatagactcattttcgtgtgcggtccatttaagaggactacactgaaaataggctcattttcgtgtgaggtcctcttaaatggaccgcatgcgaaaatgagcccatttcccagatgcgactagttatggtctgtctgcaatctaaatggtccctgtataggaaaatcgtttttagtggtgaatgattgtttggatggagcacagtaaaaacacataaatcacaagagatatatacgccaatgattttttcttcaagatgttggaccttatgtgaatatttatccaaaatacctattttttcagtcggttcaatagaatttcataggattttttcagtcctttaatacaaaggaccacataagaaaaaaaaatccatggaattgaatccctccaaaccttcaaaccctttgttgcaaaggatccattaaaatttgaagattgtacctttatgaaatggacaagcacttattggtgagaagtatccatcctcaaggaaattcagaatagtgtgtacggaataaaattgcaatatttggtagaatatgtggatttaatatatattattccaataaaataaaatacatgcaacatatcatcattcacaagctaggaagtaagcctgcacgtcctgatcacctcattttatttgtgcattaaataacattatccaacacacactaatattttttatcatatcatctcgatctttgttcgtgcgtgcatcacattagacaaattatttatttatagtagtagctagcacatgcatgcattaagccacaagatttgcagcgtgctataaaccggtgttggcggtggaagcaaagtggagcgagtagttaggaggtgggtaacgctgatgtctccggcgatggtaagctgtcgaagataaggaagactgtatggacaaggctactgctagcttgatgggggtggagagacaagaaggaaggaggtctggcgggcctcgctggctgctttcaacactggcaagactaggtgacaaaggaggtgggggatcggggtgaaggatggacggagaagtgttggccatagcgaggaatcgaagggtgacggagagatagcgaggaatcgaagggtgacggagagttaaagttcaggggttgtacgaatttcaaagcatatttaacggtctaaaaaacgtaagatgtgtggtgagattttcaatttgttaattaactttgcaatattgtttcttgattttcaatagtcaacagtgaccgatcaaatttgcattaggccattcccaatgagagtttcatactcattaaatagggtggcatgtcaccatttttttatgatgtggcagggaattaatgacgtgagagaaataagtttcatgtagatggaactatgtctacactgtttctaatacaatttatctcttgcatgcactacttatgaaacaacaaaaataacactatgtattgtacgaactattttaatataatgaattaaatgccttgttatttatgtggcactcttagaagcataaaaatgatacctcccacgtggtcttatttggctgatacttactctccaaaaacaaaatatattggtccaattgaactgatatcaaaatatcgttttcctcattcctcaagaataaggttctcaaagatacaagtcatgtcttagtaaaatgcaatgttcatttggtcttgttacagtacttaactcgatcatagaattatatagtggcgtgcataaattagctaacgtcgacaagtagacatgaaacatgtccgtctaattaaattagctagccatgtagcaacagaccagtttcgatcggcttacaatttgaagattgtgcctttacgaaatggacaagatagcacttgtcggtgacaagcatccatcctcgaggaaatccacaatagtatacacggaattaataaaattttggatttgggagaatatatatctggcgatgaaatatatatatatatatatatatttattccaatccaataaaacaaaatacatacaacatatcacccagaagaaagtaagcctgcccgtcctgatcacctcactttatttgtgcattacattacattatccaacacacacacacacacataccccaatcttttatcatatcatttccatctttatttgtgcatgcacgtcacatgacattacttactttatttgtgcacgtactagtagtagctcgtgcatgaatccagtgaagtgatcagtgatcaaagtgaaaatggatcaaggtctggttaattaccagccgtccatcacagaacctgatccaggagaccaggctcattaccagccgtccatccggtcttcttgtcccagtacctgttccagaccatgatgcccccatagttgggcagcttgttgatgaactgcagcacgtcgtagtagagatccttgtgcgacacgtagccgtccctgtcagcctccggcgacgcgacgacgccgacgaggacgcggctctgcgggtacgccgccatccacttctccagctcctccctcctcgacgcgcaccgcccgtcgccgaacaccttgacgtggatccgcgagaagagccccgtggacagcgccgcctgcagccgctggtccgggaacacgcacctcgccgtcgccgtcagcatcaccccgagcctccccttgtagtccttgttgtgcgcgtacagccgccgcgccagctcgtcgtagtgctccgtggcgccctggtcgatgaagaagtcgatgccgtcgacgacggcgtcgccgaaggggcgggcgacgccggggcggccgccgccgaggaaggcgttccagaggtagtcctcgaggtcgacggccgcctgggaggtcggcagggagtactcgccgccctggccgccgatggcgaggaggacgaggatgcccctggactggcagtgcttgatgtcggggccgacggcggagacggtgtggccggagatgtccagcttgtaggtgcccgggatgtagccgaaggcgctgaggaaggagatgatgacggtggtgtagaggccggtgtcgcacgcctcacggagggacccctcgagctggtccgtgttccggccccagaacacgacggtgtcgccggtgctctggccggcggcgaggctggacgagagcagtaggaccagcagcggggcaaggcgtcgggacgccattgatcttgactactatacactacgggtcttagctagatggagtagttagctacctatcgattgtgatgcggagaatggggaggggtgtgtatgggtatatatagggatgtcgcgcgtgttctcagctggatcgtcgatgtttggacgtctcttcctagcttctcgcgcgccgccggcgacgtggcagcttgcgtggcgatcagacgatgagcagggaaggaaaccagcttcaccaggaagcaggatgggtggggagtggggacagctagcgctgtcgcgcgcgtgcaactacagttcgaatcaatggaaattaagcatttccaagattactaccgccatattattttaatatattattttaacatggggaaaactgcaaaaacctctcctaagtcacttgaagtttgacattccaccctataagttattttgttgcaaatatccacccacctattcaattttgttgcaaaaaccactctagtaaacacatgtttaatcgaatcaacgtgtttttataaaataggagtcatcaatatgttctttaccaaaactatatacttctagagtattcttgacactttttttaatgagattccataaataaaattgttacgaaagcttaaacattgtcatactgagttttgctatatgcaataaggaaaataagcctgatgcaatcacttgacaagattgatttggctagcttagcctgtggtaaacctacatcagcaataacgaacttattcggttaagcacgtgcgcattgggtggtttttgtaataaaacttagtagaggatgggtatttgcaacaaaatgacttatggggtggaatgtcaaacttcaagtgacctatgggatggtttttgcaattttccctttaatattttacattgttgatttttaaatacttgtttcaccgttctttttatttaaaattacaaaattatgatttattttattgtgagttattttagaactaaaaatactttaagcatgatttatatcatacgtatttgcacaaaattttaaataagacaattgatccaacgtgtgttcaaaagttaacgacaacatcaatagacaccactactttactatacttataatttaacccttaacgctgactagtctagtatgatgaactatgtttttgttttttagacgaacggcgctaggcgatacaatgtttcatatttcatattgagatagtaaaacaaaaggtaattaaccatacaacatttaacagttcttttttcaaaaaaaaaatcaaatctagatataataaatttaaagtgtaattacattgtatatatataattggtcaaatcatacgtggccaattcgctagctaccactactacagaaaatgttataggcgtcggtttgaaaaccctcatgtgtcagtttggaagccgggaactattggtcagcaccaatgactcaagtcatcattggtgccatttgcttaactgacacctatgggtattatattataggtgctagttctccacacaaaccgacacctatagtggtttcggggacgacgtggatgccttatataggtgccggcacctataatagttctgatgcataaaaaatatatttcctagagtaccgaatattaatttcctgaaaacatgtatagaaatcacagaatataacaaaaatcacacacatcctccacatttacatcgacattcacatcctccacattattgttattgttattgtttttgttataattattgttagtagtagtagtactactactacatcgacatggtagtctatctagcctatgttttctgaacttgagagatttatctaatattatttttactaattcttttaaattattttcattgacggtcgttatctatatggttgtgcaatcatctatatggttgtgcaatcactttcgtaccagttgtgtggaattgatctgtggaggtttgtaaaatcccgatttttgctcaagtttaaaacctattttgaatacatattttaatttataaattttatctcttatttgaatgttggtttggttccattctagatctcaaatcaatcatccaaagtccatctaaaagatcctagaataatgagttccaaagtccatttacaattacaacaacatctctaaaaaaatcaatctctgaaattcctataaattctaaaacattatttttccagttggctaccttttcttttccctaggccaacttattcccctctatctctttctccccggtccagacacccctaccctcttccctctgcaggatggcccatcccttccccctcctcccttggtccaattgacccggcccagctagtggagttgagcttgccctagaaaggcagctcactcgcccgtgtgaccgcactgccatccctgtcgttgtggctggctgccaaccacctaaccacgtcgcacaacacagagccattgtgccccatccccgcattgcaccacgccacacagtgccatgccgtgtcactctgcgatagattgtggacgtgcctccccgcctggccacctccaccttcctcctcatcaaacccgccaaccatgcgggccccaagccgaggacctcctcgccgccctatatgccacactatcgcaggcatcatcacgcggtcccacgccgacgccgtccaagctatagccacatgacacctcacctcgccccgtctttattagccttgacgtccacgccgtgtcaacgcccctgcgcctagtccactgtctcgccttctcttgctccagctaccgcggccgtgcgttcaagatgaaggggtgagctcgtactgtcgttgtccatgctcccttgtgccatcatgcctccttcctttaccccgaagccatcgcagctcctgcatccactagccctggctataaaagcctctataccttgccgtcttcctcctttcgcccttcccgtcgccgctgccaacttcacacatcaccagctagcccaagatgctcctggacaagcgccttaggtgcgctctgagtcacgctgccatacccgctcattgctcggttgaacgccatcgatgcgccatcccttcctgagccagctagccaccagcaccgccaccacctcctggcaaggcaacttgccacctctgccatcccaactaggttggcaccgcgctcagccaccccgcaccggatctgcaaccgcctgctcgctggtcgccctgaacctagggctccatcagcggagctgctactgtcgcccccccctgtttggaaagccaccagagctaccactattgactttgcctcgatccgggccgcagtcgcgccaggttgagcaccgcccgtgtgaccgcctcctccccgctaccccagtagcgacctcctcgctccaactgctcagctccgccgtcctccgcccttgtcgcgcctggatctctctcgctcgggcagggagagtgtgagcactgaggagaggagtgttgaaatcgaaaagaagagaggagaaaagaaaaggagaagaggcaatgataggtgggatccatggtctctcatcatgctgtacacagtaattgttctcctaatcccctccaatgtctctatgacatatgggtccagtttttataatttctaaataaacttccttttaatccttgagttacttatgagtgggacccattgttcccatccgacgcgcgctcagtccaccgttccagagtcactaacacgtgggcccattcatggggtccaccaccaggtccataacggtagaccttgtccacttaccgttctctgtgaacaagtgtgcacatagtctgcatgagccgggtcaatggtcgtcgggccccacacgctgacccgtgaaccatgagccctgtccaccacttaagggcaagtactataagcccttaagcacttgcccctagatgccatgtagactcatttcctgatgtggaagagggaaggaaggagagagtgaaggagccacctctcatgcaaggggtgacctctacacacttcaataaaaaagtgagagcattaaagttattggggtttgtgtgctagaggtaacttattgtatagattacctcttaattaatagaaaggtgatagagatgaaattagaagtgacaaccacctctattataaaacttgtcctaacagcaccaggtgctcggttgaccatgcgcatgcggcggctcctcgaagcctatgaaagtggaccccacaaggtatatccctccagaatattcttttccataatagaaactcttttccctttgtgcaaaaaatcaattaaacttcgaatattaatatcttgaaaacattagctctgttttactccgttctactttcacaatttttctaacaatgagatctacctaatggcaaccttattttgcattgttgtagcaaacttagtagcttttgtgttgatttactctatctcacgctaccggaagataatctagaagctgttcttgacaaggaagaaccaccgcaggaccaaggcaagccacctttgaccatgtttcctcctatatgtgcaaaataatgttttgttgtaaatatgcatgcttaggtcacacgttaaactgtttggcctcggtttgtgagagcaaccaatggaactacctagtagtagcacttatatattgtagggtattggagtatcaatccttgatagcccaacaaatgatgcgttggcgtcttaccctatgggtatgatcgctgaggtagcttgcttatccctactgtgattgtattgccgcataggaagcatggatttccaaccaaataatattcaatacctgatgttctatgtttgtgtgtttgtgaaataaatctagattgtgaactttgatccggctggaggaggggagccggctgttgttggcggtggcgttggacggaggaggggccagaggggaagggggaggagagccggcggccggagggaggggccggtgggggagggcggcagtgggtcggggtggtggcagggggatttttttttatttggtgaggttgttttctcaggcgggtgggtgtagctcttgcgaggctgcgtaagatatagtggcccgcctgcgtaatcatctatttttgcaggcctttaagtataggcggggtggagctccatctggtaaaatctttttggcccatgagcataaatcatttttctagtagtgctacatagagccatgaccgaactgcccaccactatctccatgcagccgaaacactcatgggctcttgaacataaccgaggcaaaaaggttctagaaggagaggatgagagagaagaaaaattcattcgtcccttgcacagaatctgcatgccgccattcaagggcactgagcctagacactctgcatgcgagtttaggaaattacaggatctcctagctaggcgacacatccaaggaagaaggaagtcagaagcactatcgatgtccatccatggaattggatataattttcacctacaggatcccactagggagggagagaggcacatcgacaatgtccattgagagatcgtaatgcatcaaagtgtcggcatgctgcacccaccgccatcgctttgtattatggtaggatgtgctcatgagcttgccactagctgctacctgcacaactcaatgcagttgtcgcacggctaatcaggatgtcgaggccccaaatcctgcggtgcctcatcgccttgctgaaatctcgatcgtcgcatcacgccaccctgctagtctgctaccttggacgctggcctctgagctcccattgagcagatttggctagatctggcctcgatggtcaccgccgtgtttgatagtgcgcctacaagtatgtgtatagtttcctcttcactaaacaacaatcatggcataaaatataagatattattgttttattaattaaaattaaaaaggtctattatatattgtcttcagtattttctttatgacgcagagggtgtaaaagattgcaatcttgtgtcaatttttatacatgtccttatgctctcttcatcctcaaatataatactttttagtatgtacaaatcatttataaaaagggatgttaagaaataatagtacccgggataagtatttgaaagtagaaattgttcgatgagcctgacgtcatcatcttcaatcccactattctatttcattagttgtttgcaaacaattgtttggaccttaagcggttatcaccaccattttgtctcactgtatagccatccacagtgagttccatccctcctttcttccttttctttgagagcatctccaatagaattagactcttcaaatacccatatagccagtttttcaactgatttgggtagtcaaactaggtgctcaccctttgaatcgcaaggtttaacaaacggaggaataggaaaaacacatgattctaaccggaatcaaagtgtaaaatagagcattgcaaacaaaggaaaaaacacaggaatgcctaaaacgtttgattggactataggaaaaacgcaggaatcagatgagagagatagacttaaaggaaattttcctaagtttcctccaaaatctacatgcaatgtgtcatttcataagaatttcatcggatttggaaagcttcaatcctttgaatcaaagggccaaataagaaaaatttctatagtatttgaatcctatgaaatatctacataaatcctttgattcaaaggggccctattaaatatctctaaaatgaggacccatatgtcaactctaccaccccttgttcttcctcctctttctccccctctccctcttatcctgctggggaatggggccctatccatgagctcctccctgacccactccctctgttgtggcaatgatgtctgtgcacgccactgctccgcgggggagggaaaggaggtagtgacagaggatccgtgcgcgcgaggtaggctcatgggtgtgacggaggatatctgtgcgagcgaggggggggggaggtgttggcgggaggcgatggcaactgtggatccgtgcatgcgaggcgggctcgggagtgcggcggcggatccgagcgtgcaaggcaacagcgatggcggttccccaccttgccggcctgtccttctccacaaccattcatgtgcggcaggctcggccagtgagccgttgagcctccctccctctctcactatcctctcgccccgccgccgcatcctctctccctcgctaatgcccagccactgcaccctccctccctcgctgcttagatgcagagaatgcgtggaaatgagcatgccaggtgtggggtccataattggtgagccagtttggtcagtgaagggaggagttggcaagccatcaagctttgccatccagatagagatgctgttggagtgagattttttttgctagaatcactaaaatttggcttagagagttatgatagatggagctggatgagtactaggccttttcatctcacatagttttctttcttgaatatatatttttgttgttcaggaactactcgctgtcaaatttgttgtttttttctctaagctagtgtacatcaaatttaattatgcttatttgtacatgaattctatattatgaaatactcctagttgtattttggctttacaactatttcaatcacatgtaagcactaagcagcgggtgcatacgcacctgaccgggtataaaaaaatcttggaccgttttcatctactctccattaggaaaagatgacaattctaagagggcgtaggggaaattagtacgaaagacaaattacctatatgtctcatatttaggccctttttgtttagacttataaaccaacttataagtcaaaaagtctaaacctaaacaaacaagtagctttttcgtttggcttttttaatgccataagccactctaacactattaaaccaaaagctaggttggagaagctttttttggcttatatgaggtagatgtatgtctccacaactaaacgtaggacattaaattcactgacttataaatcatataagccaataagctgacttaaaagtctaagccaataagtctaagcctaaacaaagaggaccttaataaggacggttgaggataaaatatggaaaacaaataaatggaggtgattgtttaattgatgggataagtagtactttataattataattatagttcttttataaaatttgaatgctaattaactgcaatcttcttatgagtatattgtactgctgcagcaagcaaagctgtcggaggaagcaacatgatgccaacatgcacctgtataatcgagaattactgtccataatgcgacccgatatggacgggtcggagtctcagagatgatgtgtatcgaccacagagcttgttcagtcatgttagctctaccctggaagatactgatctgatcaacgtggacgtttggactaattgaattaaatggtgaaaaggacatgcaaatcacattcaagcatgtgttgagaaatactggatggaaaatgaatgatgacacatatatcacattcatatattataatatacggagtatatgcgacaaatagagattgttgcatccttcacgcatggccgcacaatgtgtgataatgttgataactcgatattatattattatttggagacaacccaactaatctgcgtggggtcgaagcttatgatctcttgcagaagtgtgcacgctcctgcatatatgctacctttgccttatccaccagctcatggcacattggcatcaggggtagtacggttccaagctcactaattcagcgaaatgttcctggcgcctgaaaagtatgtatacagacagctactgaaataccgttaaatttccgtcatatttttatgactttagatcaaatcaagcttcgtgtgttattcacaccttatcttaattatttactctttctgtttcaaactgctcattgttctaagtttatcttaagccaaacatgcctatctttcactctaaatttttagaaatgtagttttaacaatatgattgtaaatcgcatgataatctaaaaaatataaatcttagtaggatgttaactacatgtgtttgtagaaattaatggcaaaaaaaatgaaatatttaatttaatacaaactaaattgataagtaatttgaaacggtagagagtattagttctctccacctctcccatgatgaaaagcatgagccgcgttcttcgcttcagccgctagatcctccatctctcctctaccttccccatcgtctcgcctccataaggcgagcaatacaagagacccgcaccccaccactttcgtgcgttccacttccatctagatactctagatgtgccacttcaaaaagcattagcgactctgaatcatttggttctgcttgtgttgaaagatataataggtatcatttggatcatgctctcgataaatgtttgaccattattgttagttccacttgtggagatatattggaatgagactggcgtggaacatttccctcaaaagtctgacattgtttcatctctcgtacggaactgtcaaaactagaggaaaaaaatggttcaataatttaaacggtgaaacacaatcgaaccacacttcgaatcattttgttctaacatttgaaaaaaatgaaatgccataaatataccactccagtattttgattcaacacaaatgaacattaaaattgattgtctgaaacataaaaaaaaaagagtatattgcacccacggtataacaacttggcgggtgtgtgagatatagtgcaagaacttaagaattaaacgttcgagtgcaacaacttgacaagtgagttctagtataagaacttgacaatttagtttttggtgcatcaatttaactaagcatatgctaggtgagtttttctcacgatatcaatatgacattacatagcaatcctacggatattacctaataatattgaatttaatctttaagaattatactgcacatctaatttacatcaactacctttaagaatttttgttttcttcaccttccaaaatctcaaccgaaattaaatttctacatccagtttaattgactttcaaatattagttattcggataaaaatataaatatgcttatatacaaatcgacgctagtatatcgtcaaaataagtacttaaaaattgaatatgtataaaaaaagtgctctaaataattaagttgccgcgtaacttcttaacttattgtatcaaaatcgtatatatcttgcaagttgttgtatttatgcgatcacttatacagttcttgtactaaattacacctacttgccaagttgttacactggaacaatcatttcttaagttcttgaaccaaattacacctacctgccaagttgatgcaccgtgggtgcaatttactctaaaaaaatcataaaaaatctacttctttctgctcgatctgtcgctattggtgctataggtgggtccttgcccgagatcctatgggaccgtcgtaccacgccaccattgaggttgccaaggccaagctcatcatgctgccatcgaggatgagaggctatcactactatgagaaaggttttttcgggcggtcaaaaccagttttcgcgtgtgggtgggcggcccacacacaccaggggtctgcaaaaatcgctattttttttgcgtgtggcgcacccgcacggaaaaacaaaaatccaataaaataaaattaaaaaaaaattgaaaacctagaatccggcggcgccaccgctcccggccaccatgtcctcgtcgtcgtcgtcctcctcctcctcctcctcctcatcgtcgtcatcggccgaggacgccgctcttgcccttgtggtcatggacagcagcctccgcgcatcccgtcgccggatccgccctcccaccggcctctgcgcccccctccggccacgctgctaacgcccctcccctccggaggggagccggatcctgcgggggaaggtggctgacctccggatccgtgcggggacagctgccgccgccggatccgtgctggggttggccgccgctcgctggatcccgcgtgtcgtcgccgtgccgccgctgccgctgcgctgcctatgcctgtcgtggccgtcgggactcaatcaggaggagaggagaggagaggacggggaaaaagagatagagaggagagaggagaggagaaaaagaggagaggagagaagaaaaggagatggagaggagagaggagaggagacgaagaggggaaaatttaaagtgggtaggagggaaagagagagtgggtatttttgtgtgcggctctcttaatatgtccgcatgcaaaaaataggcttattttcgtgtgcggttcatttaagaggaccgcatggaaaaatcaaatttttagtgctgtcctcttaaatgaaccgcacgtgaaaatgagcttagtttctcatacgcgaccagttatggtccgcctacaatctaaataggaaaatcatttttgtagtagtgtattcttgtcataagtgagagaagtatagacaaatagggagagtggagagagtgacagttcgagaggtttgaagagaggataagatagaatcaaggttgagtggtggagaaatcgtgggatgaggggtgtgtccgatatttgacctcgcgtcaaacacttgatttataactttttcagatatactggaaacttaaccatcaaataggaatcaaaatatattaatatctttgtaaaattatggaaaatatttaatatattatatattcatgtagaactaatggttatgtacatcgaatttaaatttatggtttcatcatgtgatagattaaaccatagtcatatcggattttcccttaacatacttttaattttgatcgtacacattaattagagaaacaaagtgacaaatttttcatgaaaggtagccgtgcctgtgctattagtcgtttagaggctatttagattgtagctgaagtaaattttggtaagttggcaatattatcaaaattttggcaggatttcttatgtatttacttaagtttgccaataaactaaaactaaatgtaagcacttttatgacaacttgccaaaaaatgatatggttgaaaaataacatcaatatgaatagcccattaatttctcctttatctcaatttgaattctaattttgtgaagatagaggtcgcaacacccatacactgttaattatttcttttgtataaaagaaagttttataatcatttttttcaccaaatgaacatttatactctctttagataagtccaattcgaatatttactatgtcctgtcccaaaataaagtgcatttttagtatactactttttttccctgtaaaatgtactttatcgggcttattcatggatggagataatatatatttttagatgatactccacgttttatatgaaatacggtagaaatgatgaattaatataagttaagatattaaaaaatgatgtggtacattgagctctaaaacgaaaaaaatatagatgatgtatcatgtttatatttaacatataataattgttaatgatgtgatatattgtacgttaaatatggtaggatctgtagtagctactcggttgtactcccttcgtttcataatataaaattttttagcatcgtctacattcatatagatactatctagatttattagtatctgtgaaaaggaggaagtagtttagtatagatcaggagatacttgtgggtgtcaaaagagtttccccgtaatatttgtcccgtacgtgtatgctgtgccaatacaagtataggtacatgcatctgctccttctgggcggctagctagtgcctagtagtacgtgcaacgtgcggtggtgttggatcgatcgaatcgtgcagggggctgtgtgttggtgaaggaaggttggccgttggggaaaaagacagacgaacgagctgatcctgccgccgcgcgcgtagcgctgccgcacgcgcgttcgtcagccgtcggccgggggtaggtagatggtcaaatgccagcgccgatggatcggacaaaactagcataatcacgcgtgtgcgccataattagcaaggaaaagtaattaagtacgtgtgcaagattaattagataagatcagcacgacatcgaccaaatctagttagtcttatcacatcatgtcaaagcttaatcgatcaccatatatatagcttgaaaagcgcgatggtacaaacattttattcgtctagaggattaaatatccctcaaagataatatactcctcttaatttatccttgctttgcactaccatattttacttgtatcggtgctcgtcatcatcgtgatagaatacagtggtggatcaaggaatttaactttagagtgaatcagatctattaattgccaccgttgcagcttaaactaggtttattcctacgttttattttggaataggtgaattaacgtgtactttgcctcaattttagctagctttgttccatgtcactattgcctgtcatatctcatatgtttcctctgggtcaggctgctgaaaatggggacgaccccactaccctgctactcctccagaacatctgcaactctctattgccttttttttttaataatggaatagaaatccatcctagcccttgctcaaactagttacactcaaaacgagtgcaccatttatcgccttactctgattactcctctctagataagataatgccaatgatcactatgttaagatgccttcttcttcccctaaaccatgtttctcctcgatctccactataccttcgcgttagctcagtctctgcctttgcaattgcatcaccactgtctagctccaccgtgtttcatcgatctccgccttttgcttgtcctctttccttttctggacttacccattgcccccatagctcttcctccgcctagttgctccaaagctcagcctccacccaccggtgccattatgcgccttcattctcgccatagtcacactagtgcagacagtgttgaagaggattttgttatgggagctcgtcatcgagagatatttgatagcagctgttttttttatggtcgggctcacaggtaggtcattggtccaaactgttcaaactgagtaaaatggctagtctaagattaaaactttgacattgacaaagaaaagaacttctatttcaatgtgcaatttactctttttttttagatttattgattgaaggggccgggcaatagtactaatttaattaaaatttatttatatttgaactttttagtgctgatttttgcatcctactcgggaggccttggcttgccagagtatgaaatagggatagtccccaaaactgaagttatatgttttgatttttgcgtattggatgctctctgatacatgtcaggtatatgtttacttaaaaaatgacttttgaaacacaccctcttttttttttctaagccaaattgaaagaaggcccgtatataaaaagagttgaaagatacgggccctcttttaatttcaaaaatgtgaaatccattttcgcaagcgtctaagaggttcgtctaagaattttcgtacccgaccagctccatctcctttagggagaatctagcctatgttctctgaactttgagagatttatctattattagtttaactaattaattaattcttcaaagttatttggattgtcggtagttatctatatggttgttcaatcgctttcgtgccggtgaatctgtgaaggtttgtaacgtcctgattttggctcaagtttaaaacctattttgaatacaaattctattttttaaattttatctcttatttgaattttggtttggtgccattaaagatctcaaatcaatcattcaaagtccatctaaaacatcctaaaataattagagttcctaagcccatttacaattacaacaacacccctaaaaaattcaatatctgaaattcctataaattctgaaacattattatttcagtgggctaccgtttcttttccctagcccaactccttcccctctatctctttctctcccagtctagacacccctatcctcttccctgtgggggaggggcgccgccaccaggagcacagggacgaccgccggcttgaatccgccgctgctcctaaccaccgcgctgcgcctgctcccacccgtctcactattgccacccaccccagcgggcacctgcgagtgagagaagaggaggtgagagggatgagaggaaaggagatgataaggatgaaataatgagtagaagctcatttcaaaaagataatgagtggaaatgagagatggagagaggataaggatggaaaattttgaagcgttggaggaggagaggaggtaacttagactttaggcggatccttaagaggcccacctgtgaaaatcgattttcgcgtgcagtcctcttaaggagccgtatgcgaaaatagggattgatttttgcagacgcgatcagttatggtccatctgcaactaaaagagggtctcgtccaaaaaaatcatttctgtagtagtgcgcgccgcgcgcactactccactgtgcccaatccaccgtctcgccttctcgtgctccagctgcagcggtcgcccatcaaagatgaaaggtgtgagctcacactgctactgtccctattcccttttgccaccatgcctcctcccttcgtcccgaagccattgcagctcctgcatctacttgctgcggctataaaagccttcgcggtctgccatcttcctcctttcgcccttcccatcaccgctgccaccttcaaacatcatcagccagcccgaggcgcatcgacgagcatcttgggtgcacacggagccgcgccgttggactcgtgcattgctcgaccaaacaccatcggctgccgtcccttcccgagctagctcgccactagcaccgccaccaccccaaacaaccgtgctaccgcctcctggccaggcagctcgctacctccgccgttgttaacgatcaaatttggtaatccaaggatcggagatgaagaagaaatcgagacggagttcgagatggagatagtctcagaaacagagtgaggatcggctggagtccgaatcggctgcgatcaggatcagcagagtccgagttggacggggttagccgattgaaccgaattcggcagtatgacatggtacacgttgtcgggttaggttgatgtacttcatgaggattgccacgcatgggtagagtcctaagaaggcaattgtatctattaattaggatacaaaccagggtgccaccgcgctcggccaagcctaaccaatataagcgccgcatccacgaccttctgctcgccggtcgccctatacgtagggctccatctgcagagataccactgccgcccctatcgccgcctgtctggaaagccagtagagccatcaccactgtctttgcctcgatccaggctgccattgcgctaggtcgagcaccgctcgcgtggccgcctactccccaccgccctatcagtgacctccgcactccaactcctttgctccaccgccctccgtcgtcgccgtgcgtagctctctctcactcgggtggggagagtgtgaggactgaggagaggatgagaaattgaaaagaagagaggagaaaagaaaaggagaagaggcactggttaggtggaccccacggtccctaatcaagctttacaagtaattgttctcctaatcccgtccgatgtctctatgacatgtgggtctagtctttataatttctaaataaacttccttttaggcagtggcataattccatggttgagtatttgtcatggtttgtggatgcatggatggttgccaaacatgcaagtaattttggttggtatcttggttgggcttcccaaattaaaaatatggtgaagaattgttgcgacaggcaaataggaccagcaattttgacacttctataattgagattaacacacatgttcagaaacattcagcttatactcaagtgcatagcaaagctgaggtagttactgttaaacctgaaacaaaagagctaatgaaccctgaactccggtcctttgctctgcttgtcagcaacaagattgaggaaaatgattttgtcttgctgcttccgaaacatctcacttccttaagattgatagctaagattgcattgatcatgcaatgggatctagctgaaagcgaaggacaaatttataaagcttttgggacagtacaagtgtgcaatataaatcaagagtggagctttgcaagttcagaagtttatttgatatcgacttgcggacaagtcgaatttcaaggaaagaggattgttagaatccacgggctatacatgggccgattcagctgctactctaacaaaagcccagttatgcctatgagattaatacaaaaaggcagcagcagcaagcttctaggatcgatcgatcaatcaaccaaggcggcgaaatgcggcggtgtcctggtggctaggcttggcaccttggcgatcttcttcctccctatcttcctcctaccttcaaccctctactttagtttctagaaacttccataacattgtattactttgtttcctcctctccttttccccaaaaacactttgttccagttgtttatcatagcaatcgagttgagagatttaggtctctaacaatagcatgcctctatagtaacaatgaacttagaaaaaacaaatatggtggtcacagcccacttcatgttagaataattgggctaggcccaatttataatattaaatctcaaaggcccataataaatattgaggataataataccacctcaggatttaagcgagaaatatctcaacctaaatagggagttattggaggctccctattgaccagttgaggtgggggtcggaatgccacacgcgcgcgcgcgcgcgtcgggccgggccgtgggcgtgggcgtggcgtggctggcgtcttgcgtgcgtcacgtcacgtcgctatccttttgcagccactaacccacgttcccacgattccctccgcaacagcgcgtccacgttctttctcctgatagataaggaggccgcgagtccgatccgagtttgtcgcttctttcccggtgttagtttctccttctccgcgcctgagttgctctcgcttgcccacttctgatctcttgcgcgcacgagagattggaaggagcagtgcctccgaaaccacaccttcgcctgagatctgcaccgggtaggcaggtgatcaggtttttagggagtgcctcccgcgcacgacagctcatcgccatgtctggagttgccgccgccactgctggcggaggtggtgcgccgccgccgacaggagctagatctggatctggagctggtgcgccaggaggtgccgtgaacgacaacaacaacggaggcaattctgcctcaccatccagcggagggccattctcggggtataatcttctcctcctgctactgttgttagcgctatcgctatactatgtgcgctatgttcttgttcctgttctacatgatgcctctagcatgttatcgcgttactggtatgttcctgttcctgacatttatgatgcgcatagtatgctactggttatgttaagatcaccttacactgcttatgtcatgatcattgtttcaatttcttggattaaaatatgccgattaatgactatatttccaacaatccaaaaacctgataggtcattttcggttgttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatgtcatggagcagttctatgactacaagatggtcgatgaccgttctgtagtagaacaagctcatgagattcagatgctggctaaggaacttgagaacaacaactatgagttgccggacaagtttgtggcgggtggcattattgccaaactaccacattcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaagggagactgctttgtgtgtggcaagtctgggcattgggctaaggactgtcctgagcgcaaagacaggaagtctgccaacatgatcattagcgagggcggaggaacatcggggtacggtaaaatattacctacagttctctctgtttttcattcacctgattggtgggtggatactggtgctaatattcatgtatgtgctgacatttttctgttttcttcttatcaggtcgggagaggttcctccttgttgatgggaaacaggtcgcttgcggctgttcatggtgttggtacggtcgatctgaagtttacttcgggaaagaccgtgcagctgaagaacgtgcatcatgtcccttcaataaagaagaatctagttagcggctctgtattgtgtagagaaggttttagacttgtgtttgagtccaataaatgtgtcgtatctaaatatgggacttttgttggaaaaggttatgacaacggaggcttgttccgcttttctttgaatgacatgtgtaataatcataatgctgtgaaccatattagcgagaatgatgagtctaatgtgtggcattcgcgactctgtcatgtgaatttcgattgtatgacgcgcttagctaacatgagtttaattccaaaattcactttggtcaaaggttccaagtgccatacttgtgttcaatcgaaacaacctcgcaagcctcacaaggcatctaaggcgaggaatttggcacctctagaacttgttcattccgatttgtgcgaaatgaacgg

SEQ ID NO: 42765 - DNA, 3572 bp, Oryza sativa
cttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaaaaaccgtactctaactgagatggtgaatgccatgttagatactgcggggctttccaaggaatggtggggtgaggcagttttgactgcgtgtcatgtcctgaataaaattccaatgaagcataaggaagtaacaccattcgaggaatgggaatggaagaaattaaatctctcatacctacgaacatggggctgtttggccaaggtaaatgtacctatagccaaaaagcggaaacttggaccaaaaactgttgattgtgtgtttcttggttatgctatccacagtgtgggttatagattcttaatagcaaactccggagtacccgacatgcatgctggtacaatttttgagtccagagatgctacattctttgagaatgaatttcctatgaaatatacacctagcacttctagtaaagaaactgtcatgccccatgagcactttgcaccgatagaacacaatgatcaaatgcctgaggaaaatcctgaggaggacaacattgtagatactcgcaagagtaagagacaaagggttgcaaaatcctttggagatgactacattgtatacctcgtggatgacaccccaagaaccgtagaagaggcatattcatctcctgacgctgactactggaaggaagcagtacgcagtgaaatggactcgattatgtctaatggtacttgggaagtcgttgagcgtccatatgggtgcaagcccataggatgcaaatgggttttcaagaaaaagcttaggcctgatggtacaatcgaaaagtacaaggcaaggcttgtggccaagagttatacccaaaaggaaggcgaggacttctttgacacatactcaccagttgctcgcttgaccacgattcgagtactacttgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaggatttgggagaggctgatgttattcttaacatcaaactataaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacagctagaaatctggcagatcagtttatcaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcgatcactagatactcatgaaaggcctggagtttgacttatatgctccaaacagaggggatgcgaacggcagcccagtgccagtcaaggttctgagtgaaacctgatcacacaaaacttacaattcaaggcatagtccattgttcagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaatttataatattaaatctcaaaggcccataataaatgttgaggataataataccacctcaggatttaagcgagaaatatctcaacctaaatagggagttattggaggctccctgttgaccagttgaggtgggggtcggaatgctacacgcgcgcgcgcgcgccgggccggggcgtgggcgtgggcgagggcgtggcgtggctggctggcggcgtgcgtgcgtgcgtcacgtcgctatccttttgcagccactaacccacgttcccacgattccctccgcaacagcgcgtccacgttttttctcctgatagataaggaggccgcgagtccgatccgagtttgtcgcttctttcccggtgttagtttctccttctccgcgcctgagttgctctcgcttccccgcttctgatctcttgcgcgcacgagagattggaaggagcagtgcctccgaaaccacaccttcgcctgagatctgcaccgggtaggcgggtgatcaggtttttggggagtgcctcccgcgcacgactgctcatcgccatgtctggagttgccgccgccactgctggcggaggtggtgcgccgccgccgacaggagctggatctggatccggagctggtgcgccaggaggtgccgtgaacgacaacaacaacggaggcaattctgcctcaccatccagcggagggccattctcggggtataatcttctcctcctgctactggtggtagcgctatcgctat

SEQ ID NO: 42766 - DNA, 57610 bp, Oryza sativa
tatacagcagaatagaagagcagggtgattttcttttaacccctgccttctattgaatggacatgagttaacatcacaacaaaatatagaatttgttgttgaatcccccagaatatggaatatcttcaaacaaatatactagtatcacttatgggatggcctggaccatcctacgttcgcgccccgtctggtgcatgggttttctcgctgttattcttctctatcaatgagtaggtgctaagtttctcttagcatcccacgttctattttcaaaagaatgtcacttatttgtgattggactgtacgtgttgcactgaaaactgtttcagatggatattggtcgtgtgcaaaatgtgatgtttatcccttctcctacttaattgaatagcagagctcctaattttatcgctcagaaatgtgatgtttagagcaatccaatggtagtgtttaagggtgatgtcctggggtggggtggagacagtattcctgaatttcgtacaaacagccagattataactgtttctaaaaagttaagtttggaagttgaactgatatatctgatgattcaactaaagcttggtgagcagaggttcgtcctcatcatagtagaaatacataattcataatttgcgccctagtagtacatggtggctggcaatgagtcccaaacatttagggactgttggaagaagagaaaattgaaatgcaaagtatccgacaagcaagcacatgagtaaacaaaaacacaacagcaagcgttgttatgtccgatgggttatgctcggctggcagatgccacgttaaattactagaaattaaccaaacggttggttaatttctagtactaagggtgtgggtatggtatggaactatggatagctaacactatatcagtcgagttcatccagcatggactgaatggaatcgatatctttacgcatttcattaatatagtagcaagttaggcctaaagcaaaaacggaccatccagcggtgaagcatgcgaagcggtcggcgaaaaccttaagacgcgcgtgtgtgtgtgtctctctctctctttctctctctctctctctatatatatatatatatatatatatatatatatataatatatatatatatataatctacaaacaaatatgtgttggcaacttttgtgacgagttgacaagcacgatcgtagcaccttatgccttgcggtgatcctagagtcgtcaaccacctcgatctagcaaaaagctaaacctagatgggttttgataactaaaccgactagcggagccgttttctagatagctacccgtctcgtgggcagaacggaaggttttcaggacaaacctacaaagagatgtcgcactctcgcagcggcggcggacggtttacggcgcaaaccgacaaagatggacaaactaagagaaaactaaaagcaatatgaaaaaacgattcgattgattgattgtagcttggttttttacaatgaaccggccatgtcccttatataggggttggtcttgccctctacaggccctcctccacgtccaactcggggtagaaatcaaaggaaacccgaaacatgccttcccgagcaaggaaacctcgaaacccgacgaaacagagtcggactcagacctgccggtcagaccggccacacaacgccaatctgaccggccctcaaccggcggtctgaccgcccaacacaaggcggtcagaccggcccactcggaggaaaccggtagacttccaaattttggcaatatttcctattttaatcctaggtgccaaatttgggtgtaaacaccctgcctttttgatgaacaacgtgaatctaaaaacatagaacatgtttttggtcttaggacgataactcaattaccggccgtagtacctcctaagcgtcttgccaaacgctcgggaagtatttcttcaagtatttcccgttgattgctcgctaaaaacgctcccctcgaagtgtctccaaaaaatatgcgttccctcgaacaataccgcatactcgataaggaccttcccaactaggagaccacttaccgaactccctggatcgagtacccaaaggcaaaattgtcttccaaaccaagtctccaacttgaaacaactttgctttcacccttttgttatacgccttggccaccctcttcttctctttctctatctcttccaaagccttcaagcgcttgtcgatgacctcatcaaggttgtctcccatcaacatcttttaatcttcacttgacaaatcatcttgcttgatataacgaagagaaccaagatttacctcaaccggtaaaacgacttcttgaccataaaccaactcaaaaggagtgactttagtagcaccatgtttagatatcctatgagcccacaatgcttcagaaagcacctcatgccacctctttgggtgttcctcaatcttctttttcactagcttcaacaatgttttattactcgactcggcttgtccattagcctgagcgtagtaaggagaagaactcaacaatttaataccataagattcggcaaaactctttacttccttagacgtaaaagaagcaccttgatccgtagttaatgtttgcggaatatcgaatctatggataatatgcttcaaaataaagtcaattacctccgtatgagtcatgttcttgagaggcacggcttcggcccacttggtgaagtaattcgtagcaactagcacgaacctatgcccctttgatgacgaagaataaatttgaccaataaaatccaaagcccaacctcggaacggccatggtttgattatagggtttaacacggcggcgggcgccaattgaacattgccgaaccgttgacaagcttcacatctcctatagtatttgaagcaattctcaatcatccttggccaatagaaccccgctctcctaagcaaccaattcatcttgtgggctgattgatgagttccacaaattccttcatgtacctctgccatagccactttagactgatcttcatctaggcacttcaacaagacaccatctatatttcggcgatatacatcttcatcaagcaatggatatttgaacgcttgccaccgaattttccgatcaaccttaagtgtgggatctttcaaatatcgaatcaaatgaatcctccaatcctcctctgtttcctgggcacaaatgttcgaattcacagttaatttggcctctaaattgattatggcatgccccccagcgctctgcccaaaaccggtcagaccggccatacaaggccggccagaccgttcggggtcaccggtcagaccggcggcatgtggccggtcagaccgcccctggtcaccggtcagaccggccgtgcaatgccggtcagaccggccctggtctccaattttgccaatttcgcacaaagatttaaaattaagcaccggctcttctgtcacgtcccaaaacgaccctaaaatatatcctttaaattatgcctagaataattaaaatcctagtgaaagcctccaaaaattaaaatgtgccatgttaaaagtcaaataaggcttggaggatttttgtatatttcctaaaagactaaaatgtgtaaataaattttagtggaattttcagagcacaaataataattatcaagaaataaacaaagttgaaaaggttttataaaaagaaaaaccctaaaaccctccttccctctctctgggccaaatccggcccaactccctccccctctctctcctctccccgggccactcggcctccccctctctccccgcatgcgcgccgctgacgggcgggcccgcccaccaccctcgctgacgggtggggcccacccgtcatccccttcctcccgccgctccgcctgcacctagcaccaccgccgccgcgaatcccgccgctccttaccgttcccgcgtgcaattaagtggggggaaatattccccgtgattccctctcccattccccctattttcccctctctctcccacgttcaaatggcaagatttgctcccgcaaatctcgccggcgccattgatgccgaccgggaaccccgcgccggtttccttccccgccggccggcctttttactcccaaccctatataaaccctccccgcgcctccctcgtccgtttccgacactcgccgccctatctccccgccggaatcgagctcgcactgtcatcctctctcttcgccgtcgccgtcgacctccggccgggcctatccgctcgccgggaccgtcccccgcctcggcgtcgtctcctccggcttcgccacaccgccgccgatcccgtctaccgcctcgccgagctcgccgaccgccggacgccgctgtccccgtcaacccgagccgcgccaccgcctccctccactccggccacctcctccgtcgccgccgtcgccccgcggtgagccgtggaccgccgcctcctttccccttcccttctcttctctcggccgccgctccgccgcgcctatggccgccgccagcgaccacagggcgcgggcgccgcctcccgccagccgcgccgacgtggccgcctccgggagcgccgtgtggccgccgcgtggggcccggccgtcagccgcccgtgccctcgggtgcggctgacgagtggggcccacggcgccggctggtgagccgcgggtgcacccggtccaccgtggaccgaggggctgccgcgtggggcccaccactcccgtggacccggtccgcgcgccccctcccctcggctgacgcaataaaccctattttttaattaaaatttaaatgaagaaattcgcaaatattcacttaaaagagcatataaacttcaggctataacttggccgtttgaactcagaattggaccgttcaagtctctaatttttccttaagaagtcaagaaccctttttgtgctttgtttctgcttgttatatggattttattagagtaaaagcctttttctttccattggtcgtgtagacgctgcagcttcggaagatccgctctacgtagaggttaaaacagacttttgggaaagcgagaaaggcaagtcacatcattcttgaacatatcgaatcccagtttataaaattattttggtttaaattactgcattatcgctttatttaaattcccgcgttatcactgtcttatttagccatgcctatttacctttgttatgaccttattattattgctattattattattaccttgttcaccctaggataaacaaaaccccaactagttggtaccctattcatggttccactagtatgaatttagctagctgcttcgctaacttattaggcaacattaggtggttttataaccttagactttgggaatgctcatatcatttggacattatggaatggttggattatgtggaattggacacacacttcccccccccctattcaaaaccctcaaactggttttaggctgggctcgaggtgcatggttttgatagtatcaccttggccactataaggaccggtcttcgggcctctgttgcaaagcactgccgtacttccacatgtctagtgggtaagacttagtttgtggctcagtctggtcatgggcaaaagtacacggatggagacggacgaagtcggagctcgatggacatctctaggacaaatgaaggctacacgagccgtggcccggtagtcgagatgtcatggcacagggcccatgtcctgttgcttggggctcaatcctgcctacctgtctcgggggttccggccgtaggcagggttgggtcggtactcttgtctatggctaggatgggttgggaactatgtcacgtcttccgcccgtatgccatggtggtatgtggcacgtggttacacgtaaggaagacgtgtcttgtgggtaaagttgtacacctctgatcagagtacaatctattcgaatagccgcgccctcggttatgggcaagcctagcaatgtacccaagttagtgttttaattcttaaaacatgcctaacaactaaaatgtggaatggttggcctgggttggcttgggacgagatgggacctgggtctggttgccagttcggtctaaatcatcgtaggccttgggttaaggcaggttcgtgtgggttcacggccttgaataataacattgtgtagctctaggatcgtctttacaacatagcctagagcaactaaaagtcttttaaatgctgtttactgcaaaccctaacccctttattataactcccttgtactcctttgcatttattctgcattcatgggtgtgtcttgttgagtatggtggttgtactcaatcttgctcaatttttccccaactcagaagaagagttcctggaggatgaaggctttggtgtctagctcgtgcttgccgtcaagtgcctgtggtcatcgccctagtctttcgcagttttccgtttatcttcgtgtatgctgggccttcgtcgcccatgtaataaattaactatttacgcttccgcttgttaaactctgaattgtatcaacttttggtgtaccttgcctcctgggacaaggaataatatacgaacgtatggaatgctcgttgggttaattccggtcgtgacatcttccaataccagaaataatcccttcttcacattatagccagatgcttgttgtgccaaatcatttgctctagaattatcatgcctagcaatatgtctaatagcaaaattatcaaaattggcaataatatccaagcatgaatcgaggtacctatttagtgatccgtccaagcatttataaattccggcgacttgttgcaccaccaattccgaatcaccaaaagcttccacgtgcttagctccaaccatctccatgacttgtaagccgaataacaaagcattgtattcggcttgattatttgtacaataatattccaagcgaaccgatgcttcataacacattccattaggcgaaaacgaaactacccctatgccttgaccttctttgcaagaggaaccatcaaaataaatattccaaggtataacttcaacaatacaaacttctccctcataagcaatatccacatgatggtctactataaaattacatacaatttagcctctcatagatttaaatttttcataagccaaatcatattctatcaaagcatatgcccatttgccaattctcccacttagaattggcctttgcaacatgtgtttaataacatcggcttgacaagcaactatgcatgtactagataacaaataatgcctcaatttggtacaagcatagacaaagtctctctataaagacataccttgtttcggcatccaaaagacggcggctcaaatatgtaaaaatatactccttgccatcttcctcttgcgtcaaaacggcaccaatgactttgtcttcggaggcaatatataaccgaaaaggctttctggctttaggcacccgcacaacaggtggagtagacaaataccttttcaacccttcaaacgcctcttgctgttttgctccccaagtaaaatcggcttcctttctcaagcgaagtataggaacaaaagcatcgattttacccgctagattagaaataaatcttctcaaataattcacctttcctagcaacttttgaacttcctttttgcatgtcggtgatttgaaatcacgaattttttctatcttcttaggatcaatctcaactcctctctcatgcaccatgaatcctaagaacttccccgccgacacaccaaaagcacatttaagtgggttcatcttcaaaccataccggcgcatcctctcaaaggctaacctcaaataggctatatgtccctccataccatccgatttgacaacaatatcatcaatatagatatctaagataatccctagcaaatcatggaagatcaaattcattgccctttgatatgttgcaccggcgttgtcacgcccggaaatttactagtaatttccaaactaatttatacataaaatcctcgtccaggaatcagccgaggtacacaaactgacaatttaatatacaaatccatcataataataacgttacatacttacaaaagaaaagaaaaacagcagcggaattaacggtctagcgatggcttcagctccactcccacaggcagctcaactggggtataagccaaacgtctactcctggatcctttctcttcaactgaggttgattgattattgcaaggtgagcatatgacatactcaataagccacacagcaaatatgcaagtgcacaaggataccaaaggatggcataatataggctcatttgcaaaagcagcatttacaaagatttaaaagtaaaacagtagagtaattaatcagaaattttaatcaacactgaacagcacacccatgctgctcaggcccaaccatcctgaacaaccatacccggctgtacagatctaactccaaaccaggagctaaacaaattattaccagttattgcatcaataattatttgtgagaggtgtgagactaatcacgaaaaacattgctcaactcgctcataaccgctggcacggctattcgaatagttttactctggccagaggtgtaccactgtacccacaagacacagcctcaacatcatgtctaccatgcgttgcgatactagaaagtacccgaatagaggctgtgacaataccccctgcacaacacaactcaccacagtgcaccattcctggatcataatcaccctctctataaatataaccagaggcatggactccccagcgatccccacggacttctcaccgcttctccgtctggcaccccgtaatgaacaatgctatacaaaaggtaaagccgttgcccacgttggcttgtggttggtacggttaatgtttcacaacagtagctcgcgaaccggtctttaattgtcatgagcacgaccttcaaaaccatgtgctcacaacccaccattaatcatattttaattactaattaattatcataacacgattaaccatcgtgagctatcattaaatataaccataaataataatgtagtatatatgattcatcccattagtgagctaatgtttctaagcatggctaagcaattatatatataacatttagctgaaccaaaccaatacataaggttcaaggttcaagctagtcaatttattacccaaggtatcaaggaatagggcattcaatgcaaattggccataacaaaggaataggttcacaccacccggtgacattcgaaaattaataaacagttgaaataaatagagaatttaaatataggatcaacatgctcaaaggattgtgtttaggatctgtgtgacttgccttgagcttccccaaacgcttccgaaccttcctcaacgaaaacgctctcctccgaaatgtcggaaactaaagcaaaagaacaaaatcaacaaaacagtacaaaaacaagcataaatagtacatgtggatatttttaactgaagatctcgattttagatgaattagcaacttgaaccactcaaatccgagttacgatgatttagttatgaatttatgaagtttaatcgattttcatctaataaagaaaacctagaaaaagggatttatgacgtcatcgctgacgtcatcatcgccggccatggcacagttgacacgaccaccggcaaaagagggctcggttgggctatccgaggacacctacgcgtagaggacgacgacgcgaactcaccggtgcaaagaacaacgacggacaacgacgaacgacggccggcgacgaggttcaatggcggcacggttcggcttgacggcggcgatggtgctccggtggtcttcggcggctgcgaaggggcggacggggttcctctcctccgtgcgcacccgacggcggcgacggacggcagcggcgacgatgctagcggcggcggctctacgggcgacgagagagctcgggagatggggcaaacgaaagaggacgactaggggatgctatttataggcttggattgaagagatcagactccaaccgagaggaatcgaagccggaaaaaccgagggttagttagagagataaactcgaaaacgaattcgattccgcgttgatttcttcgggataaagtccgatttttgggggaaaagatagaggaggataagaggaatatttcccctcaactaattttgcaaacggagcacgggatgcggctgatttggtggaggaatcggcgtcggctagagcacaggacggcagctcgggcttctgtccaagcttgaagatgaacagtaaacggggaagcaaattacactttcgtcttgggctggctgaaaaacaaaggaaagaaagaaagacatggggagctcggctgggccgacttgggctgcacagcacgcacgcgagggagagagatgttgggctgaaatcagcccaacggcttaggagaagatttaacaactttttccaattaaaataatcactgaaatgatctttgagttgttaaaaatacttccaatgctcaaatagttttaagaaaaatcctgaaaatacttgaacactcaaagtatttaacaaaattataattagaacatttaatgattactttaatatgtggataattactgaaatgttctttgtatgattaaaattaagagttgagctccgaaaaatctgagaaaattccagagaatataattaaccatggataatttaataaaaattaaatccatccatgctttatatttaggaaattttatttcccacatttaacttcacttgtaaattaatgaacatttaatataaattctaataataatttattaaataatttataaatcctaaaacgaaaatcaggatgtgacaggcgttcttcaacccaaaagtcataacaacccactcaaacaaaccaacaaatcctgggcacctaaaagccgttttgtacatatcctcctccgccataaaaatttgattgtaaccggcattaccatctaaaaagctaatcaccttatgacccgaggcatcattgatcatcatgtcggctataggcataggatattcatctttgggagtagctttatttaaatctctaaagtctatgcaaactctaatcttaccactccccttcttttccaccgggacaatgctagaaacccactccgcataacggtatggcctaatgaaccccgccttcaacaaccgatcaatctcctctttgactcggtcatagagtaaaggattaaaacgacgaggtggttgcttataaggcctaaaacccggtttaattggaagcagacgctcaacaagctcacggctaagacccggcatctcatgttactccaatgcaaagcaatcaacatactctttaagtaactcgattatcttaaccttataatcggctctcatatttttgtttacaaaagtcggccttggtttagttccatcacctatgtctacttcctctaatggatcggccgatgtaaacccctgtccaagcttctccacttcatcaaaatctttaatagtttcaccaatatcgttctttgtagaccgatattcttgtaccctcttttgtaacaactctagattagcttctctactcattgtacaaattgacatggcctagccgtgctaaactagccggctttacagagataggtacaaatttgccatcggaaatactaatgaaatcatacctagaaagatccatccccgataagcattgaatattcccatgacgccactcaaaagtagcatcggccattgcaacctcggccgatgtatccgcttgaacaatctcaacatcatcgccgtcccattaaattaaacattgatgcaaggtagaaggcacacaacaattggcatggatccaacaacgacccaaaataacattgtaattaccttgcacatcgacgatgaagaaagcggttggtagcatcttgtttcccatggtaagctccaccgaaaagatacccttcgcctccgttggttcaccattgaagccattgagaatcatgttggtcttcttcaactcatcatctccccgccccaactttttaaacaacgagtacggcatcaaattcacggcggtacctccatccactaggatcctagagaccggcttcccattaatatgacctttgagatagagaggtttcatatgacggtttgactcatcgggcttctcaaaaaccgcatctttaggacctagtgaaaattgagcaacctcggcttcatccatagcacaaaactccataggcaacatacataccatgttgatatccatgtcttcttttggagatgactcatctttaacaactgattgttcttccttctcctctacaacaaccggttcttccttctctatggatttacgcctccataccggtggtggttacaactcattgaaccttttatctctttgctcttcggcctttttctctcttatttcttgggcccgaagacgttgcaaccttctcctttgagtagccgtcaaatccttaggcatccacctaggtttcggctctgttccaggaggtaagtagtgccccctattgagtttacttgatgacgatgaagcccccactttactccttgtgaacctcctgtcaaaccggcgctggagcccggtcagaccggacgtagaccaccggtcagaccggccagatgcgccggtctgaggcatcggtcagaccgacattaggtcggcggtcagaccggcttgaggcatcggtcagaccgtcattcggtcggcggtcagaccggccagatggcccggtcagaccggccgtatggctgaggtcagaccggccagagggcctggtcagaccggccgagtgcgatgagctggtaccggcttcggttttgttgcttgaagactctccaacttcatctccagaaggtattggcacatcatgagaccccactttgatggtaatcactttcgacgtccttgcctccaccttaatacgcttcccttccctcttttcttcactggcccggttcttaccataaaactggccattgtttggtgaagacaaacactcatggattggcctccttggtcctccgcacccttggttgaattacattggaggcatatggttgaacattggcagtgctgccccccatggcatgtaataaggataaagataacccggcggcagcattggataaggaccccatgacatgtcttgtgaatgatgatatggaggtgaatgcgaccgtcttggtgagtgaccaaatcgcttcctaggaggtgatcttggtcttttccctttgttgcgagttctctcaccactttgcttttcatacttctccaaaagcatatcaagggtcattttggtcttcctaggagctttagaagttgaagcttcactcttattttccttccaaacaccaacctccggcttctttggcactatcatcttcggcctcgattcgccaatgatcactccttttcccttagtagattcggcttgctccggccgaatcaacaccttcttctcattgaaattaattgtattcaccggaaaaggatcatgatcaagcttcatcttggaaccatcggtgaacttcaatcgtccttcatttatggctgattgaacctgtcgtcgaaacacattgcaatcattagtagaatgagagtgggaatcatgccatttacaataagctcgacgtttcaattcttcttgagatggtatgatatggtctttaggtaatctaatttgtttgtcttataaaaaataataaaaaatcttatcacacttggccacatcaaaactatatttaatctcactttgccgatctttacgaggagttggcattagattagaacaaacaaaaggcttattttagttagtccatgaccactcagcaatatacatatcatgattaccctcatcttaactatcactagcctcagggtaatcaatcaaattaatattaggctttttcttatatggtctaacaatttttttattatccttaacccggctttcctgagccagagccttttgcataagttgactaacatcaagaaattgttggtcatctaatctttctctaagatgagaaattaaaccattaaaagcaagaccagccaaatctctatcagttatattcaagctataacatcggtttctaacatccctaaatctcttaatataatcaatgacaggctcattatatttttgcttaaccgatgtcaaatcacataacctaagctcagtttctccagtatagaaataatcatgaaatctttgttctaattgagtccaagtatgaatataatttgccggtaaagaagtaaaccatgtaaaagcggtaccggacaaagacaaagaaaataagcgcaatttaaaagtatcactattagcctcaccacattgcgctaaaaattgacctacatgctctcatgtggtcctaatatcttcaccactaaacttggcaaattcgggaactctataaccacgagggaatggcacattatcataatagtcaggatacggcttttggtaaaccttagcacgattcctagcttcaatcccgaatttatccctaataatcccactaattatttcctccacattattaggcctatgttgatttggtggtggatttggtggcctaataggatgtgtttgcggcgcaatatgattatattggccttacctagtatcgggaggatacccattagcaacatcattataagcattaggaacatgtgggggaacttggggattagttgcagcagtagatataggaggatcaaatgttctaagatgatacaaataactagcattagtcattggatatatcccctgaatcggaataattgcgccggtctgaccagtccagggcccggtctgaccaacgtccagaggcgcggtcagaccggcctgagtcccggtctgaccgccgtgataatacccggtctgaccggccgtttggctggtcggaccgacggcgaagtcgcggtctgactggccatcaggcccgatcggaccggctgtctgcgccgctccatcggttccactacttgtttgatctataggaacttggctagcactggtagaggctttatcttttaacataaaatcggccatgagagggccgaatttagttcttaaaaacttatcaaatcgacctttaatagttgcatctaacttatttttaaaaataatcatggatgaatcttttgtagatacaacttgttgttggatagattgtgttacctcttcattgcttaccaaatcgggagtgagcttaggacgtggcccgggtttgatgatcacgccttgacgagtcctagtgcacgccctcatcaacgcctcctatgtgatctccttaatgtactcctctatggacttgcgatcttcctcctcgaagtcatccaatgtaattggtatcacattgataggctccacctctacctttgatgacgactgcttcgtcatggcgaagtcgaagttgagttgacgctgaacggatctccccagtggagtcaccaaaaatcgtgttgtcaacttttgtgacaagttgacaagcacgatcatagcaccttatgccttacggtgatcctagagtcgccaactatctcgatctagcaaaaagctaaacctagatgggttttgataactaaaccggctagcagagccgatttctagatagctacccgtctcgtgggcaaaacggaaggttttcaggacaaacctacaaagaggtgtcgcactctcgcagcggcggcggacggtttacggcgcaaaccgacaaagatggacagactaagagaaaactaaaagcaatatgaaaaacgattcgattgattgattatagattggttagttacaatggaaccggccatgtcccttatataggggttggtattaccctctacatgccttcctctacgtccaactcgggatagaaaccaaagaaaacccgaaacatgccttcccgagtaaggaaatctcgaaacccgacgaaacacagtcagactcggaccctgccggtcagaccggccacacaccaccgatctgaccggccctcaaccggcggtcagaccggcccactcggaggaaacctatatgggtgtaaacaatatgtactggagtaatatatatagatgaggaggaggattacacgcacgtaccttgagcatgagcaggaggaggaatcaccagcttgttgacgacaagtcatgtcagattggttttcagccgcgtgcggcgttgttgttgttggtctggtggtggcgatggcatgtggtttgctcatactagcagtcttgttggtggtagttggtttgctcatactagcagtcttgttggtggtagttgggaggcgctaatgaggaggtaaaagggcgacaagaaagccgacggcggacgagaggacgcgccgccgccattgaaccaaacaccgctctcaatctcgccgccgccgccgacatgatttctctttgttttcttttcttttccttactgcgttgcgtctttgggcgtcttgatggaatgcacgcactttgcttctcggtagtaattccccaaccctagcaatttatttatatagatacagtgtgagggaggaggagattgatcaaataccggatcggatcatcgtagtcggtaggtactactacaagccaatagccatatagccagacggactgggaattacgatcggaatccaaaatagtagtaactatagaacccaatattttggaagatcggcattggattctggttcgattctgatcgcccaaccaatacatactccctaacctctactccctgtctcctaaagattgaacttttctacaagttctgggattcaattgcataaaaatttcggcacaactgaaatggacgaatttcagaaatatcggacaaatcttgaccgaatttgttgcaatttttaaaacaaagcaccagaaaactggggaaaaaaccaaataatcatatgggactcagcacacaagcagaataacaatattgatgtaaattttaaaacaatcatcagaaaactaggtaaaatcaccgaaggatcatcgaagcatcagcacataagcagaataaccggaataacactagttttacttcataataaatgcaattatgcagtcctaaagccaagttcatgactgcataatgcattctgctaatagcaagttttgtgcaagcggttgcataatacacccatatacgtaccgttgaatatgctctgagattcattgacgcaaaatttgtcgcacacacgaaggcctaagatatttgcttcactctagtataggtcctatcaaaatcgggttaggaacatgctagttagtttgatcttgcaactaacaaggtaaaaacgagaagattagatcacggggccaatcgaccacaggggtgatatagtattctgtgtccaaccgataccgatggaattttggatcgatcggatatataaccgatagatatgaatatgaaggattaaagagacattggtcggagtttagatgtaatatatctatatctatacctaataattataaaatacgtaaggcttccgactatttttcgtccatccacctccccatcccgcatggccgcactccttcctcctcgcacgactcctccctctttcccgcgcccctccggctcttttccagcgccccacaactctcccttgtgatccctccctctaggcgccccaaatctctccctcgtgacctccccctgcagcccctctccttcttggcacccctcctcctagcgcccctcttctccactacgctccctcctcccgcacgttcaaggaaaacagaacctcctcgtttggaaacacattttgatgcactcacccggtggtgttaaccattagagctcgttgttgccatttctctctctaccaggaccacgtcattgttggccacgttcccattgttctggtttttttcattaccaagtgccaccatctatggacgagtcacattgtgggacacgtccaaccaccttcctcaccaccatttagtcataggagcattggcgcccatcttccctcctcgtttgtttcttgtttcagctagggaagataatgaacagtgttagtattgtttttccatcttttgttcttcctgcgcgttcaaggaaaatggaaccccctcgtaaggaacgtgttttgacgcactcatccggtcatgttcaccaccagaactcgttgccattgtttctctctctatcaggatcacgtcgttgcctgctgcgtttctactgctctgtttttttttggttgcccacctccaccatctatgggcgagtcatatcgtatgacatatcctaccatcttattcaccgccgtttggtcgccaaagcaccgacacccatcttccctcttttgtttcttgccttcagctagggaagacgataagcagagccagttgggtactattccttcctggtccagcccaaccatgctcctggaccacacacataatatagaccatataaatgaacataactataaatttcaaatatatgacgaagaaacggtaccagttcagaattattgcatcggattttcatctatgggctaaaataagtttttttaaaaaaattctagctaatttcaattgttttcacatttacagtattagttttagcactatttaatatattaaaaattgttttaacttataatttttctctgtgttgaattatttatagctaaaagaaaaaacaggatttagttatataattttactgatattgaattatcattctggccaaagttatttgtagtttcatattgttatttcgattattatatttccttcatcatttatgcccaattgtgatatatggtttaggatttagtttatgtcaataaatgttatttataatccgttgcaatgcacaagcattatgctagtagtatatgtaaatcttgatagatcaaaccaaaccgagatagtataagattgaaagtattctttttgctgatcagaaaccttatttcttgaactttgactgtgaaaaaacgatgaagcttctagaggcgcaaaaacacaaaggcaaataggtaaatgctatggaacgcatggtgaacaacccgcgggagtactgtaataccgattagttggatctagaggaactcaggcaaattaaagtactacctccttgattggatctcatgtcaactagcttttcagagacctaaaaagatagaagcccctctcctctctctgcaactagagaggtaggcaaacctgagttgatatgtcgaaacaccaaccggatcagaaacctcatcctaaacttacttcgaaataggttcgagagcttccatttcaatgtgtctttcgacaattatatatgttgatcctgaatgtaggccgatgcactgagatattaattaaagcttatcaatattcgcgaagtttgtgattatgatcattagcaatataaatctattaatcacaatcttgattgaacaattaaatttttataacaagatgtcacactattatacatatttctaatgccattgaaattcaaagtttcacgtgtaagaagaatttaattttaatttgattgtgttgcatattcaaaattttaactttattaatttttctatgtttctcaatgtatcatgtactagtaattgatactgtagtcaatatatttttaatgttacattgttttaaaaaaaataaaagtaagtttaaacatttaagaacgtgatgcaatattatatttctctaaagtgataaaacaatgcctgatttttggatccccggccctataattattgaggagacaaagaaccttttttaaagatacaagaactaattggtgaacggttgctcgcagaaccattaattgaattcaccgtaccccgctagcccttgttacttccagtctcttcaaaacagacgacgccgaacacgacttggtatatttattttcaaggtagccggccggaatatatgctagagaagtaaagtaaagtaaaaatcgtaacaaacaaagtagtttgacaaagtttgtgtcaagtatatctttctctttctaaacataccagcatcgttatcttcaggacttcagcgtgataatccgacgaacagttaattggttaattccattgtttcgcgctcgtggtttcttacttgacgcacgtgcaatcgcgtgcttgctaacgcgttctagctacccgtacgtactgtcgtactccaggtctccagcatatagctagcatcgcgtgcatgctaatggcgctgtacgtatagcacggccagttgtacggtgaaggtgaaaaggtaattcgtcgttgtcgttggatgtatcgccacgcattgacgcatccatgcctgcacgccacgccgccgacggcgcgcacccaacacaacacaatacgtccgcgccgacgcgcgtgcacataccataatacccatctccctatatatatccatgcaatacacctcgcatcaatcatccatcgcggctagctccgtcgtgtaatctcgagaggtttgcaaagccaattaagcgtaagatcgatcaatggcgccgcgatgcctggctgctcttgcacccctggccgtgctgctgctgctctcctcctgcctcgccgccgctccggcgacggcgcagcagagcagcagcatcggcgacaccgtggtgttctggggccggaacaaggccgagggctccctccgtgaggcctgcgacaccggcctctacaacaccgtcatcatctccttcctcagcgcgttcggccgcggcagctacaagctcgacctctccggccaccccgtcgtccccgtcggcggcgacatcaagtactgccagtccaagggcaagacagtcctcctcgccatcggcgggcagggcggcgagtactacctcccgtcctcccaggccgccgccgacctggacgactacctctggaacgccttcctcggcggcggccgcagcggcgtcgcccgcccattcggcgacgccgtcgtcaacggcatcgacttcttcatcgaccagggcgcgacggagcactacgacgagctggccaggctgctccacggccacagcaatggcggcgtgatgctgacggcgacggcgcggtgcgtgttcccggaccagcggcagcaggcggcgctggcgacggggctcttcagccgcatccacgtgaagctgttcaacgacgggcggtgcacctggggccggagagagtcgctggagaagtgggcggcggcgtacccggacagccggatctacgtcagcattgtggcttcgccggaggcggacagggacgcctacatgtcgcacaaggatctctacttcgatgtgctgcagttcatcaacaagctccccaactacggaggcatcatggtctggaacaggtactgggacaagaagaccggctacatcaacggtgacgtgttctaattccttattaagctaaacatatattaccaagatgaatatgatatgttaaatgtgtaatatgttgaacaatgtacaaataaagtgaggtcagtatgtgcagatctcacgtacagtgaattactaactggtggtgattgtaatttgtaattccaatttgtatattttccggatttcgtggatgatgtggtttcttacctcggaaagagtattcatcccttgaaaggatatcccatcgttttatgcatattatataaaaagccataaaaaattgaaataaattgacaagatagattaatatgaaatatatcactctacgaatatgcaagttaaaatttaacttctataagttgtaacaaaaagtaacaaatataattgtgaaggtggatggagcggaggcggacgacggtcgtccccatgctctccctgtggcgcggcgcctctctaccgcctagatccagtggcggtgcccctctcccgccttctcctgcgcgacgtcgacgacgacgacgagacgagtggcggcgacagctatgacaacgacgagctacggcggcagccggccccgccgacgacgacgaggaggagacggcggccaggagcggcgccgccagatttagggtttcatttagggttttcttttttttgattttttttatttttgtttttccgtgcgggccacataaagcacccgcacgcgaaaacccgattttcgcgtgcaggtgttccatatctcacgcgaaaatcctttttgaccgcacggaaaaattatttttgtagtagtgtgttcgcggtgacctagaagtggtctcctcttgggtctgcttggaatagaactagggtaagttggggttcacgctggcacgatggtaggctaaaaggaggaggctggacgtggggctcagtggcatgtctcggcattgacgttatgaccccagcgttctcaagccgtgaacccatgaggactcacctagcgttctcgagccatgaggatgatggaatgtgatatatggttatatcacagagatatgcggatgccacaagtttattatatagttgggtttggtcgggtttcccctctatttggtcatgtgggcaaaagtgaagcggctaggaccatactcgcactctgacgatgtctatgttacatgggcatcatcttggtggccggtccgccatggtatgagggtgtaggttttgtaacaatccacttttgttctttggttcgtaaaaatgtttttcatgtgcactgcactgcatgaattatttcgtgcataaaaaatcccagctgagcaaaataatgtttgtacgattgctctaaatggttcccactgccataaccgactctgagttttcaatattgtccaaaaattctggataaattcctaaatattccataccttactactagccttgcctccaagttatgtttggattgaagcagtttacccatctaaccattcaaaccctcagtcgaaattggaaaatttagggcactgttcacccaactggagacctttctctcctccactcattgtctcttatcgttgacctgttgacctaatactatcccttctttctagaaagttaagaccattagttgtgcttagaagaagccacatcatcgatttattttctcaacataggattgattattgatggcacatattgccatctcatcaccttgccccaatccatttcctctcctttctatttctacttgagaaattacaggaaaactaacacaattaattaagccacaaggagctttcacaagtctcatagcatccctttatgagcctcttaacatcccttcagcattcataacagaccacaaataccttccaccatcctctgaactcatccaatccgtgaaccatattcgttgattttttctttgaaagaaccacggtaggggaagcccccaccgttaagattttatattaataagggggaaaaaattacaacaaatttaaccactataacaatgtatctctctcagaatttttgactctatgaactaaaagggagagatcattcctaaagagaactctccaagagggaacagagggaacaatgttttcaaaaattaaactattcctctgcttccaaatgttccaagcagcataaagcaccttctcaacaaaatgggtagagttatatgaatttctggccgtgaccaacatttcaccaaagcttaaagaaagattccaaaccacaccaaattgcgcccaacattgagtactaaaaggacactggaaaaataagtggagagttgtttcccttgatcctgttgaacaaagtacacagagcaaggaagcattttgaggggagcaatgccttctgtctaacatgtcataagtatttaaccgatcaatcaagaggagccaaccaaacaccttgactttcatagtacaactactcttccaaatccatttaatataaacaggcacatggacatgagaaaaattcatggcataaattttctgtgaagaaaaaataccgttgccccaaacatatgtccagcgatcacttatcattaagatgctccaaggtatctgcagctgacattgctaaatattcttgaaaagcttgctctgaaagtggcaaggcaaagagctaaggtagatcagaagtagagaacatcagaactgagagatttgaattcctggcaaaagaatatattctgggataaaccaatgccctgactttattgttccacaaatcttcccaaaacaaacaagattttccatcttgcacagtacaggccgagatgcctctaaaaatttccacaaattgcaaaacatccctccaccaaaaagatcctttaggagtaacagcatgaggaggttctgcagtgtagtaagtattccaaatcaaactgacctagggaacaggatatctattatagaacttatgcagattcttcaagagaagggcattattttgcaatctaaggtctattacacccaaaccacctctatctttcggctgacaaactctttcccagagaaccaaagacttcttactagaattaataccagatcccctccacgggcaatgtctcctagctctatcaatactttctatgactgtctttgaaagtgaaagagagcacatgtagtaagtgggaagggaggaaagaacttcattcacaatggtcaatttgtccccatgagataacaaagcagtggttgctgagagtcttctcgctactctatcaattagaggagcaaaatcaataactcttggtcttgtggttccaagaggaagacccagataagtaaaaggttacttaccaatagagcaaccaaacaattttgagagatgatcaaccttttccaaatctacattcagaggaatcatgcatgacttactatagttaatcttaaggccagttgaagaggcaaaagtgttcaaaattgccttgagacagaaaagctctttttgggaagcagtcaaaaaaataagagtatcatctgcatactggacaatcagaaattcattaccaggtgttgggattggcattgtaagaactccctgagaacaagctttattgactatagattgtaacaagtcagctccaagaacaaataataagggtgaaagtggatcaccctgtcttacaccccttttgcaatagaaggatttgccaagaacaccatttaggataactgaagaagaggctgaagaaaaaatatgagaaatccagcttatccatttaggatcaaagcctttctgcctcatgatgtccaatataaccgaatgttcaatagtatcaaaagctttctcaaaatccaattttaaaagaactatttccctcttagaatgctggcactgatgcagatattcaaaagaccaagccaaacagtcctgaatatttctagccttaatgaaaccatattggttttggtggatcaattcaatgatgacagattgtagcctatcagccagcaccttagtaagaagttttagagccacactctgtaaagaaattggcctgaagtcatttaccttttctggagaagacttcttagggactagagttataaaggatctattaatactctcaagcaccagagaaccctcacaaaattgagcacaaagattatagaagtcctgtttaattataggccaacaggccttaatgaagcaaccattgaatccatcaggccttggagatctatcaattggcattttgttgacaacttcatcaatttccatggttgtaaagccaagagacaatgactgaagatcaggagcagcagaaatgagatctgccaaactgaagtgcatgactggagaagaagaaactcccatcctttgctgaaaggtttgaaaaataatttctgccttttctgcatgatcagaaagcacccttccatcatcagactttagctgcataattaaatttctgcgatatctttcagttgccgcagcatgaaagaattttgtattttcaccaccaaactttgcccaccttatagtgcaccttttttgccaatagacttgtttaaacttaaggagcaaaagaaccttacttttcataaagagtctaaaattccactcagccaaggtcaagtctctgagctcctccaatttatcaacaaaggctagagccagatggctagaatcgaagtatgaaagtttagtatacttcacgtaactaaagtttatggttcaacgattttatttcagtttgtttaccaattctatatgtatttgcttctgtttatttattgagcatagcctatgaatttgctctcgcacgaacaaggtgggagtttttgatgaattgtttctgctaacttagaaaaagaacagctattgcggtaattccataatgcattgtctattgctttagtttctcatgaaaagcttatattgtttgacccattcttattagtgctatctaggatattggctcctgtacttatgggaaaacctgaggattgacatagcagcggataaaattgtcataccattggattaccttcgaagcaaaggattctcatagaaggagatgacatttttgtgtttctgcaaatcaatttcttcatcctgtggctgattcctggccatagacatctttcccaatttttggtatggcttgaggtctatgacaattttgtgtttctgcaaatcgatttcttcgtcctgcggccgattcctggttgtagatgtcttcccccaattttaggtatggcttgaggactttatcttcattttgttcttttctcaagttcttttcttctactttcatctaacctccatgacattaattatgatgtattctttagttttttcttttttcaaatacaagctctgatgggaaatattcagctacatgttcagccaatgagagtgtccaaacatagactaagtgacatttcagagttttagggtaatttcacattcttatgttggaaacacaattgtatatgtttttcatgtcagagttgaatatgatctgctaattacacaatatccgttacctctatggtctggaactatctgctcatacttttatttatgaagtcgtcaatgctcctttcactaatcaagtaatcattgcagttggtagcaagattatgttatgtacggtacttaaaaaggagttcagaacaagcacaacacttaacgaagtaaatatgcaacatttttttaggattaaataactatatgactatttcttttggagaataacgaagacgctgcaattcagttcctaatgttgcatgccctattttatttttcgactatattggttcggctgaagttttactaacaagtgtttgctcaatatttgtaagtatcaaccatcatatcattctttctcttttaatatggtattttcatttctcccaagtattgatacaaaatctcgcagcaatgcgtggggtttcaactagtttatttggtaagataggcaactccatgggacatacttcttatgttggtctccactccccacctctaattcgggacccacaacccagccaaacacgagccattttttgccgcgctggaagcgtgagccaggctagccctcgcgcatgaccgtgagtttcagcttagccacgacccactagactgccctggagaccccacgccacgtcacagctcctccccaacgccctgccacgccatcatagtgctccaccacgcctcccaatcgcattgcacgcgcggcaggcggcagcggccaatctgtcctttgccgcccatgatttcttgctcccaagtcccaagaatgcctcgtctttgactcgaatgtggacgagagaaaggccgcctacctcgggacctcgtgagaagccctttgccagcctctgcaacaccctgccctatcccatttatctgtcgcaggcttgccggtgcccacgccatctcgaggccaagggagtaaggctgtgatcaggaggtgaggttaggaactcacctcctgcgcacgcaaaacggagcaacgccttttcttatgattaattaagtatttattaatttttttgaaaaatatattaatatgttttttaaagcaactttcgtataaaaaccttttgcaaaaaaacgcaccgtttagccatttcaaaagcgtgcacgtagaacacgagggaggtgagttgggaaagttgagggaagaacacagcctaagcaagcacccgctctctcccctcccttccttggcttcctccttaaccaagaccatgtcctcctaactcccgaactcgcccttgttcttaggaagccaaaggacccaagtgattgtcccttggttcgctgggcgaggtgccacgtgtggtagcggcaagcacacctccaccgttccaataccatcggtgagtatcatctcatcccagccatgtcacctcgcgtcccttcacccactgattccgtttttgcactcagttgacgctgagcacaaatgcagtgcatcgtgttctccaacgctggcccggtgccgccatgacctaacaagcgctaaactctgtccctggtgagtatctcgacatccaagcagctttaccatgtgttcctccccccaccttaatccattttcctcctcctccatggtagaacttgctgctgcccgatcttcttctcttggggctgaccgaatgcctccatgcacttgatttgggaactttcacctcagtaagttccaacccaattcctccccatgggagcatctatataccctgctaagttcattcccatgcttggttttagtccccgacgccctgagttccaccacaggacaacttcttccatctgccgtcaccttgccgatagcctcaaccgctgagctcctgtttatgcatgtgttttccttgccatgaccagcgatgtcgtcgtttgtccagccgcccaagtgccaccactgtagctacatgcatggccgaggctcaaaggagtaagaccacacaagttagaaccccagtaccttgcatgtagtaccccaagagcctccatgtgcccgtcttcaccagccgtgcactagagaatgagaggacagaggtaggcatgccgtacttaaccttggcattttaccgaacaccataggtgcacacttgtttgagctaaccatgaacatcccatcggccccatccatgctaggttggcctcactactgttagaacgtgctgaaaccgtgagtagagtcgctgccatgacttcacgtttacgccggtcatcgttaacatccttagcgagttgtgtagttcgctcgtatgaagatgttgtttttggaccgagacatttgcaactactgaagtttttcaataggttcacattaacccatatgtaggttttgcgccataaaaacgcccctagaaccaagaaaatgtttaatagatgacctgttaggtcggtagaatgtttccagccgtttcagcagctcggttgagcgaaaacgatgtttttcatttatcttcgattttagggcagagaagacttcctttagccgtttctccgtcatacaaactcggattcaagcgattctttttcctgaaatcacgcactttcatactctgcaaaaatatttggattacctgtactattaaattttgccattgtatttattgcattcgttcggtattcgtgaagacaacgatgttgtcgatcctgctgaggtggtaccaaaggaataccaggaggtccaggaccaaggcaagctcccccttgatcaattgctcatatatttcaaatatataaattgtattcattgcaaaactattatgcatgggtagcttgccaattgctgcatataccttgtctttgttacttgagtatcatgattcattgtcacctacgttatcactgagaattgggttcatgtgctgggaggatagtcgtgtagaatatgcttagctggcttatatcggtagtgctagttttaatcggattattgggctttcgagaaaaaaatgtttgcaaaattatggaaatgaacagagggtaaaatctttattatcttggtggaaaactgtgtccaaattgatctgagacactagcgcaaatcacgtgtggctcataggaagtccctagctaagagaattattggttccaagcaatagacccgtctgttgtagttgtaggtcattgttgttgacattggattaatgccggtatggttattgtccatacttgtcggtgcctttgacgatattgtgttcaaggtttacctgcacaacgtttgagcctcgggccttggagggcactcctctgctagctagtgaaaaggcttcgtcatattggaacgagccttctgtatggtagctcaggtttaacgtgtcatctcggtgcagttgtgcacattctgcagagtttaaatctattcggatagtcgtggccatggtcatggacaactcggtgaaccattccttgttatccttgcattattacggattaccattggatacactaaaagtcttgcggagtacgtattgtactcacacacgcttgtgtgacttctttttttttagagattgaggaggacctggcaatcgggtacttctatacaacaggttttggagacaatgatgttggtgcttactaggacttaacggtcagttgttgtgtgagggcagagacacacttgctgggttttggtgcctttatattatgttttcgctgtgttttactctcttatattgtcttgtattcggcggatgacccatgatgtaattgttaaagtctagatcatttatttacttaagtttggactcctatgtactgtactttgatgatgtatgaactctagtatcaaggttgaatgtatgtgctagcaattgatcgtgtaactagcacggcatacatatacgatttggggtcaaacccaggtttgacactaggcaccgtaggcccaatccacgtgtacagtttaaacagtcttgagagccatgcaacaccacaacctatgtggatagtatatatagcatgataaaataagaaggggtttcaagtaaatatttattatcagtgcccactcatgcatggtcagcagtagggtttgaaatttcggaaccccgggcaaatatctcgtccgcaattttttgtttttttacaattttttgaattcgatcaacatttatttaaattcaactaaaatttatttaaaattttaaataattttgtgaaaaaacccaccattttttctgaaattattgaaattcctgtgaccactgaaattgccatattttcggtctttaccaaaattggaaaccctgggcaagagaaccttcaattcacccaaccctcatcacagttccgggtttgggctcatcaaaacaggcaacatctgacatgacatacattttctaagtagccagaacgctagagaagtaaacattacagcaataaagtaattggtggcgtgctgggctgttatattaattcaacaacacgttcacggtcaaattaagtttatcccagcatcttcctttttgctaagcaccggctttgttatctcttctgcatgataaactgagagggacgaaacggggttaatttctgttgtttcgcactcgtggtttcttacttgcgcacgctagctgtaacacaccagctactggtggtgaagcgtgaaggtgaaggcctagctagcttcgtcgttatctttggacttatgcctgcatgcccacggcgcccgccgcgcgcacacaacataagacgacacgtatgtccgtccagcgagcgcgatcgatcgctatatatatccatgcatccacgttcgtatccttcacacctcgatcagtagctccatcgtaagatcgattcgaccaacatatcaacaatggcgcttcgacgcctcgcggcacttctctccttggcagtactactgtccgccggcctcgccgccgtgtcggcgacgtcccagaacaccggcgacaccgtgatcatctggggccggaacaaggacgagggctccctcagggaggcctgcgacgccggccgctataccaccgtcatcatctccttcctcagcgccttcggctacatcccgggcacctacaagctcgacatctccggccaccaggtctccgccgtcggccccgacatcaagtactgccagtccaagggtaaactcatcctcctcgccatcggcggccagggcggcgagtactccctcccgtcctcccaggcggccgtcgatctgcacgaccacctctggtactcctacctcggcggccgccgcaatggcgtctaccgcccgttcggcgacgccaacgtgaacggcatcgacttcttcatcgaccagggcgcgagggagcactacaacgagctggccaagatgctctacgaccacaacaaggactaccgcgccacggtcggcgtgatggtgacggcgacgacgcggtgcggctacccggaccaccggctggacgaggcgctggcgacggggctcttccaccgcatccacgtcaagatgttcagcgacggccggtgcccggcatggtccaggaggcagtcgttcgagaagtgggcaaagacgtacccgcagagccgtgtcctgatcggcgtcgtggcctcgccggacgtggacaaggacgcctacatgccgccggaggccctcaacaacctgctgcagttcatcaacaagcagcccaacttcggaggcgtcatggtttgggacaggttctacgacaagaagaccggcttcacggctcacctgtgagtgtgtgactggtcgtgacatttgaagaccattaattccttaatattggatcaataaaagctttgtgtgcagtacttgtgtactacacaaataaagtcatgtaatgaaaataaacatatattgtgtctgctataaagatttgtatgttgggtaatgtatgtaatcaataaataaagcgaggtacggtacctcgggtgaaataataaagagctttgagataaataaaacttcctttatcttaacgatttttttaatgttacatcaagttttttttgcaccttcgcccattacccgttgatccaagggctagtgttgctcggttttgctaattagcgtgtacgcgcgacttctctaagtcgcacacgtgccacgtggagggttgtgattggttggaaagagaatgttaatggagaaatagttatattttggataaattctgagagctaaaagttattatattttgggacggagggagtagtaactaaatacatagcgtatagtaacagcatcaactatgtacaatggtttgtccaattgtttataatcacatcttattagaataactctcaagtcatgtattaactatgacttgcatccccatctatgtgagtaacacctctcgctctagttgaatgtgtatgtctctttcactactagaaaaatgatttttcatagcgtttggaaaatatttttcatggcggctacaagaaaaaatcgccagcgtagaaaatcggggggtggggggtcactggccgccagcgaccatattaagaggtccgccataaaaatactatatttttttaggcggacctcttaaatgtccaccatcaaaaataagcgttttcgctagcggctactaaagagatccaccagcgaaaaaacggatctgccagcgaaaagcacagctcacagatcgattccttcacagcatcacccacccacgcatttaaaagcaatttcacccacccacccactgcattcatctctcctctctatctctttctcatctaaacctcacctctctcccctcccctcccatcccctccctcagtccctctccctctcccagatctagccagagggaggcggcggcggccgccgcggcagcgacgacaggcggacctagcgacggcgctcgggcgcggcggggcggcggctctcgggcgcggtgggcggtggcgctcaggcgcggcagggcgatggctctcgggtgcgggcggggaggccggatccgccgccgccgagccgcagggaggtggtatccgccgccgccgggccgcggagaggccggatccgccgccgtcataccacgacaacgacaggccgggccacgacgacgacggcgaccaccaccaccaccacgacgatgggctgggccatgacgacgacgacaaccacggcgactggtgacgacgaccggagggtctcctcctcccttccctctccctctcccagatctagccggagggagggggcggcggccgccgcgacggcgatggcaggcgggcgacagcgattttgatgaatttctccattttatgtttgtattgatgtttcatacatgcatgtattaatgtttgtttgttgagaatgaagtgagaaattgatgtagtgttctcttaaggttggatgattggatttgatgtggatttgaattgttatggatttgagatttggggatgtggatttgggatgctggaggctggagagggagaggggtttttgctggcggctggaggacagctacatatggttgttttttgtctcaaaattaattatcactggcggccggtataacacagccgccagtgaaaatcaatttttgcgggcgactgataaccgctagcgaagattgatattttctctggcctttgctttgtggccgctgcaatttctgccagggaaaatctaaaatggccgccacgaaagatgattttcgtagtagtgtttttccctctctctcctttcttcttgccccagccttcatctctctaccactagtgaaatctacgaataaactagaaaataaaacaaaaatatataggttaaagcctcacatgctaaccatatatagttgttactgcacaaaagtagaagtgttactatatgataggtacatgttaccacttccaagtagccatgttactgcacggtaattgtagttttactatgtcatttttacaatatgaaaatcgaataggtgagctataggtaaagtctgtaggtggctttgagcgaggtctgattgatgtaggagtgttttgaataattttatacatttggtaaaaccatgttactgcatgtatatgcccttgctactacaaactacacattctattattgcatgtggagggttaaagtttaaaataccaatatttgaaaaacaatatctcacaagatatgtattgttttttaaaacagtttccactatgatgctatagtgttactgtatgtggagggttaaacttcaaaatgcatctacgcactctcctcctcaaagaaacagttcttcccctctcttctcaataaaaccggtctcatcactccaatatagtgttactgcatgtatatgacgttactgcaattttgacagtaatattgtagtgaattgcagtaaatcaggaattgaaacaaaaatatttgggttaaaagtctcagatgctaaccatatacttgttactgcacaaaaataaatgtgttactgcacggcagatacacgttatcacatgacagttacaccttaccgcatgtttatgcagtaacactatccaagaaatgtactaaaacactttgttaatgtagaacatatagaacgttactacacctttggtaataatatcgtggtgaaattgtagtaaaccaggaataaaaaaatatagattcacatgctaaatatacttgttactgcacaagtggaagtgttactgtatggcaggtacacgttaccacatgtttatggagtaacactatacaaaaattgcagtaagacgcattgttattacaaaacttatgatcttttctatatactagaaaaaaaatacccgtgtgttgcaacggataaaaatattttcagatcgctatacattttactctttggttttggaccaaaagctcactatacatttactctttgttttcagaccaaaaggttattcccttgttcctttcttgccacctccccttgcttggcctgcttcactttaacttaacccatagcctgcttctatttgaccgaacccacaagaggagttgtagttacagctcgcatagctgactaccgtcttcaacctccggaaaatggtgaaaacatctcatgtccatacaatgccagaaacggtcctcccatcaattccgatcgaatctttctcgatcttacaaaattggttgactgcttttatacaatcgatctgttctttccgtttttataaaaatcagagcgaatccacaaaacccatgacaaaaacggtgacttttaaatatagattaaatccgttgaattaaaacagcgttgaaagagaaaatcatggggaaaatgatgaagtagtggggaatcgatttttgcaattaattagagtagggaaaaagaaaaaccggcgcaaaaaagacggatggaagaaaacagaaaataaaaaaaaaagggaagatggacggatggaagaaaacggaaaagaaagaagaaagaaaaaggaaaaaaggaatatggatgaaattttttagtggaagccttgcgtattttttaattaggtatagacttacagtaatatcgtgatgggattgtaataacgcacaacagatagtagtgacgagtaataataatgctatagtactacttacttgtagagagtcaaattccaaaaaagtcaagctttgaagaacaatatctctcacgtgatgtatgatttttttaattgtttgcaccatgatgctaggaaaaaagtgcttattaaaagtagacccgtcatgattatattttaactaaatttgaatattgttactgtacgtaagacaaagtgttactgcacagtggtctgtcgtgttattgcaccgttttgcgagataagagctgagaagaggtgggcggtggggggagttagtaggtgatttgaccaggatttgaccgacgtggggatgctttgaccgacctttgactgagatggcaggtgggttttgaacccttagaaaggagggaaggtgggtttggcccttgggagagaggggggaatagaataactattctataccataaaatctattcggagaggcctctcgtttttgccttaaccagcaacgtcggaacgcgcggagaaatcaactgtagcttactacatgcatgcatttttttttagaagtctactacatcacatgtatgttattttcttcttcaaacaaagttttctctcaaattacttatccgatctacaatccgattacattattgtgttcgttacaattaaatcttcacaacaagattttacatgattatattacgatgaaaaaatatttatatttataaattatttttattatatatgtaagttacttttatcatatatatatataagttacttttagatttgaataaattacttcttagatatataaaagtaaattcaatagagactaaaagtaattaacatatattataaaagtaacttaaaacaaaacggaagtaactttgtcacgacattataagtaaattcgttgtagagataaaaacataactttatctagaaataaaatttaatcagcatatatcaacacacgtaagtttaacaatttttaaaagtaacttcaatgttaattggaagtaacttttgtatggttaaaaataactctataaatctgtttaatcatcgattgttttttttccttttatttttagctatgtagtcacgtccaatgaaaaagggtattcattaaagttactttctttttctttttgttacgagttatttctataatatatgtaaattacttttagcctttattgaatttactttcatatgtctagaaagtaatttagtgaaatctaaaagtaatttagatatattataaaagtaatttatcatttttcatcaaaatataattatgtgggatcttgttataaagatttaattgttacgaacacaacggtataatcggatcatagatcgaatgagtagtttaagagaaaattgtatttgaagtatgtggatagtatctctaatagatggagtggtagctggtttagagacaaatcagctaccagtagctgtatagtcacatccattctatacccttggattcgccgattacatgaatcaatttgattaatgtatttgttttcacttgttctagcatggatattcaatcgaattataagatcaaatggatggtacaggtagaatcttcgcaatctttttattagtatataagtagtaccttcattgtagaatataagagattttaggtttaaacactggtattaaaaaagtagatcaaattatttaaattatttaaaagaatattgtaattggttaaaaaaaagagaaagcgaagaatttaaatgatgaaaggttatgattggttgagaaaataatataagttaaaaaaatttatattttaggataaattttaaagggctaaaagttgttatagtttagaacgaaggttgtaccaagaaggaacatcttatgaacaagttgtcttgcaagcgcgtccatgtgcagggcgaatagtcccataaaaaatttgaggtgaaaaatactgatgagtaacgtgaggtcgtgagctagatgcataatcaagggatgtattaacagcctgcactctctgttacaacattgccacaacgccagaccttggtgtgccgctggcgatcagctacaatattatgtctcgggaaaagtcggataacgggtgaattatttgcatgcatgatacatgacctgctatgctcgtatcatttgtacattgtaaccactaaccagcacagcttctttctgtttgagatgcactcagaactccgtggtaactctaaaagctttactcagccgaccaacaaagatacaagcgcccaaatccagagaaccagcaggagaaacagcgatttatgtcaaacccaaaagacaaaccactatgggtctgatcttaccttacaaatgcaataaatgaagaaaaagaaaagaaggaaataagatgatctgaacatgaaatgttcctccccttctgatagcctgtgccaagccagagaaagagtggatggggcagaacaggagaatagaaggaaaacatcggtggagcaggaaagggctatctatatgagggaagcattatccatactccctatggcttactttgcattcctgtagcggtccaatacttcatgtcgttgcaaaggcgagacagacagcaaccacttactaaactcaaggtcgttcatacccatgaaagatgcaattcggctgaattccttctttttctgcaccagtgagtaagattttgccttaattgtatgcattgtttcattcttcttactttgcagctcctctaagtgccttgggacagttttatcttctgcacagttgcttgcttcatttgtcctcgtgtttacaacatcttcatttcggtgagcataaactattcctgtttgtagggaacagaatttgttacaagaaaaaatcaatgcaccaatacgtagacagaggggagatattctggtagacaacttagcaagcaactttcgggtttcaatcttagtcaatatgagttttttgcaattgacaaatcagtttttactggaaacagtaaacgtagcaactaataacagaatcctacatagatcaagatgtcaaagacttgcatacttgaccaagtgtttatttattttagactaaatttcaaactgctactgttttgtcagaactatccgtttgctgtaaatttaactgaacatttcagaaatatgcaataataattgattgttttattttttttttcatagaactgaaactttattcttattataggtcaggcccccctgtcaatacacatcctaaagttagagaactgatagtttcatgtgaacccttttacccccacactttttttccttaagaaagtagagttggtggtggtgggggggggggaatgattttcaatattcttgtaagatgagattgatacaaatataattactaatttcctctattttattcagaacgtaagttattctatattgcatttcacagaccagatatttttctgttcataggattatagatatataatgttgcaaaaccatatcaatctacaaatgttagtgtcatttgagctctatgggatatgggacataaacttttcttcaaaatgtatgaagagaacttagggcagacagtgaacataaactagaataggatgaacagcagggctaaataaatcgatacaaacatatgaatgttacaaaaattgaatgcacaacaatgcaaaatatttagagtcagtatttgaaattaaaatttaatctaacaattaactattcagccactagtatattattcagtttcccataatagtaatagtaatagtatattattggtcattttgaaattgaaacttttcataaagcatttaaggtccaaaatcaagaaaattaaattagaaatattcagactgacagtagaacttaccacaatggtacaaattcttgttctcgttatgtattgctgtcattgaggatttcatttgatcttgcgtaccaaatatatttgtatcaactatttctcgaattcctattgtttcagctgtattacccttcccatgttctccatgcatttcaatgatctcactggtgaaaagcttatcagacaagtcgcgaaacagattgcatatcccaaagagctcaccttgaaattttttgtcatcctaaaatcatataattatacaatttatataaacaaagcaccaaagccaagtgtgattattcttaaaacgtgaaaggtatatgtgctggtaaatgactaagaaacttcaagagagtgacgcataacttcatgacttctgaactgtcgaaatgtaatctagtgaattgatagatgccttattctaaaaaaaagtattcatgttaacacagaatttggaaagtcatgaggtaaggtgagaaaactatctagttaaaaaaggcagcattgccctagatttaatacatgtagtgacacatcattttactattcaggtgccataggacactgcaacagaaaataatgaatctaccttaagtgctgtatgtgtattatgagtgcaaccattctcttatgcctatgactgctaagctaggaaccaaaataggaagtacattaacatatggtgatgtatgcaacaatgtaggaatagtgcaaggcagttcatgtgtcacgtgtttgattctgctaaattgctactcttaacaacaaatattaatatcagtatcatgtggattacacaatgtctacgcttgtttgttaacaatacatcatccaggtagtttgcatcaacttacaaactctaaattctctggtgagtatattaaactgcataatcaaatggtcgaaatacaataattttctgaataaaatatgaatgttatgattgtaataatcagtccaaatacaagcacgggagaaacacgtattttgggaaatggaaaaaatataaggacctaaatgactaggtaattcagggaaatgattttagaacaggaaaagggaatcatattaggatggtccacaattgtaccacccttcaagtaattgaaacaatcaatccaatttcatcaaaatgcattagttttacaacattacctgcactccttcaaagtaacgtttttctatttttccagagaccgcaatattggaaagctgttgcttatatatttgtcgagaataaataagctcttcaagggaaccagcaccaagtaggcgaaatacagtgacatgccgcctctgtccaaatcgaaatgacctgtcttgcgcttgcaagtcttgcgcagggttccaacttgggtcaaaaatcaccacacgattagcactgaccaggttgacacctaaatttcctgcccgtgtagatataaggaaaacctgtagaaaagcaattcaccatttgacgatgctaatctaaaaagttcttttggcagcgagtactgaaatgcacatcaacaggaagttacctgtttgcttgggcatctattgaactcatcaattagtaattggcgtgcattcatgggagtcgttccatcaaagcgagaaaagcagtaacccttccgtataagaaatttctctagtatgtcaagcatcctggttgtcaatttatgcatgaacaagtgattacacatgcagaagatataacatcaagcagcatatctaaatcgcaagtactgtcaagaaacgttccaagaagcaaacgcagtgaacaagaactaagatagatgcttaagagaaaaataagctattcgatacaagcaagttttgttttaacttactttcaggtctaaataaataggtttagtttgtgttcagtgtaacctgtctaatcacattccctaaaagtgtatttaaagaaaggcaagtagaaggaagtttacatctattcaatgatttaacgctctatactgtcaaaggtatataaaccacaacttcagcaaaaactggagcatgatgggcttgtgagaaattatacccactacagtaagtaatgatattttatgaacatttagtaacaatcaattccaaggtcttacatcaataagagctttttgttcaacatcaaatatggtttaaaacaaagaaattttctgacttgtgagatatgttattcttgctttaatcttcatgcttactgaagcattggacacattggggataaccactcacctgactgaatagctgaaaagaagaattttgtcaccctgcagagtccataatgacaatagtctttccaacgcacgcatctttccacaatgttctgcatcactgagacccatgaagttttcacttttagcacctccaccaactaattcaatatctgtgtcaaagacagcagctgcaagctcagcatctttcttctgcttctcaatttcgtctttcaggtttggctttatcagctccagatggttactgatctatggaaaattagtggggaattattaaaaaaacataaatctttccaaaatattttaagaatatgaaataacctgctgaagcttcccaaggcaaggaagaacaagacagaaggggcacagagaacaaccctctggattgtctctgtgaagataagaccagataatgccatgtggttcagttctcttgcagcattccacctgagtcaaaggacttccacagctacatgggagatccttgtttataaggatttgcacgtcaggctgttgcagcattcttctgtaaacgcgcttttgaacgtcactcattctgcagaaaacaatattatcctcctttccaagcatgagatgcccaatggtctcttcctttgttcttctcaacagaaatttgctaagaactgaaacaaggtgcttcttgcgcttatcagcaacttgtacaaatctctcaggagcactgaacctctggccatgttttaaaggctcgtcataatatactcgaaagtgttctcgatcccccaagcaaccaggtacaatccagtcaaacagattaaataattccattattttattttgcattatggttcctgtgagaccaaaccgctttcgagtagtaatttccaagcaagctgtatataactttgatttttcattcttcagccggtgtgcctcatcaacaaccacaaggtcccacgagatgccacacaaaatcttgccatgaatcctaaaagtgtcaaaactggtaataactatctctagtctttgagtttcaaccttttgaagaaccaggtcacgatttgggccatgatagacagcaacagaacatcttgcccactctgcaaattcattttcccagtttcgaattactgatgtggggcagaggatgagtataggggcaatctttcttccttccactaattgatcaccgtggtcattatcttttccaataacagctgataagaaagcaattgtttggatagtctttcccaaacccctaaatcagaaaaaaaaacatgagaaacaagggagtcagaactcagaagtccatcaaatttaaatgttgtgttgaaaaatctcattattatgttttcggtttgagatttaataataggtgagtagaaaaaagctccccaaaaataaaatgctcaagcttgctatcgaccctgagattttttttcccaacagacctacagggtatgcttatgtgatgccggtgcaagtacctgtcaatcatccacatgcttacccatcatgcagaatatgagcaaactatgtatataaattgatgataagaacagaataagaccacgaagtaaaccgccaacggattaaagctacatacagtgggaatggtttagttattaatttttcacaaaataatataaaccatgcaaactatgtgcatggttattacatagaagtttaggaacatcaggacatatgcaatacatgtattatcttttaaagactataattttaagatacttttcaaactaactacaatttccctgtcacagttttgtaaaactttaaataaacttaaaaaaaaactagttatcatgtcggagtttagactttaataaagcaatagtaataagtcacttacaaaatctttttaagaaaaaaatcccttgtatgatataatctcctggttgtgagtaatattaccaagtttcattgaatttgacgatttaagcccacaaacctatcaaccacaatgttttcacatggatagaaagagatatgtattgttttggatattgtatagtttcatttcagttcagccacaatcaggagattatatcatacaagagtacaagttatttagcagtgtacttatactgtaacaaaataacttccaaacctcacatgtcatctccaagcacaccgccatggttgtttctatacagattgtataagaatcttacaccatccctctgatgcacaagtagcctgcaatttatcgaggagggtacctgtaccaaacaaaacagaggaaagcacagcaaagtgaatgtgcttgtaataactaaaaaattgctctaactaaaaataaaagagaggctaaagtgagtaaaattctgttgaaggagggactaaagtgaacagagggaagggatattaggagggaaagggaagccacatctgttatatggtagttaaagggatattaggatatgattgatttgtattatgtcttccttatctcttgtactatacacacctgccccagccctgaggctcaatataatcatcaggttatgctgtaatctctcctcctattattcaacatgctatcaatcacccaaaaaaaaaaagccatggcaggtgcaaaacattggtcagaacctatcacggtgcgagaacctgaccagtcgccactcgccaagaactgtggaccggaacatcgaacagtagtagccaagagggaggcggcagcatagattttacctggacgacggggcgctctccgggcggcgagagagcaagcggttcgtagggcccgcgggagtcgagggaggccgctggcggaagggaagcgcgggggcggatgcaggggacctcgtcctcctcctctggcagcggcggcgcatcatccgccgccgcatccgaggtcggggaagtgcgagggggcggtggcggcgagacggaaaaggaggaagaggaggaggaggcatcaaggcggaggagctgctgcgagagggacgtttttgggggcctcctggcgaggagaggaggaggtgatcggggttgggactcggattggggctgtgaaaaggaggaagactggagggtttctttgaggctgtggagcgacatggcgttgcttggcaggggaggaggaaaccggtcggcgggggtatttgtggggacgttttgcatcctcctttcttcctttctcaataagaacttgcagtcttggttccgtacttccgtaacataaaacacacaaaaccttccatactaaaagattgtgtcttatacacacaaacttgttcacgctccataaatattaaataataaattttaccaaaaaaatctgaaaattgcattacacatatatgcaaagtctcatctagaaaatttgttatgttttcaccataaaaataaaaacaaaattccgacaaatatatattttttctttatagtttttgttagggccttcacaatgtaactacatggcgtttggcctcgtcaatccacataggcgaatggcttgcgtggaggagagaagagggtggggaccatgttttcatggggttctcacatagtcgcgtcctctccaggtacaaagagtctcatcagttttgtcagaaaaaagcgcgcagagagtggaactcgaagagtggggggagagagaggaagacactgccggagaggggaggggcttgccggcatcgatgaggacgacagggcaacgccagcactggcgaggaagcgacgttggtagcggcaggtgcagaacccgtctccagtctcccccgccggcgaggaggaggcaccatcgatgctgagctgctagatctgccctgagctcgtcgcctgcaccatcgctgtcgacgccgccagctttgcattgagctcctttcccatgctggcgaggaggaggtgctgatgtcgccagatccgccccgagctcatggccatccacgcgcacacggtgctgagtttgttgccgcttcgacccgctgtcgcatcgctcgatttccaccggagaagctcgctaactcgaggaggggagaccagataggggagaggagtgggacgctgacgtcgccaggtccgttacgagctcaccgtcggaccagcccgaagctcactagccgcgagggatgagtgagcagctgggaggagaatgaagagagctaaccaaaggaggatgctgtgggtggtcaccatctcgtcggaggaggtgatgagccaccggcaacgagaggaggaaggagagtcgccagtggtgaggtgaagtgggggattttggatttggtcaaaggtgctattttataatagtttctgattttaagggtgtttagtgtaaattttggatctatatatagatctacagaatttgaggactaaaatataaaaggcgaaggctgacttgcacaacaccatttattgctatataaattctatcaaaggaaattattatacagtaacaaggaaagcatcaatgtttccttaatttgatatgaaatttgcaattctataaaaacataaaagcttcaatattgaattagaaatttagtagacttattgtaaaattcatacaaagaaggaaaatggaaataaattaaaatactttgaattaactactaaaacgatttttgtggtgttccccttttatttttactgacggaccaatgaaacaaacgcttgtaaaaatgtattggcagattccatgtcatgagctgctagcgataactgattttcgctggcgagctcttaggaggccaccttaaaagatagctctattttataaggcaggcctcctaagagccctccagtgaaaattggtttttgttggtggtaactaattaaccacaaaaaaaattacgctattaaaatttcacaccacccacaaccatggcccaccaaaccctggctccctcgcctcgcctccgcgctcctcggcctcgccgcttctccttcacttgccgcctctcctcccttctcgctcctccactcactgttggtggctgtgaagtgcaaaatatataccaccaacatctgtataaagtacagataataaaacatccaacatagtgatagggattatttctaacatatgccacgagtgttggtgaatatccaatataggacataaaccaccaaagttgggaggaaaatcagactaaagtaaggaaggagtatatccatgcaaaaggtgggctgtagacttcatcaaaatatcaacgaatcagcctaaaactcgcaggaatgaataaggcagaataggaggagtccataggccgaaactgagggccagatgggcctgatcaacactgttgatcctggggtttggcaaggacggtccagatgtgctcctgatggggttgcggggcatttcggacaattcccctttcaataaccgtcatacctaccctatttaagaagcttcactccttcactctcacacgcacttccaagcttgagctgaattacaagaggctctattgtattatttgtatactagaattaggaagatagtagagtagaagaagtcggaggaattccggagctgtcggtaatcctctcctgtttattttattctgtttattactctaataccataggattatcttcctgagtaatttagatttatcttgtgagaattacctcttggttagttcctaattagcatatgggattattgttcactataatcaactaaactatagtgattgctttgatgagttataaacactaaaatagatattaattgcttagacgtggtgtttaggtaattattatccagtaatgttgcatatcccatagtacgtttgaggtaggtatagaggtggtgacaaccctcaagagcacttaagtcctccatatccgggtatatagtagagcgatatctaggaacagtaggttgccagtgcctgaagtattgtgttaggattaaaattaagctttccctagacactatttctcactaggaaatcatctaggaacagtaggttgccagtccctattttttttgcttggtgtccttggatgaaccggaggaagaattaatcacacacgttcccttgaattcgataccattggaatactccataggggaagtaatacatcagtatatccgtgcgcttgcggattctatctgtaatcgtaagaaataccaacactcacctcgcccccttggctctcctactctccccccttccaccacctccaaggcacgccatgctgccgttgcgtaccgccacctctcctacctccacgctcctccacctctgtcatgcccagaaattcacaaaccagaattcccaagaaaaatgtgcattaaaacccctgtccagcactggacaaggtacacagacaacaaaatttgcatacagatccacgtcttacaaaatatcataaaagtattacaaatgcagtggaaagataaagctagctaaacataggataactgatactagcagcgcgacgactccacaccataggcatctttaatggtagtgacaaagcctactcccctgagtaacctccatccaggaagcacttcaactctaatgtgggggaacagagcaagattgtgtactacccactgtactcaacaagtcataccagaagagagggtatgatgcaagtaattacaaaggaggctaggtgttcttttgcataaagcaggtatttaaagtagtagttgaaagtagtaaaaattgttgaagtaaactaatcaatattaatcatcactatccaatgctaaaccacgttgcgacatgcccaaccatccacctaaactataccagttccattaagcaatattaatctggttgtttgcccacaaccacaagcaaggcatcacaattgtacccacaagacatagccccacaatacattttcgtgtgctggcatgccaccgtgacataccggacagggactgtaataggacccttcgcataaccccttcgcaagtttcgcccctacccttaaaacaggggtaggcagccccctcttgtgccgcggtatatccataagccaatcaaaccttaaaaccggggcccgacccaactccatcacgcccacccttacctaggaaagttatataggaaagagctatactacaagcctagccgttgcccacattggcttgtggagagcacggtaattcttacagggtttcctgtgaaccggtccttacatgccatgggcgcgtttatcaaaaccatgcgcccacaacccatttgatatgttttagttgaattaataacatggtggtacatctccataattatcatcattaaaacaggatagaagttctatgtgataccccatagtgagctagttgatctaagcatggccaagcattttcctaaccaaccatctaatcatattaattcccaggttaacaatggcacaaggtaagcgatataaagcagagtaacaggaaccatcccacatgacattataaaacatcgcaatattaaatagaaagcgagatatttatgaaatatacacaatatgatcaaatgtaatgcatgacttgccttgctccggtgctactgggaactccgcaacaacttcaaagtaaaccagagcgtcggaactgccggaatctacgcgacaaacaaagcatataagtaaaatagaatataagtgtagatggtcgttagcgatcagtttcgaccgtcaatattaccaaaatagaggagaactagttatgcttgcaatgcatatccatgttagaataataatattccactagtatttggttcactaaccttttgtagagaataaccataaagtggaggagaatcgacatcaaatcaaatgataaatcaatcgaacgatgtcgtgactcatacttatgcatgaatgggccaagaacttagaattaattgggccaaaatttacaagtctgcgtaggagagcaacggaagaggccacctgccaattttgggccaggttggcctgacccatggttcggctgaagcccccgcagcgtcgttcgatccaggtttctcctggacgactgagatggctccccaatgatggttggtgggtattaccgacctttccaaccatcacaaccgtcattgggaggctataaaggagctgtcatcatcactccacacacacacctcaagcaaagctttctcatattctctcaagtttagtttagtgttatcaagctagtggaataggaatagagtagaaatcggagtccggaagccttcggaagagttcgggtatggctctagtagctcttctcttctcttttgtaagctttgtactattattagaatactcttctttatacatttatggtattggaatactttccaagtatatgaatgccaactttacattatgttcatgttatactgattatacttctagcttatttgggagatgctttggtgcgggtataatgtttgcttatgcaattactctatgtcatgaagatgatattagagtagtatctggtagtttagacgtggtgtctagattacagggtatcattatttggggttatatgctgcggatgagaggtgggccgctgatggtgacaacttagtacgggtatttctccgtgcgtggatatagtcctaagttaatttcctggggagggtactcctccgtatttagcctcggttgtatggtcatgacgggctgtcgtaaggaactcggcagtcaggggtggcttctcgaagtaccaggaggacatcggatagagggtattagctagtacatcagataactaggatgtatgtagactatgtatactagaagtataggaatagattctctttctcttttttttccacttagtttagatattttagtatgagaatgagtagctccctacttgtgtgtcactctacccttgaattatattaacccctacttagactatgattattacaagtaacatataaattattagtcaggttctctctaccatgatcttcccatgggattaaataaatacgatacccttggaatactctcaggtgaaatgctacaatggtatatccatgtacttgcggatgaactctgtaaccataatatactaggagtatttctgcgccattgctgggaattatatttctagtaatgccgttaagaaataccaacaataagattactgaaacatgaaacaacactatttttagtggattctaggcattcttatgaatttactataatttgaatggacttaaacggagctcggatgaattagttatgaaatttagaatagtcactgtgtttttacgattaatagaaaacaccttaacgaattattgtgcattaaagcttatgggttgatgtctcaagggagggaggccagcacgatagtcgggctccaccggtcagtggtgcaagtcgggcggcgcacggtgaaccaagtccatcgggccagggacgggcgcaccacgtggcgtacacgtggcgctgacatggtagccacgtgggtggccgaacgaacagccccgatctgctccgaagcagatcggacgtctgtggagaagcggtggccggccagccatcccaaccgggaggaggcagcgcaagtgaccaccggcggcagctgccgggatgcggaggcgtgcacgagtggcgatggtgcggcaaagaagaggaaggaaaatgggaggagagaggagggattcctcaccggtgaaggatgatgactggtgtgaagggatgacggcgatagtggcaaggggcggaaggggctatagcatgatctagggaaggagaggagagagattagacagataggtaccacggcagcgagcattgccggtcggagtttggtgaagatggaggtctcaccgacgaccgaggagaagcaggtttcagcggcgcaaagcgacggccggggagagggcaagcttggcgagcacggtggtggtgacggcgtggagcggcagtgaccctagtagcagctagaggcggccgtagttggtggaaaaggtagcggcgtggggtgcgacgtcgtgagggcaataagagggcaccggagagggcatcaaatgagggaaaaggaggaggggatctcgggggttgtttttatagggccagggagtttggacttgacccatgtgaggcgaaaacggcgccgatgtggggaaggagagagagagagaggcagagagatttgaaaatcgaatctccgcccatttttaggggcgcggcttgcaagaagtggggcggcgattgcaggaagggcaaggagtggggaagtgggtggagagggcactgggtgcggttgctcccttcgatttcgccggccggaggagagatattgatccgacaggtggtccacctgttggtgtctgaagagagagagaggggcataggctcggctgggccacggccatgggtcagcgagcggaggaggcgagcacgcgtggggaggcaaggcggaccgcggcccatgaccgaggggaaaagatagcaaaaatattttatttaattccgataactgaattctaattattacttacttctttgctctgaaaatttcactgataatcctgttgttgtattttagaaggggaacttaagaaaagttctatttgtatctctagtagataaacttgtaaaacacatattttaatatatataaacttgtcggggtgcgtacgaaccaagacaaacagaataaaacaaggataatcttgctaatttaagtgttgattaggatgttacatacatatttacgtaagaaaatgatacgtagatgtatacatctgttcataaaaaaaggttaataaggcccgattattgcacggagaaaggcattaaaaccgagaaatgatgcaaaaggtagaacccgcaataataaagccgatgaatggagttctcaaaacaagatccgatgaatgggcccaaacgaacaatagcggtgaataaaaagcccatggaacagtctaagtttggtgaaggattttagggtaggcaccgtagaccttgaccccgtatatactttaaacatgttatgagagttacagaagtacacaacaccaaacttgtggccagtatattacgataaaataagtggtctcagtacatttacgagacagtgcccattgatacgtggcagcagaaccttgaattcacggcgttggtctcgtatcattcatcaaaacaggctgcatctaacacacgacgtatatttaagttgccagagtgctagagaagtaaacatttgtatcaacaaagtaattggtcgctagctggactgttatatatatattcaacacgtacgttaatttacggtcaaactttgcccagcatcttcatttttagctaggcagcctgcttcgttaattttcttcagcatgataatccgacgaaccttggttaattctgctgtttcgcgtgcgtggtttcttacttaacgcacgctagctgtagcgcaccagcttagcaaccttctggtgctggtggtacgtgaagcgcgaattgtcttcggattatcggatatatccctgcatgcccacgcggcgggcgccgcgcgcacacaacataagacaacgcgtccatccagcgatcgacgacgcgcgcactgtccatctatcctacctatcgctttatatatccatgcatgcacctccctatccttcacacctagctcgctcgatcatttcatttctcgaggcaggcaagctagctaagattcgatcaatggcgctccgacgccacgcggcacttctctccttggcagtagtactactgttcgccggcctcgccgccgcgtcgccgacgtcccagaacaccggcgacaccgtgatcttttggggacggaacaaggacgagggctccctcagggaggcctgcgataccggcctctacaccaccgtcatcatttccttcctcagcgcctttggctacaagcccgggtactacaaggtcgacatctccggccacccggtctccgccgtcggccccgacatcaagtactgccaatccaagggcatactcatcctcctcgccatcgcggccaaggcggcgagtattccctcccgaccccacaggcggccgttgagctgaatgaccacctctggtactcctacctcggcggccaccgcaacggcgtctatcgcccgttcggcgacgccatcgtcaacggcatcgacttcttcatcgaccagggcggcagggagaactacaacaagctagccaagctgctctacgcgcacaacaaggactaccgcggcacggtcggggtgatgctgacggcgacgacgcggtgcgagtacccggaccaccggctggatgaggcgctggcgacggggctcttccaccgcatccacgtcaagaaattcagcgatggccggtgcccggcatcgtcctggatacagtcgttccagaagtgggcgaagatgtacccgcagagccgtgtcctggtcggcgtcgtggcctcgcgggaggtggacagggaggcctacatctcgccagaggacctcaagaaattgatgcagtacgtcttcagcaagctgcccaacttcggaggcgtcatggtctgggacaggttctacgacgagaagaccggcttcacgggtcgcctgcgagcgtaactggtcgcgacatttgaagcccgttaattccttactatgagatcaataaaaaagcttttgtggagtactccacaaataaagtcatgtaataataaataaacatattgtgtatactataaagatttgtgtgttgggtaatgtatgtaatcaataaataaagcgaggtacgatgatacctcgagtaaaataaataaagagctttgagattaataaagttttctttatcttaaaaggtataaagattaattgccgtgggaatttaccctctatggacgattaattcataatatggacttacagagatctttgcaggatgaaggaccagaacttgaatgcttgcatacaatgactttttcaatttgtgagctaataatgatgatatactacctccgttttttaatagataatgtatttaatttttttgccgcatgttgaactattgatcttattcaaaaaattatgtaattattataatttattttgttgtaagttgttttatcacttaaaatagtttaagcatgatttatatattaaacatttgcataaaatttttgaataaaacaaatgatcaaacatgtgttcaaatgtcaacaacgtcatatattaaaaatcggagggagtatatgcatacaagtacatataaaccgctcaacaaatttgtcaagaaatcacttccgtacttttttttctatagtggccttttacatatccatttcgggaatcatcagcctacctggaagaaggtataacaggctaaacccaaacaaggtgatcgatttatcttatcatatatagttcggatgatggtggttgcttaagaattccgcctaaaatatatagatgcccctccactcttcctcaatagaccgacgatacattatagatgcccctccactcttcctcaatagaccgacgattttggggaggccaataccccatgggacacgcggtggaagttgaagcgaacgacgatttttgataaaggatgggactacctatacatctaacgggtgatttttcacccaaaatcacacagatttttttaaaccattagatctacatccaatgaacaggaaaaaatataataaaaaaacaattataaaatagaacaaaaaattaaatgaaatataaatcaaatgggctgtaatctagcccaaacgtcataatcaaaataaaccataaaagacaaaaaaaagcccaatagaagaaatgagccctagatagaaaagaaaatcaacaacatagcccattgaaaatcgtagcccattacaacagaaccatcaacttggaatccaagaaagctatcaaaaaaggaaaagaggaaaacacacgcaacaaacaaggttcaaggttctagatcaatcagagcagatcaggggcgccatggacagcgatgagaaggaaaaaaaaagagagaacaaggagactatcaccaaaaaaatggagatcaagaggatcaagcaaacaagagaaaacataccaggtaaatttcaaccctgaaaccccttcccccttcacctttgcatttctgattttaaacctctaaaactttcaccacatcttctgccatcagttgaccaactagaacagatctatctaatgctcatacagttgaacaattgaacagataccaattctcatgcaggatattaacttgacaactcaaaacttccactagataacaactaaaattacatatggaactatggtccaattccactgtaactgcactgtaactgtcaatgaattgtactgtaactgaaactataagactacttacagttatattttgctagcaccatacatggccccaacccgtatgcaaaaaattacagtgcatttgcactaaaattacatttgtaagaacaatagatataacatgtaagtgcactgtaagtttagtacaaatgcactgtaaatttaccaaaaagtaaaataaccttagtatgcccattccaaattgtgctaagagggaatcactaaaactgaacacatcaactcagttttgaatcactaatagtatatcatgccatgtagctaggtgcacaaaccactgtaaatcactaatagtatatcaattggtcagaaaaaaaagaaaaagaaaaccacactagttattagcatggtgatatgggtcagagacaactaacctgcatgatggctaatagacaggatagttgagatcccttgagtaagaagcaagctaaaattaaagagaacaaaagcatgaattaggacatattccacggtaaaactgagtcacataacaattggagtagggcacaatccatatgaaaaaaactcaatccatatctacaaacatgccaggcaaaaaaaaacatgaacacctattttaggcacaaatcaactgaaatcaacacacaaataatactccaatactaagattgcacaagggattaaaaatgaaaaagaagttcagaaactaaaaacaacaccgcaccaaatcaaattcacattcacatatggtcaaattggaaaattacagtgctttgtaccttaaattacatttgtaaaaacaatatatacggcatgtaagtgcactgtaagtttagtacaattgcattgtaaaatttgataacttcaatatgttaacttcaaaatttcataaattctccatcaaacagtaatgcatatacagattttacatcaaacatgataggaacacatgt

SEQ ID NO: 42767 - DNA, 1705 bp, Oryza sativa
acttacagtcaaaacttgctacaacttacagtcaaaacttgctaaaattacaactgtaactgtagttcatgaagaatgtattggactgtaactatagtgcaataaatatggaactagaacagatatatctaaatacgccccaattctcgtagaggaaacttcacaaaaccaaaaattacagtagataacacctaaaattacatatgtaactatggcctaattccactttaactgcactgtaagtggtatacaattgtactgtaagaccactgtaaatgtgataattgatgaagaatatacagggattgtatggaatatagaattcagtaaggacaacacattacatgtttctactgtaactacattgccttaatttttgcagggttaaagaatgagacacaaaaagacaaagacatcaataaacaaggaaaaatacaggcacagattcaagtaatgaaagaaattgctggtaagtaatttatggtcaacaaaattttaaattacaaagatattatattgtaatgctttttaaatattaatgcaggattaaagccagatggagaatgtagtcagaaaaaaattctttcagaaacaagttgatacagaaatcaccaatttcaagcaacatacaggtaacaattaaattctacgaagaatagaataaaatttattttgaaaaacactgcttgcagctataaaaaatgactagggcagcaatcaaactaaggggcacataaaagtccgaacttacaaaaacatcaaacaaatttaattctccaggcatgccccaacaaatgaatgatgacaggatgaaaatatctaaaaaaactaacattctattataaattacaatacaaaagtactaaaattacgactgtaattaatcagtacttgaactgtaactgactgtaagtggtataaaatataactgtaactgattgtatttttttttgcaggtacaaggaagcgtgaaagtgaagaagggggaataaatgcaggggagacaatgagaagaaaatttcaaaaaactgggcttgaagaaatcaaaagagacatacaaatatcaggttatattattgagaaggaaaattttaacagaaaaaaaaatgacttacagtcaaaacttgcaaaacttacaactgtaactatagttgttgtgtactgtaaccttatgatgcttatttatttattcaattacaggatcaaatcaattgcaggagattgacaaaaaagaatattcaatcaggacaaaatgctagaggaggaacagaaacaccaaatgcaacaagctatggagcacaaatactatacaaccagtactcattgcttaatgaagatggaagacttgtaagtacaaaattcacaatattataaaaataatgccaatacttctgatataacagaaaacaagggaaatttacagatggaggcaggaaagatgagctacactaatctcatgcaacaaataattcagagtccaagagtgaccatgcaaacaaatgaggtaagcatattttaatcagatttcaattgtactagaaaaagaaaaatgaaagaaaaactaattgcaatctaaaatgaaatgtgcaggaaggaatagaggcatatacaaatctacttcaaacacccgtcgcatttgatgtgagaacttaacttacaaccataaatgaagaacaaaaatgtcaaaatttataagtcattacta

SEQ ID NO: 42768 - DNA, 11260 bp, Oryza sativa
  unsure (1)..(11260): unsure at all n locations
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctatcccatactagcacatgtggttgcactgtatacgaaatgaactgacattgagtgaagtccttaggtcggtttgggcacactctccccctatcggtacacaactaatcaccatatgtgcaccacttgaggcccaaacctaaaatccatgtttttccaccattttatttatcaaaatcacaagtattaaagttctgtccagattaattaaaaatttattttcatgtttgtaatgagcccataatgacaaggaagacaattctaagcatggctaagctttatatagtaacctagtgtcaccaaaagtcatatataaagtggtatagtcatattgttcctaaggttaggagtgagggatatggatatatgtggggtcaaggtgaatgcaaacaataggagtttgtccaacaagtttaacaaaattttaatttattagtgtacaatcgacatgcaagatttgcaaacattttcaataacctccaaaacataggttcaaagtgatcaaagagagggaggtgggacttgccttgaatcaggaaaatatcagcacctaaatcacttcttcaccgattaagcaatcatctatacaaagtacacgttatgcaattaaacaccgaaatatgcgaaaaatccaaaatgctctaaaatggatgatttgtgcacagcgaataggtactggtctaaaatgaatttaggtgaaagaatttctattttatctcatttcatttgagaattatgaattttagaagtttcatcggtatagcgtaggatttacttaggtactattgtgaaatgctgttataaggtgattcttattaagtttatgtttgctggggtgaagatatgtgttttctaagactaacacatttggtttcataatttttagagttaatatgaattctttatgtattttacaaattataacgtgttataggtgtatagtgttctataggttcatggctttagaggtttaggtctagaacttgcctcatctagctagtgatgtataaaatgagtattttagttaactaatctaaccttagttcataggcttatggtctttattatcatggttcatattttataaactaggggagctctagtccatgttagcaatttattatatcaacctagaaattattacataagctaagtgccttaagttttggtggatgggaatggaactatgcattcactggtctaacaagttttatttgggtttcattatagctagagtgtatttctatgtacatttatatatatacatattgctcaatcgatactatgtgattagctcctatcctataaatttaaagtttagagctataacctgtacagaaggttccatattttattttactatgttgaagcccactgtttgctggttctatagatatttggttcacttcatttagactaaagatgaattttctacaaattttacattttaaggttgctctatgatggttattacttacataagtaagtatataattttattttataacttggaagtatatgttttggtgattatacagaacttgggtttattcaaaaaggatctaagatgagttttatataaacttctaaagttcatcttatgccaaactagttattttaaagataatagttttagaggcatttgatgtaaagtgtttatatgttttattttaatttatttttagagaacatgttggtggatctgtagaaactaagtttgctctaaaatgagttgaaatgaattttgtatgcattttataaatttgtgcgtgctttatgtgtgatttaacttggataaattttagaggctaaatttgtactgtgagtgcaagtttttattccataacatcaaatttcccaatttggtgagttcacagaaatttgaatcatcttaaaatgagctatatttaattttatatggattttacaagttttagttactgttcttttataattccagattttgtttccaaggggtccactgtcagtgagagatcaatatacaaaaagatccctgaggtttctaagaatcaacccgcagacctaggctcatatgtcagtgaattgaaaagttgcacattaaaccttatagttgtttaaattctcgaaacaaggtccctgacttcttttctcacgcagagaggcagaacagccatggctgagctcgatctcaagcttgccagcggcaaacggtggctcgtttgagggtgcgaccaaaagacaaaatgaagatcatgctattgcgattccattcctcttcttttcttggtcagtggacatcggagtaacgccggcggcgagtccgagcggcggctgtgcttaggctgctactgcatgttgagttggtgctcaattctaagtgaatgaaatgcatgaatgcaatcctatgggctcaagggtgctcaccgaaccttgaacgaggcgccggaaagtctggacagcggcagcggagaagaagatggtccggcgacggtgtagagctccgggaagacggcaacggctcgatccactcatcgaattgacatgcatgtgttttcatggggttagtgaggtcccagggatggtgtatacgcgaagaatcggacaatggctcaccggaggaggcggaatcgacaatggcgacggcgaccggaggtggagaagacggtggacgatctccacactcgtagcaccattcttcaagattcttgaggggaaatggagaggaggttgaggtgaagctggtggcgtggtggctcgctccggcttgatctagattgatggcaacggcgacgatgtcgctgcggcggtgcgcagagcgcgctccagagctccggtgtgcacggcagcgttcccgccgattggctgcaccagagaggatgaaatcaaaaggagaaatattcggcatggtgaggagagtatggaacgcaagagaagaggaaacaaccgcggctcatcaacgattgcggccattgtcttcttcgtggccggcgatggagaaccagtggagaagagcagcgaggatgctctccctcggatggatcggcactggaatggtgggtgaagagtggcgacgcgtctgggagaggcagaaatggagctcggcgtttttagggcgtcgacacgtcgtggccacgcgtcgcgcggcgtccagagccggtcggcgctcgatctctccctctcagtgtttctcggtcggctagggaagttgcacagaggaagggcaagccggagggactgacaagggggcccaggtcgaagtaaactaggtggaagagagatgtgtaggcagagacatgggtgagcttggtttttggacgaatttccggaattattttctcctctaattttgtagcttcaatacttaatgtgttgatcagattaactagtgttgattttactggaggtaggtgtatgtacctagtttccattttctttggttgcactcaaaaattatggatagattactcacagaaattagaggaatatgggttctttggaaactagttcgaatttttaggagacctaaatagagaagataaattctggaaaatttatttttattcattataaatgacctagtatttgaataaattattttacttatacacttttatgcagttaaatgcacttttagacaaagtatggttttagccgattaagaactacagttaatctagtttttattagtttgactgatttatttgaggtaccaaatttagttattaaatcataccaaaattacagtgagttgcatgtgttgattagagcctacatgaattttcccatggttttatcttgcacgaattattttagataattcgcaagacttatgtcttatatatgtttccctttcctaaatgcatgtaaatgtttataaaagttatatttggactctcattaacctgaggtgatgttgatatgttagaattacaatttacattacacaggtcataagctccttacctattatgcacaagtttactttagtattaaattaagagaatgcttatagagatgattaagatagaatataccctatatgatataatttatttggtcacttccatgttcatgactagtcttcagatggatgaccaaaatagttttgtggggcttgacattggccttgttgatatattttaaggtgtatggtttctattttaacttcctctagctagcactaggccctaatggtttagttgtttatctagatcttagttaatattcatgagacctattatgaaatgcaaatcgaaaatccaaatgcaatccaaatccaaatgcatatgaaggactcaagtcaaacatgtctatgagagtatgcatgcttacacataaatttatatttttgtcctaggttagagatgcaaaggttttaatttgttttaaaattttatcatgcaagagttagatcaacttcacctaggtttaaaatggaaatttttggtttacaaaattgaagaactttcctttcaactagttttgatagaaattccttaatcctagaattcgggtatgttacaccaacatgctacctgatcggcatttttggcaacagccatgctatgcctcgcaccatccatccatcccaaaagagaagacacaaagacaatatcaaaatccgatagcaatagagctgaaaggcattgtcgctgccaaggaacccggcttgcttgtactccctatcacctatatagtccatggcaagctctctccatcctccattgtcaacgtcatcatctccatcctcttccttctccaaagaaaacaaagggcgtgccaccgaagtggaagaagtagagggcaagaagatgggggattgagcccagagcgacggcgatgtgggggaggtcgacataaatggtggttgcacggacattcaccagcatgagggggaagggggacagacgagcatgaggggaacaagggagagagagatatagacttggggggagggggggatgagctttacgaaggtccagaggataaggcaatgtgtgtgtggtggcctgatactctgatctgttgaatggatttcgtcattaatttatcccgttaggacaggacaccgttgcgtagattttctgttttttaatgtgcttgatttttttgcttcctaagcttttcttttgcagactgagttgatcgttgagccagagaagttcacacctcagagctgtttaaagcttcagacgattaacaaggaggaaaaactcgcaaaacaagatctggtatgtttctttttttttctctatattgttccttcttttcatgaattggtaggtttttgttgcattagctcacactaaaatgtcttagactatacatatttattgttttagtacatatgcacagagaatctctgacattagttcatttttttctatctcctagctcttcttcccaattgtttgggacgggcactaggtgttgttatgcatgaatattcttcatgaccagatcaattatttcgacccaaaatgcaatgactcaaaatggttccagtactctcagaacctggtaactatgtcagcacgttccattttattatgttcaattgtttcagcacaacatacatttgtatctcgcaactcattaactaatgttcctgcatttgtcaaagcatagtaactatgcatgttccatcttgttttctacaactttttcaacacaacatatattcttgttcgcaatccatgagctaatgtttcaacattttccttatgtaatgtagctgattaacttctccaaggttgcgcttgatgccaaaattgcaataaaagatataacaaagtttcagaaccactccaccacagtacccactacagtccaatgcgtaaattgcttttaaattacttgtttcaccttttttttcattatactgtttttcctatctcatcaccttgtgccatcacttatttttttctcctaggtttgattgtggctttttctgcatgagatacatgaacaattgggatggaacaaagatggactattttgatgacagtacgtcagtaccatgaacatctacaggaagatcatgacttacctgttagccaattcacatttggcgacaaccgacttcagacaactccctccaaagcagttagggattagtctggcctcccacctcctcaatttatccgataactttcgcataacttttgtctagtctttttgtttgatgatattttggttatcctatacatatgcaaggaatatttgtgttggccaaagcaagaaacaagggattatctatgatcactaaatacatgtgaagctagcttgatgcatgggccatgcaaatgtgtggatgtatcagtctggccaaccatatgactcatgtactcaactatatatgtgtgctaaatatatacatatgcatgaaccagccaacaagagagtggagttgcatatatatatatatatatatgtgcgattcatgtgcttgcgcttgtggtcgtttacttagcaaatacgtatacgtataatagatgatctttcatggacttaaagaagcagcaagctgggactagctctgggctgcatatgggctggtgccagtagttgcgctgctcgtgtgtatgtgcagccggatattcacgccaacgggagtgagctactgctgtggggataacgtcggatgactcattcttatctggatgattcaaatgaaggcaatccacagcaattgaacccagaggcatcgaatcgatctgacgcgcggtcgtagcggcgccagagaatgcgcgtctacccgttaggccaccctatgcctataaaacccatcgaaagcaagccaggccaaggggagaaacacacatccatccattgacgagcaacccttcatccgcattcattcatagcaatattcacacacattcctcacacattcaacgacacagccatcgagcaattcactcaccatcaacacacacatatgcagagatcgatatcaaaagcagctcttctattcctcatctgatcgatttgcacaagcggcgcagacgcagcctcatcggagtagccaggcgggaccagctcgacgggaggagacctcaccgacaacaagaggcagcatcagatcatgggcatcaacaacctctgtaccatgggtaatgatcctgtggctttcttattgatttttctttttcagttcatgcatgcatgagatggcgatggtgatgagatgctggagcactgctagttggcgcccgcacgccgtcgtcgagtttgccaagtctcatggaagtgtcatttgtgggaccaggaggcaagccgccgtttttctacgtcgtcatgaccggccgaatgacctcgtcgcgctacctcgccggagcatgttgtcacggcatcgtgaatgtcgtcgagtcgtgcccgactgaggaggtctcgtcggagtcgtcggaaacgtcgccaagtctcccgcgtctacatcaaccaaacacatcattgggcgatggagattgtcgcactgccctcggagccatggtgctgccctcgtcggagtcgccgtgccaatcatctgatcgacatcatccagtcgagtcgctggtgatgacactactcgttgctgtgatctcatcgccgacgtccgccggccatcttcggtggtgttaccatcttcctcacactcgtcgttgagccgcgtgacgagaatgccaatcgaagcgccgctagctgctcggtgcccgcatcgtcacgctggggttgctaagccgttcgtgatgctgtgaagccatcccttcatcacaccggagcaccatcgcttggtgcccgcacaccgtcgtcaagttcatctgcgatgctttcacctcgtcaagccagagtcatcgtgccgtccgtccgtgtctccttttatctatagtaacatgatgagatgccatctgtctacaacgcttccacttcgtcatggcgagatcgatgctgtccgtccatgatgcactctctcttcatcacgccaagatgagatgttgtccgtccgtgattctctccctcttcatcgagatcaatatgccgccgcttgtttgtgtattggagcgtcgctcgtctatatcaacatgaagaaagaatagtgccgtctgtgatgccaatgtaccgttcgtgttagatctacaccaaccaatgtcctcggctattccgccgatgaggcatttacttcttccaaggtcgccgttactatcggcacactcatagagccccttttgcaggctcgtcatcatatcaaccggatcaatagtagattcatcatccgaaggaggtgccaaagccacgtttgttcggttattgtctgcaccaacttcttcatcaacatcttcgttacaagtccctgttgtataagggacatgacgagtcaggaggtgcttagccatggatatccggctgccatctacaccaactgtcatcgtcaactctttgttactttgatcccatcaagtcaggaggtgcccagccatggatattcggctgttgtgtacaccaactgacttgaccaactcctcttccctttaacaccatcctgatgtcgttgctgatccaagcgacacgagatctatgcatgttgaagatcaatccatctactccaccacgttgctcaagactgatgaggcggagcgacgagggtgggcggagcctatatgaaggctacatcaccaacaccggcgcacggaccgatgaggccgcggatgcgttgccggcgcctagatatatatccacaatcttcaccaacattcatcgtgcatggagaacgtgaagcgaagacgacgagacgaccacatgcagcttaatcggaggtgctctgtaggcctaaacctgtggcagtaattaactaggagtctttcgagaccccaggaattagaagaccacttatccaagtttagatttgtccaacgacaggctatggagcgcacatacatatatacatatatattacattgggaatttgtatttatgatccttgagattaataaagcacatgttccctatgttttctgtttattttgtgtccttagttacactggcacgctctcgcatatcgttaccgtttgttatttttttttgtcctaaacacttttttgtgggaaagaacccaaattatgtgtgctcattttactttgaatggcattttttggaatgtacttatttattatggatggtagttggaaaagttgtgcacataaagagttttgagacttatccaatctgtccattctcctttgcacataaagagttttgagacttaaccaatctatccgcttcactgacatcgttagtcaaacacggaggtacaacagcaaagcacggtgccagccgcacgcaacaactgcctccatgacagtcaccacattctcaaccaggagcaaaccgttatttctctgccaatcactatttgtcaaggcatgcggtgttagtgtatctgtataagtggatgtatttaatacaaagattgattctctagttaattctgcatgtcaaaagataggagtcaatgcttaagacacctatacaatgttatggcaaggttttagattatgataaatcactgtcggagtaccctttacactgaacttaattattgagattcgttatcgagaaagagccggacagtgaatattatctatttaaaactgatgttaatttcctttatttatatatgtctataacattgtgttttgctgcatgccaatgacaatcgatcaaaaatgcaatgttagtgatggattattgtactgtactattccattacatccagatatttaagatgttggaatcattgcaccccatgatgcggtttttcttggatttcatcttctacaatattcaaaaggtgttgatgcatgttactagactgcatcgtgaagagttgagctttaatacaacttttattggccagaacaagatttttcttcatggccctacagtgtcatttgatgcaagcccatgtgctagggattatacaagtctttacactatatttcctgtaaggtttgggccaatgtatttactgcatttcgaatatctccttgaattcttaaggacatgtccttatggggtgaactctagagattaagcaatagttgtgtttgttacatatcatcctagtattgaatcatatgttgacaggatgaaacaactgatgattttacacaatttgctaaatgaacaccctagacatcatacggctaatgtagttgctctggaaggatatacttgtagatccaaggagttgtccagaactcaataacgttaccaaccgaacagggttccgtcaacatggttgaattccttgcatattgatgatgcaagaggttgtctgcattttgctaataactttttgaagcatgcaaaaaatatggttcatataattcttactacattattctttcactggtactgtgtttttctctaaatagtttcaagaagaacaaaacgaggtagcattttctctacacatggcaaactttttatcaacgatattacaaaggcttgctcgacttgctcaacgcaaccaaaacaagccatatatcattgacttgtaagtggatctcaagtcttttccaatcgagttcaatctcaaatctctcaatcaagttcaaaagatggagtgtgattatttctgtaggctttcaaactgaatgacggacgtaaggacgggaaattaggtgcaactatgctaacttgatcagaaattgacttatcagaatatcattatattcttcttaccatcattgcattcttctcttgatctgtaggaaacaatctggaggtatttcagttggaaagttgtgaatgaatgttcttgtatctgttgttgctagttgttctggcctcatggagatatgtatggtatcaatctggggacatcctctctatttctttgtccttgttgagacgatgaccaatgttgtaaggtagtatgtgttgtaccatggcgggttggc

SEQ ID NO: 42769 - DNA, 7483 bp, Oryza sativa
atgtccccagattgacgccatacatgcctccatgaggctagagcaactagaaaccacatatgcaaggacgttcattcgcaacttttcagctggaacacctccagatttcttcctacagttcaagagaagaatgcgaggatggtatgaggaatatattgatagtttgaaaagtcaatttctgatcaagttagcatagctgtacctaatttcctattcttacatctgtcattcggtttaaaagcctacataaataatctcacttcaccttttgaacttcactgagaaatatttgagattgaaattgactgggaaatattttgaatccacttacaagtcaatgatatatagcatgtgttagttccgtggagcaagtcaagcaagcctttgtaatatcattggcaagtagtttgtcatgtgtagacagaatattgtcttgatttgttcttctaggaactgtttaggggaaaacacaattttagacttaaatatattttcaccagtgaaagaataatgaagtaagtactatacgaaccatgtttcttgcatgttttaaaaaagttattagcaaaatgcagacaaccccttagatttcaatgtatatcctcccaacgcaactacattagccgtatgatgtctagagtgtgtatgtagcacattatctaaaattattagttgtttcattctgtcaacatatgattcaacactaggatggtatgtaacaaaggcaactatttactaatctctagagttcatcccaaggacacatccttaaaaatttgaaagagatgctcgaaatgcaatgggtacaccggtccaaaccttgtagagaatataatgtaaatacctgtataatccctacatacagacctgcattaaatgacactgtagagacgtttactacagtaaatgcatcatgatgaaaaataatgttttggctagtaaaagccccattatagcacaacccttcacgatgtagtccagcaacatgcatcaacagcttctgaatattgtaggaggcaaaatataagaaagaccacgtcttggggtacaatgattccaacatcttaacgatctagatgtaatggaacagtatggtacaataatctgtcattaacattgatttttttttatcgaatgtcattcacctacagcaaaacacaatgttacaacgttatagacacgtataaataaagaaaattaacatcagttttaaatagataatactcactgtccgactctttctcggtaacgtatttcaatagttgagtttcgatgtaaagtatactccgacaatgatttatcatagtcaacagtgcataggtgtcttgagttttgactcctatcttttgacaagcaaaattgactagagaatcaacctttgtattatatttatatccacttgcacagatacactaacaccgcatgccttgacaaatagtgattgtagcccctgtaaaaaaatggcaaaagagcataaacaccagtatataacaacaaagaacgaatgagagattgaataaatcttgttaatacgatgaagtgcatcaataaaaaaaaagtggcgtacacattactctaagttgtttacatgttataatcatgtacagagattagtttcaatattgttaaaaattgaaaatctaagataattatgtatatacacattactaagatgaagtgcagcagtgcattcaaagaagtggagcacacattactctaagatgtttatagattataatcatgtatacatattagtttcatcatttctctctagattaaaaattaaaaatccaagataattgtggttagcttcagaaagaaaggaattacgtcatactgctttgtaactaaaccgtcagcccaaaaagtagacaaatttatgcatgacttgagaattagaggggatcttttttacctagacttgagcaagtaagaagatggcgcaggcacattttgcttcacatggacttccttcacctcctcctgcgtgttcctgtagttaagacaacccaaaggacagaatccgcaaaagagcataaagagtagcaaatagcaacaaagaacgaatgcaagcatgattccctcccaatgcgaagggctgcaccatcttcacccaaaattttgttagtaagacaaaaccctctataattgccaatgcattaagaaagaaaaagaaaagaagtagcagcatgtttgcattacacatgggaatagcatagtccattctcggtcgcatccaaaggcagatggcgagggaggtatattcgaacaagaaaggaagaagataggtatattatgggagggagcccttagtagatctaaggagacacacacagcagaaccaacaaacaccacggatgacgtgtacaagaaaaggtaccttcttcttgcatagcgtagagttgccggagaactccatccatacgagagctaacattgctacagccttactagctggcatacaacttggcgcgtgcgcttccgtccccctctccatcgccagctgagatttattctcacacccctacagtgttttcaggtgcttaaagtgacatgctcgcttgggggaaacgggagtagaagcacagctgcattccacactgccaccttaatctttaaagttgtcatgatttttataataaaggaattgtacccttgttaagttgcactagatgaatctgagagttcaaattagtttatttcatccctgaatgttcctttctccttttttttgtggatggctacttgcaatgctatacttatatttgacgcttccgcaatgcttatgttttagaggagttgctgtcaaaatttctccttcttcattaaatgtatttctatttagtagcatcccggtgtctttgtagtttctggggtgttacacatcacctcctacgtgttcctctgcggtcaagacaaagacaacccaaagaaaagaatcgacaaaagatcaaacaacggtagatagcaagcaagaatgaatgcgagattgatcacatcctgcaagtaaggcgaagtgcaacaatgcatcaaaaaacaagttgcatgtctgcacacttcaatcggagcccattctcggatgcgaagcgcatcctaaggcctggcggcgatgcacgcaatcactgtcttttggcgcaatttcattttcaaatcagacatagatttgctcttttttattctatgtgtgtggggtcaaattttcatttgattcttttttattttgtgtgaagtcctagacgacaacatcacctatgcacctgatttttcttttccagatttccaaattactttctagatgtgtattgtaacacttgagcggtgctctaggagggagcagtatccgtgatacattcttgtatgatggattgagtacgtgatacgtttgaggtttaggttgtgatggggaaatatgaagtgagaattctaacatagagtagatataagggtgcacacacggcagaacgaagaaacaccacggatgacagcgtaaaagaagaggtaccttcttcttgcacagagtagagtcgcccgagaacacatccatgcgggagtcggtgtcactgcagccttagcagctagcgggctcgtcaagtcaaagcagccactgctcaacgtcgagcttgcctttgcagccatcgccgccgcatccatgcagcccttggtagcttggtccacgtcgttgcggcaacaagcgcatgcgcttctgtccccctaaagcacatgtctaccgcaacaacaacatctttgtcaatgatgacacaaatgatgctcgcgttcagtggatcaagaacaccaattcgcagtgtgttccacagacctcctcatcccttcacctcgcagattcgaccaagcaccacctgatgctctagcgtccagctgctgccatcgtcgttaagggcaaatgagctgagcacgaaaggatccttctaaaacaactcgatgtagcgcaacctaccctcgctgaccaccaggcgccggtgcataccctgctcttgtattatatttgtgctgggctctaggcacacactgttcctcgggagctcaaaaaaaacgagctccagccggtcgttgaacgggtcggtggagacgatgtaccatgtcagatcgagccaccacagctatccaacgaactccaccgcctcgatgtacatgtttatctgccatgggagcgggagcggggatggtttgcaagaggaaccgccgcatgttgaaggctccactgttactgtcctcgcagagcacggtgacgacatagctgtcaggcggcccgtggccggcatcggagcaggtgaagaggctagtgttgcggcacccggggaacatggtgctccgcttggtgccttcgatgtccgggaggcggaacagctcgccggtgagcgggttgcagacggattgcatgtattctggttctgggtcaccgaggtggcttccgcgagtggcgccggtggcggcgacatgcttggagaggccgctttcccaagtagcacgggctatgaggtcggagacgacagaggccgggacgcgggcatccatgtagatgaggtggaggccattgccgcttgtgcgtagaccttgccgcttacgaaccccatggtgtcgcttgttggtggcctagctcacaagatcacgcactcacttattgtttacacactatagaaagagtctaacagatgaacataagaactctcacgcacaagcgctagatgtacgcacaagcaatattttgtggcgtgcgcaccagcgcgcagctaatgcactgtctattctccacaaacaatataactaaacggaatgcttacatgcttaattagccacacaataataaaacaataacttagccacgattggccgcacgacgcggccgagcattctcgtggctaagtacccactcactaacttatcgacatgcaagccacaattgcttgcatgcagatcaccactaacatatgcatgcatgctagctgatccacacttcacgccataactctcacttcacttgacttggccactcctccaaggcaacttgcactagctgcatgtaatcacttgcatgcagatcatagctatcactgatccaactaactcgcacatacacctatcaacttattctttctgacacacacatgattgagtacagctcgactacatgcactcacacgacaagaacacttaatcaacaagattaaacccaacaatcacctcctaatctagtttttattatcacctcctcgttcgtcatcacaccaatgttggctcatcatccgcgtcaactgtggcaagaaaagccatgtccttcttcggcttaggacactcatcagcgaaatgcccatactcttgacaattgtagcaatgaacttttgccttgtcgaatttgccgtggtacttcctcttgtcaccaccactgctgctgccggaaccacctccactcctcctctctttagcaaccttggcctcccactcagcacgcatcagtcgtggctcggcatatgcggcgaacagctgctgctccccctctttgtcacgacgcagcccctgtgaagagtcctcgaatgcccgcaggtgcccaattgtctttgtcaccatcatctctgacacatccccccattgctcaatggtgcttatgagggattaggacttctcgggaacagaatgtaggagcttctccacgacggtggtctcctccactttcacgccaagagagtgaatctcgttcatgatcgtggtaacctttaaagcaaaatcattaattttctcagaattacccattttcataccatcaagctcgctcttaagggtttgtactcaggccttcttgatactctcttcacccatgttcatcaacttgagggcgtctcacgctgccttcgccgtctccttctcaaatatggtcatcaccacggcctccggcatagcttgtacaatggcggtgagagccatttggtccatcttctcatcggccgtgttgccctccacagcagcccacacgccttgtgcgcgcatgaaaattttcattttcactgcccaaacgccgtagttgttctcctcgagcatggggtaacatagcgtcaacctgttgacgaccaaatttggtaagatatgaaccaggttcgacattggaatcgaagcggattcggtagaaagatagattcgaagaacaaagcatgcatcggctgcgaaggcatcggctggagtcttgtcacagcctgattttccgtttcaagatttataaattatttaataaattattaatagaatttatattagatgttgattaatttacaagtgaagttaaatgtaggaaataaaatttcctaaacataaagcatggctggatttaatttttattaaattctccatgattaactatactctctgaaattttctcggatttttcagagctcaattcctaattttaataatacaaagaacaattcagtaattagttaatcaataaattaatcattaaatggtctggttttaatattgttaaatactttgagtgtccaagtatgttgaagatttttcttggaattatttgagcattggaagtatttttaacaattcaaagatcatctcatgggttaatttatttggaaaagtaataataatcctcttcctagtcttgggcccttttcagcccattccctccttctctctcccttcctctcagcccgcagaaaagtctgtttttcttccctctcgctacagtgttgtcttcaacccctggacagagccgactgtctccagcccgtgcacagtttccgccgatctcctcccaccaaatccgacctccctgttgctcctttttccaaattagttgtgggaatggaatcctcacaatctcctcttcattttccccgagaaatccccaaaagtttctatggaaatcctttccaatttcgcggatcaatctttcctttttccggcgaagatcctaaactttcgcccgagtttttcccgtcgatgtgggcttgatcccgagctcccgtgcctatataaaggaccccctagtcgtcctctacctatccccttaagtcccgtccgccgccgtcgccggaaacgctctccccgcgctcgccttctctctccacctccggccgccgctccagccgccgtgcgccgtcgcctaggccgtcgccctcctgcgccaccacctccatcggctccgcaaggtcgatctctaccccgtccaccggttcccctccgccaagtctcgctggaagtcgctgtcaccgtgaaggccgagttcgccgcctcggtttgatctccggccgagcctcctcgctgttgcggtcgtcgccggttcacccagaggccgtcgtcggcatcgcagcgccaagccgaagcccgtacacccctctgttgccgccgctcgtcaccagaaagccgtcgctgttgttgacccgtacctcgccgtcgtcccgatctcgtcgccagccatcttcttcgccgttcatcgctgtgtaagtgttggtaagcatcg

SEQ ID NO: 42770 - DNA, 41998 bp, Oryza sativa
ccacggcccatttttcattcacgggcccgtactgacacggcgggccacacgcatgccgtgccggcacgggcacggcccggccatccacgggccgtgcttgggccggcggctcggcacgtgggtcgggacggcacggcccgtttcatgagccgtgcctaacgggccgtgccgaaacgggccgtgccggacccgtgcccgtgccgtgccgggccgggccgcccgtttggccacctctaccggttattgtgccgtggttcgcgggcaaccgccgctcctatgtcgttcaccggtatagtttatccctagggtcttaatcccatctaatcgaatcttgtttggccctagcgtcgtcatcgtcttcgtgtgttgtcgccggaccgtcatcgtcgaccctttctctccgatcgctttggttcagtgagacttctatccattctctcttttcagtggcatattatgtttttttatatatgttatctactaaatatgattcaatctatttccggaggttgttttaatattttatctcagttataaatcatttgtaaatggtttaattaatttagaatagtcttttctttaataggtttaattggaattaaatcttgtaaaattcgtaactaattcatatgaagtcggaatgaggccgttcaagtctcataattcatctaaaatcatgatctacatgtttgtttactttacatgtactgtttatttggtttttattagtctttttcctcattttacatgttagcttgtcgtttccgtcgtttcgaagattcgtgagtgcgtcagaagtattcaagaagattaattgaagaccctttattgcaaggcaagtcacacagatcccaaacacaattcctttgagcatgttaatcatatatttaaattctctatttattttaactgtgcatttattttcgaatgtcactgggtggtgtgaacctattcctttgttatggccaatttgcattgattaccctatttcttgattaccttgggttataatttgactaattggatttatatattggttcaactagatatattagatataattgcttagccatgcttagaaacattagcacactattgggataactaatgtttcactgttacttaatgatgtacatggtaaaggtagctcacgatggtcaatcgtgattggttaattaattaatttgacaactaaaacttgataatggtgggttgtgagcacatggttttgatggtcgtgctcattgcaattaaggaccggttcacgagattcagttgtgaaacattaaccgtgccaaccacaagccagagtgggcaacggctggacactttgtatagcaaggctcattgtggtgtgccagactgagaagtggcggagataagcccacgggggtcgctggggagtccatgccttgttttataagggggtaattatgatccaggaacggtgcactgctttgagttgagttatgcgaggggtcttgtcacaatcactcgccatggtgacgtgtccgcgcggcacggtgacatgacggtgggttgtgtcttgtgggtacagtggtacacctctggccagagtaaaactattcgaatagccgtgcccgtggttatgggcgggtctaacaatgtctttcgtgattagtctcacacttctcaccataataaatgatgctataactggtaataatttgattagctcttggtttagaatggtacattcctggtttggagatagatctgtacagccgggtatggttgttcaggatggttgggcctgtgtagcatgggtgtgctgttcagtgttgattaaaacttttaaatgtttgctaaatgctgcttttgcaaatgagtttatattatgccatcctttggtatccttgtgcacttgcatatttgttgtgtggcttgttgagtatgtcatatgctcaccttgcaataatcaatcaaacctcagttgaaaacaagttgcgaaggagaagacgtttggcttataccctagttgagctgcccgtgggagtggagctagagcttcgctagatcgttttttcgctgcagttttcttttcttttgtaagtatgtaacgttgtattattgatgattttgtatattaaattgttagtttgtgtacctcggctgattcttggacgaggattgaatgcacaaataagtttggatcggacagaggacagtcgatacagccgatagaggtgatgcagccgattccgatgatgacggtttcaaagatgtttctataatcgatcaaggtgcatcacaaggattgccatgatggagataaagctctcggataggcaattgtatctattaattaggatatttcatgtaatttctttagagatatgtttgggcaaaagtgtcggagcccaaaactaacaacttggatccgactagaattaatgtatcaatccctggatcagtaaatattgatacatacaatataactggttctttgttgcgaacgttaaagttttacaatactaagtgttttacaataataggtactcacctaactaattaatacacagcggaagtttctatacattatgactagggaggtataacctttagggattctctaagttatccgggtcatcgtagtaatagtcataagggtcctcctcttgacccaaatctgaaaaaggggttataagagcaaggatgagtatttacaatactcagcaagttatcatgggaatatgttatgcattgacatatagtagggttctttgcaaaaagtagtactagacaatctagaagagttatagcaagaatttataaaacatatagactttagatttctaaccagggtaccatatgagtcccggtactcaattccatgagtacggctattcggatagtttcaaagatattctactgcagcagatgtacgctttacccgcagtccacgacttgctgataatcatcagctttagtcatggcccagtattaagtcattaacaattgtggcacctgttccatgaacttatatcctcatatgctctgaacgtattgttaatagcagcaagaggagttctggcgttcccgagatatttaaggggaactgatcgtatgacaccatgtcatctcgatcagggtttagaaatataccatatagtttatactcgagtatcacaaaccatttacctgtacatggtaatggttaaagttgcccttcgcggctatagttgcctcctgcgcgaggacttaaaaataagaaccactatacagaggtgccatattgctaattaacataataacaaggtctgtccccattctagaaactgcggtcgtactcgttcgttcgacataagtacctggtaaaacttatatcgattgagacagtactagccacccggaaatcaaccaaatcttacgtactgtcccaatctaagtataaggtattttaaccagattgtaagcaaagtaagcaatactaaattatatgggtttctatgattgatttatgcatagaaaatagaatattgaatagaaggctataaataaataatttataaaatataggcttaaatgatcaacaggtatatggtaacttgccttgctcgatgtcttgagattgattgatattatctattgagtcaaaagaatcctcaagacctagggttagacatatataaaattcaaatttaaaaggaaatcaaataaaatccaaaaatatgaaaaatggagaaaataaaataaaatgcaaaaatagcaaaaaggggctcaaaagatagagaatgattttagtagaatattggtccaagtttcactggaattggatctatattttaaaagatatgggcttctaaagtttgaaaatcaaataaatgtgaaatggcactatgtgcgggtcccacctgtcagtctctctctctcctcttcttctacctccggccattccccaaatcggaccggcggtgctagggtttgggattacggcggcgatggagggggaaagtggttgtggccgaagaggggagggagctagggttctctggtgacggcgagtggcggcggaggggttaatttgatatgtggatgggttagcggctagggcggcggtggcacggttaggccgtaatggtgatcaaggtgatatgagttagacatggctaggggaggggttctagagcatctacgaggtgtctagagggattccggcagcttgccatcctttggcaagacgcggagaatagttgccgacgagcgcctccataggcggcggccgtgttcacgtcggcagcccagagggtggcaagatagtgcaaagggattgctaaaatggaatctaggtagtatgtagatggttgaaacggaagaactcaccgagatcggttgaaatggcggattacggccggaaaaacttctcggcggcgaagaacagagcagcacgggggcagcggtgctcggcttggcgcggcgaggtaaaactcgacgcagagcttcggttagggcttagtatactagaacatggtaggatataggtgttctaaggggtaattagggcggaggatggatggaggggtgtgaagtcgatcgcgcacaaggtgttcgaccgacgggcgatggtgattgatagaatggattggggaagcagagcttcggggttggggggttatggttgttgatgatcgatgatggacaaggaagggattggggtcctatttatagggctaggaggagcggatgagctcgggcaccgtcatcgccatggatgagctcgggatttggatatggctagggcggcagaggctgtgagagggcgggcaagatcaatttgagtggcgggaggccacgtttgaatacttaccggcgaaggattggcttgaccgcgtgcgaattcggctggcgacgtgttggcgccaatccgggcgcaacgcgcggcggcagcgaaggtgaaaacggccgactcgggggtgaatggtttgaattgtgagaggggataccaccgtctatcttcaatccaaccgtgcggcaagaattggtgcgattcaccccggatagaatcaaaatcggactcggcggcggctttggtcgggcgcgcacggcgtcgagctgcaatttcttgcggcggtcgtcgtcccggctttgtcgtcgtcaagattggtgcggcggtggtggtctgagggcatcgaacggctagcggtgcgccaaggcgattgggcacgcgcgatcgatcccgagaccgacgcgcggtggctcggcgcgcggcaaagtcagatgcccgggcggcgcgcgtgaaggggaggaagaagcaaagaaatccacggtttttgagtggggtatggtcccctaggatcaaatatagactttgcaaaggattgggtaggaattaggctgtgttagatgggctagacattttgccgaacaccttgagggcaatgaacagtaaaatccaggaattttgaatattttccctaaaaagatttgaatttaaactatgattttggaaggttttcactaaggtttgaagtgaagcatatccttactaatattagggtaagctaagaaaataatctctagtttgaaatttgagagaatttgctcaaatttactaaggtttggaataaagggaataattagagtaaattagtagggttctaaagaagtattacgtgaaccaatcaaatagatttttaaaacacactaatttaatcaaaagccagcatgatgcaatcaaattttagtttaaaatttgagattgttacaaaaaagtctgccgcaaagacttatggtatcttagagtttgttagagataagtatcgtgtctggcaaggacatatcttgtatctcaggtataaataggacccgaacccatgtaattaattaacaatcattcaatacaatctcgatgcatcgccaccctttttactttcgtttatttcgacgagttcttgctttcgggttgagctgcatcggtttcaatcttctactagaggtaaaacttgttatggcggcttgtgttctcgtggttaatgcttccatctttacggcactttaaccctgtttatgtaattcattgagttatcatatacacgacacaatctatattagttgcgctatataacttattatcggctggttcttatttttaggaagcaattggtagagttatgttttgttattaatctagattgtatcgtgtatctaccatctcttgtaggttttcatcatcctgcctagatctcatacttgtctttatgcttaatgctgcatcggttgagttcgatctattaagtagtatttataattataatatctggcttattttatgatcattgagagatatagtatcggggtttcagccgatcttacctgatttagctttatgtcccatatgcttaattgatatgctaaatctgccctttatattaatatcttgttgcaataaagtgtattagacttctatcatgatatgttctatctgttttaatatcttaatatagagtggtatcggagtactagccgatacatgctagatctatctgatcggctatgctataagcgcttataatctttatgttaatgtatacttcgatctaagtgatttatactgtctcggcatgacgaccgatctatcccaatcactttgtttaaatatacatcgacagaaggattatatagcgttaatatctacagtcgatcgagtagatttagtcttatcttgcttatttataactgccgatcgattcacatatgacatcggcttgaaaataaatgatacgtcatcggcgactggccgatcagctatcatttatggatttaaccgcgatttttcttgtctttgtttcttgttgattgcaggatcaaatcaactggcacgctcatgaacctaaaagcaagattttggacctgcactgaagttaagcagatcttctaggccagtgtgtgtttttcgcgtcaacacaacccaacctccttcacttgttgcacaacgagctcatggccacctagggcactaccgctgccgctaccgctgcagtgacagattggcggcggcgtgtacactccatcgctggacatgacagcaataacccacctccaatctgataccactgttggtggcccagctcacaagagcacgcactcacttagttgtttacacattgaagaaagaggctaacagatgaacataagaactctcacgcacaagctctagatgcacgcataagtaatattttgtggcgtaatgcattgtctattctccacacacaacacaatgcttacatgcttaattagccacacactaattaagcaatggctcagccacgattggccgcacgaccgaccgagcaatctcgtggctagctacccactcactaacttatctagtattgccattttccggctcaaattgcgtcgcctagctcgtgacctgagaagatggagccgcttccaggtcggggacatcaaactccagcttgcagtagcgttcgaagtaatcttccaactggaagtagctcaggaatcaaggctgctctctgccgaagaacaacatctgttgtcaggcctcaaaacaaaagtcttaggccttgcggtgctcaataaattgaggctaagacagtgcttgagattaacttggcttaaagaaggtgatgttaattccaaattcttccacattaaagcaaacacaagaagaaggaaaaactacattcattcgcttcaaaccccgtcaggagtggctgtttcggcacaaaataaggaagaagaactttttagatttttcaaggaaagattggggaccaatttccaaagaactttaagcctaaattggtctctattacaattaccttcgttggaccttaatgagctagacgaagatattacggaggaagaattaaaatccataattttcgatttgccccctgaaaaggcgcctggtcccgatggcttcattggggcatttttcaaaaccgcttggcccacggtgaaagatgatctcctcgcagcaattttatcctttatgcatctcaacacttctcaacttgcagaactgaactctgcctttatttgccttatccctaaaaaagatgatgctacaggcgctgatcacttccgtcccattagcctcatgcatagcttcgccaagattatcaccaaaattctggcaaatagacttgctcctcggctaaatgaaatgatctcacaaaatcaaagtgcttttgttcgtaaaagggcgattcatgacaattttctgtacgtccaaaacatggtgcagatgcttcatagatcaaaaaaacagagtctattcattaagatagacatagcaaaggcgttcgacactgtgaattggccatatctcctgaaggtccttcgtcatttcggctttgggcatcgttggttaagttggatttctaatctgatttccacctcctcgtcccaagtgctcctaaatggttccctagggatgagaattaatcatgctaggggactccgtcagggagatcccctgtccccgatgctgtttattttagctatggagccttttcaccggatcattaaagcagcggagagtgccaatgtgttagccccgattggcgtgagaagtggcagattcagatgttctctctacgcggatgatgtcgcggtttttgctctcccaaatcccgatgacctgaatgctctttctcgcatcgtttcgtgtgttgcacaaatttctggtttacattctaacatcaacaaaactgagattttccccatcagttgtaatggaatcgacatgcaacagcttcttgccggctggccagggcagatcaagaatttcccttgccgctacctaggtctccagctccacttcaggaaattaaggaaaattgatttccttcctcttatagacaagatcggggccagactaccagcttggaaaggtcgcttctttacctctgcaggtcatcaaaccctagttaactcggttttgagtgctatgccgatgcatcatcttacagtccttcatgcgccaaaatgggtcttcaaaagaatcgaccgtttcaaaagatcttttctatggaagggcgaagaccctgatcattcaaatccaagtgatagtctagtcaattggcaaactgtttgcaaaccgaaaagcttaggagggttaggcctaccggatctggacaggttctctagagcactctgactccgctggctctggttcaagtggaaagaatttgataaaccctgggtaggcatgaatgtgccttgcgatgagatggacacaatactctttcaagcggcaacgacaataatgattggtgacggagcaaaaactagcttctggcatgataattggatccaaaaccattgtttaaaagatattgtgcctagttgttttagcatggcaaagagaaagcaaagaacaattcagatggaaatgcgagataatagatggctcactttcttcagacaattcacttccgtgaaacaaattcatgatttggtacagcttggtggattactccaattggtttcactttcccaggatcctgacgacatcacctggaattggaccgagtctggcgtctacacaacaaagagtgcttaccttttccagttcgaaggctcatttgccaccaatgagtttgattctctatggaaatccccgactgaaccaaaaataaaattctttggttggctagttctccatcaaaaaactttgactgcccaaaatctgctccgtaggcattggccttgcaattggatatgttgcctttgtggttgtgtcttcgaagatacaaatcatttgttcagtgactgtgtgtttgtcagacaagtgtggaccctaatttgtcaattccaaaacttgtcttcggtcggaataaatcctgtcttggatgtgtcaacatggtagtctggaaccaaatttgcaggctctaagaaggatgtgcagctggtcaggggaactcttctaactatctggtggcatatttggttggaaagaaatagaagaattttccaaaagtcttcctgttcagagattgaagtagcttattttatcaagcaagctattgatatgcgctgcttggcctttaaacccccatgaattttttagcttttcctgcagttgtaattctctttccattccttggcttgtaacctctgaacctctgtgctactttgtatttttttctcttctaatgttaaattccggcagatctcctgccgtcgttctcctccaaaaaaaaaaaacaattgcttgcatgcagatcaccactaacacatgcatgcatgctagctgatccacacttcacgccatgactctcacttcacttgacttggccgctcctccaaggcaacgtgcactagctgcatgtaatcacttgcatgcaagtcatagctatcaccgatcgaactaattcacacatatatttatcaacttactctctctcacatacacatgactgagtacagctctactacatgcactcacacgacaagaacacataatcaacaagattaaacccaacaatcacctcctaatcttgttgtttttatttgagcccctcctcgttggtcatcacaacaaagttggctcatcatccatgtcaattgtagcaacaaccttttttccttgtaaaatttgccgtggtacttcttcttaccactgttgttgctgctggagccaaccccactcctcctctctcagcaaccttggcctcccactcagcacgcgttagccaaaaatcataaatggcccatcagccatgagctaccatccactaatggaaaagggataagtttactcttggtgtcttattttgtcgctgagtctggaattcgtctctaaaccacacaataccagatataatgcgtccctcaacttccaaaatcggtgcaaataaggtttcccaagtcggtttggacggcgggacgtggttcctgcatggcacttaaagtcaaaaaaaaactatatgatccacatgttaataggacccacgtcatcacccccatttctttcccctcttctctcccttcctcctctccgtcgtcgacgcaccccctctcttcgccctcttctatccctccctcggctgtgagcctaggatcgcggggaggagcagaggcggccgggcgaaggaggcgggagtggggaaggccacgcagagctaggcgcaatgggagctcgaccatggccgtgcaaagcgacacaggagcggaggaggttggacggcaatgaaacggtgagtaaagaggaaaccgagtggggcaaggcgaagaggaggaggcccacaacggcgaggtgatggtggtccagcccgggtagatccctccgcggacgtgagaagaagaagtggagttcactggtgaggtcgccgttgggctttgggctcggccttccccatgctcccctacatcacccatcccctccccgctcaccagcagcccagtcagagtcgtcgcgcttggcgacttcctcctatgtctatcttaggaagcagcccgcccacagcgggaggcctgctacgcccatgctatagtcgtccgctgcagcgtttgggccgggcatggagctcattggtgacttcctctgtgtgttgctctgccaccggccgacctcagctccatcattcctgtctctgccgcgacgtcgcctaccactacatgggagagagtgtaaagaaagatagggagggagagaaagagggtgccaggtgggacctgtatttttttttcacgcaatgacatgcaaagcaccatgtagacgccacatgcaacaaagaccaagttaaagcaccacataggataaagagaaaattccctatatacccctgaaaatttactcaatcccttcaatacccctgaatttgacattatcccttatatacccctgagttttcattttgatctcctctatacccatctccgttagttgaccattagttgaccgttaaatattttaaaatgactatattacccatattatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataaatctttttttattttaatgaaataatgttttattttcaaaaattcataacaaatatttagtaatttattccttattggttttcacaactcaaataatttacacataaaacatttctagcttttaacaatataacaaggacaataaaagtaatttctacaataactaacggtcaaactaatggtcaactaacggaatgggtatataagggatccaaataaaaactcaggggtatataagagatcaaacaaatttcaggggcgtagaagggattgggtgaaattacatgggcatatagggaattggccctaggataaaatcattgttccaaactgcccaggaacctgatttgttctggttttgatagttggcctatgttatgtcgcaagttttgttgctaagggatggtaataaaattcgacctatagttgagggacataaaatggaccttattgtcttacagatttcttgttacaatgggccttgaggtttaggggaaatagcccatcgacggtgggccacatagctagaattttggcgggaaaactagtgactgggtggcaactggtcgtccaaaaatatctcaatacggtctgacatgtggacccccaaaagaagaaaagctctgagcacagatgggtgcaccaagtccacgtacaccgagtgtcacgggttcacgacccccgctgcagaagaccgggcgctccgtggaacgagtccacgcccgcccagctccttccttctgcgctacggctgtcagagctctactacctccgtgaacctggctcaccgtgaaccagcaacccataccacctcctcggcttctcctctccggcttctcgcttccctttcccacagttcgcttcgccggcctcctccgccgcgcagaatgcgtctcccgctccgccgcgcgctctcccccgcggcagttcggcgcgccttctccacggccgccgcctcgcgccctcagtgggcgatgatccgccaggcgccgccggtcagatctccgtcgccgcacgcgtccctcctgctcgccgagcccccgcgcgactcctacctcctcgtgccggaccacctcatcgaccggcgtccgggccccgaccccagcagcgacatccgggggatcctaggcggcacggtccacgccacgagcggcgacggcggcctcctcctcgtcgtctacatggactcccacgccccggcccccatcatctccaagatcgtcaccggcgcctttcctgctcggcctcgggtcagcgatctcgccggcctcgacttgagcgacccagacttcatccgtttcgtctgcaaccccatcaccggcgagctgttccgcctcccggacatcgacggcaccaagaagaccatgttccgcggctgcgacaacgccggcctcctcacccgctccgcagccggagccgggcacggctcgcctgacagctacgccgtcgccgtgctcggcgaggaccgcaacggcgggaccttcaacatgcggcggttcctctcgcgaaccgggaagtgggagaagctagtgggcttaccatccccgctcccgctcacgcggcggatggacatgtacaccgaggcggtggcgttcgccggacggctatggtgggccgacctgacttggggcgtcgtctccgccgacccgttcagcgactggccggagctccacttcgtcgagctcccgaggaacagtgtgtggccagtgcccagcacagatcttgtacaagagcaggctatgcaccggcgtctgggaatcagcgaggggaggctgcgctacgtcgaggtgtcccaggaggatcctttcgtggtcagctcatttgcccttgacgacgacggcagcggctggacgctggagcacgaggtggcgcttggtcgaatctgccaggtgaagggaggaggcccgagggacaccgcgcggattgccgtcattgacccactgaacgcaagcgtcatgtatctgatcgttggcaaacatgttcttggtgttgatatggacatggggaaggtgatgggttgttcactggcagatgaaactgaaggccctccatatgctatcacctctgtccttaaaccatgtgtgctcccaccatggctttcatcaagcaaaatccctgctgcaggtaatcatgatcttccacatattcatgtcttgtttaagatgatatgtggttagggatagtagaattgttagatctgtagtacttattttccatgttctcttatattaaattatgtggttagttaggggcttgtgcttaggagtttgttttgttctatatatggctcatctcgtatgactgtttagaaacctcgaactcaaaaagggtggactaattgtagctgtctgtaatgtacatattataatatagcattttggtagtcttggcaaatgattgtgctaagccactaaccgatagcctatgaatattagcagtgtagtcatgaataacgtctttgaatatttcctcaaaaactaaaatttcagaatagaatattggtattagtaagcaaatccacatttctgttttaagtacatttgttataagaatgacatgctcttggtgtctaataaacctcaatagatgcaataatgtacaaaaatgtgagcttctacttttctttttctggcataatttttcatgtcctttcaattgaaggaactttttcacgcgacaatggtgacgccaaaagcaagactttatcagacatattggttcgtgcagacagcgacaagaggtgaagaaaattatttacttgtgtactctcctttggtacttatataattcaccatctatttccttatcaaacagttaagaaaccatgttagcaaatactagttaagaagtgctaattttctgttgaccatgataaccttgtttacagtgaaattggcacttctgttttaagcaaatgaacgatattatctgcgatcatgtaatataacgtcagaatttagatggggaagcacctttggtatggtggtggagttgtggattgcacccacccggttcaaattctggtgttgtacgtttgcatcctttgttgatgtagaggccagactttatttctattttctaaaaaataaaaactttagtgtcttgaccttgcttcagttgtacatatttgtagttgccagatggtagttcttactcaatacaaagtttgctttcgtccagtaaatcttattttgtagtaaaacctaaacaaatcttattcagatttctagttgtcttgttattgtctatattgcttagtatacccttcttgataagtgattatatcacaataaagaaactgtatatagaaaatcaacatttagtgtgttttaagaggaaaaaaaaaggaaacgggcatataatacaatgtcatcattcctgtttacttgctataattaatcaagaaaatttgcttcttcctccgctcatttttcttcatatgatcaattagatgtcatctatcatctctgaaatttaacagttgaaaatgtccttggtggactaggaagcgctatttcattttcagataggatatattaggatgtcaatgctgctgcaatcttgaactctcgttttgggggaaatgttggctgaagactgatgttatgatcttcacaatggtatcacacagaattgtgcttcacttaattgcttctgttacgctcattttttagtaggataacacagttctgttggcaagcgaccatagtcaggactcaagaacatagatgaagagcatcatcattttttgagtcatgacagaatagtttataagatggatttgtttagttgataatagttgagcaactgttgcctcttctgcagtcttaagggtagaggtagactacatcactacactaaaaattatcacaatcatgttctactcttgagtcttgaccttgcatcagtgtgcagattatagctttttttctgaacagcattgcatgacttacttgtatactccaaattaggctaatacaggtaccaaattaccaagtataaaagccttaaaagtgtttggtcttgtcatcattatgatttattttcatcaaatagatcattatgattattgtctcacataatattatggacaactaattaagagctttctatttgtgacacatgatcttgttctgatatttttcctgggatcaataaatttatagaaagtaataagcatatcatattcattgctttaaataaaatacaaagaggttataggggactatggaggtatttctgctggcttgtgtgtatacagtatactgaacaagcagacattattaagtgcacactagcactgtataagagctttcccagcattgttgtcatcatgctgagcaattgtcattctttagtcctaaaatatcatgaactatcagactaaaatgaagcttgctatttcataacaaggatcatggtgtaaccttctgccgaatcaagggatgaatatcaaacaatagatatgtactgtaatactctgctgaatcaggacaccaataaaacataaaacactactccctccgtactcataaaggaagtcatttaggacaatgtttaagtcaaaccttgggaatataaatcgtaaataactctcaagttgttgagtttgaaaatgtaaaaattatatgaatagatttgtcttgaaaaatactttcataaaagtatacatatatcacttttttcaataaatatttttatagaaacaaaagtcaaagttgtgttttggagaccgtgtcactgtcctaaacgacttcctttatgagtatggagggagtatctttcaatttttgtgagtaaaacggactacatggattgtcgtagtttcctgttttcttgcgtttatattgaacactgtaaattgtatttttgtataccagtagttctcttcatataattattgacatgcatcctaatgttttctatttgatccaggttatgtaaagacgaactgacaggtgttttaatagaaagctaatgaatggtagcttggagaagtctcgttttgggtaacttggagaattatttgagtgtgttggccctctcagtttacctgctgtcttattttgtgagaaaccgttactgtttcatgttttctttttttggtggacggtttgtgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcctatatataaggggggtccggtgcctctaggggcatgtgttgattctctccaaatcatacaatcaataagatactcggcggattcatccccggacaggagtaggttattacttcttgaataagaaggcctgaacctgtataaatcttttgtctccaaacccattcacttctccagcttgatagccacccccttttattattgccgaaatctagtttcgacagttggcgcgccaggtaggggtccgtcaagcttttcgccgatcagtgcaatgggttccgtctccggcatcgacgacctcgtcttcccacccgggcagacgtttcggttcggcagcctcgacttcgtcaccaacaacttcggcaagatctctctccttgactcggagtcagaccagtcgggagagaaccggatttcagtcccgtttggactcccaaacgcggctgaaagttacttcaagaccatctcaatcgagttggcttcaaaccactcgggcgagatcgcatcttctccaatgtcaccagatcaagatgatgaggcttacccaccgatcctgatgaagctccccaacgatttggcggccgtctccatcacgacagcgtctccatcccgtaggcctaggcggaagtcggcttcaacaccgatttcgcctagcttcagggaagtcggcgtcatcctccaaccactcggcacggtttcgacggatcagctggatggctactacagctctcccaccgtcgactcgcgtcccaccgacatcgtagagtacgacgagtttagctctcgctacaacgacgcggatctcgacgacttcgacggaagcctagatgacaactacacccctctctacttcggcgtcttcatggccgataacgagacggaggagcaacgccaagcccgggaaaccgaagcacgtcgcgagactgagcgtcgccgactggaggaggagcgtcaagcacaagaacaagaacggctacggcgtgagcagcaggagcgtgagcgaaccgcgaaggaggctgagggccgacggcagcgagccttggaagcaggccgccgagcgcgtgatttcatcggccaacaagatgttgaagggacaccggttttccgcacccctcaacagaacgcggttgccgcgatcaccctcctcaacaccctcctcaaggaaaacgagctcaatcaatctgatcacgtcgtcaacatcttgaaccagacaaagaccatgattgcggcttcggtcccagttaactccgaaagcgtccgcacgccgactggcagccgactcccccacttccgatctcatgactaccgtcgtccaagtctcagcatcactggcgcaggatccaatcgcaggagcaggggtcacgacgagcggtccgttcactcgcctcccgaccatcatagggagcgccgagtggaacggcctcgctcaccacctcgtcgccgccccgtcgatcttcgcgacacaatcatacagcgccaagcagctcgaggccatcatcattcgccggaccgccacgacgacgaccttgatggagtagcagccttcaccgacgacctgcgtcgagtggattggccagccggcttcaagccgactggaatagagaagtacgacggcaccaccaacccagaatcatggcttaccgtctacggtctcgcgatccgcgcagcaggaggagatagcaaggccatggcgaactatttaccagtagctttagcggattccacccgatcttggctccatggattgccccgtggtacgattggatcttgggccgaattacgcgaccacttcatcgccaacttccaaggcaccttcgagcgtcccggcacacaattcgacctctacaacgttgttcagaagtccggagaatcccttcgagattacatccggcgattttctgaacaacgtaacaagatctccgacatcaccgacgacgttatcatcgccgcattcaccaaagggattcgccacgaagaattggtcggcaagttcgggcgtaaacctcccaggacagtcaaacttatgtttgaaaaagccaacgagtacgccaaagccgaagacgccgtcaccgcatcaaagcagtcgggtcccagttggaagccaaaaaaggatacgccggctacgggaggaggtggaagtaacaatcataaggaccgcaagcgtaagcctgaggaacttgttgcaaccgccattcactcttctcgacagcgttcgcgcgtcaacacgttcgacaagatcatgaactcccaatgcccgcaccatcctaactccaaccacgtggccaaagactgtttcgtctacaagcaattcgcggagcaatacaccaagactacacggaagaactccgacgaagaacaaagcacgtcgaggaagaaggacgacggcgacaccccggtaggatttcaagaccaccgcaaggagctcaaccatatcttcggcggccccctggcttatgagtctaaaaggaagcaaaagttgaccgaacgggagatcaatgctgttcagcctgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggatgatatgcagattcctcgctccgagctaaaaccaagcaatgcgccttttcacggagtaattccaggattatccgcaactccactcggccagatcaccctcccggtcacttttggcactcgggaaaacttccgcacagagaatatcagctttgaagtcgccgatttcgagacagcataccatgccatactcggacgcccggcgttagccaagttcatggccgtcccgcactacacttacatgatgatgaagatgcctggtccccgaggagtcctatccctacggagcaacatcaagcaagccgtcacatgcgacaaggagagttgcgacatggcccaaacccgcgagatagcgtctgcccgggaggatatccgactggctgcagccacggcgagcgaaggagaagtgcccgctaccaagacttcaaaaagtggagaaagcgaagccaagactaagaagattcccctagatccttctaatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttgcatgtcaaagaagatgccaagcctatcaaacaacgactccgccgattcgcacaagacaggaaggacgcgatcaaggaggaattaaccaagctgttagcggcaggcttcatcaaagaagtccatcatcccgactggctggcaaacccggttctagttcggaagaaaacggggcaatggcgcatgtgtgttgattatactgacctcaacaagtcttgccctaaagatccttttgggttgcctcgcattgaccaggtaatcgactcgaccgccggctgtgagcttctcagttttttggattgctactcggggtatcatcagatccgactgaaggaatccgactgcttgaagacctcattcatcacgccctttggagcatactgctatgtcaccatgccgttcggactaaaaaacgcaggagcaacttatcaacgtatgatccagagatgcttctcaacgcagatcggccgcaacgttgaagcctatgtggatgatgtagtcgtcaagaccaaacaaaaggatgatttaatctcggatctagaagaaaccttcgcgagcatccgcgctttcaggatgaaattaaaccctgaaaagtgcaccttcggagtaccgtcagggaagctgcttggttttatggtgtcttataggggtatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactgaagaaaacagatgatttccaatggggacccgaagcacagaaggccttcgaagattttaagaaactcctcaccgagccaccggtcttagcctcaccacacccgcaggagccgttgttgctgtatgtatcagccacctcccaggttgtgagcacagtcttggtcgttgagcgtgaggaagaaggccatgtccagaaagtccagcgaccgatttactttgtcagcgaggtcctagccgactccaaaacgaggtacccttaggttcagaagctattatatggtgttctaattactaccaggaagctatctcactactttcaaggtcactcggtaacggtggtcacatcatttccactcggtaatatactgcacaaccgcgaagcaaacggacggattgctaagtgggctttggagttgatgtctttggacatatcattcaagccccgaatttcaatcaagtcccaagcgttagctgattttgtcgccgaatggaccgagtgccaggaggatacccctgcggagaagatggagcactggaccatgcatttcgacggatcaaaaagactttcgggcactggagcaggagtggttctaatttccccaactggagaaagattaagctatgtgctttggatacatttttcggcgtctcacaacgttgctgagtatgaggcgctccttcatggactgcgaattgcgatctccctagggataaagcgtctaatagttcgaggcgattcacagctggtcgtcaaccaagttatgaaagagtggtcctgccttgacgacaacatgatggcatatcgacaagaggtacgcagattggaagacaagttcgatggactcgagctcagtcacgttcttcgacacaataatgaagccgccgacagacttaccaactttggatccaagcgcgaggtggcgccctccgatgttttcgtcgaacacctttatacgccgacagtacctcacaaagatactactcaagttgcgggcactcatgacgtagctatggttgaagtcgactggcgagagcccctcatacgattcttgacttctcaagaactcccccaagacaaagatgaagccgagcggatttcaagacgaagcaaactttatgttatgcatgaagctgagctgtacaagaaaagcccttcagggattctgcaacgctgcgtatctttagaggaagggagacaattgctgaaagacatacattctgggatatgcggaaaccatgctgccgcacgcaccattgtcggcaaagcttaccggcagggttttttttggcctacagcagtgtccgacgccgacaaaattgtgcgcacgtgcgaaggttgccagttttttgccagacaaattcatctaccagctcaagagttgcagaccatcccactgtcttggccgtttgcggtttgggggctcgacatggttggcccgtttaaaaaggcagtcggcggttacacgcacctctttgtggccattgacaaattctccaagtggattgaagctaaaccggttgtcacaatcacagcagataacgctcgagacttcctaatcaacattgtgcatagatttggagtgcccaatcggatcatcactgataatggcagacaattcactggcggagtttttaaagacttttgtgaagactttggaattaagatttgctatgcctcagtggcacatcccatgagcaatggacaggtggagcgagccaatggcatgatacttcaagggattaaagcgcgagtttttgaccggctaaaaccctatgccggcaaatgggtggaacagctaccatcagtactttggtctttgcgtactacacccagtcgggccacaggccagtcaccttttttccttgtctatggggcagaagcaatgttgccgagtgaagtcgaattcgagtctttgcgctttcgtaatttccgcgaagaacgctacgaggaggaccgagtggatgacttgcaccgactggaagaagtccgcgaagcagctttgattcagtcggctcgatacttacaagggttgcgacgttatcataatcgcaatgttcgatcccgtgcctttctagtcggcgacctcgttttgaggaaaattcaaactacacgagatcggcacaagttatctcctctatgggaagggccatttatcatctctgcagtcacccggccaggttcctatcgactcaagcgcgaagacggtacactcgtcgacaactcttggaacatcgaacatcttcgtcgtttctacgcttaagcttatcactgtacttccctatcttgactgtcaacatcaagttttcttcttgaagttgtcagtcgggggctatcatcataataacggagtgtgattttttatcaattcaatttgcttccttggtctatcattgccttgtttgatttttttctacttagtttgcgaggactgaaagtttttaatagcttctttgggttttaggctcaacaaagcttgataaaagcttttaagaaatcaaagacttggctagaattatcaagcacagcataaatacaccagtattgtacaagttatgcctccatttgctacatttatgctcagtcagaatcagtcctttcatcatcagagttattactactcggctgaaggtcggtgttgcggaattgatctacgacgtcacttgcaatcttgtcagccgcattttgagcattgctgataagatcaagagcagcctctacgcttgtcccgtctgcaaagccatcaatggcgtcaatttcaatcctcgggtacaaggatttggtcatcaccaatgccgtgctagctcccatacttccagctttcttgatattcttgaaatatacatcggagcaactctcagcttgtcgaagatttcggttgcgtcgagtacactcggaccactgttattgaggaacatagcttggacgagtggtatagcgacattagcgacttcatctcttgctccttcaagcctcttgatcttaccaaccaggacgtcaaattgagcttgagatttgattttgcggtctacaaaacacatttatgataaaaatctactgcattaaaaagagagaagttcagattgtcagctggcagtaccttcaacctccttcaaggccgagtccctttgcgcagccagttctaccttgtctctttccagggcttcaatttgtttctccatttgagccatcctggcggcttgcgctgtttgaaatccaaatggttgaggatacagttacgacagcgtaaattaatgggacagatctagagattaccttttgatgaaccactcagctcgaagtttgaatcctggagctgagcaattcggtcccttaattccttctctgtctttttggcaagctccttggcctcatgtagctggtccctaactgcttcaagagttcccaaatgaggaaccagcttttctaaagttgcggtcttggcctcattgcgaagatggattctctgcatgatggttcatggtttagttttgctgaagagaaaacaaagtcatcaaaggcagtcacccggaagatttacattcacaatgcgagtggcttctccaagtgccttcttcagctggcacacttcctcatcttctttttgacgatttatgacgatgccggcagcttgtgagttctcgtcccaccatttgagcaagataggaggacgagagtcatcagccgcctttatgcgaggaatttcttcttcgtcatcgcctggtggtcctgatgtatttccaagatattagacgaataagctgaagttatttaaatcggcatcacttgagaagatgagttacttgaggatgttcctagctgagcgtggggtgatccttgttctttatctggagacccaatcatcgagtcgttaccagcctctggtccttgagaagttgtcgtctgcgcttcaacttcgggagtttcttgatctggacctacatccgactggtttccagtcgggggctcttgggttgttgtagtttcagttgccgccgactggttttcagtcggaggatggtcactcggattggccttatcacctgaagtatgggcgccagtcggctggctttcggcagtcggctcagaatccttggatgaacttggttctgtcacagtcggatcaggatcttttccagttggatctatgtcggatggtttcctgcaaagtgttctttcaatattcagtattatttccatgagagaagcatgtcgaagtgaaatggtaccaagaggtttatacctagaagttgttctgatctttggccttggacgactagccagttttttcctgggagtggtatgctttgggagtttattgggcgagcctttgtccccagatttgttgccgtcgtcgccttcgtcgtcattaagcaccagctttctcttgcgagaacctgtctgcccagtcggattggaggtttgaggttgcggatctgatctgattgtcggccctctacctccctgaacggtgtgctggcgaggagaccggcgctgagtgattggggggttagacttcatcaatacatattcctgagtgagatgcctccacggttagttaactcaacatgaagacaagattatgttttggtcatgggttgaagatttcagatacgtacctgcggaggcggattgaatgcgttatatggcacaactggcagctgatgtgagtagctgacgacaatggcatttgagaagtttttatacattctctccttcatgattttaaaatccagagaatctgattcttcatgattaggatcatgcttaccgtcaaactcgaatgccgtacgggatctttctttaattggtgccaatcggcatttgatgaagtgccgagtaatctgctctccttgtaagccttgttctttgagttttagcatgcgatccatcagctccaaggcttgggctgcttcatccccaatcggaagagagttccaggtatcttggtacaccggaggaagacaagagtactcgggaagagcaggctcaggattctgaatataaaaccagtttgcgtgccaccctttgtttgaggtcttgaagggcatagagaagtacttctggctcagagtccccctcagctgaaatccggcccctccgactacacatggcttactcttgtttggttggggcttgagaaagaagattcggcgaaacagagcgaagtggggcttaattcccaagaaggcttcacaaacatggatgaaattggcgatgtgaactatggaatttgggtttaggtgatgcaagctgattccatagaagcttaatatcccgcggaaaaattttgaggtcggaagagcgaagccgccatagaagaaatgggagaagaccacagtctcgtgtgtatcgggggtcggaaaagcctcaccgcacgctggccgccacccgatgatttccttggcagggagaacgccgtgcgccaccatctccttcaggttctcctccgtcacgtcggatggcgcccattggccttcaaagctttccttctcttccgccattgattttttttcgaatgcgctgatttgattcgagggatggctagggagaggtgaaggattgaggcggtggatcacgggaaggattttgatgaacttttcgaaggtggattcgagtggaatggtgaaccctagtttgccggcgtagctctgtactgtagcagggagtggggaaaatggcgagagttccggcgggggagatgaagtgtcgcttggatctcgggatttcttgttaagggtatcggaggtacgaatgggtttaggcctgaacagtacctcagcccagtacttttaacagcgtggcccattgtgctccttagggacttaggcattttttgctttggcaatttatgcgcacaatagtgttgcccaatgctgataaaatcctttttacgcggtcatataattctttggaattattacaatgcaaattaaaaggtgcccgacagaaaggtgttatgctgtttttgtaagcttttttaggctacaaaagctgtctgggttaacttggaatgacttgtttttaccatagtcatttcctcggtatgttatatgcctgttttcattatggtaaatagtcatagcctaggctattagacttattcattaccataatttttataatatttggtgggtaatctttagagttttctattcggatgcctgtcaagtgtgttcattcgtgaaccttttagagtgttaaccactcggattccttttaattatggctaaaaagcagtcggctaagaatgcctctttaggcgccgtgtatgcttttgtcatatgatgcacgattgtgctattattttgttctcaactatatgtttagtttgttaactaatcacatagttgggaggtacacctaattaggtgcatctattcgatgcaccatattctttatcttttcgccctttacagtcttcgtcttcgctactcggcaggccttggcatgaaaagtttgaagcattcggattattatctttgagaaggctatgatggttgactgcaaaggtctcgggggctactgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttctgtaacacggactccttcctatatataaggggggtccgggtgcctctaggggcatgtgttgattctctccaaatcatacaatcaataagatactcggcggattcatccccggacaggagtagggtattacttcttgaataagaaggcctgaacctgtataaatcttttgtctccaaacccattcacttctccagcttgatagccacccccttttattattgccgaaatctagtttcgacagtttgctttcaagcaaattgagaacattgctttaaactgtgaaagtgatccagttcagtcagcattaaactgccatcacttaagattatatatgttgtgttagttgtataccattaccatgcatcttatttaggcatcttctctgcatactcattctcttaagatacctgcgatcacattgtctcaggtagcaaacaattcagtatcagcttcctttttatcttggcactaaggtgacgatctattgttactggcaagatatgaaaagtcccttttatttggagcagatggctagaaattccttcgaatgcgcaagtgtgcaaacaccagtgctttgcttgttggtggtgtttatcttgtctggtttggaaaggaaaatttgaggcaacatatctatctatcaatctacagagggaagggggacaggaaggggaaggggaagatggaaggggagggatgctagctgaattgttcggtccttcaatgtgatatttgaactccatatgtaatagctttctacttactactctactttacttactaatttagtcggatatacggtaccaaatatagatagaatatcttcatgaggactcgggttagattctaaacttgtatgtcaaggaaatacccgggatcctagtcggttacgattgtattttatctataatcccatattctgttaggatatggactgtattttgtaaagcggacttcttcccctatataaggaggggtccgtgtgcctctcggggcgtgatcttttttccggtttatacaatcaataatacactcggcggaatcatccccggacaggagtagggtattacttcttgaataagaaggcctgaacctgtataaaattccttgtctccaaacctatccgctttcctagctagatagccaccccctttcattattgccgaaatcttgtttcgacagttggcgcgccaggtaggggtagcgtcaagtttttgccgactaagtgcgatgggttccgtctccggcatggacgacttcgccttccctcccgggcaggcgttccggttcggtagcctcaacttcatcaccaacgacttcggcaagatctctctccttgactcggatttgaaccagtcagggagagaccaggtccccgcgccgtttggtattccgaactcagccgaggcctactccaatatcatctctcccgagtcggcttcaaaccacccggacgagatccaatctactcctctgcgaccagatcaagacgacgggtcctatccctcaatcctgatgagactacccgatgatttggccgctgtcttcacagccaagacatcttcggccccgatccaatctagatccagagaggttggcgttatactccaacctcttgggacagtctcgacggaagagttggacggctaccttagctcccctggcgtcagttcccgaccaaccgagatcctcgactgcgacgacttcggctaccactacgactacggcgacttcgacgacagctatgaggataacaacacgcctctctttttcggcgtattcatggctgacaacgaaacggaggaacagtgccgagcccgagaagcggaggaagagcgcacgcgacaagacaccgaacgtcgccgactggaggaagaacgacaacgacaagagcgagaacgactacagcgtgagcaacaagatcgcgagcgagttgcaaaggaggctgaagatcgacggcagcgcgccttggaatccgggcgacgagcgagggatctcatcgggcaacaagacatcgatggaacagcggtttttcgcaccccccagcagaacgcggttgcagcaatcactctcctcgacaccctcctcaaagaagacgcactcaatcaagctgatcatgttgtcaacatcttgaaccagacgaagaccatgatcgctgcctcggttccagccaactccgcaagtgcccgcaccccgactggtagccgagtccctcatcttcgatctcaagactatcaccagccaagcctcagcattgccggcgccggatctagtcgcaggagcaggggacatgatgaacgatctgttcgttcgcctcctgaacgacatagggagcgccgagttgaacgaccacactccccacatcgaaggcgccccatcgatcttcgcgacaccatcaaccagcgccgcgcggcaagaggctatcattcaccagatcgctacgacgacgatatggacggagttgctgccttcacaaatgatctgcgttgagtgaattggccagccggctttaagccgactggaatcgagaagtatgacggcaccaccaacccggaatcctgtctcaccgtctacggtcttgcaatccacgcagcaggaggagacagcaaagccatggcgaactatctgcccgtggccttggcggattctgcccggtcctggcttcacgggttaccccgcggcacaatcggatgatgggcagaactacgcgaccacttcatcgccaacttccaagcacttttgaacgccctagcacacactttgatctctataacatcgttcagaagtctggagaatcccttcaagattacatccgacacttctccaagcaacgcaacaagatctccgacatcaccgacgacgtcatcatcgccacctttactaaaggcattcgccacgaggacctagtcggcaagttcggacgcaaacctcccaagacggttaagcagatgtttgaaaaagccaatgagtacgccaaagccgaagatgctattactgcgtccaaacagtcgggcaccacttggaagctaaggaaagacacgccgaccgcaggagggagtggaagtaacaaccacaaggatcgcaagcgtaagcccgaagaacttgtggcaacaacctctccatcttcccgacaacgttctcgcgtcaacaccttcgacaagataatgaactctcaatgtccgcatcatcccaactctaaccacacggccaaagattgcttcgtctacaaacagtttgcggagcaatacgtcaagaacgcacgtaagccctcagacgaagatcaaggcacatcaaagaagaaagatgatgaagacgatgccccgactggttttcaagatcatcgcaaagaactcaatcacatcttcggcggacccctggcttatgaatctaagagaaagcagaagttaacagaacgggagatcaatgtggttcaacctaacacgccccaataccttcagtggtcagagatagcaatcaagttcgaccgctcggatcatcccgaccgagtggtccacccggggcagtaccccctggtactagacccagtggttcgcaatgttaagctccgaagaactctcatcgatggtggcagtgcactcgacatccttttctctaagaccctggacgatatgcagattcctcgaacggaattaaagccgagtaatgcacccttccacggtgtcatcccaggattatccgctacaccactcggccagatcactcttccggttacttttggcactcgggagaattttcgcacagaaaacgtttgtttcgaagttgctgatttagagacagcataccatgctatactcggacgaccggctctagccaaattcatggccgttccatactacacttacatgatgatgaagatgcctggtcctcgaggagtcatatcattacagagcgacatcaagcaagccgtcacatgtgataaagaaagttgcgagatggcccaaacccgcgagattacactcgcccgagaagagatccgactggctgcgaccatggcaagcgaaggagaagtgcctgcaaccaagatgcccaaaagcggagaaagcgatgccaagaccaaaaagattcctttagatccctctgatcctaataagacttctgtaataggcgctgagttagattgtaaataggaaagcgcgctcatcacctttcttcaaaataataaagatatctttgcatggaaaccatccgatatgcctggtattcctagagaggtgattgagcactctttacatgttaaggaagacgccaaacccatcaagcaatgactccgccgttttgcacaggacaggaaggatgcgatcaaggaggaattaaccaagctgttagcagagggcttcattaaagaagtccttcatcccgactggctggctaacccagtcctggttcggaaaaagacggggcaatggcgcatgtgtgtcgattataccgacctcaacaagtcttgtcccaaagatccttttgggttacctcgcattgaccaggtagttgactcaacggccggctgcgagctactcagttttttggattgctacttaggatattatcagatccgactaaaagaatccgactgcttgaagacctcgtttatcacgccctttggggcctactgctacataaccatgccctttggattgaagaacgcaggagcaacctatcaacgcatgattcaaagatgtttctcagctcagatcggccgcaatgttgaagcttatgttgatgatgtagtcgtcaagatcaagcagaaggatgacctgatcacggacttagaagaagcttttgcaagcattcgtgctttcaggatgaaactaaaccctgaaaagtgcatcttcggagtaccgtcagggaagttgctcggatttatggtatctcaaagaggcatacaggccaacccggagaaaatcaacgccatcctcaacatgaaaccgccaagctcccaaaaagacgtccagaagctgactggttgcatggcggcgctcagccggttcgtctcacgactcggcgagcgggggatgccctttttcaagctgctgaagaagactgacaatttccagtggggactcgaagcacaaaaagcctttgaagacttcaagaaacttctcactactccaccagttttggcctcgccacatccacaagagccgctactgttatatgtgtcggcgacctcccaggttgtgagcacggtcctggttgtcgagcgtgaagaggaaggccatattcaaaaagtccaacgaccagtttatttcgttagcgaggttttggccgactctaagacaagatatccttaggttcaaaagttattatatggtgtcttaattaccgtcaggaaattatctcactactttcaaagtcactcggtcacggtggtcacatcgtttccacttggggatatacttcataaccatgaagcaaacggatggattgcgaagtgggccttagaattgatgtctttggacaatatctttcaagccacgaacttcgatcaagtcacaagctttagctaatttcctcgccgagtggactgagtgccaagaagacatgccagaggaaaagatggaatattggactatgcattttgatgggtcgaagaggcttacaggcactggagctagggttgttttaatttccccgaccggagaaagattgagctacgtattgtggatacatttttctgcgtcccataacgtggcggaatacgaggcgctgctccatggattaaggattgcaatctctctaggcattcgccgactaatcgtccgtggagactctcagttggttgttaatcaagtcatgaaagagtggtcttgtctagatgataatatgactgcttatcgacaagaggtacgcaagttggaagataaattcgatggactcgagcttacccatgtccttcgacacaataatgaggcagcagacagattggctaattttggttcaaaacgggaagcagccccttctgatgtgttcgttgagcatctttatgaaccaaccgtgcctagaaaagaaacaattgaagccatggatactcaaggtgtaaacatgattgaagccgactggagagaacctctcataagatttttgaccaaacaagaactccctcaagacaaaaatgaagccgagcagatttccaggcgcagcagactctatgtcattcacgagaccgagttgtacaagaaaagtccatcaagaatcctacaacgctgcgtatctttggaagagggaagacagttgctaaaagatattcattcaggcatctgtggtaatcacgcggctgcacgaactattgttggcaagacttatcggcaaggtttcttctggcccacagctgtttccgacgccgacaaaattgtgcgaacatgcgagggttgtcaactctttgcccgacaaactcacctactagctcaggagttgcaaaccatcccgttgtcgtggccgttcgcggtttgggggcttgatatggtcggtccattcaaaaaggcactcggcggttatactcatctctttgtagctgtggataagttttccaattggattgaagccaaaccggtcgttacaatcactgcagacaaagctagagatttcttcatcaacattgtacatcggtttggggtaccgaatcgtatcattactgataacggcactcaatttaccggcggagtatttaaagacttttgtgaagactttggcattaaaatctgttacgcctccgtggcacaccccatgagtaacggacaagtcgagcgtgccaatggcatggtacttcaagggatcaaagcacgagttttcgaccgactgcgtccctatgctagcaagtgggtagatcagctgccgtccatactttggtctttacgcactactcccagtcgggctaccggccagtcgccgttcttcttggtctatggcgcagaagcaatgttgccaagtgaggtagaatttgaatcccttcgatttcgcaacttccgggaggagcgctatgaggaagatcgagtggatgatatcaaccgactggaagaagcccgtgaagtagccctaatccagttagctcgatacttacaagggttgcgccgttatcataatcggaatgttcgatcgcgagcctttttagtcggcgacctggttctgaggagaattcaaactacacaggatcggcataagttatcgcccttgtgggaaggaccgttcataatcgctgaagtcactcggccaggttcttatcgactcaaacgcgaagatggtactcttgtcagcaattcttggaatattgaacaccttcgtcgattttatgcttaggcatttcgtttgtatctttcctctttgactgctaacttcaagcttttccttgaagtttccagtcggggggctattatgataataatggagtgtgatttttatcaattcaatttgcttacttgatttatcattgccctgcttggtctttcgacttagtcaatgaggactgaaggtttttaacagcttttgcgggttttaggctcaatatggcttgacaaaggcttttaagaaatcagaagctaagtatggaacaccaagcatagcataaattcatcagtattgtacaaattatggctccatcttcattaatcatcaaaatcattgttatatcaatcagtatcagttttttcatcatcggaattatcagacccagtcggccgaaggtcgacatcttggaatctctcaaccacgtcagcagcaatcttgtcagcggctttttgcgcatcattgatgaggtcgagggctgcttcttcactcgtcccgtctgcaaacccatcaatggcatcgacatcgattttggagtataaagatttggtcatagctaatgccatgcttgctcccatactcccagcttccctgatattcttgaagtaagtatccggagcgactcttagcttgtcgaagatctcggaagcgtcaagtgtactcggaccggtgttattgaagaacatggcttggatgagtggggtagcggcattagcgactttatccctggccccttcaagcctgttgaccttttcaactaagacatcaaactgtgcctgggacttgatcttgcggtctgcatcaacagattcacattaatgaatcagcatatagaagataatggcttttgaggtattgattattggtaccttcaacctcctttaaagccgagtccctctgtcttgccagttctgccttgtcattttccagagcttgaatctgcttctccagttgagatatcttggcagcttgcactacattgactctggttaatcaagattacaaacataatagcatgagttagttgggcagagtttgtgcgtaccttttgatgagccactcagttcaaaattggattcctggagctcagcaatccgatccctcagatcatgtttattcttcctagcaagttcttttgtctcatgcagttgattcctggtggcttcgagggttccgagatgagggactaacctttctaaggtcactatttagcttcgttcctaagatgaatcctctgcaagacagtttaatcagcgcttgaactaaatggcaaacgagatggttgagatcaggcgccaaaaagcttacatttacaatgcgggttgcctgaccaagcgcctttttcagtagacataactcttcgtcttctttttgcttatttattacgattccttgaggctgcatgttgtcatcccaccacttgaccagaatgggagggcgtgaatccttagctgctcgtatctggaggatctcttcttcatcaccaatcattggccctagtgtatccatgaataaagatgaagcaatcaaataaagtctgttggatcgaaatgatttcagatagcgtgtttacctgtgatgattcccggtcggggacgagtggactcttgtgtcttcacaggagatctggtttctgagtcattgccagcatcctttccgggaggactgtttgtttgagcttcaacctcgggaatcttttggcttggccctgtatccgactggtttccagtcgggggctcctggttaactccgactccagcttcggccgactggcttgcggtcgtgggttcgtcgctgggttctacattgtcgctggcctgcggattatcactcgggtgatcttttgcagtcggcccggtttcttttgaggaatccgcttccatgttagtcgggtcagagtctttctcagaaggatctatgtcagatggtttcctacaagttttaccatcagtgttattttcatgatgggagaataataatacaaggaaggttgctatatgatttgtacgtggaagaccttctgatttttggtacaggacgactggaggttttcttcttcggattagttggcttcggaggtcttccggtcgctcctttatctctgagctttccggtaacatcgccttcgtcgtcacttagaaccagcttcctcttgcgagaatctgactggccgactagatcagaagcacttggttgggttttagaccgaattcttggtcctccgcttccctgaccagtttggcagcgaggtgattggtgctgggcgattggaggatctgacttcatcaatgcgaattcctaagcataaatgtcaagcaacttaacaagagacgaaatcatgtttttaaggaaggttggaacgtttgaatacataccggtggaggaggattgaatgcattgaacggtacgactggcagcaagtgtgaatagttgacaacgatagcatttgagaagatcttatacatcctttccttcatgaccttgaagtcaagagaatctggatcttcacagtttgggtcgtgcttgccgtcaaattcgaaggctgtgcgagatctctctttgattggagctaaccgacacttgataaagtgccgggtgatctgttctccttgaaggccttgttcttttagctttatcatcctctccatcagttccactgcttccgcagcttcatttcccattggcagtgagttccaagtatcccgataaactggaggaagacaggagtactcggggagagcaggctcagggttttgaacataaaaccaatttgcatgccagcctttgtttgaggttttgaagggcatagagaagtatttttggcttaaggttcccctgagttggaagccagcccccccaacaacacatggtttgctcttgtttggctgaggtttgaggaagaagatgcggcggaacaaggcgaaatacggcctaatacctaaaaaggcttcgcaggcatgaatgaaattggcgatgtgaactatggagtttgggttcagatgatgcaggctgattccatagaaattcagaattccccgaaaaaatcatgaggttggaagggagaaaccgccatagaagaaatgagcaaataccacgatttcatgcgtatcgggggtcgggaatgcttcgccgaatgccggtcgccacccgatgatctccttcgccggaagaacgccgtgcgccaccatctccttcagattatcttccgtcacatcggagggcgcccactgactctcgaagctttctctttcttccgccatgaatgtgaactggatagtttaatttggtcctagatacggctggaaggggatggggaatcgaagcggtggacgcggggagaaatttcgtaaagtttttgaggatggattggagcggattgatgaaccctagcttcgtcggcgcggttctgtactgtagcagggagtggggaaatggcgaaagtctcggcggggaagacgaagtgacgcttggtcttcggtgtttttagggtatcgggagtactaatgggcctaggcctgtacagtacttcagcccagtattataatcagcgtggcccgttgtgatccctagggacttaggcgctttttgctttggcaatttgtgctcacaatgatgtggcccaatgttgttaaaatcctttttaatgcggtttgataattctttggaattaacacgatgcaaacaaaaggtgcccgacaggaaggtgttatactatttttgtaagccttattaggctgcaaaagctgtttgggttgatttgagatgactaatttattaagagtcattctcttagcatgttatatgcttaatttggttatggtgagagtcatagcttaggctattagactcgttgattaccatgatttttatcatgtttggtggatcattttaagagtttcttactcggattcctatcaaatatgtctgtttttggaccttttgagtgtttatcactcggcccttttcgtattttttatccttgatatgttcaagttgagaagcagttggctgagtgttttactgagtaccatgcatgcttcgctataaaaccactcggttcttgactacatgtttagtttttcaactaatcacatagtcgggggctacacctaattaggtgcatctactcgatgcaccaagttttattttcgcccttcacagtctttgattttagcactcggtaagctagagcaagttgaattgaagcgctcggattactgttttttgtttcgagaaggctattttgtcaactgcgaaggtctcgggggctactgtggagattatggataccccatatctacatgacagttataatttagtcagatatacggtaccaaatatagatagaatatcttcatgaggactcgggttagattctaaacttgtacgtcaaggaaatacccgggatcctagtcggttacgattgtattttatctataatcccatattccgttaggatatggactgtattttgtaaagcggacttcttcccctatataaggaggggtccgtgtgcctctcggggcgtgatcttttttccggtttatacaatcaataatacacgcggcggaatcatccccggacaggagtagggtattacttcttgaataagaaggcctgaacttgtataaaattccttgtctccaaacccatccgctttcctagcttgatagccaccccctttcattattgccaaaatcttgtttcgacagttaatggccatataatctagacatgtaatttgtggtgttatgttgactatgtcatactgtcaaagctcccttctactccctccgtttcacaatgtaagtcattctagcatttcccacatttatattgatgttaattttttagataatgaaagctttattaatctcagtaaaactctatcaagtgatacaattattctgagagcacctccagcttctgcacccaaagagtgcacacagccaacaagaaagaaacagaagataaactcatcatccaaatagcatggacaaaaagaacttcaggagccctctaaccgtagcctagaacgccacccatgcgccggagtagaaaactccatggccactagctccaattgttgacaagccgcaatgatagtaccccgcaaattgaccttctgaaggatagcccatgagcggagccaatgtgtaatcaaaaagataacctgcaaaggagcagatatgttttttctttcaaaaaccacatcatttctacaaagccaaatagaccaaatagtggtagttgcccataataagaccaaagatctcaaattgcgtggttgtcttcttatccaatgcccaaacatatgagttgtactattaggtaaactaatattcgaagcaaactggattaaagaccaaactacgtgggcaaaacaacaatcaaagaacaaatgattaatagtttcatctttgtggcagaaagaacaagacttgtttcccctccaattccttttaataagattatcttttgttaagactactccacgacgtaagtaccataagaagatcttaatctttaggggggcattgatcttccagattcttttgttaatattgggaacatcggtctgcaccaacgcaagataaggagatttaaccgagaatctgccatcagtggttagattccatttaaactcattttggtcataagataatataatattagcgatgcgtgagagaaggtgattccacgccactaacttagagcgagtaaggtccctgcgccaagaaaagcttagaggactggtttggaaaatttctgaaatagttgcatgtttatgcctaacaacgttatagagacaaggatattgttgtcttaaacaggcattcccaaccatttatcttcccaaaaccgtacttgagagctatctttgatgttgaaggagccaaacctgagaaaatcaggcttggccttcattagactagcccaaaagtgtgagtctcctgctttccactgagcttgagacaaaggctgtgaccccaaatatttgttccttagcatttgttgccatacaccatctgtagtgagtagtttatgcaaccacttgctaaggagagcttgttcttaatttcaagatcttgaattcccaaccccccttggtctttaggacgacatatgatgtcccaccttgctagtctatatttccttttgtgtccatccccttgccaaaagaaccttgatcggaaataatcaat

SEQ ID NO: 42771 - DNA, 6475 bp, Oryza sativa
aaccaacctcacattgaaaaagggtagaatattgatcctgagttgtttgggcttcaccaaagcagtaaagctcgctcttatggaaattaatctttaagccagataattcttcgaaaacattcaacaacattttcagattacaagctttctctagatcatgttccataaagagtacagtatcatcagcatattggaggatggacaatccaccatcaatgagatgaggcaccactccaacaagctgtcctgcattatttgctctctggatcataaccgctagcatgtccgctataatattgaataaaatgggagatagcgggtcaccttgtcgaaggcctttctttgtttgaaagaaccgtccatcggagaaaggggcaatgaggtggtcattttcagcctctgtaacttgggggatatcatcaattctatttgcatcaaaagagagagtacttgcatctggtggtccaaagagtttcttataaaactcagtgatataattctttatagcttcattcccctcaatcttaccttcctcttgatcttagactaaaaatacgtttcttccgatgtttgccatttgcaatcagatgataatattttgtattattatctcccaaacgaacatcatcagtctttgcaatcatattgatgttaatgaatctagatagatatatgtctagattcattaacatcaatatgaatgtgggaaatgctagaaggacttacattgtgaaacggaggaagtaacttgcttttgttggatattgatgtgtgctgttgagtatggtgctactttgtgatgcttcacatgttatatgtgatatgttggaaatatcacttgaaatcgtggcaacgatattgctgaaattttgtccatgatattgtgctatgtaatcttttacaaattgtgttcaaattattgatgaatttctatcaaaattttgtccaaaatattgtgttctgtcatcttttacaaattgtgttaaaattattgctaaaattctgtcaaagttgtccaaaatattgtgttccattatattttacaaattttgtcaacacttaggtcccatatgaaatacgcataaattcaacttgaaacatgtccagtgttcgcgacaacgttattgatctcaatagtagggctatatttgtccattcaccacacatttaaacaccgttaccatgagttcacagagtatgggtagtaggttgcttcatttcaaaaaagcaggagcaaaatcacaaactctaaaaagcaggctaaaatcacaattgaactagaaagcaagggcaagaacacaattgcctccaaaggtctatgtggagctcaaggtagggaaataaaaatgaggcattacttatatcacatatattgtaaatcagaaggtggatcaaagaagaaaacaaatcatacaatctggtcaaggtgagggctcaaaggttgaatcttgtgatgtggaaggtacaagatccaattcaacagttgagggcttctcatgggtgtgctcgatttcctggatggtttcgctgctgatgaaggaggtgttctctaggatacgatccaagagttcccttccttctatcgtggttttatgtgcaaaggtacctttggcgtaaatgtgaagatacggagcatattccttgtttagacccaaacaaaaatgttataacaagacatgatcgggtatagatgttggtatttcttaacgacattactagaaatataattcccagcaatggcgcagaaatactcctggtatattatggttagagagtttatccgcaagcgcacggatataccattgcagcatttcacccgagagtattacaagggtatcgtatttaatttatcccgtgggaagatcatgtagagagaacttgactaataatttatatattacttgtgataattatattctaagcaggggttaagataatctaagggtagagtgacacacaagcatcagctactcattctcataatatattatctaagctaagtggaaagaaaagagagagaatctattcctatacttctaatgtacatagtatacatacattcttagttaactgatacactagctaataccctctatccgatgccctcctggtacttcgagaagccacccctgactgccgagttccttacgtcagaccgtcatgaccatacaaccggggctaaatacggaggaataccctccccagggaattaacttaggattatatacaggcgcggaggaatacctgtactgagctgtcaccaacagcggcccacctctcatccgtagcatataaccccaaataatgatatcccgtaatctagacaccacgtctaaactaccagatactactctaatatcatcgtcatgacatagagtaattacataagcaaacattatacccgcaccaaagcatctgccagataagctagccgtacattcagtataacatgaacataatgtaaagtaggcattcatatactcggaaagtatttcaataccataaatgtagatagaagagtattctaataaaagtacaaggcttacaaaagaggagaaaagctattagagccatacccgaactctttcgaagactttcggactcctgatttctactctattccttttccactagctagatactactaaactaaacttgagagaaatgagagagctcttgcttgaggtgtgtgagtgaagtgatgatgagagctccttttatagcctcccaatgacggttgtgacggttggaaaggtcggtaatacccaccaaccgtcattggggagccatctcagctgtccaggagaaccctggatcaaacggcactgcagggggttcggctgaaccatgggctgggccgacctggcccaatttcggcaggcagcttcctcttttgctctcatacacagacttgtgaattttggcctggtttgttgtgtcaattctaagttcttgtcccattcatacacaagtctgattctcgacatcgtccgattgatttatcgtttgagttgatgttgattctcctccactttatgatcattctctgcaaaaggttagtaaacccaatactagtggaatattattattctaacatatttatgcattgcaagcatcactagttctcctctgttttgataaaattgacggtcgaaactgatcgataacgaccgtcaacaatagacaactctaaccaaattgagttaacaatgagaacctaagccaagctgctccaataaattcctcctttctctgctgaaagccaaggatttccatccgtagggagacaatactggatagcgggaagaaaccaagacaaaacctacttttgagttcccccattcgttgttcgtcttcctaacggaaagagcgtaccattgttttacctcctcaatgagagagaagggaaacaacttccactttggagtttcttgtgtcatgcctgagattgtctggcacgagcacaattgctaaaactctcgtagatgacagtagggctttgagctatcgcacccccgagaaggattgttctcgaatggctataaagccaggacagagttcatatccagatgtgagaataagttttgatgaagttgctggctcacaaaactcgcccttcggaaacatttcatatagatagttgctccatgatggaaaagaaaagaaaagaaatataaaaagataagataagaaggcaaactaggtttgaagataatataacaactgttccatagtaacaccgccagaaattcttatattgatatttattactcacagataaatacgcaagcgcacggatactgctgtagcacttaaccatatcgaatctcagggaacaagtgtgtaaaatcaaggaaacaggttcatccagggacaacaatttaatggtaggagggggatagagaggatccagatgggttaataatcttgaattaagttaaggtaaaactctatcacttgcttagggcactggcttttccatggtttgccaaacgaatcaggcctatagctctatgatgtacctgaatgtgaatcattacaaagtatgaacggagctatcaccacgtgttgcgtatctctacaacccatggagcacacaataaacaaaggtaatttttaacctagacacacgcttacgttatcgattacttctctagcccccacacaagaagtttcttctttatctagagtcttactagagcacttaatataaatattaaacgatgaacccataatagtgagaatatatcttacttaaaaaaattaaatacccaaaagaaatcacgaatactcacttaatgtggaatcctgtatacttatacagttgatccccactaactattttgctgtcctctcagttagccacgtcactttttattcttatccgttcgatcaatgtgttcaacgcagcagatagcttcttgagggttttctttcctactcagcgggcccagtccaaattaaccaccttgggccaaccggtgaatgacccctgcccttcccctctcgagttcccactagcgacacgaatcctttacgattttgctagaaatctgatgtcaaattttcttccccatatctgacgttttttgcgccgtccgatctgctcttcaagattcgtgctgatatttatggtattagtcaatgcgcggtctgaacgctgtcaaatttcgttttccgcgccgtgtctgtagccgtagctcctctttatctctcctactttctccggtatcttctccattcttctttcttctctcctcctctctttttgcttttttcttctctttctctccggcgagaggctttttcttctctctcgcgctcgagaaggagaggaatctcattggatttctctcatctgctccagatttgatcggttagttttgtgtcgttcgttgctgcttggtttttttgcatcctccggttgtttttttgagcgattttgtctaggtagttcgattttgattcagtttttgaaccggttgcgcgcgatagggagaggaatctcgtcgaatttctctcatctgatccagatttgatcggttagttttgtgtcgtttgttgttgcttgttttttgtttcatcctccggtcgttttatttgagcgatttcgtctaggtagttctattttgaatcggttgcgcgcgagaggcaggattttgaattatttttgtgttgattttgtggtcttagaatccaaatcctttttggatttatagtcagaatcctgtgtcgccgatgattcctaagttttttatgctgatctaggtgtcgccgatgattcctagttttttttagatctggcctatacttgtttttggttttttagttgtagttttaatttgaaatatgtcgatctgcttcttctgaggttctagacatttatttcctgaattgttttctagatctgattaggttttggttttgattttttccatgttgatgggttttgatctatgatttatggtgatggctattcaactcatgttgatttatcattatagtttttagtttttagattttttcatgtttgatttgtttatttttgtatttccagatccatgagatatcttatatagtgtttgtatttagttctatgctttctccatttctgtataataatgatgatgccaatatttttaaagttaaagctccacatgaattggtttggctagttcaggtatcatgtttatgtgtgtttcgaattacttagtgctaatctaaatgattctgtatgacatggttcactagtaatataattttctttttagtttctgtaccttttgttgttattatctgtgttatgttcattttgtaggtctaggtagatgtccaaatgacatgtatttgggttttggtatgttaattcttttgttcttgcattttttaacactttcgatgttgattttgattagtttagccagccaaattcactccagtttttgtttaggatcaataaataaacctgattatttctgctacacctgattaaagcagtattgttttggtgagatttctgtgtgcaattggataaagcagtattgttttttggaattgaggtgaaatctgaaaaaacttgataaatttgtactcatgggatggctttatttttcttcattgaattttgattgtgcttgattgctctattaaagaattacatctcaaaattacttcttaagcacatgatatgaaagtcgtaggaagctgacaattgacattgttgtgattttgcatcattttgtattgcaaacttgacctgttcaattgacaaaaatagctgatcaatacttgttaaagttggactctatatgtgatgacaattaattggaactgtatgtatttttcctttacttaggtgacctggaaatgttctaatgtattaatgtcttagttctttaagctcatgttttttttctttgtattgatgagaatgcatctgatcttgatgagaatgttggtttactttctgacagaa

SEQ ID NO: 42772 - DNA, 1641 bp, Oryza sativa
tgattaactctgcttatcaattgtccctttttgtcctgttttcacttattattaactctgcttatcaattatctttatttccagtcaggagtctgacaagatttttaaatccttcttattacttagctgtagttgattagttgtactatagatgtgtatttcatatttgactgtatatttttacttgtatattttcatatttgacattcttcttgccttactcaggaagatggtatgattattatatacacatttttatttttttttgtaaatcaatttaccctttttttttgttctcttttgtagattgtcaaggagatgaaagaaaatataatgaccaattcatcttttgattttcaaaagcctccagtatggttcttctttatttttttcttatgttttgttttaaaaatttgtaatcttcaatttataacttttttcaaaaaaaatatttgtatttgattcttttttctttgtttaattgcttttaaaggttaagaagaagaaggcccatgctaacacagagtcttcattcacaagattctctgtgaaatatttttctgaagttgtgtcctctttgtctgattatcaaaaatccattatcaagaaatttgagtttgatttcttgctgatgttcaatagtagttatgtgcctatcaagtttgccacttggattgccaataaagttgatgtcaggacatcagagattattgtgaaggaaaaaattattctagtcatagttgaatcagttcatgatattcttgggcttcctttaggtggaataccttttagcaaagattatgaacgtggcaggcaatgcatcctttctatgtttggtcagtctgtattgccttcagttaaattttttggtgatctactgattcagcagaaagatttgtctgaagatcaaataatcacatcttttcttattgtcgccttggcttgtttcttatgccccaactcttctttgactccaagtgtgaagtatttgactattttcgaggatgtttctcgcttgaaatactttgattggtcaaaaatttacctatgattggttgatgacttatataaaaaagtttcagaagaacaccactttcggaggctgcttgttttattgggctgtaagttttatttcacttctttagttttttttgcaatgcatttatattttttttattttaggttttgtatcttgacaatgttgattttggctcaagaaatgttgaccaaagttgtcctcgtatttctgtttggaaagatgacatgatatcaacattctctgaattagacaaaattgatgagaacacttttggattaagacctctgaaagatttccaggacacttgctatttcaaggtatgtacttctgtcttgtaatgtattttttttcaatgaagtttgttgattgtttttatatttttttagcgtgattcaactcaatctagatcagtgataattcaagacaaacttgattcagctattggtagtatgcttccagattttctcaagcatgaaatctctgaaatgttgagttctcattgcttcagtcatcatttagttgacagtgaatcatgtgaagatttggttgtttctattttgtcgctgattgctaaagcaagtggaagtgagggctgcaggaat

SEQ ID NO: 42773 - DNA, 5018 bp, Oryza sativa
ttatcgttacagaattccccagatatccaatttcttggtgaatcaaaatttgctgactgttgtaagaaactttgttctaaatctgatgaaatttacaattcatccaataatttgtctacaagcacacaagatttcaattccactggtggcaagatacctatacatggccctaggagagttttaattcttgcaagacatgccacatatccatttgtgactgagatacgtcgatttccaataactgatgaagaaatctgttattacattgttttttgtcgtcttgctgatagttccaaatggcagaggtattaatctgatttttatttgtttcctattttttgttacatatgtttatatattttttaaaaaattttgtaattatatttttttcttcagttatgatgctgttgatatagatggtgtgaaggaaaaagtatcttagtttggtcattctctcaagaaaggtggttttgtctccacttttgttatgtcagttttttgtcgagtcttgtttcataatgatcatccctcaagatctaagaagaattactttttcccatctattgttgtaagttatttacttctttttatttttgttaaaatttgaaataaatatattcaatacattttttaaattttgtgatttaaatgtaggaaaaattgccatctaatatgtcttctacaagtgttatggagaaacttgaaaaatcttttgttggagctgggaaagctaggaaattacacttgtgtgatatggtaaggtgttttacttgatttgcttgttggtttttccctgttcatatcaacttttttttttgctcctgtccatgtattgctttgcatagctttctgtttttttattttatgtcccttaaatctaccttttatgctgtaatttgcatattcatgttcatcttcttttagattatactttaatgaattgcatagttaccttgattgatttatggcattttgcaaggaaatatgtgtcttttcgaaatttatgtttgtcaaactttcaagtcaaaaaatatatgaatattattattcatagtgtttatgcctgctgaactttctttatcattgcacatatgaagtttcatgtttattaaacttatagtttgtgatttttgcagcttcattttccagtcaacttcaatcatcattggtttctgtttgttgttgacatcaaggatagaatgcttgtaattttggattcattgcataatgagggtgatgagtattttcgacctattctgtctcagcttgtaagatcatatcatttctacttgtttattatttaattgttgcttaatttttgaggccatatatttctttttttgttattatattccttttttatgtttaatctaattaatttgtaccttgaaaatgtgaattcgtgatgtcgacctgtgactgtatatatgcatgtctgaatttttgatatttcttcaaattattcttttacatgatcatgatctttaatttttttcagttcttggtatgccatggtattagcttgccacttatatatttacttgctgaacatttcttgtgttgatctatgatgcatcatcaaacaatttttttgtttaactttttttttaatttttaaatttggtattcagatagccaatttacaaattgcttgggataaatttgtttgcgtacctatggattttcaaaggttccagattgtttttcctccagtacctcgtcaagatttcaggttataatctttattcttcatttttttattttagttatcttttttttgtttgatatttttaattgttctttttttctgcacatttttttgttcagctgtgattctagaatttatgtgatgaaattcaccgaactttggtcacctaggattatattatccactgtgctttcaaatgaaaacatcaagaatattcgtgtccaatatgccaatcaaatattctttcatccaaagaatagaatgctgcaaactgagattgaagatgttgttctcaattggtttgatcaagtaagttttgcaactaatatttttccctttttatcaaatttatttggtctatgtattattgtcacgcccggaaattcactagtaatttccgaacttatttgtgcatgaaatcctcgtccagaaatcagccgaggtacacaaattgacaatttaatatacagattcatcaaattaactaaaacgataaatacttacttaagaggcactaagtcctcaccaagaagaaaactgcagcggaaaataaaatctagcgaagctccggctccactcccacaggtagctcaactggggtataagccaaacgtcttctccttctgaattctttttcttcaactgaggttgattgattattgtaagaatgagcatatgacatactcaacaagccacacagcaaatatgcaagtgcacaaggataccaaaggatggcataatataggctcatttgcaaaagcagcgtttagcaaaatatttaagagaaataaaacagtagagtagttaatcagaaattttaatcaacactgaacagcacacccatgctgcacaggcccgaccatcctgaacaaccatacccggctgtacagatctaatctccaaaccaggagctaagcaaattattaccagttataacatcaataattattgtgagaggtgtgagactaatcacgaaaaacattgctcaacccgcccataaccgcgggcacggctattcgaatagttttactctggccagaggtgtaccactgtacccacaagacacagcctcaacatcatgtctaacatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattattaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatatatgatcaacatgctcaaaggaatgtgtttaggatctgtgtgacttgccttgtaataatcggtcttcaattaatcttcttgaatactccggcgcactcgcgaaccttcgcaacgacggaaacgacaagctaacacgcaaaacgaagaaaaagactaataaaaaccaaataaacaatacatataaagtaaacaaacatgtagattataattttagatgaattatgagacttgaacggcctcattctgatttcatatgaatttattatgaattttacaagatttaattccaattaaacctattaaacggagactattccaaattaattaaatcatttacaaatgatttataacggagataaaagattaaagcaacctctggaaaagattggatcatatttggtagatgacatatattaaaaagaaataatatgccactgaaaagaggagaggatttatattgattttggacagttgagattaaccttgaccgaatcgactaagatcggatggcttggattgatctggcaagcgagcctcacgagataccgactcaacgagtcaactccacgtgacatgagatcacctaaatgatcaaccgaaaccggcgaacagaaccggcggctctgaacggctctaaactaaaggacgactcaacacggacgaatgaacgaagcacggggaacacctcgttcgaacgaacgagcgaacgactcaacaacggctgtggctaaaccagtcggctagacacgattcacggtaaagccctggtacgacaaacgataggccggtaggaacctagggttgcacctacggctacacaactcgactaaaagcagcggctaggtttaagcggcacacagctgcgacacggcggcactaagacaacttgactcggctaggcggcggctaggcggaaacacgcagctagggttagggtgacggcacagccggtagcgaccatgcacggctagagcagcagggctgcgagcaaaaacgcaaccggcacggctgcggctgtggcaaagcggcaaacagcggcagcggtagtgatgcatgatagcagcgcggtgacggactgcggctgcgctaagtctaggcctctagggcaacagcgcggcaaagcggcaagcagctgcagctaagcggctcagccggcacacgcgcagcagcggcacggcaagcagctgcggggcaacgcggcaaggcgcgacgcggtagcgactaagcagcggtggctaagaggctcggtagagcgacggcaaaccgcagccgcacggcgtgcagcagctacgacacagcgacgacgacacacacggagacgatgatgacgctagggccaaacaagattagattagatggaattaagaccctagggataaactacaccggtgaacgacataagagcggcggttgccggcgaaccacgatacaataatgcaaacggagggcaccgggaggtagagaaggtgacggcgattcttaccaacacttacacgatgacaggcagcgacggaagatggccggcgacgagctccgaagggcggcgaggtactgatcaacggtggaaacggcgttgggctgcagga

SEQ ID NO: 42774 - DNA, 3272 bp, Oryza sativa
gacgacggacgacgacgaacagtgcggctggagacatggcgacgacggcggcgctctggttcacgacgacgggcaacctccggtgggatttggcgcaaaacaaccggtggccgaggtagctctcacccttgcgaagccgagggaggcgacggctcaaggcggcactgaccagaggggcggcgcggcgccgctggagatggtggcggcggtggagagagaagacaagcgtggggagagcgattccggcgaccgcggaggacgggacttgaggggataggtagaggacgacgagggggtcctttatataggcacgggagctcgggaaaaagcccacatcgaggggaaaaacttgggaaagtttaggatcctcgccggaaaaaggaaagattgatccgcgaaattggaaaggatttccatagaaacttttggggatttcttagggaaattgtagaggagattgagaggattccattcccgcaactaatttggaaagaggagcaacgaggaggccggatttggaaggaggagcggcacggttgcacaggctcgggacggctcggctctatccaggggttgaagacaacactgtagcgagagggaggataaacagacttctatgcgggctgagaggaagggagataataggagggaatgggctgaaagggcccaagactaggaagaagattttattgcttttccaaaaaaaataaccaatgagatgatctctcaattgttaaaaatacttccaatgctcaaataattccaagaaaaatcttgaatatacttggacactctaagtatttaaaaatattgaaaccagaccatttaatgattaattcattagttaaataattactgaaatgttctttgtattgttaaaattaggaattgagctccgaaaaaatccgagaaaatttcagagagtataattaatcatggagaatttaataaaaattaaattcagccatgatttatatttaggaaattttatttcccacatttaacttcacttgtaaattaaagaacatttaatataaattctattattaatttattaaataatttataaagcctgaaacaaaaatcaggatgtgacaattatttagtttaaaatttcatttttttttcttcctgtaggagaaatttcctcgtactcgtcagcctacttttacttcagcagctcagaaaaagttctgccagtgacattgaattcttaggatcttttgtagcaaattggacagctattagctgtagttaattctgagaagaacataatactttcgagactaaaatgttgagcatggttttctgtaatagaatttttgctacatttgatagctggttctgatccagtaacatagtatattacaattgtctgttacacaattttttcattctcattgtagcaattgtaactaatctttttttcccttgatctatctgttcatctttgcttcatcttcttgtcctcttctcaattgtttttctttcattgtcttgactagctgacctctttcctgaaaattgaaatttcatttttttatatgtcagcctctaatttttttcctgttcttaggtgaatgttttttgtttcttacttttgcttgacgattctccagtttgatcttctccctgtttctttcttgttccaggcttcctttgcttctcaatagtccctgacaatgttaaatccttataagtacatttttggtaacacataatatttttgtacaagtttaatttatttcaaagaaattgttttttcttacttgtcttggctgttttttgctgactttgcataatgtatgtgtcttccatcaatgggcatgtctctattgtatgatttgttcttccacatcgtgtgcaatgcctttttggaatctctttaagcttctctacaattgcttttgttctagctgatttttttgccttttgtatttgctaaattagggtcttcgatatcttcttgttcattcattgtttcttctgtttcttattccccattactctcttttgttgtactgccttgattattttgttgcagattttcaggtgcctgttcaatcaacaagtccaaatttccatccaacctgtccatctgatctagcatatacaggtaagtgtctttactctttgatgcttttgaagccatgtcagccattcttctagagaggacattgaacctaagaactgaactgttttcatcactagctggtttctctattcttgctatgcattttctctcctttttcttccacctttcaattatgtacttttcaggaattttgcttatttttagaaatagcatcactttcaggatatggctttgcacatatgcacacatagttctattgtgctaagtctgttatgatcacatattttctctgtctgaattcctgttttgttaggttttcagctgcatatacttcatatgttttcccatgttctataactgcaatttcttgattcagtgtttcctgcaactcatcttgaaattttttgaaaattctcaagttgtacatctctgaagcttgtagttcaatcttgtagcttgaccatagtgtcttaggcttctttgttctggactgatgatctttgcaaaattctgtatcaaagattgtgtcattgattatctcaaattctttaaggaaactcattacactgtgtgttgggcccacaccccttttgaaccttgcatttgtcacctcacttagtgctgtactgtgaataaatgggcaaaaatctaatttaaagtacaatggtatatagttttcccttgttctccacattgtctgtaggtatttgatgttttgcaaaccatacttttcaatcatttgaggccacaatgtttcaaactcaactcttgtcaagcagttgtgaacaatatcataaaattcattgtagagatctttatttttcttttctgaaaatgtgtttcctgtcctttctctccacttcttcataatatggaacaagcaattcgtgtgttttgtatccggaaatactttttctattgctgatttcattgccaagtcttggtcagttatgattgtctcaggatgttttcctcccatagctgttaggaatgcctcaaaaacccatttgaaagtttccatagtttcatctcctaaaaatgcacacgcaaaaatgcatatgctgccatgacctgtaaccccaacaaaaggagcaaatggtaggttgtacttgttagttttgtacatggtgtcgaaactaacaaattcaccatactcctcatatagttgagtggatct

SEQ ID NO: 42775 - DNA, 796 bp, Oryza sativa
aaaggtgcttcttgcatgttaaatgtgcccatgttcaatatttcatattagtatttcctgtgcaaacagagtctgttcaattctacagtgtaactacagatatctattgcattccattccttaaaatattagtatttcatgggcctttttcatttatgctcatactttccacgggattcatgtagactattaatgtatatatgtagaagcatatcgtttgacttgagaggtgatgtcatggcatttgtcttgcataatactttcataacagacagtttccatgtactatattgtaatgaaaaacatgggcaatattgcattggagactgaaaagtgaaaaattgacctgtgtttgtgaagtttgagagggcaaagattaaccttattaccaacatgtggctccgctacattgaaaatatatattttaattcttccatttggtttaatattattgatctttttgatgtagatgtcatttcagatgtgtttgcctactcattatgaattttttctttatctgttgaatggttaataaattacaactcattttcctttcttgtttatacaaaggacttgtaaggaaaacgaagataagacatttgccaattgctctataccacaagagaagacagatgatgagatcaatgcaaagcttgggctttcagatgcttctgctgatgaagctaatggcgatggatcaaactctaaaggtttgaatttttgactctatacattctggtcagaaaatgcaaaattttcttttggtgctctctatcatatctgatttgtgacaaac

SEQ ID NO: 42776 - DNA, 1741 bp, Oryza sativa
  unsure (1)..(1741): unsure at all n locations
attatatctcagactaagatgatgctagggaaaacaactgctgtaaaaacttacaaagcatacaaattcaagagataaaccacttcagtaatgagcaatcaaaacaagcaacccaagatgagctgaagcctgaagtgtcactttccaaaagaaaagggcttttactggaaatacataacaaccaggaggttaaaaattcatgcagaacaatagcacatttttcccatagaaagaaaacataaacacagaaatatctgtggtggcaggaaactagaaaaacttacaacatcacccccatcattaacatactctatgaaagatccaacagccctgttccacagaagacaaaactcttactcacagctaagaatatcaaaccagaatggtcagaatagcatgattaaacttagcatactttaaggcagcaattctgacacgagagctagcctcgtcttgcaggcatttcagtaaaataggttgcaaatcattcagatgagattgaaaagtagttccgatagtttcagtaagggaactgaacagtatcaaagctacctgttaagaaaaaagtgagcgagtaagcattgacattatccaccaaaaaatgctgcaggttatagaactaggaaattggtccggatcatcagacttgtcaatatcaaatattgtactattagtatgttgctaaccaaaaaaaaatacaacttttatattcttatagcataaatcaagttcataaatttataaaaacagacaatgaaaatgtaaagcacaaaaggctcttcttatgtttaacaacaatatgattcaaattgccaattctcaggttgattctatggtcctagacaattacgtagtataagcatgcataactaaacataatatcggaagtaacacaagtttgataagaacactgaaactcgggatagacttacttctctatgatcttcctgtggactttggctgcattggaaaataaaaggtaacaactcaggccattctcctgcagggacagcgtacttagctataatactcacaacatttgcgctagctcgtcttacaagatggctgcataaaagtaagattcagtctctaacagaagtacatgtcaaaatacgatgtagtttgaattgtacaagtaaacagcatttgcaccaaatggaagggattctagcttgctaaggaggctcttttaaatttatctacttggttacatnnnnnnnnnnnnnnnnnnnnnnnnnnnnnnnnnnnnnnnatgtaacgctccgcttttcgtgaggcgttaaaaactaattcggcaaaatcctaattgcgaaaattttcgttctttgtgtgcgagtctaagtcgtgccaagatctcatctcaaatcccgttgttccctcacatcgaaatcaaaatcctccacctcaaattactcttccgattcaagtctccaaatcaaattccgaaattcagtcgcatcctttgaatcctcgctaaacactcgctcccaattccgaaaaataccaaaccctatcttgagccttccttgattcctccctgaaccctcgagttcgaatatcgaatttgaatccaaatccaaactccaattctctccaaatcgccttctctgtgaaagtctattttacctccctctggctcggtgggccgactcttcttccccggcccatctcctctcagcccgcttcacctcctccccgcacgtgcgctgcatgcgccgagagagagagaggcatcgcctct

SEQ ID NO: 42777 - DNA, 20038 bp, Oryza sativa
tttgttgcagagtatactgtttaactaattagtactgggtaattgtaggtaaaaatatttcgggattttgttcctagtatcttgaatgtatcaaggcagtgccttgctaatggagaggaagatgttgcttccatcgcttttgaaatatttgatgaactaattgaatcccctgccccacttcttggggactctgtgagatcaattgtacaattttcgcttgaagtttgctcaaaccaagaactggaaataaatattaggcaacaggtttgatcagtcagccacatcctttatacatccgtctgattttacaaactgctaatatttcaaatgtgcactcattttttcaggctatacagataatctcatggcttgtaaaatttaaagcatctttcttgaaaaaacataagctggtaatacctattctacaagttatgtgccccttgcttacagaaacagctgatgaagatggagattctgatctagcagcagatcgttctgctgcagaagtcattgatacaatggctatcaatttaccgagacatgttttcccaccagttcttgagtttgcttctgtgagctttcgtcatattaatcccaagtatcgtgaggctgctgtaacatcattaggtgttgtctcagagggatgttgtgagcatttaaaagataagctagaggactgtctcaaagttgttttagaagctttaaaggaccaagagcaaatggttagaggtgctgcctcatttgcacttggtcaatttgctgaacacttgcagccagaaattttatctcactatgagagtgtccttccttgcatcttaaatgcacttgaagacccatcagatgaagtaaaggtgaaattgccaacttcatgttaaatcttgcatatggattgaagttgacgatattttctgtaataatgaactaatgtgatctgatcttgcaggagaatcatattatgcactggcagcattctgtgaggatatgggtgaaaacatcctaccatatctagatcccttgatgtgcagattagttatgtctttgcagggtagtccacggaacctacaagagacatgcatggtttgtatagtaatcattgctctaaaataatctctatatgttgtcaagtaggagattgacttgttctatgtaatcttttatttgacaaatgacaatgtttctctgcagtctgcaattggctctgtagcagctgctgcagagcaggcttttatgccatatgcagaaaaggttctagagatgatgaaaggctttatggtactcactaatgatgaagatttgtgtgcacgagctagggctactgaggttgttgggatagtggcaatggcagttggcagagcaagaatggaaaccatactgcctccttttattgaagctgctatttctgtgagtattagttgcattacttcaggcaattgaccaccttagtgcaaatatttatgttccttttatttgcagggttttgtattggattatagcgagcttagagaatatactcatggtttttttagtaatgttgctgagattttggatgatagtttcgcacaggtaacaagggaagtctgaagcttgttcaattcatgagtgctgtttatatttacggaagtggtttgttgtatattgcagtatcttcctcatgttgtacctcttgcattttcctcgtgcaacttggatgatggttctgctgtggacatagatgatgctgatagtgttgacaatggattcagtggtgtctcttctgatgatgatgtaaatgatgagccgagggttcgaaatatcagtgtaaggactggagtattagatgagaaagctgctgcaactcaagccattggattttttgcgctccacacaaagagtgcctatgctccgtatccttaaaatggtgctaatgtaatgttctggtcataatcattatcatccaaaacttccttgactggaactaggtacttggaggagtcattgaagatcttaattaggcacagtggatattttcatgaagatgtcaggctccaggcaattatttctttaaaacgtaatttcttacctggtcctctttaatgtgaaagtatgcagcagatgtttaatttctttgtttctgtaatgcccgcattattaaagttccattgtcaggtttagtgaatacaaacatacaaataactttatttcattgtaaaattgtaataggtagtttaaccttcaactccatataactatatcaaatgaagtgtgttaaaaacatacaccataaaaactatcactcaaagtgcaagttgaaagggggcagatatataacataattctccttaaaaccataaatctcaagatccattcatgaaagttttgattttatttatttattttgtgcctgtcataatttgatatctcattgaggtctgatggaaacatggaatactatatcatactgctactgcaatctgtgagtgcacaatatatagaaacaaaaattatacaaaaatgagttatggcagtgtggtctccagtatattttcactatgaatctagattgtatagccttaattaacttgaatcagttggttttctgaacttcaagctggtaaaagctagaacttagaagcttctttgatgttgttcaattgaagaattgatacttcgtggctattattaattcaagtggttgactattattgcagatatcctaactgcaataagagcaatacctcctgcacatgctgtgagtacttgtcttaaagaggcttgtattattccctctcattataccgatcattatgaaacatcaaaactctgatgcaaaatattcttttctaccatgcaggatgtattagagaagcagaaggatattcttggtagatgctaatatagcatgctatgtttttattttaagtcaattttgtcctgcatattgaaacaatactctatttctttccatttgcagatacagtaatgaacatttatatcaagaccatgagagaggatgatgacaaagaagtagttgctcaagcttgcacgagcttagcagacatcgtgagggattgtggatttgccataattgaaccttgtaagctgaacttatttaaagttggtatcctgtgaatgtttagggatgtgtgcctaaaatgtctctctgatgttgaaatttcagatattacacgacttgctgatgcaacactcattcttttgcgtcaagaatcttgttgccagcaagtagagtcggatggtgaagacgacggtgatattgatcatgatgaagtgctgatggatgcagtttcagatcttttgcccgcctttgcaaaagtgatgggatcttattttgatcctatctttacaaaattgtttgattcattgatgaaatttgctgtgagtaaactctacacatacacacaatctgaaacctatagaagtttctgagttactttagttaacaaatttctttctggtatgagtgcagaaatctcctcatcctccccaagataagactatggttgttgccactttagctgaggtcgctcagggaatgggagctccaatctctgcttatgttgatgtatgcttttatgttcttgaaaatcacttccttttcccatttttatgtccacttagtgctttgtcacatttgcatttacagaagataatgcccttggtgttgaaagaacttgcatcatctgaggcgacaaacaggagaaatgctgctttctgtgttggtgagatgtgcaagaatgggggtgctgcagcactgaagtacgtattcaaccacaagctgaaaatgtctctttctcgtaacaaacttttcgaatactattttcagaaggaaacatttttccttctataaggaagagtttagcatgaaacaagtttgaaagagggtcccttctttgtgcataccagaagtagtcttttaaaaaaatctgcaaacatcgaaatttgtttgcacatggatcttttgcaactgatgcttgcaaaggtttaatatttgtgaaagaataattttgcaccaaatacaattagatagtagcttttgaaggtaaggaaaactagtccaaataagatcaaggtatggggttggggatttcataatttggaaggcagagcataaatatgatctttggaatggtttaaaatctgaaaagaacagagaggacttttcagagagtgaaaaggctgaatataaaattactatttaatagcaatgaggggcaaattgggatgggatgtctctcaattaaatgctcagaagaaacttctttttttctgaggaggggttttcaggaagctttggataagggattttagaacactaactgtgggtgcaaggtgcaagggattttatgtcttgcttgaaactcctatctagtgccgtttctaggtatacttgatagttccaagtaggggtgttcaacaacagtttaaggcggtttagctggttaacccagcccagcacaaggttgtccggtttaggtggcttggtttcacgggttaaactgtttccccaatgcgagaaaaaagcagatcgagataatcaggcacattggcaagaaacaggcatggcattcgttccttgtgaggtcggcagcaccagatttcatggcggaactgcccaagaagcacggggaggcagagctaagttgcataaatcacgttgatgactgagtcgtcgaccacgcagtgacgcagctggccgcagagacgtggcgtgtcgagcactagatgaattgccgtttgccagggtatgttgccatgggcatggccatggccgacgcggggacgcagccgcagcataggcccatcgaagggttggggtcatggccgccgttggtgtttgtcaagtgcatggggatgcagccgccagggtgctcgtcgtgggcgggcgcacagtcgccggtgacctcgccgcatggggggcgataactggtgggggactcatcgcggcctcacgggtaaggggcacagccgtccgggggcttggccgccacctgagatggccctgctggagaaggaggcgactcatgggttgaacggggtggagtaaaccgaaccaaaccatgtacacaagcaaaagtgggttgtgttagtttgattcggtgggttcacgggttcgagcccaagattttggcacttcacaagtccaaatgctgcttatcccattttgcccccatggtttatatgcatttccttgtgatgtgtgtaatacttgatgacacaatcagatggagttaattattacggtgtatttatcagtcccctgtcagtgactagggtactctggatccattttttctttcatagtccaacttggacaactgtattttcaaaattctgctcgaaagaccaagaaatcaagctattgtttcttccagtgataatatgccaagagcattatccttaaactgaacccacctcgtcaactgaattgctaatgtatgtgactaagaattctgaagcgtactgaatagtctgctgtctagttgataatgaattggttttaacattgcattgctctttctatggagcttagagtgacttcccatgctgtaaattcagttcattgtttttgttaacgtgtactgtttgctggttcttattcatctttgtgcagatactacggggatatactccatggtctgcatcgtttgtttgctgattctgaacctgatgacgcagttagagataatgctgccggtgccattgctaggatgataatggtgcagcctcagtcaattccactcaaccaggttggcactctgcagtacataatattttgcataatttcagatttcaaacttcagagtgctggtctaatacgcattctgtgcttgattcttaggtacttccggtgtttatcaaagctttgccgctaaaagaagatcatgaagaatccatggttgtctatagctgtgtctgtaatttattattatcttcacatcctcaggtgattcttgttttaacctaccatttttcattcttggctttgctaatcatgtgagcaaagcccatgctcttttcatggattaaacatagccttttactgttgcagatccttcctctagtccctgatgtgataaatgcctttgcccaagtggtagtctccccaaatgagagtgatgaagtcaaaacagtagttgccaaggccgtttctcatttgatatctgtttatggtcagcaaatgcaacctatattgagtgctctgccacccgctcatgctaatgcattagcatcatttgccaataggagatgatcagcagaggaacatctatattcagttctttggcctactgggatgctttgtcagtggtttttactcactgaagaccatttgatttgccagatatttatagatctgccaaaaaccggtttggacatcttcattgggatatgaaagtggatgcaaatgctggaaaatgtgccagcagagttgtttgcgtcgtgattatgcgatatatttctgccttttgagttatagtgatcttttgttgggatggcttgtgcggtggttctggttgaaggaaatggccagcggtgagcttttgttggtcatcatcctggtttcgattttggttgcttgtgttgagtttacaattctttgctcgggtgtactaccattgctactattgtatataaacatatttctccatagaggtgtaattcttttgttctgaaagggagataattgtgatttttggaacctggttccttgtacagttgtacttagcatcagtggtggagccacttccttgtctaggggtggctgcccggcacgacacctacgtgtgccgtcgtttgttgcccaaaattcctggctgattgagaagccacttcgctgcctgagctccacgattacctttgctccgccgctgcttagcacgcataagcttaaatagtgcacacgcgataagattgccctgttttttcaggctgaaaggctggaggaatatacttgccctatcatttgagagaatttgaaggaggaaaaagaaaggcatcaaaatttcgagggggattgcctgattgaactagcgacgagaaccgattcaatcttttcgaaggaatacgatgttaacacaaaaccaaacgcccataccattattatgcccggggaaggatcataagcactagtgccctctgtaatatcatcgtcatatcattattgtgtcggggaaggatgataggctcaagtggccagtaatatctgcaaatatgttttttttcccacttactagcttaatgatatcagcatttggtcaatccggttcagggagaacttctgtttcttcttgacgaaggatttagcagggaccatgagtccatgactgtccctgcccgtgacgcacgttttgctctctccttttcgcgagtacttttggattaagatcagcaaaggcaattagctaaagccccgagcaactcacaaaacgtcccatcgattaatcaaatcattggctctgcaagcagcttttaaccaagaacaacaacacttgcaggttgcagctggctggatcataccgcacaacgtaaacactagccctctacccttttctgtaacataaatcagcttagagcaagtttaacagtatagccaactgctggtttcaaatcatctatagttaatctaatagtcaattcatataatagttaactataaaaatatattacaccattaatatccggtcccacctatcatacacacataacgtcttagaatccgtgttgtagctagctacaaatatatagcctgctttcttctctcttttttttcttctcgatacgtggttatagctggtttatagcatgctattgtaactgctcttaagttattttcctatctgtgctctgctgggtggccacgtagtccgtacgcgagcgtcaatcgcgaggcggggatcgatcggacggcggaggagggaggccagcccggggttgacacgtccaggggtagacagcagtggtacgtcgcgggggccggcacgatctcggcccggatcgcggccacctgctcgcccactacctcccaaaggctaggggcaccgccatttttggcatcccaacccggccgcgtcgccggccgctccacgcatgtgcgcgcgcgcgcgcggccggtgccttgcttcccccacgctaaactagctagcatttccctctcgtcccattggctgagtaagctactgcctagccgcatggatcatttggtacgcgtgctcagggactgatctgctatgggaacagagggggctcgagcggactatgatagtctcactgagcctcttctatgcatattgccagtgcgttgaaataataataataataataataataataataataataataataataataatattattattattattattattattattattattattattattttccgcatatatcgcccctcagtttatgtatatatttgctattaacatatacattgtcctattttcttctcacataaaataggaatttggtggtaggggtgattgacatgtaggtctatttctattaaagaaaaatgtagaaagttggtggtgcgggtggtggcaaattcgccattcatcaccaccatcactgttcccttttaaaactaaactagtatagaaatttaaaggatagaaggttgatgttttatgtaatttgttcaactcatctgttattttttttctagatccgtttcagcgcttgctagctagctagctttgaagttgtggcttactagcattgctaggtaagagtattactactagctataggtaggtatagtagtagacagtatatagtaatagtagggagggttacgtatttacgtattcctttcttggtgctttgcgtgccacgttggacggtatgcttctagctactgcacactttgtcgttctctcgtacgacgctgtatctcgccttttgctacggtccttttagtttctttctttctttgggggtaaagaactgatcggatcaacatattactttgtactttacagcctaaaaactacgacgacttgatggtattgtatctaatccaactccggcacagctagctaggttcctttttactcgctagcatgaaccgcgcaacgctaattacatgtgaacacagtgacatatagctattcataacagaatgacagaatcatacccctgcaggtcgttccctttttcgtgaccagcttgcccatgctggtacgctccacgccactacactatacacaggctctgaactaattctgaccatgcatggagatgtcaaatagatctctgataccgatcaaacctaatgtccacggggtattcgatcgtacatgtcctagtccacaagttcgacccagcagccatatatgtgccgtcacagtgaaatattccaaactatgacatgcgtggtacgtacgaacatattgtgtaacgtgctatcattgtacgaacaaacaagtgcaattctagctttgtacgtcttctctgtcttactcaattttttttatctaaaattctaggagaatgtgtttaggaatgtaagcgggcaatctcactatccatacaaaaccagtttactagtcttttttcacatgatagtataaaattttgaagaaaaaaaactagtagtagaataaacgggcaaaaagacttgcttgccggtcccacctacatccctattacatatgtatcctttatataattttaggtaaaaatgttaaaaattcaacccaccctattttaggctcggtcctcgaattttgaaactaacaagtacggagtaggtttgtaggttcattaccactcctagcagagagcaattatagctaagcatgcagagcaatggagatgagaagagagggatatgaaacaaaagctatgagatctagatgatttttttccctcgtaaattacttattccatctatcatcagattataacgttacattagttatgataatttttttttcaaaaagatttcatgtaattatattctaacggcagacatgtatatatttcgactgttgaaatttgatgttttgtatgcgatagcaaattgtttcaacatgcattttagtttgctttacaaaggcaaatattgcaatgactatttttttcaccatggtataactccatgtttcaactatggtcaactatagcgttggaccgcccgaattttcacgatcgatatgtatccgaaattttggcttactctccatctccatttgtattacaagagtctgtaacttacaataagctacatttggtgtttatcttacaatggcgtaatttatccgtctgctacaaaactgatcgacaacggcaaccttgcggacctactacttctgtttttaaataaatctgacttttatacgtaaatttgaatataatatgtttaaaagttcatttaggttaggacggatggagtatatgagtagctatacatgagagtagaacgatcgatggatcactgcttttggtagctagctgtagcggatagatgatggcagtagtacgattttgacagaagcagatgcgatggccccaggatcgggcctgtcctggtaatggcacgcaagattcgatggctttcaatccaagagggattctgatggcacctgccttggatttctttccggtcctcttgctgtgcaccagcaccgctgcgctagagatagggaatccatccacacgatcaagcgatcgatctcacctttttcccttttttttttctcaaacaatgtacagtgaaaaacaaagcagtagcaaccaaattcaccggtcaccacacgtccacacatgcccacagtacttctcttttcacacaaacaccagcaccacacagcaaactatactagcatagcaatgcaattccttttaattatcagagggaacaggaacactatgctaggtgaatatatattactgtggaaatctgaacatatatgcttgttgagcacatatcaggtgggagtgagaacagaaatgcatatatgcttgctctgttagctagcgttgtcatgcttaacaagctgtaagctcgaccatcagctggcttaggcctgaagagaccaatgctgctacgtctaagtgatcatattcttccagtagagctgaaggggacgtgaatacgactcgtgcatgctcggaatacggtacacttcgacgaacgatcactcactcactccacttccgtttgttcgctcgtctcccatcccttgctagtgtttgggctttggaggcgacacttggcgagatagctgccccacgcatcactgaacgctcctccaagaaacgtcctctgatctgcatgcccggatgatgttggttgggaatgcaaattgtggatcgctctgcgcctgtgattcctgtatatgcgcaagaaaaagtggtccaattattgtaactgctcggtgaaaggtatactaggtcatttctcctacaagaaccatcaataccagaacaaattggagcctaacaagtgtaggaagaatccactgtccatatatgttttttcaaataagtgagtgaaaaaaaattgaaatctctacatagaaaagtttgttcgttaagaaaaactccaaagctacacactttctttcgtgccgtgtaactgtcaaagctgttgtggactaccactcggcctatctgacaacaacctttttgttttcagactcctcgtacgtacattaagctttcacatctctcgggggtaaaaattctcctaattgttcagaagaaatgtacggaggatactaaacatgacgttgaacttatcaaaagctaccgcagtaccgctcgtggcacttcagatatctggtcggtgctgctttaggcccatcaatccatttttcgtggaaaaaagaattaacaggagttttagctgcaatttacatgcttctttctaaaataaattcattttctaggggccttttgatttggaggaaaaatataagaattttagaagattcaattctataggaaaattttctataaagatttttgaaacaaatgattgaatcctatcctacattgaaattcctatggaatgattgataaatcctataaagattttggagaaaatttagcaagagctcgaacctcttgaaaattttcttttgagtctatctctctcatattttttttcctactatccaatcaaacagtcatttccgtgttttgtaattctatgttttgcacttatattcctaacataatactgtgtttttctattcctatttttccattccgacgatttaaggagagcccttagcctctataatttatcccaaaataagttccattttacttccttacataatcctagcacgaggagttgtatttttttaataccctttatatctacccttccagtaatactattttcttatgaataagaagtattatgatcttttacccttctattctaatctcaactccgctggttagaaatgaagttatttagagaagggaatatatatattatctatcataagaaagagggttaaaaggagctatatatgatgttcgctatgaagattattgtgtacggtgttaattcagaatgagaaaattaaacaagcaccatttcatcgtggcgagtaatccatattatcagtatagattgcacggtatatttgtatattaaattgattttatttatgaagcataagtgttgttatcaaatttaagagtaaattttactttgggtcaccttttactactggtgttttgctttggaccaccctttaactaatattttcactttgaaccgaaaaatcttacttttgtgtcactttggagcacactcaaatcttttatctatctacgtcaaacttgtcatctgtcaaataaattgccgggtataaagtggtgggagttcatcgatgaatcggagccggcgtactcgaaatcgttcatatgcttgagaagagagttagggtagtccaaaacgcaacaaatgtaagattatctgatccaaagtgaatacgttgattaaaaggtggtcgaaagcaaaacaccggtaataaaaagtggtccaaaataaaatttactccaaatttaatttaattttaaagtccagctccaataaaattgattgtatttatgaaacataagggcatgctcagtggtagattctagtataaggtctcagacacttgatatgactaaggatgtaaccattaactaaaaatattttttattactattcttttttaaccattatgtaattgtgttcacattttatattttttacagaggctgagtctatattgagctattgttaaccatagtacactattttatctctcctctttctatctctcctatgtcagaaaatattcctaattaataaggttattaaaagttttctatcatagtacatgccttgacagtaaagaatggcgatatggcaaatgaaacagtaggcaagtccccgagaaaagagcggcgtcacctcccgcttaacatcctgacgttgccatgctacatgcgcaaatgcgcgccaattcttcatggccctctccagcgctgacacgtccacccctgcaaacgttacattccgccgtatatacaacactacgctacccacatgaagcaacagagcatcaacggctttccctcccacgatcccataaaaatccacagatgcgccggtgcgcagcaaaggcgagcagatcccgctgccgcttccgggctgacggtgcgccgcgcgcatatcgcgatccgctcgtaaccgccgatgtaaatgtttgggtcgcacaggtggggtttgacgagcggcgagagcaacgggcgcatgcagattacggcaacatgccccgttttacagagccctctgctctagtagtgttactgggatcggcaaagtttctttgcccaacacggggagtggggagtgggcgcaatcggcgactgtccctgtcagcagcgctttttgccgtaccgttttgggcagcgagatggaaagagcagaggcgtactactctgcatggggccatgggggggggggggggggtatgtgtcgaacgaacacgagctatcaatcagtcgaaatgtgaaaaattttgagctacgaaggaccgagcagagcaccgcgcgacggctgcccggctgggcgggccgtcgtgtggcgcgcgcgcgcatggacgagcggcaccggggcgaggcacgtcgcgcgatgcgggacacgattcccctgcgcggctgtgggcgcgagatgtcgggacccgagccgagcgcccgggccgggcgcgtgtacgtgcaatccgatcggcagagaccggaaaattttaagcagcgccgcaggcctcagagcgcgcagtggtgggctggtggcgcttttagccgtgccagcgcgaccacaccccccaccaaactccctgtcctaagtttgtgtcctcgttgtccgtgactcccgtcccatctgtgtcactcgcggcgcgccgacgtgtcgtcgtctcggcgaggcacgccacggacctgccgccgtcgaacccgcggatgcacagcacaaacgctagtagctcgtcatcgaggatataggcgccatgcatgcattgcggtcacgcgttcgccgggggatcgatcgcaattggcgtcgcgctgcgtgtggccgtgtgggaactgggacgggaccgggaaagatgctaatccgcgtatggtgctgtagcatttgggcggttgggccctctcctcgccctgttctgcgcgctaatcgggcatttgtcctgcatgcacacatcgtgaagagacacggagagggacgctttatgtgtgatcagatcaccgaaactctggaagggtgcagcttgcaacttgtgccatggatcagagcatcttgattcttgatttgaggaagaaaataattttgggcggaataatggcattgcaaaaagccgaacagcgtgcaacttttgcatgatcagtagtcttgtccagaccaaaaaaaaggaggtgtgattattttggaatttgggttggatatttccatagttattacctccaacataatgggaaaaacgttgaacctagcgatgctctaacgtagtgtatctgtgtatgcgcaattgcgcatgcacagcacagggtacggccgtactgcatgaacttccaagattggattttaaagaaggaaaaatgtaaagggtcaccgacacagtaagcataataagctcttggaacttgcaagcatctcgaccatacgccttctgttcgaagtcagaaaacgcagctaagcattttggtgcttttcttttatgttttctttttctttcttcactgtagcatgtatgacatttcttgtatagttgtatataaatatcatgtaaagccatcacatcatatttgaatagcaatatatgctacaatgataactctaataatttgtatcttgtcggtcaaaagaaatccatacaacataggcctggtttagttactaaatttttttctcaaaaacatcacatcgaatctttggacacatgtatggagcattaaatatagataaaatcaaaaactaatttaacagtttgcatggaaatcatgagacaaatttttttgagcctaattagtccatgattaaccataagtgatacagtaacccacgtatggaaatgatggattaattaggcttaataaattcgtttcacggtttccaggtaagttatggaattagttttttcattcgtgtccgaaaaccccttccgacatccggtcaaatgtccgatgtgacacccaaaaattttcttttcgcgaactaaacacggcgatactcgacaggatcaacctctcaatagttattttaataagtaatagaagtaaatctcaaactctatactaattttttttgttgtgtgtccacggacagagaccagagatgtaggggatgtttggttgcttactaactttgccaaaccacatattaggtaaggtgtggctgccacaaaatgtgtggctagcaaaatgctagccacaatttagctaaagttagccaaacatacaagtgtatgacatgtggggccatatagagaaaaggtgtggctagccatagttgagtcatcaaccaaacgagtgactaagaaattttggcatgactcactttaggtgtggcaaattgtgacctgcaaccaaacaacccctactaatccattttcattatgttaataaaaaactctataccaaattaggatgcactactcgatcattacactgtgatcagctgaaatgcttatttcaatcaaaataaataaaaaaaaataaagacaaacaagcagatataactagcgaactagcctaaacgaatagtgtcaccactcaccatggagaacattaattactagtagcaacttagtacgacagctacacaatgaaaagttgttaaagcttctagttctgtgcttttcaacttatttgcccgattattgaaacacctctacaacaatttttttttctcacagaactttttttattagatcacttgttttaaactatttactaatttattaattttaatattaaatttatttatataatcaaattgataatccacaataataatttgctcgacaatctatgtcaaacatggctagtctctgaagcaacagactctcttgagaaatgagatgtgaagcaactcgcattgttgacagtagatagtaccaaggcaacaccttcaaaaaaagaagatccaacgaataaaatgcaaataaaatatttttccctggaaaggttaccaaagttctaaaagaatgcccagcacaatccattgttgaatccagccggaggccaaatcactagcaaaatcattcatccattactaatctctactacttaaaaaataagtggtgcttccatcgtccgtaaaaaaaaccgagcgaaaaaaccaagcgaaaaaagtccgataaaaaaacggagtgaataaaaaatcgggagaaaacaatgtccgatcaaaaacggagcgaaaaaaaaactgtccgacccaaaaattacgaaccgggcgaaaaaaacatgcgaaaaaaacgagcgaaaaaaacccggtgaaaaaaagtccaatccaaaaaattcggaggaaaaaaacgggagaaaaaaatgtccgctccaaaaaatacggggcaaaaaaaaacgaaaagagacagtaaaaaaagggcgaaaaaaattatccaattccgaattatatgtgacacggtaaaaaaatcgaccgggcgtaaaaaaatgcagcgaaaaaaaacaaatctgtccgataaaaaaaaggaaaaaagggaagaaaaatcgaaacgaacccgactccgttgacacggtaaaaaaagggcgaaaaaaataaataaaatgtctgattccaaagaaaaaagaattatatgtgacgcggtaaaaaaatcaaatcctattatatctagaaaggtccgacactataataaagtagtaaaaaaaccgttcgtaaaaaaatgcatgagaaaaaaattaaaatggcagaaaaaagcgcggcggaaaaagtctaatttctattcgtcgttttagtagttcgtttatatctcttctttatctctaatctaatctaatctaactatttaaacagagaagtttctaccgtatattaaaaaaagatgcatgagaaaataaaaacggtttaaaaaaacacgtgaggaaaaaatatcagaaaaaagcgcaaaagaaaacgcgctagaaaaaaagttccatagtccgaaaaaaaacacgcgagaaaaaaatatttccatcgtctgtaaagaaagcaaaaaaaaaaaagcatacgaggaaaaaaactgttaagaaaaaacactaaattgataattgatagacacctggttggataggctccatccacttttttccatctcctacatgacttttgtttcgtcatctattctcatatagtggagaccctgcacatatttgtagacaattatcatactatttttatgaagtataactattattcttgataacatattatatggaaataatcttagaaaataaatatattctaattgttatttagagaagagtgcatagtgactctattttgtgtagacttgaccatacgaggcagtgtaggatttgattggttgcaagaatgagattaaaagaacattttagattatatgcatattgttatatgaataattcaattattttaggtaaagcaaacatcataaagttgtcatcatcaaggttgggctattacatttaagatgttccaattttttgattttctaattgtcatcgacatggttatgcatgaaaaacgtatattatcattatgttttttcacccattgcaacgcacgggcatgtttgctagtaacgcacgggcatgtttgctagtaagtattaaaatatgagcttgcttgttacaggtacacttgagaagtaatgttttttatttatatactagatgatatacttcatacgatgctgcgggagtttggtcagcttaacttttgatgacttggtctcacctgtgagtttttttaagaataattctagttagtaattaagttgtaattatgtcgaatagaggatatatcctacataccagttcttctaatcattacaattcttattgatttttatgatcaatgagcaggctacatatctcttatgtaagataggatcgttgcgttctttgtgatcaatgcgagaaaacaattgatcatgcgagaaataatcgggtcttcaaccagaagagcagaacatgggcggagattataagggttatgatgggtgatgcagagctttggcggctggctatagccgcaatccctcttatggtagtccctgtgaatggagaagggtcaccaaatttatttggagattaggcttttttttttcgttttccctcttgtatcttgttctctttgtttttttacccgctttgtacatacatttattccttcttaatacaatgatgcgccgcgtattaaaaaaagataattctcctcatcacccacttttgaatcctaatcctagtgggcacatcttaaaactagatgctttgtaccatcataaacgctcctaactagtataattttatttatatattttgtattcgtccggaactatatgttgtactatacgtgatttatatttttatcttataaaacatagttaaccgtggcattcatcctagacttacaacgatacattgcatcgtgtgtcctactgattatactttctgttttactatttggttgtgtctgtctcagcttttattattattatttttgtgtctgtctcagcttatagctaacatatatacaactgtaaaaggcagaacattaagtttattattattcattctttctatcaccatcgaagcaagcagcaacttaaaaacattttgctgtcaaggacgtactcgtgtgtaaattagtgaccttcacttgcgaagtcattgtgcttacgcgtcatacatcattccatccggtttgcatccttgtgcttgttccaacaaaaatccaaagaactaagtcattttcaacgaaaagaacatcgcggcgattcagacgaaattcatctactacgttacaatggttcaacttagacctgtggctgtgtacaaaactgagtttgcaataagacaaaatatagtgtaagcactaaaatatattccatgagaaaaaaaaagggggaggtgggtatcttttctaatagtagttttgtttattccctaatctttagccgtaggacaacaattccagaactgctacgctatgcacatctctatcacgattcttttcttcgattaaaaacatttctttttaactgctttgctaaaattatgtcgacatatttctggactaaatacagtcaaatacagtcagtttgacgatctgccatctaatcttcttcatgattcgtgcaaagtacatctgataagctgatcgaacaacttgctcctaagttcgcgactcctttttgctttgcatgacacgtgtttgtcatcaactaatgtaattactctatttacacagtaattacacatgtataatttaggacttagatatataattttggtacttacattgtaaatacactaaaattac

SEQ ID NO: 42778 - DNA, 5039 bp, Oryza sativa
ttttttgaaaaatatggcgtcataaatatagctactcccccttttaaaacctaatcttcctattctgcccttgtccttctcctcctcctcctaacagtagtttgggttgggttgtcccagaaaataaaatacatttgcaccatgcaattttccaagctgaaacgttgaaatggcgagaacatgcccgttttgtactggagagcgtgttacccccagctagatggaaatgggcacacaccttcccaaaatttcccaatggaataagcatatgtcatggagggtcccccacgggcggcaaaagtatttgttccctctattctagtggggtgcgtgctgagccgagccggagcacgaaagcacacaccccacaacccccccgtccgctccctacaaataccccccgctctcccgttcctcctcttatcatcggtgtgcgctcccatctgaactgaagcctcttgccatctcccccagccgagtgagtgatctctcctctccatctcttagccgccaaagcagaagtcgtcgttgtgaggcttacagctagctgcatgcgctcgcgtgtgtagaagatagcagccaccaccatcaccagacaccagcaaaaacaagagaaaaattccaccggcgaaacacggaacaaaaccgagacgcgcgttagagtctaccaagcttatctccccaaccccaccccgccgcgcagcccagcctctcgttcgtttccacagcttctcccgtcaaaccgcgcacatccgcctatatatcgcgcgcgcgtgtgatctcccggtttttgtttggttttgctccccgttctcccgttgccgtcccacgaggtaaaaactaaaccaaatacatatataaaaaaaacgcggtgctgcgacgaggacaacgtagcggctagcgccatcactcgtggtgttactgctttgccactgtactgtgtactgtggtgtgtgtgtggggggttgtgacttgtgtgacgctacctgcgacaagaggaccaagggagacatggcagtgacagtgttcgagaccgccgagcagcgactgccgtgccacgccgccgctgccgagctgggcgccgacggcgggaagaaggtggcggtggatgatgatgcgagcggcggcgggcccgggcaggccgtgctgctgctgcaggagaccgatcacggcggcgacgacgacgaccggccggagagggacgacgtgtggaacatgatccagtcgcagaggccgccggtggcggcggggaagcagcagcaggcggcggcgccgtacgtgcacccgctcgtgcggaggtcgtcgagcctgctcagccagaagagcctggagatttgcaccgagagcctcggctccgagaccggctccgacggcttctccgacgccgatgggtccaccgaccgctcgtgccccgcgtcggacgatgactccgacgggggcgcggaggaggtggccgcgcgcgccagcccgccacgcgcgttcccgccgccgctgccgtcgctggcgcggcgcacggtgggggcggtgcagatgacgcaggaccgccgcgacggccgcctcgtcgtcaaggccgtccccgtgccgtccgccacgctgttccgcgcgcagcgctgcggcgggcgcctgctcctctccttcgccgacaccgccgctccctcctcggacgaggacgacgagaacaatgaccaagaagaacccgagcagcaggccgacgaggtcgcgcacgacgaggaggaggaggaggacgacgaggatgacgaggaggaggtcgaggtcgtggacaggggcaccatcgtcgaggtcaaggtcagcacgcagccgcaggcgcgcagcaacggcggcggcagtgttgggccgcgggtgcaccgctcctcgctcgtcatcaacaagttcgtcaacgccgagccggccatcgccgcctccgacatcagcgacaccgccgccaccgcacccaatcccccgagacgcccgaccgggtccaccaccacggcggccgcagctctcgtcgcagcctcatctctgagcgcgacctcggctccgtcgggcagtgacaaccccggcggcgagagcaagctgctgatgacgacctgccggcgccggcggagcaaggaggagctcatgaaccacatgcgccgatgcgggcagctcagcggcaagctcttcatatgggagccacgcatcgccacctcctcctgagccgacgagcctcgccgccgcctcctctgctcgcttgtgccacgagtgctctgctctgctctgtttgttcgtagccgttgtaacgtaaacgtgcgtaatatttgtgttagtagcaaggtgatcgccacgtgattggcttagccctcttgtctgtgtctccttccgtgagtgagagggagggagctagatttgctttcgtttatctccatccgtccccgtgtctcgttgcatgctgtatctactacgaatttgcatgcattgcgtaccagtggttgctgctcgctaattgattttagattgtgccatgtgtctgatccgattacgatgtgtagtaataatgttatggcacaagttatggataatgctggttcatcagttcatgcgaacaaaaccaaatcgctactagatgcacgacaaccttgtgatcatcgctcaggcagagcatctatccgaagaaaaacagagtcaatccaagatgaggaactgtccaaaaaatgattagtattcttggcaccagcctaaacgtacgtcggtggctgttctgttgataaccttcggaaattctcagtgaacacagcatagattggcatgtttatactgaattaaacggataattaccctgcaactcaaagtctcaagattggcatatctccatcggtccaagttcggttaattgcattgaacaaatttagtttactcgtacatgttaggtgcgtaccagcatttgtttccagttgtgaaacatttttaggactagtcaaactcaagtttctcaatcacaatgcgtagtgttgtctatgtaaaagtcccatcaattccttcattcctcgtatgagcaataatatagatcaaatgatccgttataaaattttggtgaataaccccaaaaattaactaagccattgtgcatttgcttcgaaagcatgtgtcgttgtgatctatattattgtttattaagaggaatgaataataatatagaacatatagtagaagtcttttaaaaaatatatatttctcaaaaagagcgtatggtttacacgacttattttaagctatttgttaaatttattattaaaataattagtttactcctataatcaaattaataatatgcaacaacaatccgccatcaccaacagattctttaaacatatccaatcataaaattatgagattttagctgaaaatcgtgccttgtttggtagagctctaactccaaaatttagctataggggttaggtctggagtagaattgtggaggagccaaaacgcaactccacatctctaattcattttgtaagagcactccacccagctccgttcctattttaggtggaactgaaactgtttggctgagctggagctgtgtcaaacagagcccaagtctcaaaaatttggtagtcctatttctgatttttcgctctccacaagttggaagcgcgcaaccactcccaatctccaatcagagcagaggggtggaggggagttgaaggtgggtacatgttctgttttaggaagctaattttaagcaatctattgcaaagattcctaaaacgattttcttttttatttggaatttggggaactgttggtcagctattaataatatatttcaaactaagcctaagaaaacactagaaatgcgggtagttaaaatcctgcctatcattatgtatagtcgagtacactaccaataagggtttagtgattttaataaggacttagcgagattaacagatttaaaattaggtatctatatctggaacgtgtgttctgatgatttatctcttgaaacatgtgttaaatgaggtggggttatgggggcacgagcgtagtgtgtatgtgtgcatcttcactataatcgaaaaaggcttaattgaaagaaatcagatgctagaaaataaaatatgacaaaaaaaactccaaaattatatttaaaatttatcatagctgcttataagttgaaaggtagacgttgtgttttaaaactagataaacatgtctgtccattgcaacacgatctaaaataataaaataatatggaataatagttttataaggtttagtttttttatccactttcattagtcggttaattttggaaagggtggtagggtaggagaggtgggccagttcgttttttatagattttttttgcgcacacaggtgggagaaggacaactaccacttttataaggtagtagatatttccgatggtatttttatgataactggtattttttttctaataagtggtatttataatcttgtctcagtggactcaaatagtagatatagtttgaaccatgaagtttgtttactttgtgccttttttttaacgaaccagtatatgatgtgccaatttcattaaatataaaaaggagtaaaagttacttgtacaagtacgaagaaactgtacaaaagaggtaaggcataaggaactaagagttccaggtgctttgctcctgccaaggtctaagttttagcttcctctttgatttttactcctagctcctagggaagtgacagactaatttagactaagttactttgtgcctaatcaacttatcacactataaactcaaagttttgcttttattggtaggtgtcggtgacatgggaccgggagtatcacgactagaggcttgaggcagacacaatcgcccacgtggcctggcaccctcgggggacgtcgggcccgagggtgatgtgtgcgcccacctcttggtctccccgaagggggggggggtcggaccactcctgcctcgcccccgagggccaaggcgccccgacccctcgcgggttctactccgcgtgtatgggttaggtgagcacagcggggc

SEQ ID NO: 42779 - DNA, 16448 bp, Oryza sativa
  unsure (1)..(16448): unsure at all n locations
ttcagccagatggccgagcaagcaaaggcgcacgaccactctccgagtgtgagtggcgacgacggggagccgaacccacgccgtcgagctcgtactccaccgccccctccacgccaaagtcctaagcggggggaggcgctcgagagggtcgaaagatccgcgacttcaccgatcgcggatgatggaaaagaacggcgagatggggagcgtcgcctcctcgtctacggcgacggcagcacgccccagggcgcgctccaagctgcgggcgcgctcttacgccacccgcctgtcgtccctgacccggagtctccagcccaacgatggctggacgacgtggccaaattggtcatgacggcgcggcagcgcctagatgctggtgggcggtcctccgccaccaaggcctctggtgctgctaccaccggctccgcgtcgtcaagacggagggcacgacgagcagcagccgctgttcgccgttcggctgccactccttcgtcgactccttcgacccgggaagatcagcgtggggagcaggacgcccgcaccagcatcgagcgccggcgtaatgaccgaagtgctacccacgcaacggagggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaggcgcggggttggctaatgaacttgccacctgcatctgtccactcttgggaggatttgtgccaacagttcaccatgaacttccaaggcacatatccgcgccccggtgaggaagcggacttgcacgccgtacagcgaagggacgatgagtcacttcgatcgtacattcagcggttctgtcaagtccgcaataccataccatgcatccttgcacacgcggtaatctacgcgttcagggggggcgtgcggcacaaccgcatgctcgaaaagatcgcctccaaagagccccagactaccgcagagctttttcagctcgcagaccgagtggctcgcaaggaggaggcctggacttggaacccctccggttccggtgtggcagcttcggccgcccccggatccgccgctcagacagggcggcgtgacaggaggaggaagaagaggtcagtccgttccgacgacgagggtcatgtcctcgccgtcgagggcgcttcgcgggccacccgaaaggggaggcctgcgagcgacaaaaagaaggaggccagcgctcccagcagggagcgtcccaccggcaagtggtgcaccgtccacaatacctccctccatgaccttgcggactgtcgcgcagtcaaaaacttggttgagcggacaaggaagtgggaggaggagaggaggcaggagcgccgggaaggcaagtccccggcggttccttccggccatcggcgaagtgaggccaagcagaaggcccccgccgaggacatcgatgatggcgatgatgacctaggtttccaagagcctggggccaccattgccactgtcgatggaggagcgtgtgcgcacgtttctcgccggagcctcaaggccatgaagcgagagcttctggccgcggcccctactcatgaggcgacgcgccgggcgcggtggtcggaggttgccctcactttcgaccagaccgaccacccaccgtgcgttgcccggggagggcagattgcgatggtggtttctcccaccgtttgcaacgtgaagttggggcgtgtcctcattgatggaggagcagccctcaacatcctttcccccgcagcctttgatgccatcaaggccccggggatgatgctccggccgtcccagccaatcatcggcgtgacgccggggcacacttggcagctaggtcatatcgacctcccggtcaccttcggtggacccgccaatttccgcacggagcgggtgaacttcgatgtggcggacctcagtctgccctacaacgcggtcctggggaggcccgcgttggtgaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccggtcaaggaggttgtcctgggcgacggcccgtccaagaccacacggatcggtggtctcttggatggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaaaactgcgttcattacccccataggaacttattgttatacgacaatgcccttcgggttaaagaatgcaggtcctacttttcaacgtactactcgaatttctttgggtagccaaatatgacgtaatgttgaggcttatgtcgatgacttggttgtaaagacgcacaaccaagagactttactctcagatctagccgaaacttttgaaagtctccgctccgcccgcataaaactgaaccccgataagtgcgtattcggtgtacctgcgggcaaacttctcgggttcttggtctctgcccgaggcatcgaggccaaccccgagaagatacgagctatagagcggatgcgcccccccagcaaacttagggatgtgcaatgcgtcaccggttgcatggccgccctaagtcgtttcatatcgaggctgggagagaaggcgctacccctgtttaagctcctcaaacgctctgggccgtttgcttggacggaggaagctgaacatgccctcactcgattgaaggcatatctcagctctccaccggtcctggtcgccccggagccagatgagcccctgctactctacttagcggcgaccccccaagtagttagtgcagcgttggttgtggagcgcgatgaggacaaccctcattccgcgcacctccaccctgtgctgacttagcccgggagcgagcagggaggagaggcccccgagccgaacggtggcctaaggcccctgacgaccggagtcggccctcagcccgctcgtcagacggtgctgggtgcccccgaccctcaggaaggccccgaggccactgcgggaaagccgcatctatcgccctttgaccccgaggctaaccctgtgcggactcgacccgggggagagcagggaggagaggcccccgagccgaacggaggcctaaggcccctgacgaccggagttggccttttgcccgcttgtccgacgatgccaggagggcccgacccccaggacggccccgaggccactgtgggaaggccgcccctgtcatcctccgaccccgaggtcatcggcacagaagacgagtgcgccccgagaggccacttggacgaagagcgccccggggatatggcccctagcgaagagaatcggccccgccgaaaggtgcagcggcctgtctactttgttagcgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgggtggtaaaatgggcaatcgagctttctgagttcgatttgcactttgaaccaagccacgctatcaagagccaggccctcgccgattttgtggcagagtggaccccggctccaaagaccgtttcagtctctgaggccagctcggacccctcgcagctgcctcacaccgcccactgggtgatgcagttcgacggctccctgtctcttcagggtgccggtgcgggggtcacgataacttctccgagcggagacgtcctcaaatacttggtccgtctcgactttcgagcgaccaataatatggcagagtacgagggactccttgccggactcagagtggcagctggactggggatccgccgcctcttggtgttaggcgactctcagctggttgttaaccaagtctgtaaggagtaccggtgctctgacccgcagatggacgcctacgtgcgccaagtatggcgcatggagcgccattttgacgggatagagcttcggcacgtgcccagacgagataatatgatagccgacgaactatcacgactcgcgtccttgcgagcccagaccccaccgggcgtctttgaagaaaggcttgcccagccgtcggcgcgacccgaccccttaggggagacggacgcgcctgatcggcccccgaggcccgtcggagcccaggcctcgggacccgaggggagcactcctagctcccttagattgattgcttggatctctgagatccaagcatacctcacagataagactctacctgaggaccgcgaagggagtgaacgcgtccaacgcatttccaaacgctacgtgctggtagaagggatcctctatcggcgcgcggctaacggaatcctcctgaagtgcattcctcaggaacaaggcgttgagcttcttgccgatatccatgaaggcgagtgcggagcccattccgcctcgcgcaccttggttggcaaggcctttcgtcaaggattctattggccgacagctctcaatgacgcggtcgatctggtccggcgatgcagagcgtgtcagttccacgccaagcaagtccgccagccggcccaggccctgcagatcataccactttcatggccatttgctgtctggggactcgatatcctgggaccgtttaggcgggtcccgggcgggtttgagtacctgtatgtcgcgatcgacaagttcactaagtggcccgaggcttatccggtcatcaagatcgataagcactccgcacttaaattcattaagggcatcacggcccggtttggagtgcctaaccgtattattacggataacggcacccaattcactagtgaactcttcggcgactactccgaagacatgggcatcaagctctgtttcgcctcgcctgcccaccccagaagcaatggtcaagtggagcgcgccaatgcagaaatcctcaaaggccttaaaaccaagaccttcaatgttctcaagaagcacggcgattcatggatcgaggagttgccagcggtgctctgggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagcttcgcagagatgacctcgactacttggaagaacgaaggcggcgcgcggccctccgagccgcgcgttaccagcagagcctgcggcgctaccatcagcgccaagtccgggcccgatcactctgcgtcgacgaccttgtcctacgccgcgtccaaacgcgtgctggattgagcaagctctcaccaatgtgggagggtccgtatcgagtgatcggtgtcccccggccgggttccgtgcggctggccacgggcgacggcactgagctgcctaacccgtggaacatcgaacaccttcgtcgcttctacccctgagaagggggggggggtcgggtctcaggtttcgggctcgggccaaccccgcacccccccctcgggtgtgcagggctggccgggggctaccacacatgcacattctcatttctcttatttcagtatttcaataaaagcagtttcaatttcctaagggctgtatctgtgccgttttttcctttttgaagaattttgacttgaaataaggtcactcgtgctcaaccttgccctcgggggctcggttcggtcagctaaaatcgccaaacggggcccagaaccgagccgtgccctggggcgtggtgaactccgggggggaatcggcaaaaacccacaatcgggtcacccataaccctcggtcaccacgttcccggcctggccagcctcgacatgtggatctccccaggcactagccccgacccgcgcctttcgaggactgggacttgggcacgagtccttaaatcaagctaagacacaaaaggaccacggcacggatcatcctcatctcatttgtatagcagagtaaaattaacacaaaaattttcatcatttttgattgcagattaagttgagctatacaaaaaagagacctgaaggccttagaagaaagaaaaagaaaaaactgaaggggggctcaatccgatgcgcccgggtcgccggcctcgtcgtcactgtcgtctgcaccgctggcgtcgccctcctcgtcggagttgggggcgaacgcgagccgaggggccgagccctcgaagctgtggacgatgtggtcggcggcatcccggacctgcgcgcgcgcgctgtcttcagtcccaggagggaactcatccagcgccatccacggagagaagttggggtccctggcctggtagctcgccaggacgagctccaccgctccttgggcgaggtccctcgaggatgacttaattgtcctctcgagctcctcggggagctgctggagagccccggccatcttcgagaggcgctgggcaaggcctccctggttggcggcagactttattgtctgccctctccaaaggcccacccgccgacctgcacggtctaggcgggagactgcatcccaaagcatgccgggccctatctcgcccgccaagcggagggcctcggcttccccggtggatgagtctagcgcgcgctgcatgtcggcgatggtgagttcggcagctgcgaggcgggtggctaagtcactttcgcccgcagccgccccaccgctgcgtgccctcgagtccagctccttctcccgcgcctcgaggtcagcggcccgctggtccagtgcggccctctcggcgcggacacattctagattgcggcgtgcctgctccgccagcgctgcctcacggagggacaggctgtccgccaaccgttgcgccgcggcctcggcctcttcgagagctcgctcccgctcggtaagcgcgtcctcgcggaggcggagtgcggactcctcttcggcgcaggcagactcgtgcgccgccagcgttgcctctcgggtggtgacggcggcctcgcggtctgccaggtccttctccgcgacgcaggcgcgctcttccagcgccatggcgcgcgcctcgagggcctcttcgcgccgccggagcgccgcttcggtctccgttgctcgctgctctcgggcagcggcggcatcaaggaccccctgggcggcgtcgagctttttctttagctccgcctcccagctcccgtattgaaggcggagggtgtcctgcgcctcgttcatcacggtggtggcgatgagggcagccccccgctcctcctccacctctcgagcgatctccgccagtgccgtcttacgggcttcaagatctgagacatgccggcggtgtgccttgcggcccgcttccaccatggcctccaccgagcgccgcccctcctcgacacgcgcccacgcggcgtcgagctccgcacgctccgcctgcagggcctccacctgggcacttaacccatccaacaccgcggtgtttgcggcggctaaggcctgcagaaggggctcggcgctcagcggggcgacggaaggcgtggggaagagctgccttggtgaagatgccgcgcggctcggcccgccaatggacgtgccggactcggggatgtcccccggacctgtttggtcctgggcgtcgcccgaaggagtaggcccaagcgatgcgcccgcggcctcgtcgcgagccaccccagaagctgtcgcctgaacgtcgcccgaggaggtgggcccaagcgacgcgcccgcggcctcgtcgcgagctgcctcggaagtcgccatcgcctcagcctggcgagcccgggcggcctcctcccgagcggcttcttcggcttggcgagcccgtgcggcctcctcccgagcggtatcctcagcctggcgagcccgggcggcctcttcagcttcccgtaggcgatctgcggcctctcgccggtcagattctcgcctccgtgcctctgcggccgccagatcttcggcctcgcactggccggacttgggatggcgggaggaacgcgacgggacatcactgaagcggaaggaaaaaccagaagataaacaagatgggtaagagaaaacttgcttttgggatagaagaaagacggtcgcaatgagcgtgggacgaacctgcgagggggtcggttaaatgaccaccttggaggggaaatcaggtttccccgggatggttctgtctcccccatcttgcggagccgcttcttcttgcgctccccctcgggctacgatgttggcgcggccccctccgggcgcctgctgctggcacgcaccgccccgccccctcggggaggagatgggagaggtgttcctcccagcttcctcttcccccgggcgtcggtagggcggttgctccccgagcccccaacgcggggcccagaagcacgaccccctcctggggtagattgttcccctcggcggctcccgcctgcgccgtcatggcccttaggagcctgctcctctgaggccccaaccgccgtcataatggtcaagatggaggcgcggtctggatcgctgcagagggggaggattccgtggggaatgagggacgcctcaacggagttgagattcagcacccgttggaccaatatcttgaagtcctcgggagcccaatcccatctgactccctggtgggtccgcatgtagtcttcggacccggtgtactcccaggcgccccgagcgcgccgctggagtggcgcaatccgacgacggagatagtcgccatacaccatggcccctgtgagcccttgggatcgcaggcccgccaggcggtcgaggacggcgtcatagccatcccccagatctaccggcgcccgccagctggaggcctgcgccgggggctggctcggaagtcggaggcgcgcttcgtcggcgaggggggtgtagaaccagtcgctcttccagtcatcccacttcttgcggaggacgcaggggatgtagcggttcaacaccggcccccgcggcaggaagtagcacccaccgaccaccgacggtggcgataccgactgcacggtgaagaaccaccggaacagccgaagagatgggcgcaccccaatgaacatctcacacaggtgcgcgaagatggctaatgtcatcactgcgttgggggtgaggtgcgccatctggagatcgtagaactccaggacatccatgaagaaagaagaaaatggcggaaccagccctgccattgcaaaggggagaaagaagacggaccgccccgggtagtctggcgccgggcgtccctcgcccagcatgactatctcacggccggtggcagattccggcatgaagcggcgcggcaacccagcctgcttctcgctcacgatgcgggaaggcggtagcacgctaccatcaagcagtgcggagccccgtgccatggcgccggacgaagagaagatggagagcgagcgcgtgtggcgaaagaagggcgcagggaagaaggagttagggcgcaagcggcgaagacaaggggaatgatggcgaaaggaaggaaacaaatcccttccccagtgcctttatacccttgccaatgctgtgcccggctcctcgtttctcgcgcccattatttcgccccctcgtttctcgcgcccacgcttccactaatcccattcgcccgcttgcggcgcatgaggtggatatgcggttgtggcggtcgaggtagatcatatcgtgtgcgcgttgattacgctcgccgaccgaagcgccatcacctatctcctggcaaagcgaatcggctcgtccagattcgtgtactactcgagtaatgtgacagtctggaagagaccgctcattactgacagccgagttaccattgccgatgtgcgtagtttgtgaccgttgggtttctgcctgtttgtagaagccggtcctacttgtcaccaggctttaggggtggcgtcacgcccgaccgcttcccttgaaaagggagatcgccctggcataacgccgggggctactgtcggtgacatgggaccgggagtatcacgactagaggcttgaggcagacacaatcgcccacgtggcctggcaccctcgggggacgtcgggcccgagggtgatgtgtgcgcccacctcttggtctccccgaaggggggggtcggaccactcctgcctcgcccccgagggccaaggcgccccgacccctcgcgggttctactccgcgtgtatgggttaggtgagcacagcggggctcacctaaccgcatttattgcggctcggctaaatgtgtcacgccgcacgaaatacagtgcagtgcactcgtttgtccggtctgtggccagtcacagaccggtcagatcgcaggttaggaggcgacagtcggtctgacgcacgcttcgccccatcccgtcaagacgagagcttctaggcactcgtccccagctggagctagcgtgttacctcccagagatggcacgttagccccggtcggatatatgccaggcttcatcctaaccattacaagcaagatgttgtgtgaagaagggcaaacatgcacgttgctaagctgacgcgtggtggacaagaatgaccgatttgtgaccggtctgacactgatcatgtcatcggcagacagccacgttcccacgacgcgcctgcccccggcagaagtggaggtaggtatgtgccgtcccgtcagaaggatgttcggagggcaaccgtgcaaatctccgtccatttatgaagagaagaaaagtccagtttggaaagagaggggtgcatgtggtatccccttgagatataaaaggaggaccttgcccattgagaagggggggatttttggttttttccagagtcggaacctagaacaagggggaggttggctcacactttgtagctccttcatacacagatccaccaaaacacaggagtagggcattacgcttcttagcggcccgaacctgtatacatcgcttgtgtctcatgctctttcgataggtcgcgatctttccacatacagagagagcttgggatttcaccctgagcccccggccgaaccggcaaaggggggcctgtgcggtctcccggtgaggagccccgcgctccgtcatctggcgcgccaggtagggggctcagcgtgtgtcctctgagctctcgcactctgccctgtgcgccaagcttttcctgttcagccagatggccgagcaagcaaaggcgcacgaccactctccgagtgtgagtggcgacgacggggagccgaacccacgccgtcgagctcgtactccaccgccccctccacgccaaagtcctaagcggggggaggcgctcgagagggtcgaaagatccgcgacttcaccgatcgcggatgatggaaaagaacggcgagatggggagcgtcgcctcctcgtctacggcgacggcagcacgccccagggcgcgctccaagctgcgggcgcgctcttacgccacccgcctgtcgtccctgacccggagtctccagcccaacgatggctggacgacgtggccaaattggtcatgacggcgcggcagcgcctagatgctggtgggcggtcctccgccaccaaggcctctggtgctgctaccaccggctccgcgtcgtcaagacggaggaccttgcccattgagaagggggggatttttggttttttccagagtcggaacctagaacaagggggaggttggctcacactttgtagctccttcatacacagatccaccaaaacacaggagtagggcattacgcttcttagcggcccgaacctgtatacatcgcttgtgtctcatgctctttcgataggtcgcgatctttccacatacagagagagcttgggatttcatcctgagcccccggccgaaccggcaaaggggggcctgtgcggtctcccggtgaggagccccgcgctccgtcagtaggaaaatccattttaatgcatgggctatttatttttgccggaatgaccgaaggaggtcattcaatataattaagataggaagaaaatgttacaagaaaagttttacatcgacagctggttgtcgagaaagtatgtgcactagagcacacgcctcaaaccatataccaaccgcccaaacacatgcttcagaaagggaagccaagcaccggccatcgctatgcgagaccgatcgccaccaggccaacaacaccactacgacacgaatactctaaaacgacgctctcacgagggttgcgacgatgcatgggctattttgctaatcattacaaaatctcaaaattcatcactaaagaaattatatccggctctagtgttaccgcagcaagcacaaagtgagagtaataattaatcatcatcctgtctctctagccaagcgaagacaaaaacagaaaggcaaagacgaaggggatcacatcctgtctttccagcctcaactgttccaccccattacatgaaaactgtccatcaacacgcacaaaacaaaacaattcccccagaattaaacaggaaaacccaatgtgtttccagcacacggttttcagttcagtggatgtccaactccaaagcaacgccattcagcagagtgcagagagaagcagggcgatcgaaggaatcagaatcggaatccgaatgtaggagcggcccgcccccggagtggaacgggacggaatgtcccccgcaggtgccacccctacgaaccgtccaaaaccatcgcgagattaagctgctcctccctgataaaagtcgcgaaatccggggaccattgccggaaagccgagcttggaataaaggcctagctagtacgtgatgagagacagacagggagagatctttctcacgtcaattacatccagccagtcaggcagaacagtagttctcgatcggtagtgagaggtgacgcactggcgctaatcttctcctcgagcttgctttgctggctgcaggctcgaccgtgccgtgcggtgccttgtgttatgttgtgtttgtgtggctcgcgcttagctagctagggcgggctagtgcatgcaagcttcgtgcgagattccgacggcgatggcaatggttatcttgaacagcttcgacggctggcgctgccggccggctgcccaatctttccgccggaaatgacaccatgacagggaaaaatctgaaattcagatgcttcacgaggctgtcactcgcactgcccccagtgatggcactgtttctcctctgcgtgagtgaggtttacacggcgatggggttgtgatatactcgagttgatcggcggtagacgtacgccaatccttgtttatccctgtccgtttcaggcatttctaaagcatgttccaagatgtgcaaatatgccggcatgtacaacttgcggcagcagtgccgctttcgaatttttgatccgaagcaggaaaggtcccgagtgagtgagtgacatgcaagccaagcgattcagagaatgtgtgttagtcacagtaattaattaattagatctctatggatagcctttggattttagaagcattatattagctgtgctcgtttacaggtcaaaggttcactgctcatgcgaggcactcagatataattactctttttttttttcttatgtacatcgactatggccagtctaggcaacagtctcatcagggaaaaggctaatgcatgatacacataaaaaccttcactttgcaacgctaattggaggagaatataactgaaagagatggcgagacaaacaggagagattgcgtaagggctaagtgactgctgctttcgacgacaagagcttttggaagagagagcaacatggccgtgatgatcagtagcgataacgaactcgttttccttgctacagagcagaagcaggaggcttcaaagctatagttgttttggcaaacaaaagcgtgaacattggacatcagcaagcactgcatgcacagctggttttccagtggttacagatcaagactccagaggatgccctagctctatccagaaaagggcctcaactgattgcatatcaaaagtgaaaaaagtagaggatctaagaggagatttgtcctgtactaaaaacgtctttacttgaagaatagtgcggaattgattacaaaccagcctgaactgtcagtaattcaacctgaaagcaaaaatttctggactcagcgaggattttcatttttagcatcaattatctgaatcttgaaaatagcctttcaatcttcttcaacaggcccaaagatggttatataatgttctttgtgagaaaataataatgcactagaagctagggcgggtttgtgagaatctgcctaggagcaatatttagtagtgcatgccccatcaacttgcaatggtattagtaattacatgtatgaggcaaaattagtactacatgaaaaggcaaagaccaaaaggaggcccaaaagaagaaatatggaggatgcaaagcaaagcagaacaaaaaggaaaaaaggtttatgctaatgacaggaaaaggaggaaccatatgcttctgatgctaggtagtccctacttttgcctatttaaccgaataagcagtgttctgctacgaaggataaagaaccagtatttcagtagaattcctacttcagcacttcagcagcacttcctatagtcttacatcaggattgctagcctttgtcgggttaatttaagaatagccgtatcatgatgcaaattcacccatatttaattgggattctttgatatgcaagtggaaataaaagcatatgaagaatgttttttttttttctgctaccctagttatcttgtctaacggtaggctgtctgaaatgaaattttgtatctcatcaactagggcaacatgttgctttatgtccacttgtaataagtgattttctttttctgtatttcctggtatagaggacaggatatttattccattatcttaaaaagaaaactaatcttatcacaccaatacatgtccaactcaagatgtagtatgtctctaacactattgggcagaaacattaccaacagaccagaacatataccattctaatatgtgatttgtgaatgaaatacacagtacatgccattttgttttttcgagatagtgattacagatgttttttttatttttttttattaaatgtggattttctgatggatacttaatgacagaggcaacatataagtattaattcatttcttccaccattttatgttgagccccactacggtgctctctctggtagtatagaaagtaatctgaactgttgatctcatttgattgaagggtacatatctatttatactaccaccccaaataactgtagtagaaacatggtggagtattattgagaaaaaaataggtacaaagaggtataatcgttatttagtacctttttttctcctttgtttggcttatttcgatggaatatgagcgatgacagcgtaatggatgaacacatatcgatctagtcaaatatatatatatatatatatatatatatataaatgccaattacccctaatcgatatattagtaaattactaatttacccttaataatgaacggatcaaatcatttctaccggtagtataatactactagtacaaaacactagagcatcactagcaatggcggagcacacccagatctaacacgtcggttgtttattgctagggccacggttgatgagtgacaacacatggtgaatgcgtgccaccctaatgtttgggaccgtccctaagactttgaggtcctgtgttaaaaatacaaaataagaagtcttatatatatggcaannnnnnnnnnnnnnnnnnnnnnnnnnnnnnnnnnnnnnnnnnnnnnnnnnnnnnnnnnnnnn

SEQ ID NO: 42780 - DNA, 16780 bp, Oryza sativa
tagtaaattactaatttacccttaataatgaacggatcaaatcatttctaccggtagtataatactactagtacaaaacactagagcatcactagcaatggcggagcacacccagatctaacacgtcggttgtttattgctagggccacggttgatgagtgacaacacatggtgaatgcgtgccaccctaatgtttgggaccgtccctaagactttgaggtcctgtgttaaaaatacaaaataagaagtcttatatatatggcaaatacaaatttatagagtaaattttatttaaatccatgtacatggataaaaattacatgaatttaacatgactaatgacagctagagctagctatacaagagctcacctgctgataaaggtggagacaatttgcctatgtaggaactaccgaactagaaagaagaatcatgttctgatggagtgacttagttatctttgttaagaaaaaaatggaaccttaattgcgtaaaacatacgttcacatcatcatcacgagtttcaattctttgtggctataattatcatcgaacacttgttatacctgagcaaaacaaacccgttctagctaaacaaatgaagagaaatagaaggtgatccactctgctttggggggctccgcctccgtcgaaggacatattcaattcttcatgttagttgtatataaggtgtcctttgaaacacgggagttataaaaattttataggattagttcaattctttaaaaagattttttttcagaaactttgtattccaaataagcgctaacatgcttatataaaaatgtcagatccaaaggtgcatgtcaagattcatgactccatcatgttccaaacttacaactcctgtatatatttataacagaaggtgtacaaaatattggaggagatgctgtcgatcagaccggagagaatagcctcatgcagagtaccgaacgaaggacagcttctttatgttctctttattagttatcccgcgtttaattggaaactttaattatcacccggaattgggggaataagatccatgggaggatcatgcatacgtacaaagtccgtgcatgtcatgaccaccaatctttcatgtggtttgccaaatgacaaattgccaattgccggacgaataactaaagttctacgcgtaatgcgtatataggtgttttacaggtaaactttagttagcagctgaagccctgcctgcgtttgcgtggcccccatttgatctcatatggtctcgcaataatgacaatcttttgccaagcttctttgtgttgtgccaaaaggatgctagctagccaatttgctaaattttctatgctttagtagctagctgctagctaactgcagcttggaagattgtatttgtcccctgacggatgcatatttgcattggcttgttttctctttttttttttcatattattcaccggattataacgtcatgctgataataacgtcaagctgataaaaatatactcccaaaacaaaatcttcttcgattacacgacaaatgcggatgcatacacaccactatactatacatgctcaaatagatgataatcaacaacacatctctgatctcactaaaaatatattgaaagcctaaaataatgtgtaatatttgtgggtactaggattcgaacctctgatgggtaaagtcatgcatgcacccacgactttactagcacatcattggacattggtgctttcttaaaaaaataagtcttctactgtattgcctagatcacatgttttaaataatttgttaagtttatttatcaaaatatttaagttatccttatagtcaacaaaataattcgaagaaataacccgcttaataatttgcttcaaattaagccaagtttaaaggcgtatcataatattttggtctagcttgcaagtgtttgattgaatgtggcattttgactaactgtatttgttagacctccatcacatatagcatatattttttccaagctttgtttacaatcgtggctaaaaaattgttcaccacgccttttgtttcacgccatactttggctaattatttttagcaaggttaggcttcaaccggacatcctctaataaagctaaaataatatgctaagcttctcgtcaatcacctttaattacatcgacttttcgtgatgtagcaccgctaagtgtcttacgactattcccaacccaataactaggatggtgtctatagcattaaataggctgccatctagaatgaaaaatgatgtggcaagtgaataaataagaaaagaaaagaaaaccatgtcttgcatgagacatagtttctacacaacattcaagacatcatgtgagataagtagcattaaatttaagtatgaatagtggtgtttgcatgggaagagtagtgtctagtactagtttcttgatgatgtggagtttatgaaaactatgtcgttttgggttaggaatggcctaagagcaagtttaatagtatagcccactactagctccaaataatctatagccgatgtaatagccaattcatacaatagttgcttacttattaatacatgatcccacctgtcatacacacattacgtcttggagtccgtgctgcagctggctatagatctgtaacccgctgctcttctctcttcctttatttctttaaaatatatttatagctgacttatagcctgctattgtacctgctctaatacaaaacattgtactttcacgaatattttgatattaaagctaaaatgtccacgtagaaacatataaatgtacgcaaggcattattttccattaactcgacctttaaactagtttaaagctaatgctaccatgaggttcatgaccaagtggtgccttccctccatagaacccaccaccaccgtcttttccaaagcaatattggaaaacccaccaatggcggatcgacacttgctcgtgacgcctacccgctacctgacatgtgtgtgcaaaagccatagaaaccattcgcgcctttttctctcccttttctgtgcataatatttgccgatctccgagaacgaaccggcctcgagcgctctggtccaccgtccacgcgcaatggcggctcacggatttgtggagctttggctctcctttccgcggagcaatcatagcgaggcgttcgttcgttcgttcgtgcggtgacggccggtgcagcgagctaggcgaaggcaagaggcaacgattcggtcgggtcgcgtcccctcgcgcgctgcttttttccgagcgttttcgctcgagggccccctgcatgacgcgcacgcacccggcgcccgcgacggcttcggctttgcgttgcaccgtggcccacgggggggcgggggggggggggggggggcaacggccaatggtggtgcggttgctgccgctgcgtggtgtggtgcgccgtgcgcgcgtctcgctcgctcgcgctcccatccaaagccacgcccacgcgcgcgatgatctcacttgagagggcgcgaggcgcgacgccggcaggatgggatccacagggcaggtggtgacaggctgtgggcatgggccgggcgggcggcctttcggggcaggtgcgttgggtttacgatgcgccgccgacggaggccgcgaacgggtgattctggaactggaaggccgaataacagctggccaacttgtgcttgctccatccagcagagccaaatattagggcacccgcaatggttatctataggctctctacaagagatctatgtcagcatattttcctacttggaagagattaaatgaagagagagagcaaagctatctactaatctggagatagtctatagaaaaaaacgaggcaatggattagagagctatagatacccatgtagacataccattgaagtggtttactattaatttagtctattgctgagatgtacatgttttataaatagcaccttactttactattgcgggtgctcttagtactattattttagtgaaggggatgccgggatggtcactcgtgatgcttgtcaaacctggcttcttccaggatgaaacgatgccgttgctggatgtgtggcagtgggacactatgaccaccgcaaagggacggacaggttcggctgtttaggtattggtctctgaaactgaatgctcgtctttcaggttcaggagtgtgacgaacgaacctgaggtgtgacacgttgttgggtattggatacagcgcaacgggaatcaagtgacacggcgtgtaggagagaacagttggagcccttgttttttgacgagccctttcccacagagattgacggtggaagtacaatgcgtgtgctcgagaactttcgcatttcccagggtgcagctgccacgcctgactaggatcgtcgatggcatttgcatgattgcatcttcatccgaagtctcgccgttgctgtccagttgctgtgtcgtatactcatatactcctgacttgccgtcagaaatggaggtcaatttgtccagttgctgacttgctgtgtcgtataatcgtgtgattactaaaaaaggcaaaacatcctgcctcttttttatcggaacaaaatatcttgacttgttccatcatagaggacaactttgaattgcatctcgtcatgccaatactatgagctacctatccacaggattgaataaatcaaaacatgcatgcgcaacctgcacatcttgccgtataaccatgctcccagccttgcaccatcacatttgcaccggggagcgcaaagacaaatccagcacaatttctccgagaaaatcgaagagaccaaagcgatccaacatacaagtgttagctgaatgtttgaggtgcgaacaaattggagggaagatacaaaaaacttggcaagtttctgggctagaaaattgtggcttctaaatctaaataagaaaatgacagtactatagcaatctctacccagtaaatgtggcagaattgtgggagctcgacagcccgtagttgcatcgtcgttacggcagcatacaacgtgtgttaaaaaagcatacaatcaacaagtatttgagctacacaaatcgtgaaacatattggcattaatttacattagactagatgaatcccaatacgttattgtaagagtttattgtgataacaataagtaaaaataatatgtaagataatatagacaacatatgcttacacaagtttaagcttacataagttgatgtgatttattaaatttaaatattatatagaatgatgatttaaatgtaaaagtaaaatgatgttgctttacgagagaacaaaagaaagacgataatttagaccatacatctaaaggctaaaaaaatgagataatatggcttagcgagagaaaaataagagagataatttaaaccatagattaatcatctaaggactaaaagcaattgatgtaatatgacttaatgagagaagagaaataacattaactaagtcagcatgaactatataggtatatgggatattatagaaaatgatgaatagatatattaaaatattatgtgaattatgtgggatgatttaacatacttgtattttaaatctctaaaattttaaaattataaaattatagataatatagcatgcttacataatgtttagatgtaataattattagtggatgataatgtgacatatttacatgttaagctttaggatttagtggatcataactctataataagatgataataatggaacaatgatccgttggagggcatttcagcattcaattcgatgagtttctttttcacatatttttttcaacattttccaggaatgtgttatatccaagaggtacattaatccaatacaactctatgtagagaacatgaagccattctgctaacaaagatgtgttatgttccctgactacagtgggaacacggaaggcataaccgaaccttacagcctgccaggagctttgataggataaagcttagatcgggtaacaagaagaatggttactgtatatatgctttggctgcaaagactaacatcattcctcttaagcacgcttcaccggcctctgaacataagatttgttcggatcctcggtcttcagctttgggggtttgatctcacctttccttgcctataaaaggggtcagtaagttacaaattaatgcataacaagatacactagctcaagtgcactctctaaccttctttcctgtcttcataaaatccctccagctagagacctacaggccataaataaattgatattaggcagtacccatggcaggtaatcaaatctggagaaaaacaaactcatctaaggtctcattcttacattgtaaaatagacacgattagaccacattgtactggatttgggtgatagggaatttagggcagatctacaaacctagcataatggatgcataaaaaccactaatgcaactcatggatgcagcctcatgctttcatacgtttaagctgagaaaaaaacatccacggtatcctgtgtgaaccgtatcagatggaataggagttcacaagatcaactccttgaacacatcctaaagttacaagtggatctcatggttgagccacactatgcggcagcagcagggatttacaccagcagcaaggggcagagcactaatatacaacagtgggggaacggcattgggagatgagcaggatgaactggtgctacggcaggcctaacatgtgcaacagccagctgctgcgtgtggcaagcgggagacaatcatctgatgtgagtgggccttgtaggcaagcacatagatggaagggcaccaacaggggcagaggcaggcctagggatttttggctttgccactgggcaccaacacacacattgacatctgtctgtgaggccgagcatgaccttgggcagagattagtagacaaccagccagcatggatagcaaggcaatcaaataagctaaggtcccctttttgtgaaactcgattggattttgaatctttttatagaacttgacttttttttcacacactcattttctgtattccggaacagaatagaaacctccattttggaactcaagttttatattagaaagtaactgaagcactaaattatgaatgtggaacacatgacaaaaatatcataagggtgaaaacatgattatcaaattaaacaaagaactgcgagcttactcgttggtctctggtctcttcccacttctcttcatgctcccgcttcttcttccacatttcttttgtttcctcttcatccttcttcagtcttccttcttcctctgatatctgtaggagcacatgggcatagctcatatcgactgtcacaatcaatgatatttaaaaattttaaagcactttatttaccctcatctgcattttcctgcgacgccactctttgtctgtcaaaatttcacgaactttaattattagctgcttctgaaattcttctgatcgttcatactgctcttcatattttccctactcataggcaaaccaatcagtggacgttctcaatttttcaacatgaatgaggttcaatatgatgttacaagtgacttgcaaaagtcattttggcaacatagaatcacacattgacacatatgttgtgcacaaaggaaaacatctgatatccaaacgtacatagctgttgaaattccagcagatggctctttcatgatacatataaagtattttgtctttctgaaaggtttttgttctttatatatctataaagttcaatcataagcatgtaatgactcctaaaagaatctattactgaatgtggtcaacaaacatgaagcatggaactacaaagtcgtcaaaatttcagcaaatgatctttttgtcagagtgcgcatagaagcttctttctttcagaaatttttatccatattaagtaagaacgaagtcatgaacatccaagctcataaaaataaccttccgcgggaacactaacaagcagtcagcagccaccaaccaggttgaccattgctgactgctggttaaggaaatccctgcagagactggggtttcaaacttcagatagtttacacttcagagttggccaaaaccaaaaattgttccaaattacaccaattcaggtttagcatattattattacacattgatattcatatggtactcagcactaccaaaaaaattacgattaaagtttacaccaccttgcatgagattgtcttacctcatctacttgggactttatctttgacgcgctgtctttcttcagctcctttttcctctttgccctcagctcttctgaaatttttaacacgtaagatcatcaaatttgctgcaccgtgccctttatatttcattgaacgaattacgaagctcaaatagtatgaattaatagtgtaatacaagagcaatataaataaaatcacattgcaccttttgcagcagtaacttgatcaagaatatatcctctctcctgtggatcaagtaggagctgctgtgcttttgccagagctgtttatgacgaggtaccatcaattagatatacatccattgagcaagtgagaagcaaaaaagatgtgacactggaaatcatatgagttgtttaagagcaaaaaagtggctgagtttagtggtagaactagctacagaagtcaaactcctcagtaagagatagtgtaggcattgcattttattgtttctttttaaaaaatatctcttataagaatattaaaaactaactccaaggtgattctcagttactggcaaagccaacaaaaagaatgtattcatttccggcaaaaaaaaaattccatcaaagagtgattagatttgacatgcaatgatgacactcccaatcttgatatgtagaattaccagctaactttgtttattgtcggttaaattatcccatgactgctgtttcaaaatgaacccaaactctggcctatagcaatacagtgcaatgcttcttcgatacatgtatgataacacgtactattatcattggacatgctacacagctacgcaactggtgttaatggataaattgcatacctgcgaaagcttcttgtgctttcggatgcttgcatttatcaggatgaaccaacaaggacaactacagatggtacgaacaaacaacaattagatctaaaaaaaggattggaagaaaagaatcctttcagataaatggctcaataccttcctatattgcttcttcacctcatctgctgatgaatcaaatgacaacttaagatgctcgaaagggtttaacttgaagcaaccaagaatcctgataagttttgaatatgttaggaagtgcaggcagatgtatttttttttaaataaagtaaatcttatgtcaaattcatttagtttttgcactgataatttccacgagaagaaaaggtattcaagaacacagaaagcgtgtagtgtcgtcacagtgcaggtttatttttctttcttttgcaacatactggtttccataaagggaaacatgaaatcccagctaaaatcgacatccatgagccactgaattcgagagcaggatgcagacaactgattatggatgagagccaatcgtacgactctaacctagggttcaagtggaaccagctggatcccctaacccccacggaaattcagcaccgaggctgcttctacatctgctgcatcacacgccgaacaattccggagcgaacagtgtagcacggctggggatctgaagctacgccgatgcggacacggatcgaaaccgctctggccgacgaggggggaaagggagggagagagagagggggggggatttacctgagcacttcgttgtcgcgttcggcctcgctgacctcggcgaggaagctcttgaggagctggtcctcgtcggcatccgtcgacgccatggagggagggcgaaaggcggtcgctccgggaggacgacgagacgaaacgagagagcgcgtcgcgtggagagagagagccacggagaggggagagacgggagtcggtgacggaacggacggtccagatttcttgtgctcggaagataccagagacatgccgggccgggcggccggcgaccgctcacatgtacagttcagcccagattggggacggcaatgtactctcctgaactttttggatggcccaaagtagtgtgggaagaaagaggcccaaatcctcgacaaaaagatctaaacaaactcccttcatttcatatactagcaaaatgactgtgtgttgcatcgggtgcaaaaaaaaaattaatacacagttgaataagatgatgcctcacaaaaacaaagtaggaatcatgcaggtttatgcaatctttgtgtgtgcacgggaccctgcgcttataccagaacttacgctctatttcgtatcaacatgatcttcgtgatctaattttgttagagcgacagaagaggggaaaatgctacatttctactccctccgtttcactagcatttcccatatttatatgtttagattcattaacatcaatataaatatgaaaaatgctaaaatgacttacattgtgaaacggaggaagtagtataataagtcaattatgcacataataaacaacatattaatcctttttattatttgtctattgttaacgaccaaatttggtaagatgtgaaccaggttcaatattaagatcgaggcggattcgatgaagagatcgattcgaataacagagtatgcattggctgcgaagatattggctggggtgtacatcggctggaatggatcggacagaggatagccgatacacccgatagaggtaatgcaaccgattacgatgaagacggtttcaaggttgtttctagaatcgttcaaagtgctttatagggattgccatgatagagataaagtttaggcaattgtatctattaattatgatattttatgtaatttccctagagatatgtttgggcaaaagtctgccgcaaagacttgtggtatcttagagcttcttagagataagtgtcgtgtccggcaaagacatattttgtatcttaggtataaatagagcccgaagctatgtaatcaaacaacacacgttcaatacaatctcggtgcatcgccaccctttttactttcgtttattttcgacgagttcttgctttcgggttgagctgcataagtttcgatcttcaactagaggtaaagcttgttatggcggcttgcgttctcgggattagtgcttccatctttatgatactctaatcttgtttatgtaattcgtcgagttatcatatatcctatataatcgttgacaatatcgttatttaaccttcaatcagctaacatctatcattggacggcagccgattaggttaaataccaatgttgacttagattatacaggatatccaccatcctatgaaacatccaacggcttgattgtctagatattatccttcttttcatacttatagctgcatcagttgagtttgaccttataagtcgtgattagaatctcaatctctagcctgctttttggttgctgattagggtagtattggagtttcagccgatcttacttgatttaactcttttatatcttatatgcttgattgacatgttaaatctgccctttatgttaagatcttgtcgcatttaggtatattgagcatcctgtttgatatattttgcttgctttaatatcttaatatagagtagtatcggagtattagccgatacatgttggatctgtctgatcggctgtgctataaatgtctataatcttctcattaatatatatttcgatctattgtctcggtatggcgaccgatctatcccaatcacttgatttaagtatatatcgatgaaagtattatataccattgatatctatagccgatcgaatatatttaattctttcttacttatttatgactgtcgatcgaatcaaatatgacatcggctgaaagataaatgatacgtcatcggcgactggccgatcggctatcgtttatagatttaaccgcttttttcctgtctttatttcttgttgattgtaggatcaaatcaactggcacgctcacgaacctaaaggcaagattgttggacctgcactgaagttaagcagatcttccaggccagtatgtgtttttcgcatcaacacccgtgttacaaacatcaattagtcacatgcccttaaacacatagggctggtttggttttataccaacttattgtcctaccaaaagtttggtaacttcaatagtgaaaagtgattgtttggtttgctactaaattttacctacattagttcaaattcaatacaacctaatttagtagtgccaaaacttgttaatgttttggcactaccaagattttggcatggcaaaaattggttccaaaacaaacaagcccataacactattgaaatcataaccaccttttgaatcccttcgaacaaaggtcacacaacgaaatttctcttataaatacggatcagccaaaaaaaaaactgataaccggtgccgttgatatgttgctttcaaacttatgtttgaactaaaaagcaaatatagcaatgtatttgacactatatgataccggtgattacatgcaacaatttttgccataacaaaaaagtatttttatagacccacaaatagataataagaatagaaaaatgcaaccaaccgtaaaaacatttctttcaacctaaaaatgataaagacttaattttgttttaatatggttccagtccttctgcctatcagctaggattattcattttgtatttttataggaacttctatttttgcaaatatggcgacttactccaggatatattttcaagggttaattagatacatgccactaaaaatttatcggttttaaaataggaataagttcatctgaggtcccttaactttacactgaatccgattttcgtccctcgatcggaaaaccagacacaacgggtccctcaactattaaaaccggtgcagattagatccctcggcagttttaagagcggttttggctgacgtggcgcctatgtggctaatttgactcggtctttgtccgacgtggcattgacatggcgcttacgtggcaattcgacccgtgggacccacatgtcagtctcacatagaaaataataaaaaaaatttgtgggtcccacatgtcagtccaactcacccccttttcttcctcctctctccccatctcactctcttcatctccctatctctactctctctaggcgccacggaagacaacggcatgcggcggcgtgcggccggcgataggagaggagggagcaacgcgcaaagaccggcgaggcgggcagggagggaggacgcagggaggccggcgatggccgagcgccgtgggtgggggcttgatggcgacggacggagggagaggtgcacagccgacggtggccagcgggagagggagcggcgaccgccctccaccgcaacctgcctccaccaccgagcttgtcagcgatcgcccaccggagcaaggaggacgatagccggcgacgggtgaagaggacgaaggcggcggtctggagcagaggtcggagaagggcccccagccgccaggatggcgcacgatccgccgcgtttcaccaccaccgagctcgtcagcggcagcccaccggagcgaggagcttccgcttccccttcccccattgacgccgccgctgcagcagctgaggcgccgctccccatgccgccgcttctgtggcgcacgccggatgcggacggggacgccatggccatggacgcggacgacgtcaacgtcgacctcggcatcctcggcgactcccagggcccccgcaccgccgctactaccgggtggagcagcgcacggcggacgtcctcctcctccggctgccaccgccacacctccccgcatggctgcatctcctcctcctccggcggccatcgctcacgccgccccttctccccgccggccactgcccttctcccggccgccactgccggatctcgattgccggcgttgctccggggggacctgctgccgcccgggtcatctgttccgtccaccgccgtcgccgatccccttttatcaccccggctttctcctccaacttgctgctctcaccggtgggcgccggtctcgccgcccccctccaactcgccactctcaccggaagaggagaggagaggggagagagatgaagagagggagatggggagagaggaggaagaagaggaagggtgagtttgagtgacatgtggggcccatgatttttttattattttctatgtgagactgtcatgtgggtcctacgggttttattatttttccgggtcgaattgccacgtaagcgccacgtcaatgccacgtcagatgaagaccgagtcaaattagccacgtaggcgccacgtcagccaaaaccgtcctcaaaaccgttgagggacctaatctacaccggttttgataggtgagggacccgttgtgtctggttttccaatcgagggacgtaaatcggattcggtgtaaagttaagggacctcagataaacttattcctttaaaatatgccattactatttcttgctgtacaccctgaggccccacctggggacaaacagcccctacggcatggcttgcgacttgcaagcagcagcgccagatcgaggcccaaacggcctagctccagactgaggcccaagcggccgagcgtatgtacgctcgctgacttctatacggacggccaacaaaactattccgtgtaagaagacagaagtggcttgacggatgaaaaaaaaagtatatagaggctatttagatcctctgataaaatttttcaccatgtcatatcgaatatttgacacatacatgtagtattaaatataaacgaaaaaaataattaattatacagattgtgtgtaaattacgagacgaatcttttaagcctaattgcgccatgatttgacaatgtggtgctacaataaatatttgctaatgacggattaattaggcttaataaatttatctcgcggtttataggcggaattggtaatttgttttattattagtctacgtttaatacttgaaatatgtgtccctatatccgatgtgacgtgccaaaactttacgcccatggataacacccccataaacaatgtggctacagaatcaccttcatttgttttataacagataagtggtttgactttttttgtcaaacttaaaaaagtactaatatctattatcttattaaaggaatagaaaaagagcctccacgttcgctctcacggcctagaaaatctcatattaatcggagaaaaagaaaaacagagtccatatagaaatataatttagaaatagttgaaattcggaattaaaaaataagaaattttggaagaggagactgagttcatatagaaatacaatttataaataactaaaattcggaattaaaaataaggaatattagaagaatagtatagagtccatatagaaatacaacgaagaaataatagaaattcggaattaaaaataaggaatattagaagtagggtatagagtacagaagtagggtatagagtccatatcgaaatacaattaagaaataatagaaataaggaatattagaagtagggtatagagtccatatcgaaatacaattaagaaataatagaaattaggaatttaaaataaggaatattagaaatagagtatagagtcaatataggaatttaaaactaactaaaattcagaataaacataataaaattaaaattagagtttagagtccatataaaaatacaatttataaataactaaaatttgaaattaaaaaaaatatgggaagaagagtctaaagtcaatataggaatacaatttataagtaactaaaattcaaaattcaaaattaaataatattgaaagatgagtttagagttcacatggaaatacaattagaaataataaaaactaaaaattaaaaataaataatattggaagaagagcctagagactatataggaatacaatttacagataacgaaaattcggaattataaaaaataaatattgaaagatgattctagagtccatataggaatataatttacaaataactaaaatttgatattaagaaatattaataactacaccgtatataaaatgcaatattacacattattagtttcaattcataaagttagtacaaaatttaaaattatgttgtcattttaatatatttgaataatacatggagaatatatatatgttattatatgagagaaaatataatgatgctagccgcgcaatctgcgcgggccaccatgctagttttcaataaaaataaatatagtaacaaaatatatttgatgttaaatataatgaaactaattttatgttgtgaatgttgctatttttttataaacttgaccaaatataaaaaactttgaataagaacaaaagtcaaaagagatataatatgaaacagagggaatagtaaagtttgctattttgtggatgtccaccggatcatgatcgtccggatatgcctggaatgttaaactgtgctcagggatcattttacttgtaccgttgtgagattcgttattcttaattgatatatagttcagagcgatgcttgaaaggttaacactttgacaccacatttccacgtattttcaatgagcctcactacggtgctctttgctggtagtagaaagtaatatgaaaaagtacgaattaccctccccctcgggaactattgcgagagttcgatttaccccccctaaactataaaaccggacattcgacaccctaaacacataaaaccggat

SEQ ID NO: 42781 - DNA, 1896 bp, Oryza sativa
tcgatgtaatatatcagaaaatataagaaaacacaataatacaacatattagatttttccacatggtatcagagccttagagaccaacgtcgttcgatccccgcgtcgccctggggagatgagatcaatcttataatctccctggggcgccgcatctattagctccacaaattatccatagattagattttaccaatattagaattagatcaatttatttttttgccacatcgaaccctacgatctccaggagccaacacaacgatgatttcgtcgcaagccgtcgctcaatagcatcatcaagcagaaggcgaggccgtggcgtacagcaccaccgtccaagtcgccgtgaagcccgagcgacgggaacaccagacgtcatcaagccatctactgttgcatccatctactcaattgagagaagcacatggtgcacaggtgacaggagaatcaagcgtcaagacaccaagcaatccgcatcgatcatcttcgccaagctcctatgaacggccgcgacgcaagccacaactgcttcctcctctacatcagccatacatttgtcttctccgacacaacatcgccgatggtcttcatcaacataggaacaagcgcgccgccgccgactcgtccacatagatggacacctcgcgtcctctgacagattaatctgcaagacgcttcatcgacgacatcgaccgcgtcctctacgacggcaacgaccgcgtcaccgacgacggcatcgatcacgtcatctacaacgacaacgactgtatcaactcggcatcattattgtgatgaccgcttcacggcgcagaaggaccaaccgaagtggtggcctcatcgccaacgacgtcctctgacatatgcaagacgtccccaatggcatcctctcatcctctgacatctacaagatgcaagatgctaacaattgcagtttttgtcttcacaccatggcgtgaattttttttttttcgccttcggctatttgcggctacatcaactaccatgactaccatgaccacgactactatatgattggctacatcgacgaacgtctacaacaagaatcatctacgacaactccagtcaaagcgtccgtgtcatcgctatcgtccatgacactcccgctatgactgcgggagggaatagaggatagtcaagggacgacacagaaggggacgcagccaccaggtggaggaccgaccatcagagatgcaatcgatgatgatgactcagagagatgaagaaatagaagatttcaaatccagtcgcaatcgttcgcttcgctcccgttacgactgagggggaatgttagaagtataatatgttaattagagataagagtcaaatacaaattatagagataagatatattctagagatagaatcctagagataagatagagtcctagagatagaatcctagagataaatctactcttacttgtattgtactccaagtctctatcccctatgtactcctatatatacctcatgagagggtcgatgtaatatatcagaaaatataagaaaacacaataatacaacatattagatttttccacaccgaggccggcggcggcctgagtaggctacgctgatcctccatcccgcgagctaagcagggtggcgccgccgttgtctgtccatctgctgcggctatggcgagcggcggcaactgcggcaggacgccaggccggtgacgggcgttgcgggggcggtgatggcgcgcggcgcggcccacgacggcgactacggcgagcggtctccccccctctctctctgtctctctgtggcgccggcggccaacggcagaggtcttcccccacctctctctcctcttcccccctctctctctctctctctgtggtggcgagcacggcaccccggcgttgg

SEQ ID NO: 42782 - DNA, 6973 bp, Oryza sativa
caggcacaaaaccttacccatgggtgtgctatcgggcataattctcacccatcgggtggaccgggtccaatagcgttctatagtcacccgaacccattaacccgtaggttaaaaacaaccgcatggcctagcccatgagtgtaattggcccaaggcccaacaaggaaaaaaaacccctagctatataagttgtccacccaagcaacactaagctccatttctctccctcctctaaagccgcacacagtgggaatggggatagcggcggcgggggcgggccggcggctcgcgtcacagaggccgtgaggtgcaccagcctcacgaacgctgcctcctcctcacgagccccgctgccatcgctgccacgcgagacgctgttcgcgagctctgggcctcttgtgccgctgcggcctcctcccgtgagcgccgctgttgctggatccatgcgtatccgtgaccgccgccgccgccgccgcagctcttgcgacctgcgtctccttgctgctcaccgagaccattgctgtagcatgcaggcagcaacacgtgcatctccactcactcgccatcatcatctcgcccactggcctacctatttctgttgtgcttctcctgtttgtgatgttaattgatttgtttcatccaagtttgatatggcggttgggttcaattgtcaaagccaagtagctaacaatagcttatactgtgatctggaatggtttgctaatactgtggttgtatttatgtcaattgaggtgtgatgtgctctcttaaccgtgccactttttatgtattatcatctgacatgttgattttgcaatgtggccatatggttttcctggatctgattgttgcacaatgtttaactactgtaatgggtatgggtacccgtttacccatcacttgcgtgggtatgggtatggggaaatttctcacccgacagcaggtgtgggtaatgaaatgggcaagttcactctccatgggtgtgggtacgggggaagagaacccgatgggtacacacctgttgccatctctagtcgccaccgtggacgcggtcgccgacaaagtgcttcgcattcgccgtcgccgctcgccctcccaggcgcgcccgccgtgctccccagcggatgagagaagagagagagagagggggggtgaggtaggatgacaagtgggcccaaagtttttaaatatttttttaaatggattgccacctggcgccacgtgtgtgccacgtaggagcaaaaccactccgggttgagctgggggggagggggggtaatttgtccggtttcaatagtttagggtatcaaatgtccgtttttgaggttggggggtaattcgtactgtcgcgattgttcaggggggtaattcgtactttttctaaagtaatatgaaccattgatcttatttgatcgaagggttcagatctatctatgctaccaccctagttagtagtagaaacgtaatgtgtggatgggtataatcatcatttagcagtggctaaaccttttctttagctttttcgatggaatatgaacgatgccaacacaatggatgaccacatatcgatctaactaggaaaaaatataaatgacaaagttactcataatcaatgtattggtaaattactgatttacccttaatactactggtagtattatacaaccaatagagagcaccagggtatcgctcatgttcaattaattatatgggttccaactaaacgttgaatggtacatattctggcaaatactgaatctaccgggtccattgaagtcaattagaagatctctcccatcttgaattataagtcaaattagttacaaggtttacatgttgtagatgaaggtttggtgttattctcacttctaaacgtactagtaatcatgccgggggcccgggggggggggggggggaggtgcccattgaggataaagtattggatctgctggttactcatgcaaagcgtatgaacgtgttgtgcgtgatgaaaggaggacaactccacgtttatagtaaagatgaacaatcgaaagccaattttgcgagctggacaaaatatgtgaagggttggtgtggtgatggtgcttagaaagcatgtgtttgccgacaactaaactgatcaacgcccgaaagacagtgctctccttacacctctacgaccttcgctcacttcggctgatcagtgattagccaattgtggacaaaacccaacaataagcaatagtgcacagacctgtcccgaaattatacacgaatagtgaggactcaggacactccacaaaaggtgaaactaacaagactgtctaccaataaccaaccatgttccatttaataatttcttttttttttttgtaacatgttccgtcttattgactaacagagcataatgttactcctccccgtcgccagtggccaacgccattgccgcaccaacaaccgaggtccaatgcctacgcctacgaaccacaggtggtccagctgccagcaagcgcgcgcatgccgcgttctggttgccgcaccgccacgccacggccaccggtggacgccgccgcgcggttttattacctctaggcttctttgtactatcactgattcactgtacagcgtgtgtatgtgcgaaacgtggtggctagctattggccgtcgtcgcgcttgtggaggatcttgccggcgaacacggccgtctcgatgacccccctgatgacggacgccgtctggccgacgttgcacttgttccccgggaacgtcgccccgctcacccggtcgatgcagctcagcaggttctcgttgcacatcgtgttcaggtagtcgtctgcaaaaacaacaggaaaagccagtgagtgaatgagtgagccggagacgcacatgatgtgacgaactgacgatggacgatcgatgtgccatgggccatgacaagtgtacaccaaattcaccacatgcacacttggggggccttcggcgccgcgaggtcaagcttagtgcgcgtgcacgacgtcggcggcgcggctcatctcatggtcatgggtcgagcaatatgtggctagctttgcagcggcggcgactcgtgcaaaactgcaaaccgtgcgctttgcaataacccaatcgctggtatactaacaccgctggtttttgagacatgatttgattcgttaggtggcgcgtcgtctcgccagcatctggcatgaggttgaggcctcagagtcaagggagaccttttgtcccccctgctgcagtgctgctggtggaggcgtccgggcgaagcaaatatctagtatctcttctcgatcggaaggaagttcagagttcggagagtgaagagagagacagagagatgataccgttgtgggtgtcgacgcagtggtcgtgcaccatgcagcaggcgtcgagcgcgtcgcatggcctctcgccggggcacccgctgtagaggatcccgcagtacttgccgtacctcagcagaggtgcaactttcagaggtcgtcggttgcatcacggacacccagcaaaaaaaggcaaaatgcgtgtcagctccctttgccggacggccggaacaccaactcaagaatgcatatcatgttcagtcaaattaacggtgacacggaaggattcaaagacaagaagtctgcatctaatgccttggctagcatcatatgctctgcttgttttttttttttttcatttcagaagcagggggaagagaagccccagaactgcaaagatttctctgctctgtaggcagtatcagcctgtcagattattagtaagaggagtggcgtactacgtacttgtgcaaaactgggattcgcacgtccggctacatccctggtccttctgcgccgaaaacaaacaaagccaaaggcgaaaatcaatcaactgatcaataacaagtaactgcaaaaaatcagacttggtcagctagctccacgctggttctcaccgccggcgtgctgccaagcaggtcgccgatgttaagcccccgcgacgccgtcaccagcaagaggagaagcagcacggaacaccgaggagcgagcttgaggaagaacctcatctcgctcgcctcgcccgtcgtgtttctctttgcgcgttcaagcaagagcgcgtgttggatgggccgagaaagaaacgggtggagaggtgatgatctgcttccggaacaggcaccagctgagctgattatttatactagcagctgcgatgagtgatgaaaagtacataaattttctgaagagatattatagtatttgtgttggtgagagctgcgaacttgaggtgaagaagcttcggatgtgcctgtcctaccaagatatgaagacaacaacaccctgatcagatcaccgagccgtttcctatcccttcgttgtggtggttggctgatcgtagttgcacttgatactagtatcttaaagcaaaaggagcagtatcatttctacaaatgaaaagtgaacactgcaggggcaaacgcttgttttttcttaaaaaaatgtaaccgtgtaatatcccaattaaatgagactaatcctgattagtacactaaaatactaggatagcaaagttggttgcagtgataggtacactccaatctcactgagccaatattattattgaaggcatatgacaatgccattacttgcaaatgcagttcaagagttgccgtcagcccgtcacaggagaacaccagacaagtggctgcagttcttttgtaacttctgacctatacgtctatttggcatgcaaatgttaatatgatcagagttcaggatctctatcctttttgccatctcaacttctcaaggcacaccaaacaacatatagaaaaatgagacatatttcagtgtttgaccacatccatatggaaagcccagcctgcaccagccttggttacttaaatgctacaagaagcggtatcaaactgtggctgtttgggcgtctctctgaagaaatgacccggtaaccgcagagcccacccaaccgctgcacatttcaaattgtttgggcctagagtacaggctcctctagaacgaatggaacgtttcacccagccacccaatatcaatactagttgaaagcaagtttacgagcatagttcaggtggagaccggagatgcttcgacccaactcacagtttcgtgtaaatcccatctcatgtttcgttcgatctctatctaccagctagagttaaactagtactatatatgtattagtacactcatgttagagtgattatatgttcttgtgctgttgactataatctgatacacgtgtgggaatataggttgtgtttagttcagcgtaaagtttagattttggttgaaattggagatgatgtgactgaaaagttgtgtgtgtataacaggttgatgtgatggcaacagaaggagctttcagctacctctcttttagccaagatcaaggaagaggccaaaacttaggctttagcaggagcgagaagttttaatagctggtttttttttaagttagctcggaccaaaggtcttagcttctttctttttttcctttcgctttctaaagttctccttctctattcaatgaaattggcgctcattgattcgttcaaaaaaaaggttgatgtgatggaaaaagattgaagtttggatccaaattttggatctaaacacagccatgtatgcagggagttgagaaaacagagagctaatgttgtgtgatgactgatgaattgaagtctttggatcagttaagacggaattgattttgcgggtttgccccagcaaggctgtgtttagttcctgaaaaaagttaaaagtttagaaaaaaagttaaaagtttatgtgtgtaggaaaggtttggatgtgatgtgatggaaagttagaagttaggggtagctgggggtgaactaaacacggcccaaattgagggacacgtacgtagcccccagttctactccgatctagctactaggccgtctgggaaagtgacggcacgagtgcacgaccacacgaggccgtgctccacaaacaaaccgaggaagctccgaagctaggcatctcagtctgcactccacatgccaaaaactggagaaatgcaatgaagctgggcatgtacaacttggcgtctgcacagtccaaaaactgtggtgcaggttgcagtgaagccagtggcacagtgcagtctttggtttcagaaatcagaaacagagcaaaaacgaccgggaggaacgcatcatgacactgttccgctacatttattcttcccttccacgaactgtgctttcttcgagatagatataatagtatctcctcacaattttatgtatgcttcatcacttcacatttcctttttcttcagacaacggtacaccggctcacctgtccggctcccactccctatttactcccaaagtaaacactaattgacaaactccatatgcaaaatctggcgaggaagcggcaaatagtgtatatggggtgtgtttggttacagggcacactttactttttttttttaagactcccaaagtaataacaaattgacaaaccccgtatgcaaaatctggcgagaaagcagcaaatagtgcatatggggtgtgtttagttacaggtcacaccttacattttttttagagaaggtattttttacctgacctctatatccaaccggatatatgtagtctttttaaattataaacttagcctatcaatcatggaacttagccctcaaataactcaatctaaaatttgctcctatagagatttgaactcaatcttagggtgctactcaagtcactgtcagcactaggctacatgcacttacacggccgcactttaccattactaaggctaggtaagttgtggtacccataaagtgtggtggataaattgctagccacaagctcacaaagtgtggcaaagttgttgacaataaagttaagtctatgatgaataataaaattaagtctatgatgaatgggacatgttattgaaaaaagtgtggcaat

SEQ ID NO: 42783 - DNA, 13084 bp, Oryza sativa
tgtttatattgaaatatgagcacacgctaaaagttttgcgtatttctcagtaaatgtgctaagtgcatgttgatagcaagcaaataagtaatggaatttgcaatgaacagctaaatgtctaggtgaaatccaatgatgacaaattgacgagaacatgcctcaatgcgttggctcctttgatcatgcagattgtacggctagcattattatatcttctctcatataataataatattatatatatatataatatatatatatatatatatatatatatatatatatgagtaaattgcacccacggtgcattaacttggtaggtaggtgtaatttgatgcaagaacttgagaaatgagcgttctagtacaacaacttggcaggtaagtgcaatttaggacaagaactttataagcaatcgcataaatgcaataacttgcaagatatgtacgattttgatacaataagttaagaagttatgcaaaaacttaattatctggagcacttttttaatacatatttaattttcaagtacttattttgacaatatactagcgtggatttgtatataagcatatttatatttttatcctaataactaataactgaaaatcaattaaactgtatgtagaaattattatatttcggttgagatttggaaatgtgaagaaaacaaaaattcttaaagataattggatgtaaattggatgtgcagtataaatcttaaagattaaattcaatattgtaaagtaatatccgtaggactgctatataatagcatattgatatcgcgaaaaagaactcacctagcatatgcttagctaatttgtcaagttcttacacaagaacgcacccacttgttaagttgttacacttgaacgttcaattttcaagttattgcactatatcacacccacccgccaagttgttataccgtggatgcaatttactatatatatatatatatatatatatatatatatatatatatatatatatatatatatatatatattaatttacctatataggatacctatatgggactccatggtgcccgggcttcaaggtataaaacacacaaattctctcaaatttttaaaaattttcaaattgtgagtatatacctagctatatgaatttgattcatacaaaaacctaacaacaaaacaactcaaactaaactttatttcacaattcattattaaatacctaacgaattatatgtttggatgttatatacctagaaccaaaatctaacaaaaaaaaaagttcaaactcggttcaaacttgtttgaactaacgtagtaaagaagttaaagttcatatctaaacatttaaaaaaattcatactcattcaaattaagtatatactcaatttgaatcttggagcccatactccatgtagcaccagttaatttacctatatatatatataatttattattaaaatatattaaaatgacaatataattttaaattttatatgaactttatcaaactaaccaatgggtaatattcatattgtactgcaaattgtatgtacgtgatagtattaattattttttaataccgaattttagttatttctaaattgtattcctctaaggactctagatttctctaccagtattctttatttttaattttgaatttccagtatttacaaaatttatgcctatatggattctaaactttctttcaatattttttatttttaaattctgaatttcacttttttaaaaaatatacttctatatggaccatagacttttcttccaatatttattatttttttaattccaaatttccgttatttgtaatagtatttcgactctagaatattcttcttctaatatttcttatttttaattctaaatttttattatttataattatatttcgatatggactctaaactcacctttcatcattccttatttttttaattctaaattctgttatttgtaaattgtacttctatatggactctaaacttacctatcaatacttttaaaaaaaaattaatttcagttatttttacactgtattcctatatgctctctggactcttcttccaatatttttttttcaaaatttagttatttgtaaattatatttctatattgactctaaattctaattttaatcttattatttttcattccgaatttaatttaattgtaaattcctttatggacactaggctcttcttcaatatttattttttttaattcctaatttctattatttctaaattttatttctatattgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtaacaaatatgaatcatagcaatccttaaaataaatagaggacttatttaccttaacaccaacagcagcaacaacagcagcggaaccaacggtctaacacccaacaccacaggcgacggctgggaaccaggacgaaaccctaatcttcacttcactttatcttctcttcagggcggaggaactatatatatatatatatttatatagagcaagggtgagtactttcgtactcagcaagtcacgggaacttaggtggttaatgcaagcttggaagagaggcaaggttgttttgcaaatcttttgtttgaaatcattttgaaaccactaagtgatttatttctttctaagtttgggccgaaaagagacttgcgtctcgattcgactttaagagatgtttttcaacagctcatttggtaatgtatcgacctcccgggtcagatcattacttctcggctcccagagccattccacttgattaatcggctcccagagccttttcattttctcggactcccagagtccagctgcccagcagcacaacaatctgcttccactcgggaagcctaatctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctattcgaatagttagttaacctctgcagaggggggtacactttacccacacgacacgaacttactccagacactggccggtgtcagaggttcgcgacaaagcctttcccaagccgacccagggatacctcatgccacatagaaggatcaaatcctcacataaacataggccattttaggcgttcacaattcaaactccaaccacctcgatcggtaattcagcaagcttctcattcttgtattaccaggaacccggtttggctccaactgtcacgcccaaaaattcacgaaccagaatttctaagctgaatgtgcattaaacccctgtccaggaccagccagggtacacaaacgataattgttgacatacagatccacgtcttacaaaaatagaaaagattacaaatgcagcggaaaaagataaaagcgagctaagcctgaaggcttgacttctgcagcgggcgactccattccacaggcatccttgacggcagcgacgaaaccaacctcttcgagacatcttcaactgagaaggacttcaattctggtgagggggaaaagagcaagactgagtactacccacggtactcagcaagtcataccggaagaggaggtatgatgcaagatatatccaagggaggctaaaggttcttttgcataaagccggcatttcaaagcagtagttgaaagcagtaaaacagttgtagtatttaatccatattaaccaatcactgtccaacgttacaccacgttgcaacaggcccaaaccaccacatgaactaaccagttccaaaagctaactagggtgaaactaatcacggtgaatctggttgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaaatgccatgggtgcgactagcaagaccatgcacccacagcccaccatgacgtgtattttaattaaccaacaccattacggtggcactaaatcaaagctatgccaataatcaagtctatgctttaatgtgatccccttttgtgcactagttgaactaagcatggctaagcatctcctaaaccaacatctagtcattttaatacccaagttatcaatggcgtaagggaaacaacatatagctgagtaataggacccatcccacatgatattgtaaaacaatgcagtatttaatagaaatgcgggatatttgtaaattgggtacaatatgatcaattgtattgcatgacttgccttgctctcgcactgatgagaccacagcaacgtcttcgagaatccgcgaatcgacgaaacggccgaactctacgcgacaaacaaagcacacaagcaaaacatgctataagactactgaaacatgaagcaaaaccatttttaatggattctatacatttttatgaatttactgagacttgaatggatttaatcggagctcggatgaattagttatgatttttagaagattctctgtgtttttactataaaagaaaaactcttaatcaatttattgcgcaatattgccccagggctgacgtcagcacaaggaggggtggcgccgacacgcgggacccgcgggtcagtgactcaaggagagagaggggcggctggcaagcgggcccactgggcagtgtcacaaggggggggggaaaaaggcggcctggctcggctcggcttcaagccggccggccggttatggcgagggcggcggcgcgcgcgcacggttgccagcgacggcaaccggcgacgggaggcggcggcggacggcgcaaagacggcggcggcggccgaagcggcggcgcgagcgaccctagcggcggcgctacgcggcgggcggcgcggcaaagggagagagaggaagagagggagaccgatcctcaccgaggggctcggccggcgcgagggaggagcgacggcgaacggcaacgatgagagacgggaggacgacggcgacgggctccgggaggacctagagagaaggttgggaggggttagagagagggaggcggtccatggcgcacgacataaccgatcgaaggcggcggcaatggtggaagctcaccggagtgcgaggagatgcgagctccggcgatggaattggacgggagaacagcggacgaggtggacctcgggatggcggacgcggcggtgccgatggcggggtgcggcggcgaccctagcggctgctagaggcggccggagcggtggagatggcggcggcgggtgggtgcacggtgctagggcgatagggagctcgggagcggacggcgaaagagggaaaaaggtggagagaggcgcggtggtcggttatatagaggtgggggggggccggacgtggccgggaacggcgcaatttcgccggagtagtggaggaggtggaggaggagagagagagagaggcgggattcaaatttgaatcccggccatctcgcgggcgcggggtgagcgggagtggggcgtgggcgcggggagggcgaggtgcgcgggggaagtgggcgacgtggcccggggcgcggagtggggcgcggaaggcgggggaggcgggcggcgatgggtggtggtttcggcggcggttggcgcgggcgtgggcggccggaggttagggaaagggctgacaggtgggccccacctgtcagcgcccgagagggagaaggaggccgggtgaacttcgggagtaggagggaggagcgggccggcgcgggaggaaatgggccgggcccaagaaaaagaaaaaaggagggaaaagaaaagataaaaggaaaaaggattttcccagggatttaatattgcactttgcttattttaattggttaaaattatttccaaggctctgaaaattccactaaaaatcctgttagcatattttgacatgtagaatccaagagaaattctacatgtcgattccgattattatttgcatttattaattagggattcatctctaggttaaattaaacaatttcttcgaacgatttattttatgaatttagagcaagggaggggaacttcagggcgtgacaaacctaccccccttaaacggaatctcgaccccgagattcggaagagctggcgaagaggtgcggatgagcggccttcaattcatcttctctttcccaggtggcctcttcctcggagtggtggctccactggactttgcaaaacctgatcaccttgtttctggtccttctctcactggtctcaaggatacgaactggcttctccacgtaggtcaaatcttcttggatgtcaatgtgctctgagctagcttgttcctcaggtaccctcaaacacttcttcagttgagacacatgaaacacatcgtggataccaaccatattagatggaagctctagctggtatgcgacttcacctctgcgttccaagatcctgtatggtcccacaaagcgtggtgccaacttgcctttggtttggaagcggtgtactccccgaagcggagtgacacgaaggtacacataatcccctgcttcgaaagtaagctctcttcggcggttatcagcataactcttctgccgagactgggcgattcgcagtctttccctgacggtcctgactttctcctctgcttcggttaacacttctgtcccaaacagttggcgctcacctgtttgatcccagaaaagtggggtgcggcactttcgtccgtacaatgcttcaaacggtgccatttgcaaactggactgatagctgttgttgtaagagaattccgcatacggtagacttttatcccaggctccaccaaagtcaagtgcacaagctctcaacatatcttccaagatttgatttactcgctcggtctgaccatctgtttgcggatgataagccgtgctgaaattcaaacgagtccccaattcttcttgcagtttctgccagaactttgaagtgaattgacttcctcgatcagatacaatcttcttaggtaccccatgcaaacacatgattcttgaaaggtaaagctctgccaaccttttcccggtataggtagtgtgtactggaatgaaatgagcaactttggtgagtcgatccacgaccacccagattgaatcgtgccccaacgatgtcctgggcaaacctgttatgaaatccattccgatttcttcccatttccattccgggatttgaaggggttggagtaagcctgctggcctttgatgctctgccttcactcactggcaaacatcgcagagtgcgacgaattcggctatttcctttctcatgctgacccaccagaatttctctttgaggtcctggtacattttagtactaccgggatgaattgaataatgagtttgatgagcttctgtgagtatgagatccttcagttctttgtcgtcaggcacacacaatctttctcccaaccagattgtgccatgttcatcctcatggaaatctcgggcttttccaaccctcatattcttttttagctcagctatttcaggatcatttacctgagctgctctgacttgatccacgagcgtaggccgtgcctctagggcagctacgaacccgtgttccacgatgcccaaatttaggtgctcaagatcttgctgcaatttgtcacacatgtcttcaatacatactgcattgcaatagctctttctgcttagagcgtctgctaccacatttgctttgcctggatgatagtgtatccccatgtcataatctttaatcaactctagccatcttcgttgccggagattcaagtcgggctgggtgaagatgtacttcaggctcttatgatcagtgtaaacttcacagcggttgaaaataagatagtgccgccagattttcagagcatgaaccactgctgccaactcaaggtcatgagtgggataattggtctcgtgtgggcgcaactgtcgcgaagcatatgcgaccactctgccttcttgcatcaacacacatcccaatccttggcgggatgcatcacagtagacttggaaatcttttgtctgatctggcagaactagaactggtgcagagactaacctcttcttgagttcttcaaaactttggttgcactcagctgaccatttgaatttttcatctttctttagcaactgtgtcatgggcctggcaatcttagagaaattttcgatgaaccgacggtaataacccgcaagtccaagaaaactccggatttgagaaactgtctttggtggggtccactttgtaactgattccacatttgatggatccactgccatgccttgagcagaaatgacgtgacccagaaatttgacctccgataaccagaagtcacacttgctaaacttggcatatagctggtgctccttcaatttctcgagtaccagacggagatgctgctcatgttcctcttctgattttgaataaataagtatgtcgtcaatgaataccacgacaaacttgtcaagaaactccataaacactttgttcatcaagttcatgaagaaagccggtgcattggtgagtccaaaggacataaccgtgcactcaaacaacccataccgagtggtgaaggctgtcttgggaatatcctcttcccgaattctcaactgatgatagcctgatcgcaggtctatcttggaaaacaccttagctccttttagctgatcaaacaggtcatcaattctgggcaacggatatttgttcttgattgtgacctcattaagggcgcgataatccacgcacatcctcttagtcttgtctttcttctccacaaagatcaccggagcaccccaaggtgaagtactcggtcggatgtaccctttctgcagctgttcgtcaacttgctttttgacttctgctagctcgttagctgccattctgtacggcctcttgtagattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgatgctggggaatggaaggtgatcttctcccctttgtcgttggttagggtgatggtgcggcttgcgcagtcaatcactcccttgtttctggtcaaccaatccattccgagaacgacatctaggtctttagattcgagaaggatgaggttggatagaaacggtgatcttttgatctctatagtcaccgaggggcaataatgtgctgccctcatgtcatttccaggggtatgaacctgcatcggtattttaagttccactaccgataatccatgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtctagtgcgattcagcttcggacacttgccagcaaagtggccgtgcttgccacagttgaagcatggtcctggctttcctacagcccccttcttgggttgttctgactgagctgacacagctggcggatctgactgagctggtgccattagtgggggtggagtcgagttgtggttgtgctgcttactgttgttgtgactgccaccgttgtaatcgttgttgaagttactcgggtgatagggacggtgctgacagacgatcagggtgggaggcccacctagctgtcccgtcatgaagcgaggcttctgattgttcccctgaggaaagctgatctgagctgcctttctttttcggtccattttgttgcgttgctcttcctggcggatagccttgtccacaagcttctcaaagtcctcatagactccggagattagctggttggtcaattcatcatcgagcccaaaaaaaaacttctcctgcttctcagcatcggtgcgcacgtcctcaggagcgtagcgcgcgaggcggttgaactcgtgcagatactctgtaaccgttctggttccttgttgcaatgcacggaactctctcttctgttgtgccataatcccttcaggaatctgtaccttcctaaagttttgacaaaactctgcccaagtaaccttcgttgcatctggacgggtcaccacgtagttatcccaccaggcagaagcgggaccttgcaactggtgtgtagcaaaagcaactttctcttggtcgttgcattgtagtaggttcagcttcttctcaatagcacggagccagtcgttggcctccattgggttggtggtgcttgagaaagtgggtggctgaatacgaagaaagtctaacagtttggacacgtgtgatggtggaggaccaaactgctggttctgatgcgcctgctgcaacatctgatggtaatgttgctgcatctgttgcatcatcattgtcatcatctgagtgactgttgggttctcgggcggcggagatgaactgctgccaggtgcaccactggtatgagcttcatctgtctgctcttcgctgccactggcgtcgttggagtcacggggatcattccttgtcttcaccatctggacgaggataggtagaaataagagaaaggaagaaaacagatggctcagaaactaatctttcttataaacttaagtgcaattatcttaatcttgattaaaacactgaaaaagaggcacgcaactcctaattaaggctgtcataccactcacacatgatatcgaccgccgactaacccacaagcaacaaacctaaacatggaaactagcaagcaaacaaaactaagaagacgataaagctaagggcggcgactctgaagctcggagcggcgcttgcgatcgaagaacaggtctgacttctaaggtagacaagggataggaatcaatgcatgctcaaatccaaatttaaacaaagcaacaaatggcccaaacaactagccaagcatgatgatttttacgcatggaacatttttcatgaacccagacaaaagacactaatgcaactgactaaacaatgacttaatgtatgaaataaatgcatgataatcatgatgcgcataaaaactgcatcccatcgaatctagacacaacttaatgcataccacctaacaattctcgactgactgccaaataaattccaaataaagttttgctaaaaccctggactgtccctagccaagagatccgattaaataggcgaccaagattttctcccaaaatcaaaagatcaaaccccaaagtttcccgaaacaaatccaagtgaaaaaggcatgtgcatatgaaaaggggttcagagggctcttaggttttccagttggcttgtcctacggtcaaggtcggctctgataccaacttgtcacgcccagaaattcacgaaccagaatttctaagctgaatgtgcattaaacccctgtccaggaccagccagggtacacaaacgacaattgttgacatacagatccacgtcttacaaaaatagaaaagattacaaatgcagcggaaaaagataaaagcgagctaagcctgaaggcttgacttctgcagcgggcgactccattccacaggcatccttgacggcagcgacgaaaccaacctcttcgagacatcttcaactgagaaggacttcaattctggtgagggggaaaagagcaagactgagtactacccacggtactcagcaagtcataccggaagaggaggtatgatgcaagatatatccaagggaggctaaaggttcttttgcataaagccggcatttcaaagcagtagttgaaagcagtaaaacagttgtagtatttaatccatattaaccaatcactgtccaacgttacaccacgttgcaacaggcccaaaccaccacctgaactaaccagttccaaaagctaactagggtgaaactaatcacggtgaatctggttgaccgcccataaccgcgggcacggctattcgaatagttttactctgatcagaggtgtacaactgtacccacaagacacagccccacgacacgttcccgtgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaaatgccatgggtgcgactagcaagaccatgcacccacagcccaccatgacgtgtattttaattaaccaacaccattacggtggcactaaatcaaagctatgccaataatcaagtctatgctttaatgtgatccccttttgtgcactagttgaactaagcatggctaagcatctcctaaaccaacatctagtcattttaatacccaagttatcaatggcgtaagggaaacaacatatagctgagtaataggacccatcccacatgatattgtaaaacaatgcagtatttaatagaaatgcgggatatttgtaaattgggtacaatatgatcaattgtattgcatgacttgccttgctctcgcac

SEQ ID NO: 42784 - DNA, 2169 bp, Oryza sativa
aaggaggccgggtgaacttcgggagtaggagggaggagcgggccggcgcgggaggaaatgggccgggcccaagaaaaagaaaaaaggagggaaaagaaaagataaaaggaaaaaggattttcccagggatttaatattgcactttgcttattttaattggttaaaattatttccaaggctctgaaaattccactaaaaatcctgttagcatattttgacatgtagaatccaagagaaattctacatgtcgattccgattattatttgcatttattaattagggattcatctctaggttaaattaaacaatttcttcgaacgatttattttatgaatttagagcaagggaggggaacttcagggcgtgacaccaaccgaccccgccccggcgttcccaactattggcatgcgaggtttccctgaaccgactagttacttagacagggtgtcccattccaccttgtggttgcactttgattatgttcgatgagtttcccacaggaatcggtccttatatgcgaatacgggacagtgccacataggcacaacccccgcatcgcgagttttcacaattcattttgttttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccatcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgggaaaacccgcgatcgacgaaaaatccgataaccgcaactatacgcaacaatcgaaaacctaaacaagagaccaaaagaaagatcctatttagactaattagtagtgccattaaatagatctcaattttatggaaatactggaagtggaacggagtcaatcggagttgcgaattgggtgatatgaattttagaagtttaattggagtttctggaataggagaaatggtttatggaatttataatattctcaagaatattattgacagtcactgtcacgcgggaccaaaggaaatggtttatgggattttagaataaggaattgatttatgggacaaaggaaaaaggatttattaaatccctgaaaaagaaaaggatggagggatgttaattggacttgggccgagcgaaggggcgcggcccgaagagatgcgcgggcgcggccgaggcgagcgggtcggcgcgcgggagggaggcggcccaaggccgaacgaggcgcggcccacgcgacgcaagccggtggacgcggtccaccgtgccgggcgcaaggtgggacccacaaggcggcgacacggctcacgcgagcggggtgcacgcaaggcggcgcgttggatcggtggaccgggagacctttgaccggtctccgcggggccgggcggctgaggtggcatccacgtggatgccacgtcggatggggaagggagaggaggccgggcaggctgatccgatggccggcgacgagcgacgtgaaccggcgaacggcggcgaggtggattgggggggtagcaccggaagagagaggaggccaaggggaatcgattcaacggagcggattagccgggggaaaaacgacggcggctggcggcggcgaccaatctcgccggcacgccgacgtggccgcgcgcgagaagagcgaagggcgcgcgggctcgggcttagccgaaccggtacgcgaccgcgatgcgcacgcggggacgcgggacccgatggtcaccggcggcgcacgcacggcggcgttaggcggcggcggaagcggcgacacggcgcggagacaaaggagaaggccggcggccttggggcagccagggggaggtcaaggggatccccgggagcgtggcggcgagaggaatcgacgcgagaggagccgacgacggcggatttcgacggcgatcgtcggcggcgagcaaacagggaaacttcactggggcaacgggggttcgattcgttgggg

SEQ ID NO: 42785 - DNA, 2979 bp, Oryza sativa
ggggcggcgcggagctcctcgtcgactcctcgtgctcgcaagctccccaacacgcacgacggcagaggagggcgagaacgacgacgaacggcgaggcggcagtggtgtgatggaggaggggaagcgagaggtatgggagggggtgtgggttttataggtggcgatgtcggtttgagagaaccgaccttggggcggtcaaggagatgaggcgggtggcgcgagcggtcaagcggggcagaggtggtgacgccggcggtggtcggggaaagggaaaaaaagaagggggggggaaaaagggggttggtcctttgccatattgaggagaggggaagcagctgcttctcccattcttggacgatgcggcgtggagtggcaggggccatggatgacgtcggcgatgacggcggcggtcggtttgtcatggagcgggggcaaggcggcagctcgtggcgtcggcggcgcaagggctgatggcggcggcgttcggccggtcggccacctcgcgagcgagcgcgcgcgcgcgatgcgggggtgcggccggatttcgaacggcggcggcgggaaatcggcgccgaggagagggagaaaggaagcagagggagagagcgaggaaagagagaggaagaagagaggcgatgcctctctctctctcggcgcatgcagcgcacgtgcggggaggaggtgaagcgggctgagaggagatgggccggggaagaagagtcggcccaccgagccagagggaggtaaaatagactttcacagagaaggcgatttggagagaattggagtttggatttggattcaaattcgatattcgaactcgagggttcagggaggaatcaaggaaggctcaagatagggtttggtatttttcggaattgggagcgagtgtttagcgaggattcaaaggatgcgactgaatttcggaatttgatttggagacttgaatcggaagagtaatttgaggtggaggattttgatttcgatgtgagggaacaacgggatttgagatgagatcttggcacgacttagactcgcacacaaagaacgaaaattttcgcaattaggattttgccgaattagtttttaacgcctcacgaaaagcggagcgttacatatatggactctaaacatatctttcaatatttgttatgtttctgtttcgaattttagttatttctaaatgctctagagtcttcttccaatagttattttttaatttttaattttagttagttctaaactgtatttctataatgactctaacatccacttttattttcttttattttttagtttcaaaattcaattagttctaaattgtataccgatatggactctagtctactcttcaatattccttaaaaaatatcaaattttagctattttgaaattgtatttctatatgaactctattttttttctttttctccgattaatatgagaatttctaagccgtgagagcaaacgtggaggctttttttttctattactttaataagttaatatatttgattgcaaccacattgaaaagaaggatttgattcttgtctgtcacaccttgttataggtttctaccaagtgtgatgtgcttcctagctagcgtagtggcaagggcatgttgtttcaaccctaaagactcatgttcaactcgctcacactttcttcttaactacttggcgccatgcttctcttagttgcccaacgttttatttggatatcatgtgacgctagatatacaagctactccatataaaacacttatagctgcatatttacttgcaatacatacttcttccgaatatggtttacaagtaaacgcttataattcactactacaaaagtgatttttctgtacgagacctcataatttttgcaaacggaccataactagtggcgcctgcaaaaatcgcgcggcattttcacaaacggctccttaagaagcccgtatagaaaaatcgattttcccatacgggtctcttaagatgtccgcatgcaaaaatgatgtcatttttgcatgcggctcacttaagcgcccgcatggaaaaatcgatttttccatgcggctcacttaagcgcccgcatgcgaaaataaaatttgaaaaatttgaaaatttgaaactagtgtatctcactcatacgaactccaaattggatgattttttttcctaaatgtttctaaaatcatgctctatcatgttattgtgttcttactgttattatttaggccattttttcttgtgactttattttatcaatttaaaatttaaatttcaaatcttcaaataatattatgaagcaataaacgatttcagctgaaaaagtcaacaacaacaaagttgtataactcatcaagatctataatttctattttggtcatttcttcatttgacaaagtgatactaacattttcacaaaatttacatctctctcttatagtttataaaactatataatagatatgtacattctgtgaataatcttacaaatcactttgtcggatgaataaatgaccaaaataaaagttatagatattaatgagttacaccaatttgttattgacgactttttcagttgaaatcatttagtatctgaaaatattgtttaaagttgttataatttgaaattcaaattcagactgttcaaacaaagtcatatagaaaaatgaccaatacaaaagttgtagatcttgataagttatacaactttgtttttgataacttttccatttgaaatcatttactacctaaaaaactatttgaatttcttatattttaaaatttaaattttatatagttcaatcaaactcggatggagaaatgaccaaaagaaaattggtagatctcaacgacttctacaactttatttttggcaactttttcatatgagtttatttatgaccataaaatttgattcgaagttctcacatttttaattaattttttaatgattatttttacatgcggaccacttaaggag

SEQ ID NO: 42786 - DNA, 3306 bp, Oryza sativa
cggcgggcgcggcggctcggcttcctcggctcggcggccgacaacgacgatggccgcggtgggagcggcgacggcgggcggcgggagcggctacggcggcggcggcggctcggcggccgacaatgacgacggccgcggcgggggtgacggatctgatgccgccgccgacggatccggcaccggtgacgatgatgggtggcgggggcgatggatccaccgccgacgacggccgcggtgggagcaacgacggcgggcggcgggagcggctacggcggcggcgggctcgcagcggggtcgcggcggcggcttggcaacctcggctcggcggccgacaacgacgacggccgcggcaggggcgacggatccgatgccgccgccgacggatccggcatcggtgacgacgatgggtggcgggggcgatggatccgccgccggcgatgacgctgggcgacgggggtgacggatccgccgccgacgacgacgccgagcggtgggggtgacggatccggtgccgctgccgacggatccggcgccggcgacggcggggggtggcgggagcgatggatccgccgccggcgacggcgtgcggcatggatgtggcgctccggtggcgggctagggtttggtttggggttttttcgattttattttttttgtttgctcaatttattttcgcatgcggccggtataagcaaccgcatgcgaaaataagattttcgcatgcggttgcgccggccgcatgcaaaaaggatgatttttacagacgatttcgtccatgcggttggcacaaccgcatggaaagatggttctcagccgtatggaaaaaccatatctgtagtagtgattaattggaagtgcatctaggaccctattgtaggttattagcttctgcatttaattttaaattagtctattcacccggtcaaaccccccccccccctaggcctaagtgatcctttcattaataatcagggaaacaccattagtttggtgttgaaattatgtatgtaactctaactaccaggattcaaatcctagtgttcataaatatagttgcatgcatcttagttggtgcagggaccaaaagttacactttatttgtaaaagaaatctagtaataatgcctataaaatacatggaatggcttgttaaatatgctttttagtcttttgtgatataggtcggataactgtttttttttccaaacatagttacattttatcgactttgaaatcatcaattagtcacgaagctatgtgttgcacgggcttatattattttttagcataaatattaaaagtttaatcatgtaataaatatgttgttggctgtttttctttttttgaaatgcagtaagttagataaaaaaaggtccacatatgttacatcttgctaactgttatatatttttgaaattaaattaacaaaaccctaaattatgaggccttaaaagtccatgatataaaaattgcatatatatatatatatatatatatatatatacacttcatataactaattcttaaaatgatatagtgctctacgacaaagacgatctatttaatcaacatcatatttttatgattcctcggcgtgcataattagttggtatagtacaccgttagttaacccagaaaataaatatgttttcgatgtaaatgtgaacatgtaccttttaattatgaccaacagagatcatagctcattctagcaccatcccttttaggtagtatatagaagtagatatatagatactggtattggtccatttgcactaatcatgcgtaccaccatatgcattgaaactaattgatgatgaatgtcttttctcaacctcatggtacatggaggaattggcgccattatcctcgctctacgacagtcaaatcaccgacaaaatctcaatttaaactcgcgcgtgccgatttactcatttttaatttaaaaaaattgagagtgaaagtgcgaatatatgtatagtaataattacttggctagattaacatgtgcactatgtgtaatcacaagttcacaaaaaaaaaacatgtgacgcaaatgctgcttaccctaaatagaaaaccaatgcaattttttttcatacaataagtatatatgacgcggttatacaaattgaaggaaaatggttttgactgtgaacagcttgcacacgtacaagaccccttaagaagttaagaaaagcttatatgttaatgtgtacagttagtataatcatcaattgaagctgcaaacttaattgtaggaagtatttgcataatctctcttctggaaccatccaatctatagtttctagtaccctatatgtaaatgtgagaaaaaaactctgtaaagttttaccttggacatataccctctccctgcctctcgggtgcaccaggacatcgtgacggtgtacattatactatcagttattgcatgtatggatgtggtggatatatatgttatggctttaatagatgagagcatagcattatgatacaaaatctgcatcaccaattaattaagtaaaaatgtagtactagctagattcagagaagttctatcgtgcttagtttggaggtatcggctagctatatccatttttatgaaatacacatcaaaggttaggatgttttacacacacacacacacatgcttgaaattaagggttttagaggtaaacttcactttaaaattaaacgttgtcggttgatatatgttttaggccctatttgaaacatattttgcgtgcattatttagacagactgcttacttagttaacttgataaattatatttttagaaataaactttacaatatcttaaaataactggtctaaacaatgcagcagaagaattttatttttaaaaaaatattttaagaagcatggaggaaataatccgtgacaaaaaaaaatctggaaaaaaaagctgaaaagtacacggctttaagcactgtaaaacatatcgtattattagagttgttaaactacagtaatacacttctagctactctttgcacgctccaaggataatatgatcgagtacatgaagatcagtagatcacccacatcacaatgctaaaaatagttctagggatctcttaattaagaaaagttttatgccaggccagatgaacaaagagtgtggccttgtattgattgctgagagatgccatgcagatatacagcaccaagattcacacacacaaagcagtactagtataaaatcaatgggagagaaaactaaaattaaagaaatggaaaacggttgtacttggggaacatgtgatccataatctagctagct

SEQ ID NO: 42787 - DNA, 9204 bp, Oryza sativa
cgcctcctcctgctgctcgccgtccccgtccgtccccgcgcaggcggcggcggcggcgctgtcgtccccggtgacgacgagcacgttcttgacgcggccgccgagtgtggtgatctcggccttgagcgcgcgcagccggagcgccttgagcgcgcggatgaggtccggcaggaggtcggtgcggtcgtcgcagcagagcgacgcgcgcacgacgaggcgcccgtcctcgtcgctcgacgcgtcgacggtgagctcgtccgactcggtggggagcgggcacgcctcctccgtgatctccgacgtctgccgcttcagctccttgacgtgctggatcacctccgcgagcagcgacgccttgtccgtctgcacccacacacacaccgcaccaacatgtaagcgcgcgcattgtcgatcaatgagtaaatcacaaggaagaaaacgcacggcggcgagagctcgatcagccaagcagcagtagttaaattagttaaactgctgtgtctaccgcgtgctaatgggggtgggcgaatggggggaatgatgagatggaacggatgggggggagtacgcatgcagggtgcaaaagggcttagggggccggggcgcggtgcgtgccgtggcatgcatgcctcctctcctctcctctccgatccaagcgtgggactcacactactctcgatctctgccaactaggagcacaaacaccgcgtaatcaattgcaaaacgctagtgcgtgcatggcctcgcagctagcttagctagcatgcatgctgttgatggtgctcgcacgcacgcgcgcttccacaagcgagccgtgttcgtccttttggtgttaagtggggcatctaaccatcaccactccccattgtttatacttcttcccttgtcacgccaacatgcggtcgtcaaatctgccgtccgccatctcgcagagtactactactaggttattggcgaatctggaacaaataatcctatgtacagtgcactcactaggcacttggaaatccataacgacctttcagcctacatatagatctaacagaattttcttttcaggtaaagaacagtagtagaaaagtaaaagtttcatagatgcaaaaagggaggaagagtgtactcctatatattgtttccctcgataacgataatgtaacggtttaattagcacaaggcaggcagggaattaggctgagtggcataggataacgtgagtggttttggagtaggggctcgcagagaatatctgggttgggattcttggaagtagggggaggtagcaaagcaggatctctcgagatggtcggctttctttttatctttgccgctgctgctgcctgcttctactactactagctctcatctgtgtctgacacaagctctcgtgtttgtctctcctcggagaggccagcatgaactcctgcgcgcgtcgcaagcttttcgtgtccttcctggtctctcttttgcgcgtcaactaggcggctcccctcccttcgcttgtctcctagctcccccctatttactagcagcgctatcggatgacgagccagtgccagccatggggttcgcgcgtgttttggttgggtcatgtagttgcaccgtggggatatgcattgcatgaatgaatttatgacggggatatggactgtactactactaccttggttgtgttggggaggaggctgcggaggcgggcgaggtgcgcgttgatccgctcgcggcggcggcgctcggcctcgctgtggctcttggacgcggccagcgccttggcgtccatgatctcctgcgcggtcatccggccgaggtcgccgaacggcgacggagcgaagggcggcggcatcatcatgccggcgacgtgggagccgtggtgacccatgtagagcccgccgaggccgagcgggtcggacgacgacgacgcgccgccggagtggtcgtacgcgtactggagcgcccgccgcgcgtagaagtcggcgaagaacgggggtggcggcgggggctgagggggcaggggcggcagcagcgggaagaacgggctctgctggccgccgccgccgcctaggttgtggtggtggtggattgcaccgtggacaggctgcgccggcggtggccagcacatgatcggcggcggccccatggtggcgctcacgctcccgacgctactggtcgcctcgaacaccatgccggcagcatcttggcacactccaccaccgtctccccccacctcttgctccaccacgccgctcgtcgggccaccgcaagcctgctcgatcacctcctcctcctcctcgtcgacgagcaccccggcttcttgatggtggtggtggtggcggtggtctccatgagcacccatctatcaaatcgatctggaagaacgcaacacaaaccgagccgcggggatcgatcgatcgattgaacgctggacgggcagcgtagtacccggggcttgcgtgtgggagggagatggatgcttcggcagggtgtgtctagggctaccttttgtatagggtgtggcatgtggcagcatgatgcgcctttcggcctttttgtctttcgcttatgatctcgccgggcgctcgcaagaattatggcggcctcccccctgattatacatatacaccaaaaggcctcgccttttctcgcttcattcgcccccggccggcgggggtactacctctagacctggcactgaccggccctgacctgatggtagctactggtgttacttggctgccacgcctttcgatggctttgtgggggcaaaggctagtagggtaatataattactaggctggagtaatggagacaggaggggaaagggagtgtggaaatggagctggtcgatcaggcctggaagatggcaaaagggcgctagctgggaaagagagaccgagagtcgagggaaaaggcaaaagattttgcatggaaggagagagaggacgagagagtagaagagtcctacgtacagtgcagcggttagtagtgcttgtgtgtggatggacgcctgaatggctcggtcaaggcccatgttctgcagcaccccgcgctccgctttaccaatccacgcctccccgagagacacaatcattttgtcttggaatacactcctcgcctgtggctgtggtgtggtgcatgcagctagccagcgtacgcttaacatattggtttttaccagagcagctgcgtgggcgcaggattatgtattgagcgagaaaaacaaaacaggatccacgcaaacagcgggctaatggcagcactcatgccccatcgatcgacaacggcatggttatcgagttcaaatcttagcccatgattaagctagctatagaactagtagctccgtccaggcaaacgaaaacggaatgcgatccccggccacgtccccggcccggccggccggcgccaatcgccatgatgcccgccaggcccccgcccgcgacgacacgatcatgccgccgggctggcctgtgtcaattttagcgcgggacgaggcgcaaggggacaagtagcagcttcctacagtttcccacctcccctgataccgcatcgatccctctcgccttctccctcgtacaccgcgcaggcgctcgcttcgccggccgcgcttgcgtgctgcgtgttcggcaccgtgcagtgcccaacttggcgcaggcgggcgggcgtaatctcgtatctcgtaccgtacgctcgcgcgcgcgcgcgcgtcaggccgacgaccaggcacaggcgcgcgacgagtggcatgcgcgcagcccggctgggcgggcgctgcatgcatgagctcatggccatggaccatgttgtgtgcatgcgtcatgcaacgtgatccatcgcgatcgatcgagtggtggttcgagctagcgcgctcctcgctagctagcagttttgttcagagcttggctgggaaatgcacgcatgcatgggggagagagagagagagttggcccgagatggatcgaggcaaaacgacgggagagggctcatcatggcgtggatccgccgcattcactcctccctagctagctcgttgtctctcgcttctgtgttcttcgttggctagctactccagtataggactgaaaacggggcgggtatttcccgaccgcccgcccggccacattatttcgggtcaaattcgggtcgggaattcgggtacccggacccttacacggatacagggttcgaatacgggtaattttttgcggatatgagatcgggttcgggagagcggtatccgacggatacggattatccgggaaattatgcgggtattacccgataatctatccgtatattacccggatagatggacagcagcccaacaggcaagcgcccaacaggccaacacaacaggcaacagccagcccacatccaaaaggcccaccaaacaaagtgccaagcacaaaccctagccttcacttcacagttcagatcagtacagcattgagtctgaagctatcaagctatgaatgcctacttttgctactactttggtatagttttgctgataggcattacgatgccataagcccctaatatattcataatagacatataggaaatggctgaatggctattgtctatgtggtatatttggttgttgctttgacttgatatctgaataaatattcgtaaccgatatagttcgtatccgtcttggtacgtattcgttccgtatttatgcccaatattatccgtacttctattcgtatccgataatatccgtgcccgacccgattccgattataaaatatgggttaggatatgagaaggatgagatccgaccgaacccgacccgatttcacccctactccagtatatagagagtactggtactactgcgttactgtgctgtgcctgtatttatgtttctcgggtgtatcctcacggaaatgatccacctgtagggacggcccactgcgtagttccttttgccgcctctgggcttcctttgcggaaattggaagagcaatgtgcgtgaactgtgaaggctaaaatgaagttccagatctccggatcggtctccacagctcctttttgcaggttttattctctaaaaaaagttcgttttgcagagggtatatatatatatattccagttagtagggggctcaaaagtgaagaggatagtttcttgatagaatcagtggccagcctgaattaattttgagcggcctagtttggatagttctgcatacctttattttagatagagttcaagagagaagcttcgtcagttggattgggcgttctgaggtcaggagtatgaggtaactgcccctctgatccatgatgggctatatagccggtaagctgtatctcatcggcctagtatgtcttttttttatatataatggaatagagcatcccggcctttgctcaaagagctacagtcaattattacaatctcacactcaaaatgagtgaagttcaaagaaacttaaaagatgaaaccaaccatcaataagaaacaacctaaagactgccaacccaagataaagagtacataattattgaattctatttgtgaacctccatccaaaattgacaaaaagttacataaccgttgtctcaagaatacggcatgcagcctttaaaagctcactatcttcctcacacttttgtagttgtgcccaaaaccggagccaatgtgttgtcctgaaaactacttgcatatatgaaatagatggtgacttgtcaaaaatgacatcattcctactcaaccatagagcctaacatatagcagatgctcctatgagaacaagttttcttctttttttttccacccccagaagccaattatcaaaaatatgagatataccatgaggaaggtaaagaccaaaagaaaattgaactgctctccataaaaactttgcataatgacactctacaaaaagatgttgagtagtttcatttttcatacagaaacaacgtctcaagctaccattccaattcctccttgccaaattatctttagttaatacaacccctttaagcaagtaccacataaagatcttcatcttaagaggcatcctaagtttccaaataatcttgtttctctcaatataattattgtttattaaggctaaatacattgtccgaacagtaaattgatcattttgatgataattccatctaaaacgatcattcagttgactcaactgaatatgcacaatagaagcacacaagttatgccaatttgctaaattctgaccaaccaaagctctcctaaaaaaaacattcagcggaacagatctcataacattagcaattgaagaattcttccttcgaacaatggcatatagagacggatacttatctttaaaagccacgttacatatccatttatcttcccaaaatctagtttgttccccattattcacaatccaggaacccatattcaagaaagtatttttaactttcatgagacctgaccagaaatgagaatcccctggtttcctatcaacttgagttatagaatggttagagagatacttccttttcaataagtcctgccaaaccccttgctcatttattaacttgaacaaccatttactcaaaagatatttattttggatctccaaattatgaacacctaaacccccttggtctttgggttgacaaattatatcccatcttgttagtctatattttttcttatgatcatcaccttgccaaaagaaacgtgatctataataatcaattttttgaagaactccctttggaatctcaaaaaaaagatatcattattttccgttggaataaatacattatttttcctccctcatctctagcccttgatcgaatcgcattccttaaccgcaaatccggtgaaaattaactccttcgatggttttagagaagtggttttgctgacgtgctatgttaacttggtccaagtatgctgacatagcaactcaatcgtcaaatgaattaaaaatagaaatggattccacatataattaagtgacaaggataaaaacataaaaacaatggagcctacttgtcagccccacttctccttctcttcttcttcttcctctcgcagtcaaagcttgcacgcgcggcgatggcggctacggaggcaagcggtgtggctagggtgggagggagttgggataaggagtgtggatgggcgttagtgaacggtggcggtggtgacaatttctcctcccctccctctccctactctctctctctctatctctctctcccagcggacagaaagacatcgatggtgatgggggacggtgggttggcgagggccgcgttgtgcccacgacagagccccgccacatcgcccataaatctcagttgcgttgcccggatctaaggagcagtggagttgcaacagtcgattcctcctaacgacgcaacgacaaacacaatgactgcaacggagacatcgtaatccccgaagataggccaatgggaggggatccggtgacgaggagcgcacgaagtgggtgttgttgcctagtaggaggggatccggtggttgccactctattagtttcacaccctatggaggctggctcaataagaactagttgtggtaggaggtgcgcatccaagcattgaaaccgccacatcagcgtgcggcagcctggtagagctcattatcgctgggatgggagggggaacaagaggttggggatgggagtggagggggaggggaggagaggaccgcggatgaccatgtcatcgtcaaccgttgtcgcactcaccgatagtcgctcgagttcatccttcggccgtctctgccattgttgcccccttctcgtcgaccgctgccttcccatggatgagctggcgagcttgtcaaccgccactgtcggagagaaggaggaaaagagactgacatatgggtccattattttctaattttttttcactaacatgtgggtcccattaaatttttttatttttattttcgtggcacaggttccatttagttttttatttttattttagcgccacatcattgtcacataagacgaagaccaagtcagcatgccatatggatgccacgtaggacaaaaacactagccgaaccgccgagggactcgatttgcaccggttttcaaagatggaggatgcgttatatccagtattgcgatttgagagacatgattccattaagggcagaagttgacggattgagagacgtttctattgttttctgcacacacacttcccgaactactaaacagtgtgttctttcaaaaaaaaatctatatggaatagttgctttaaaaaatcatattaatctattttttaaatttaaaataattaatattttattaattatgtgttaatggcttacctcgttttgaatatcttcttagtcattttccccttcctctcaaacacagccttattcctttggaaaaagtccactttgactcccttaattatcggcggaatctaatttgtgaccctcaaccgcaaaaccggataagacgactccctgaactattgaaaccggttcaatttgactccctcagcggttttggagggcggttttgctgatgtggcgctgacgtgtcgatgttgacctagtattcgtctcacgtggcgcttacgtggcattcaaattaaaaaatatatgtgggacccatctgtcattcacacagaataaaatatattgtggaacccacatgtcatcctctcttatctaccttcttcaacctccccctctctttctctctctttttgttcgcgagcgtgggatgagggccagcggtgggagggtgggcgggcgaaggccgaagcagggtccagatcgtcggcggcagcggtggacgggggccggagcagcggtggccggcgcctcctccaaccccatcccggctagagttcacccagcccggagcggagtccccctcgccgcctctctttctctccccccgcgagtcgtcgacgtcctcgcccgtccctccccacggcgccgttgccgccccgcctcgtcgctccaggtgccatggagctcgccgcgctctgcaccgaccccgtcgtgctctccgccgccttcctctgcctcctcctccacctctccctccgctcctactgcccgccctcccccggcggtggccgcagcctcccccgggacccccgagcgtccccgtcctcggcgcgctgccgctcgtttgcccggccccgcacgccgacctggtgtctctagcgcacaagtacgggcccgtcatg

SEQ ID NO: 42788 - DNA, 16704 bp, Oryza sativa
cccacaatattattttttgtgtgaatgacatatgggtcccatatatatattttttaattcgaatgccacgtaagcgccacgtgagacaaagactaggtcaacatcgacacatcagcgccacatcagcaaaaccgccctccaaaaccactgagggagtcaaattgcaccggtttcaatagttcggggagtcgtcttatccggttttacgtttgagagtcacgaattaggttccaccgataattaagggtgttaaagtggactttttcctattcctttcccattggtgcccctagcccattggcaccgcgaaaaagttttggcccaattatcggttggccagatttgcatcgatctgtttgggctggcccatgtgtaaagggtaagatgagctaatatctttctgcgtttttgctgctggacaggccgcttccggcatcggcgatacggcggacttagcgagactttgccggccggcaaatttcgagctgagctctcgacgccaaaccggcggtatatgcggcattgcgggcggctgatgctattacggcagtacggcttactctaagtttagtcttgtatgcacgcgaaatatcgatagtagactttgtactacttcctccgtcttaaaatgtatctatttttaatgttggcacaggtattaaaaaaagtagatgagaatgattgtagaaagtatatgattgtttaaaaagagaaagtcggtgaagaagaatggttgtgattggttgacaggaagaggtaggtggagaaataacttaattttgagacaatgtactgtgctagaaatagctatattttagagcatctccaatggtctatctaaatcggactctccaaatgtctatttggtcaactcttcatctaatttggcaagtcaaactcgtggtttactccaactgcctctccatctactatctccattataaatctattataaatgggacccatatgtcagcctatactaccatttttccaccacattccccatacatccccttcttcctcccttctacctcggatgtagcgacggcggacagcggaggcgggcgcgcgaggtggcggcggacggcggcgactcgtgggcgcgggaggcgggccaggggacagcagcgagcggagacggcgccgagccagcgggctgtagcgcggagattcactcctcaccggcctccctcgctcctctctcaccgccacgccctccatccctcgccggcgcggctggagacgacgcggacggcggcggcggtcgcggctggggatgacgcggacggcggcggcggtcgcggctagctctggtgcctctctcctccgtgccgtcgccgtcgtacggttcgtaaccgtcgccgttcacgagcggcgccatcgctgccttcttgctctagccgggggagatggagagagatggggtggaaggtggagtggtggggcccacgaatagctaggcaaagagactctaagtttggctagtgaggggtgtgatttagccatccgaatgatttggctaaccacatagagaggctattggagagttttttttttcatacttgctaaattttaacttggcgagtcatttagcctttatattgaagttgatcttagaacggaggtagtagaatgcagtgttgagaccctgccgccctcgcgtttgacccagctcaacctgcagcggtgcagccgaacctggtctcacgtgaactccccgtctgacccgccggtagtagaaacttctcatcgtttagctctgtttttcttcttttaaaaaaaatatagatctggtttgaaaaatgctcaaacatttaggttatatttgaagcagattattaccaagattaactacttgattttacaggaatgaagtagattataacaaatcatctagacaatacagtttaagatttttttttttgagaaaacataattttggagttgtgaagtacataatcctggagctccaaataatctctcgtggagtagctggaaaatttattttttttcactacaagaaagaagagctgcattgtgtgacgtagccctacagtgatcctacatgtaccagccggccatcctaaagagtgatgagaagctagtcgtgtatactggcggtactgcgtagtgcgtacgtagggacattagtatactggaacatgataagtggccctgcagcctgcaggccacccggaccccggaactaagtactcccctataggagtacctagccaaacaataacagatgctttactacaggagatgatacagagtactccataaagctagcatactccctgtgtcctaaaataaatcaagctaagatataatatactccctacgttctataatataagggattttgatttttttcttatactgtttgaccactcatcttattaaaaaatttgtgcaaatataaaaaacaaaaagttatacttaaagtactttggataataaaataaatcacaaataaaataaataatacttcctccgtcccacaatatagagattttcagtttttgcttataacgttagaccactcgtcttattcaatttttttttgcagatataaaaaataaaaagttgtgcttaaagtactgtagataataaagtaagtcacaaataaaataattaataatttcaaaaaattttgaataagacgagtggttaaacgttgcaaggcaaaaactcaaaatcccttatattatgggacggagggagtaatttcaaatttttttaaataagatgaatgttcaaacaatataattaaaaagtcaaaatcccttatattatgggacggagggagtaacattatctattgatgttttatgtcaagtttgtttgttttgaaatggaaggagtagctgccatactttgcttgtattgttatcaagggaaaattggaaccatgccattataattttgtaaaatttaagatataccattctgacccacatgtgattgactcatgtgggttctatatgtcattgagataccgatcacatattttaaattttataaaattataatggcatggatcaatgcataggaagagagtggaagtacgaatcgaacaggacaacgtacgtcatcagttgttcagttatctcacctgtcaaaattaaatcaagtactgccctcgagggatatctgttggcaaatactacaatatatttttaattttgattgagacttggaacctggcaaatatggtattttagcgcgattaaatatcttcatgaggctgatttttggtggagatataaccgtacagggactggacaagttctgcttcgcccaaatatctgtacggagtaaccttatagagttactccgtggttactttcctattgttctaagtaatgcacgcggtacaatgttcatgagaaagggttctctattgatgcaaacgttgtgcttagaggatatggatagaagaagagggaaaaacaaaaataaaataaataaagaaaaaaataagtcgaagatagaagagcccaaattccaaatgatgtccactgtcccaaaataagtatatctaatataggatgcaacatattctagtactggtgatcatgttagcaacggcagcctaggagcccaggcttaaaaatctcttcggcaacgacggctctaggggtagcaacggcctaggatagcggcggcctgagtgctggcgcaaggttctcggcaaggaggtgaatgtgggtcccggtggcggcggtggtagccctagtggcagcggcggcctgggagttcgggaggcagaaaagaatcccgtcaatggcggcagccctatgggcggtagaggaatctggcgaagcgaaagtggatctcgtcagcttgtgtcttgtcgctagttctaactagacgacgatgaatgaaggtgggctaatcggcggcgcgtgacgttagctcacctgaagcggttgaaaatggcactaacggagattcacaacaacgacacactaggggcagtggcgactaggcgatttccactcatcgaatctggctgtttgagaaggtgatgtcacgaagcagggtctgaggtagtaggattttcgtttttatggttgtgtgttctctttctttgttgagatgtaagttaagtgcttttgtattttttttgctgtgtatatatcataaactttatggatattctagctggattaatgaaaattcatttctaaaaaagtagctttttaagttctagaatatgtcacatcatatactatgtgtaattattttgggtaaagggagaatgaattagctaacttttcgtacagtttgatccaacaccgttgccacaaagcctccttgctactcgaagaggattcggatcctagttgtacttgccacggtgccgcctaacaggcagccgtacctgcctgcgactcgatctgatttgtccacgttgcgtcagatccccgtctcgctcgcctcgctacttttatactcccctctcagctttcccagcaaatgcaacgctcgtactcctcgcatcaacagcctccctcctccgctctcaaaaaaaaaaaaaaacagcctccctcctccctcccgaaggccaaagctaccctccatcagctacaacaagcgacaggcggcgatcgcctgcggtcgtgcgcgcgtggcgtacgtgcggccaccgagtagcggcatctgagatggtcctgcgccggagacagagaccggcggcggcggctgcaggtgggctgctcgggccgtggctcctcgtcgccgtgcttgtatactcctcgttcctcggctccaccgtcttcttggcagtcgacgccgcccgcacgtcggcgttcgtggccgtggcgccgctaccgatggccccttcgccatcgccgaccgcggccgagcttgtcggtgacagcaagcggaaggtgcccaccggtgcaaatccgctgcacaacagatgacaatcatcgagcgagcagcagctgggaaggtgagcgacgcagcgttcggtagcatgtgagaagcgaggaacaagcgagttaagctgtcagggaagccatgcatatgaagaagctagctagctactgctgctccttggtgagaccgtaagagagcagagagcagccaagcggaaaggggtggcggtggagagatcggcaatggcgcggccgccgccaccgtaagcttctgattctgcttcttttcttctccacactttttttttgtttctctttgatctgtcgaagctgtgatccgagaggagaaatgaagctgaatgagaagggtactgtggagtgccacatgctttacgtagctagccacagctagatatactatgctcttcttgtttttagcatgtcatggttgcgaattgatcaatgcttcaagtaaaaacgttcatgtactcattggtttcttcttttctagcaataaaaatgcacatatatgtctattctgtgcattcttctatacatgtaactttaggatcgattacattggaaacttcttcaaattagacgattttttagatagtcccttaaagagcctatatatgctatctctattcaactcgctcttaaatatacacaggaataccaatttgttgacaaaacaggctggtcaatgtaaacaccttcgcctgccacttacatataggcttacactagctgacttctccaatctctagcagcagaagtgctgtgtcaatggaggggctagctatttttgtccgcaaccttattttggtgctagatttttaccaacgtagtgtaagatattgttagctgacagatattgcacatgttcctgcaatacatgtctgtcagtgtgtcatttgcgcgctcgctgggcatccttcgcgaagatgagaaaagacgcattgtacgtgtatgcctgcacgcgaagccgttaattgtattactccatccgtttcgaaatgtttgacaccgttgactttttagcacatgtttgaccgttcgtcttattcaaaaacttttgtgagatatgtaaaattatatgcctacataaaaatatatttaacaatgaatcaaatgatagaaaaagaattaataattacttaaattaaaatttttgagtaagacgaatggtcaaacatatgataaaaagtcaatggcgtcaaacatttcgaaacggagagattacgtacgtataccagtgtggcagttattagtggccaccgtcctgcaggaacagtccaaagtgagtcctatggtctgatacagtagctctagcttcgtcgacgtccgttgcgaccgtggaatttgacttgatcattttaatcagagatcgttcagacacccaaggccaactgcagattaaaaaaacgcatcagtctttacgcatacagttccaaactccagtgctgttctcaaggccggaaacggcgaccaatacccacatggctaggaattcagtagtaccaactgcagtacacaaacaacaatagttttaatttccatagctgtttccagattaagatcacacgttatatactactccgtatatacactcaactcgcggtttgatatctaatttaaatactctctctatatattatactactgtaaattgatccttgtttggagtgcatctattccgttgttcaaacggaaccatctttctgggattcaacgttcatagggaagcatcttgtggccttttcctcttggcagcgcactcgatcgtgcgggtctttgtatgcagctagcgagcctagagcgtgtgcgcttgggcaacttaacgcacaagacgccggagaaggtgcgctcatgtcgcttcagctagatccatatctcccctttctcccatctacacctgcactaaccacgacgcatgcgctgcgcgccctatctttcaccgatcgatggatccgggtgcatgcaagctctaagtcatgatctacgagagcttaatcttagtagtactagtttaatccaaggtcaaaatggactggtgagcataggagtgcgcacacttttgtatttcaccgcgtctgcactctgcagcactgcatatatagtcctgcacagttcaagatggaggtaaaaaccttgacaagatggttaggaagagtagtaaaccttaaccacgatgtgatagctatctcggttccagatttgtactaaacatgaactaattagccctttgctgaagatgctttgcaagatttgactgtcgtggaatcccaagacagggtaagataatggttaggaatagactaacaaaatttgaagtattgcctcaggtaccattctaaaaaaaaagtattgcctcaggttaacgcaatgtttttgtactccagtcatcaggtagcttatgtgcaaaggaagaacattacaacatacatactccatggtttactccggtcaagcacacgtaaatcttcaatccatgccagctgcgtcgaggttaaccctgcccatggaagcgcgaggtggaaataaatgtcatagaagtgcggtatctttctcaccttaattaagccagagccgggcttgaaaacccattttggtcacgcagctcaagagattccaagccagcgtccatgcaaatgcatgacggatgcatagcccgcgcgcgctggggctggagcgaggggagcccagcgccgaccagtggctgggtcgccacggtttcccgggcttttgtttatcgcttcgaaggcgttgaatgtttgctgccgccattaatgaggtcacgtgaggtggaaccgtggccaccccggccgcattggctgccctgatcgatccatcggtcagctgagaccgcgtaaggtcagctgcgctgatggattgatctctcgctgttggatctgtagtccctgcttgctctggcctcggtgttcttctcgagagatcattttcttttggcaaaattggatctatagcatcgaaagtttctgttttaggttttgtaacaccgaaagttcaccgcttactttattagcatccaaaatctctctctgttcccataccaagcaattccgtccatctcatcccgtttcccgttttctttgactggattgaccaatctcaccacgaacagaactggaacgaactcttccgtgcttggtggcagcgacggccttgccgcatttgtccatccttggatgtcatcatcgtccccattaccggtggcaacacggactcagcccaacagtccgtgcatgtttaattgcttgatgcgctgctcgccgtcaattaactgaaaaagcttttcacttgcatcaatttactactaaaagagctgtccactgaaattgattggagatcgatgtgatggtcaaggttgttaccgcaggacgggctgccagcgatggacaagcaaggtggagtgggagctgctgcatagccactgatgatggatgtgcaacgttggtggtagtctggtagaagtctgacggcgaggtggggaagcagctgagcaggagcggacgaacaaaaagctgccgctggtgatgtacggcggcgccggtgatggtacgtagaagatgggtcacgcagctaaggtcgcaggagaagatacagcaaggggaaggccactgccggtgggagctagacgaacctgaacttgatctgtgctcccagtgggatgcccagtatggttggcgagttgacatggctaccggagtcaatccagtcaaagaaaacagaaaataggatgaaatggacggaattgcttggtatgggaacggagagagattttggatgctaataaagtaaacagtgaactttcggtgttacaaaaccaaaaacggaaacttttgatgctataaatacaattttgccttttctttttcatcatacggcctatagagcacagtgccacagactggccaatggccacgagcacgacgacgaagattaacgggcccatggccgaggacggaggcccatcaggcctagcctataacgtttcagcccaacatgtaaaaggccggcacgtccgtggttccgcccatgcgtgatgggcccacatgaccgtggtcatgggtatccagttccggttctgggctaagtcactggttcgtcttaaggctcgggtggcccacggcccaccaggccgggcactcttcctccccgacacggcaccaccgcaccacgggacgcggcggcgtagagattccccgccgcgccggatcccgaacccgttcaccgcccagcgatggcctcgcacctccgctccccgctggtgcttctgctgctgctcgccctccaccggctgtgtgccccgtggctggtggtcgccgacgacggcgcctcggtggcgaggtcggccttctccatggacggcgacgtggcgtgggtggtgcaggtaagcgacctccacatcagcgcctaccaccccgaccgcgccgacgacctcgcgagcatcctcggccccgccctgcgcgccatccgcccccacctgctcctcgtcaccggcgacatcacaggtgagcggcgagcccccttctcatgtatcgtcaaatttgattaaaaaaaagtcacgaattgttccttcatgcatccattttgtacagttgtttggtaaggagcatggcaactgccgagaaatagaccgtatctactctggttttgacatattgcaagtgatcggtgttgagtggtattgttatatgtgggaaatagcagtatataaactcgattagctatgctgtgaacgtagaatcaacttccgtataagctgtgaactcgattagctatgtgggaaattatgctcacagcatgagctttttgttacagttgtgctgttaaatgcgcatgtacttctgaactaatcccatctagtacatgatggcactgactacgaaggaatatcatgttctgttaatgagaatctgcagaaaattctgattcatttccatgtagcgtaggcaggttgaatttgtatttgtggttgccaagtattgcctaaaaagatcaaatgatacagtaactcagagtccatggctccatgccatgaaacttgagaatagcttcattagttaatgcaaggtaaagcatacaacttacaaactaccataaggttagtagatcatttttctaataaactcagctagcgtaacatccataaacatattctggaaatatcctggagttattggcctaacattcatttcaactatttgcatgaagaatatgactctgaatttgttgtataaaccattaaattctccaatatcgtatctaatggcgacatacatgaaagctgctttgttacaacaaatggagataaatcccaaatcacttgaaaacattactaactgtattttttatatttggaaaatatttatttgtatgtggaaggtcaaatattggaaagttgatttggtagtaaatttggataacttcaattttcgtcccttgctataatgcatttccttttttcaccttgagtgtacatgttaatttgttagacagaaagcccttgctagaataataaggaaatgaaacaagcacatatatggttgatgcaattgaatgtatatgttgttcttgtagttttatatattcctatgactgtataataatttccagttttttcgtgggatgttaacaagatgcaaagaataggagaaaaactacgtcaagacaagatgagagggaatggattacatacaaaaaagctattgatgcaattgttggaataggtggtattgataagagcaggatatttgatattagaggtaatcatgatacatatggagttccctataggggaggaaaattggatttcttctcaacttacagtgtgaactcacagcttgaccgattaagcaccatcagtagcattttgcttcaggtactccttatcttcttgtctgatctccttgttaggcacaattaattttgttcatagtcgtttatcatgacttattattcgtcatgcgcataatccagtgtacagttatctttcaattaatccagttctatattctgcttctttgaagatgtaaagcatactataacatatttgctgtcagagcttcagttgaacattgacctgcactttataccgctgattactgtgcacagaattaatgctcctctgccttgattattgaacgtcctctttggttagctggtagaacaatatctattggtccataataaatattactctcgtgtgatactgggcatgtagtactacaaatacatcatgcttcaatatcatactgatgatacttgaagcagaaatgtacgataagcttgaacatagcactaaaccatcttactcaatggagaacagctcttgctaactagacttgaccatcaattataatttactaataattgcatttatatgtaacaataatgatgtagtgtgctatactgatgtcaatgcaccttcagactcgcttaatgtacactcaatagcaggacagatgaaggtggctatacattcagcacttaaaccataactggcctgtgtcaacctacaatggtagttaaatttactaaactataactctatttatctttggcagctattacgaatcaaattatgtcttatctgtgccttataatttccgtaacccactttgtctctagcacttatatagatttctaatggtgtcataacagtactagaggagatttttttttttatgttgggctatctgtgcataacacattgtctatgttggattatctgtgcataatacattgtcaaaattcttgtaccatttatatgccacgcatctctgctaattctgcttacaatgctgggcctgaattttatcctaaaaggtactgtagggacgcaggaattatctcttccttggcatagatgatacaatgagtattggcattcgatatccagctaatttatttggccatcctactgataagaggatagacgctgttaattcagaacttcaatactggtccaatcattccaatgttccaataacaaaagtagtttttggacattaccctatgtcattcactacttcatctcaaaaaggacaacgttatgaaagtatatttgcaaagcagtcaatttcagcatacctatgtggccatctgcacgcgaaaattagtaagcagctttggcggtttcatgaaatgagtgcaacaacacaagagcagaaatcaagctattgggaatgggaacttggagactggaaagagtcaagactgatgaggattttagcaattgatggaggtgcaatctctttcatagaccacacactaaaacaggcatttcaaacttccatcttgatcacatacccaacagattcaagaagtatgaatacattggaatcaatgaattggtcaacgagaaatgatataaatgttcttgttttctctaatcaggtgatccgcaatgtgagtgcaagagtttttgactctcataatgagtttaagatagttgaagaaataccactgcagcttgttgccacaccatctgttcacaaacctttgttccatgcggaatggaatgctgaaaactacaaaagtccatcccctactcgctactggctgcaagtttttgctcaggattctcagggtgggaagacatcaagcgagcgacgaccattttcagttgagggtaaagtgcaaattcaatcacgtccatgtctgaactacttgatttttgaagtccaatgggaagacatgtatcaagttcttctgtggagtaattttgccttcataattgtactattgtttgctcccaaattgctgtatcattttatgaagaaaagtttgacataccaaagatggaccgtgtcagttatgctatcccctatccagccgaggaaagcttacttttggttggtctggtttctaatggagggtgcaaggagtagacccatctggttttctttgctcatatatgttatttggcttattgaaatgccatggttttggggtcatgcgacatctgagaaaggagaaattgctcaaatgtacttatccggatggagcatcccatctcttggtgaagacttgacctggaacaaatcgagcaacccagatgtgctggttattacactgcctttcctatacctggtggttgtcccagttgtagttgtaatatatagtttgtttgcagagaaggctgttgcttgtttgcggcacagcagaagaacagaaaacacggtcaacccaacaaattcaaaccctgagtcaggatatctactgccaagtgcttcagtgtctttagcgaacctctcagacaagaaaattctctcaatggtaatgaaattctgtggcggctggacaaggagggtgctcctattgttgtgctgtatcattgcggtgatacatttgaaggtgcgtacctatctaaaacaccatctgcagactgtaccatcaatttcatgtcttaaatgttgaattgcatatcttgcagctttcctcaaggctaatgtcagcttatggagccaaaccagtagccttttctcctccagtaacgtggatgccgttgttattattaagtgctactgcctattgtacaatgcccaacacatattagtgctgtcagctatttttgaagcacgagtatattagataagggcgtgaaaggtactgtccttttgttgtacttgaacgtggtgtgaatcgtttatcaccaacaaaaagctttgtacaattactcgatgtttcagttaataaagtgtcaatttcatttcatggacggcaattcacgtaaaattctatattttgtaaaatttatttattctaagagtacatttttaaaattctatattttgtaatattggattgtaaatttgtaatgctttcagatttactaacttgcgttcaacatccgggcaaaaataaacaaggaaatatataggtgttttcctcactagacccagcaaatatacttgggctttatccatactaaagatacttatagaaaattacaatgcatacgataaattagtacgatttttgcatacatatatgtatcagcgctgatacatatatgtttcagttaaacaaaacaggacaattagtgatgcatatgcccaccgcaacattacgaatcaaaagttaaccataacagcagacggcaatcaacttaggttcacagctagcgacacgccacaacagcacatggcaacaccataaatccaaagttttgacctaaggcaacagcctaaacttcacctgcggcgctgatcctgtccatgatgttcgcgacaacctccttggactgccgcagcaggacgatgctcttcttcaggcgctcgcgcttggcgccggtgctcggcgacggcgccagcatcctctccacgccggccatcttgttgcccaggagctcatccgcgagctccgcctcaaggtcgtgctccacgaggcgcttgacgacccgaagcacgtgcagcgccagcccgtcgacgaggcggagcacgatgctcctccagtacgcggtgagccgcgccctcaggtcgaacgcctgcccggccaagccggcgtgcgccctcaggtgcgaaacgtccacctccccaaagccctccagggtgatcctcgcgggcttggagccgtcctccacggcctccatgaaactatcgtggccctccatgatctccgtccacgtcctcatgtaatccgggttcgccgtgtagtcggagacgagctccatctcgatcagctccttgacgtgctgcgccgaccgcgcccgcgccttgtccatcagtgtctgcacggcgcggcggcacgacggctgcacctgggggaagttctcggagtgcttgagaaggatgttcatcaccacatcctccacgtaaccccacacctcgttcacgagctcgtgcggcacgtgcatgacggtctccaccttcttcttgagcaagacgaggaacgcggacctcgggaggaagttggggaggttgatccccttggtctcctccaggacgcgcacctcctccatcaggaacatggcgtcgtcgtcgctgctcttcgggcactccgcgggaagcctcctcttgtagccgtccatcttctcggcgatgcgtgcggtgccgtggaaatggcggtcgtcggggaactcgtcgaactcgcctcggacgagcaccttctcgagcgaggcgcacacctgcttgacgatgtgaaagaacgccctcaccgcgtcggcgacgttgttgaggtccggcggcatctggtccagctcgctgctgtggcgactgaggcggtcgttgatctgcttgacgatgtccgggaggcatttggcgatgatggtcgcctgaatctgcatcagcctctgcgcgagcaccgggatgccgaccatggacttgtcgatcttggagaggaggggatgatacttgaacagccgctcctcctcgatgcgcgcctggtcgtacgtctcctcgccaatgcggttgcggacgcagacgtagccgaggccgatgttgacgtcgtccatggtcaccttctcgagcaggccctcaggggccttgtccgccttggtgacgacggcgagcgtgcgctccccggtgcggtcaacctgctgcgacatgcggatggactcgcacgtcgggaagtcgacggtggcggagagcacgttgaggatgatgctctccttcggcgcgatatactccttgatgatcttggcgatctggtcgtagatgtcgtcgggctggccctggacggggacgcgcgtgatgccggggaggtcgacgagtgtgaggtcggggacgccgcgcttccgcacgacgagggtgatgggcgcgtcggagatgcccttgccgctcccggcgatctcggccgtggcggcgttgatggcgtccgcgaccttggcctccgaggtggtcaccacgcggccgttgctgtactccagctgcagcttgggcgagtcggcggaggggtcgtcctggagccgcatgacgagcggcacgcgggtgcagatgccctggcctcgcgggaggctgatgccggcgagcgactcgagcacgctcgacttgccgctggactggtcgcccaccacgacgatggtcggcagctggatcccctcctgcgtcaccttgaggtggcgcagccggtcgacggcgtcgaggagagggcggatctggtcgttgtaggactccgcgatggcgctgctggtgacgacgtcactggctgcgaccaaggccttggagtcgccaaccaaatccttcgcgctcttggtcgccatgatcggaagcagcttcttggacatgggtgcagcagctagtgtgggtggcgtcagggcgattggaagaagcaggggaaggagatcgctgtggttgtgagttgtgccacgccggtgaggagggttttaatggcggggatgggtgggagaatgattgcccgggaggtggagcgccgcgcactggaatcccttctcggaagacgaggggggtttgcgcgcgccgggaatcggagcggcggccgcggtgaagcgaaagttcagtacacgagccgacgagcgcgtcttttcgcttttcgagctttgtcttgttctcctggagaaaggtgggctgctttttagacaccgattgggctactctactaccggcccgtggattggcccattactgaaaggctcactttggcaggaccagttctcattcagcccgatctaactttcagcccataaacaatcgtgaagtactccggaggggcccgcgtgaaaaataggtcaagacgcagcccgcacctcgattggatggtgcgcggcgacccgatccctggatcgcctgtacggccagttcatctcgccggccgacgatgcccggag

SEQ ID NO: 42789 - DNA, 12483 bp, Oryza sativa
  unsure (1)..(12483): unsure at all n locations
ggggggggggggtcaagtacgccggcgacgaggggcgaggggaacaatggtgggcgagatcgagtagtatcagaggccttcgcgccgcgtggtaccccaacgtcgacgccgcgaggttcgccggcatggacgcatggtgagtttcaacaactatactctttcagtctttatttctatattttcgggggccaacaattatacgcgtactgtattgcaactgcgactacaccattgttagtctagtaggtctagcatagaaaatgcaacgagtatactttgcattctctccacagtccacaactccagattattgagtccattatgatcagtggggcctaaccttccaggcttccacgagctgaagagtgaagacagctcaaagccagacttcaaagtgagcataattgggcaagccagagtgcccagttaatcatgctatcataaagatgtgccagtagtactatactaagtaatctgtacatctatggcttcttaagttttagggaagaaaaaggaaggcttcttaaactggatgggagcagaggatttaatagtgtacagcagaagcacaaggaccagagaatcgtggcaaatgcaatagcaattcatcatttccgaaaggattgctttcttcatcaaatctggctataaaaaaagaacaaaccgcacgtaccaaccatacaagctacaacctcatacagaacaggacaaactcatgcacattcctacctctgcacaaacaattctgaaaattgaagaaaaaaaaagaagagaataaataatagatcctccacatctccactcagactaactttaccttttctttttttcccctaagttgtgcatacatccgaagctggcaccaatgattcaacattgtgcagctttggaaggactaatgatttctacaactaccacatcataaagccggcaatgctggaccagaaacaaaaggaagaggctttgcttccgtgccaccggcaaaatgagcaaaacctcccatgaaatcagccattatctttcaaaggtaccatcaccaaccaagtacttcagatcattccgatcgactcaccaaagccgatccactaaatcaatagcaagctacggtaatctgcaaagcataattgattttggacgttattgatggtaaacagctatctgaaaacagttaaggaggatatggactgtttcagtaacacagaattcagtactgtccaaaagtataaatacgagtgctagcttttactgtagaaattattgtctgcatattggatgctcttgatgttaatctataccaaaattatgttattttctcctgaaaatatagttcacactagtacaatcaaagatgcttcctaatgtataccttctgaaaagtatcacccacccattgcagtgtagtaaagaaaaaaaaaagaaatttccaggagtaggaaattaccacatgttatatataagaggcatgtgctatgctgaatttgcagcaagggcatcaccagcatgcttaacatgaagttccacgctccggagttcgcgaagatgctgcaagatctcttgaagaaggtccatgcccctgtcacctttcttcagggacttgatgcagtgcctgaggaactccttgtctgcctctagtgcttgcagtctctcgtatacatgatcaacctcctctattattgccagcctctcctgttcttttacaagcacagaaaccggttttgtcgaattatcaacttgcacatccccaacccttgcagatggtgtctgatcactgctctcatctccagctgcatcgaatagaggaagaagactctttcccctgcaaatagaatttcgaccttcaaactttgccttgtcactggtgatatcaccatttcccggagaatggagaccgtcagccgacagttcatattcatctgaagatcggcccacagcagcactggtgtcgttgatgtcatcatcttccaatgtgaagagcctctcctccaatgtcttgagctcttccaagatagatagcctttccatctcaaagtacgtcaaggagtcatcaagagccaccagatgtttcttgttttcttgatctgtcctggggctaaaagcagcatgagacgggctctgaagattgctgccatccggggactcacctagttcgcagtattcatcggagtgcccgtcactgtcctcaccactggatgacacagaagtgccattaccattggggctatgcccgttagccttgaagcttgccattctcctcctctccttgtcctcgtagtgtagcaccttctgcctgcacatatccagctccctctccagttcctgcttctccctctccctcttggtgaccaactcgttcagcaactgcagcgcctcctggtcgtactccgactgctcctccatcatccgttggtattgcagagcctccatctgcattgctgccttctcttcctgcaacctgttgatcattgccatagtctggttggtcgcgatggcagcggcgctcctctcttcctcaagctcggagtacaatgcgctgagtgcctttcgctccgcttgcagcgccgatttcagctgatcaacggtggaaggctcggacaactccatctcgcttgccacactcccgtccaaagataaggatagtgaccgtttcctctcaagcaaaactttttgtctgagatttgtgtggcaacgctgtaggtcggtgtctcaggtgccttgtcgtcttcaacctcgttctgttcgtttggtggctggtctaatctctggctcgccgtcgcctcctcctcctgttcggtttcacttgcttctaatccaaacataagaagttaacattaagttcataatcattttgaaagcatcttgatgggggacaagttaattactagtcaaatgcacaatccgataattgtactaccttgcgcagttgggtctgtttcatggagactttccaatggcagtggctgctcatctgggtacgccaatggatcagttggctcctcaaactctgctgattcatgaaacggcacgacatggtcatcttgctcccgttcgcatatctcacttccgattgatacctcacagttagtgtccacctctgctgatctgttgtcatcttcaggaactgcttcagtgactgaaaggaaaacgatgagactggcataccagatgacaagactggacaattgattgtcatcttcagaaacttcttcaatgactgaaataaaaacgatgagagaggcataccaaatgacaaaattggacaatcgagagaagccaatgatgatcttaccttcgggcacaacaatttcttcttcttcagctgtctcaacttcttcttcttcaactgtttcttcttcagcagtggcatctccaatttgagcaacatcttcaataaccaattcatcatcgtgggggatgatattctcatgaggatcaggtgggcttgtgacaggctctgcacaaggaacgggcacaacaaagtcgtcctcaatcgcgacatccgccgttgcagccgaagaatccaacatcctcttctcctcaagaacaactccgatatcaagatctctcaactcgtgctcgccgtcgatatggtccatttctttctccttttcacagcacgcctgatgcaaacctgactcgtcggcgattgtcatctcatcgatggctgccaccgacagcaagcgctcgccgtcgagctcgatctcttctccgacagccatgacttccaaggactcgtcctggacagcggccatcttctcctcttgctcgtctttatcgtacacctcttcttgccgctcttcctcctgaaattctccatgctcttcttcgttttcctcgtcgtgctcctcttgagccaaaataacatatccttggtcttcttcttcgccgtgctcttcttgagccaatggaacatacccttggtttctgtcttcttcggttgtcttctcctccgattggccttgtcctttatccggcagctcgcgcgaggaggttttcacaacggcgtagcagcaagagcacaccgtggcgctctcctcccctgcatcttttatgctctcctccttggaagaagacaggcaggcctcgcacatgtcgccggcgtcggcgagccgaccgtggtgcaggcagtacccgagcccggagatctccgccgcgtgggcgccgcagaggacgctccgcagccaccgcgcgccatcctcctcctccgtcgccttctcgaagaggcggtcgacgcgggagcagaggaggcacggcggcctgagcccgaagtaggcggcgaaccgggcgatggcgtaggagaagagcccgttgatcagcagcagcgcgatgagcgtccactccaggacggcgtacgccagcgccgacgtgaccctccgcgtcctcctgtggaacagcgccgccgcgaacctgctcgccgccgccgccgccgccgccatcgcgccctccgatccttacaagttagtacagccacagcatgagaaaaaaaattccgatcttcgcctcggccttgacgactgcttggaatctagctgccgccacgccaagccgagcgagaccgaatgaattcttgcgggttgaaacttgcaaaggcagcagatggaatgatttgggaggggtggaggcttggctggatgagttgttttgaagcttctagctttcaccttttgagggagaaagttcgggccattggaccccatgagagagctagctcgctctcatttttctccatttttttttcgcgtttgaatggagggaagggacggatgacgagggttaggaattcgtcccgtttgatgcggccgccggccaatgggtacgtacgaaccttggagcctggtaaaatggaaatgctgcaccggccatgacgacgagtcgacgagacgggcatgaattggcaaattgcgtggtggtgagcacgacttgggcaaggatggccgtgcaaaatctggggtgattgtctccagtaaccattggattctctttttttatggcgattcagtgtccctgtcaacaggtagacacatcttttaatttgtcatcggttggaaaaaatggtacggaatgaaaggaagaactggccttaatcatacatctcggcaccagcaatagaatccgatgcatgcatgctcttaatcgtacatgtacactggcaggaacaccggtcttgtattgccatcgacgtggtttgtagtttgtttgccgtaggtatatataagagtatcggtttgtcgctggagattttcatgtttgttaataaaacgctgctgcagagggtttagtttatctcatgaacctacagcgctgccttactgggaaaaaaatgcattcgcagattcgttgcatctgttgttgtaatgatagtctaaatatctctcaaataatcatggaaggctggccccttcaagaaaccagctaggttccatgaatgccttcttcatgacaggcatagccgtgaacaccaggggatccgcagcctctgttagtttcaggctttcaatggccggctcgctcgtgctggactattcgtactgatcttggttagttgcatcgacgttaggctaagagcatgtacaatagcatgctataagcccgctacaaatatattttaagaagataaatagggagagagaagagcagcgggctacagatttgtagccagctgtagcacgaactctaaggcacactgtgtgtatgataagtgagaccagatattaatagtgtagtatgtaactattgtgtaaatgagctattaggttagttatagatgaattggagctagtagttggctatactattaaacttgctctaagggcatccacaatgtaaccataagagtgagccttaagactttttttcagccatatacattgtggacatggacataaggcattaaatgcttaaaaacagctctaagcttatagttgaacttaagagattaaaaaatgatatctaatggagcctatcagcatatgattgtgaattggtggtatatttcttctttgatgggacccagtgggatccagcttgtttctcatccaaggctataaccattgtagagatagatatagctaaagctatctgcacatgggcccacccctatcgctcattcagcaacccaacattgagcctgccctaagatcagccagcaggacatacgtacgtgcaccgatgcactggtgcgctcacgcactggaaaagcaggccgagtttattacgcagaaatcaccacgtttcgcagcaaactgtacacgagaggcttctttcgagtgtagcatggggagaaaagctaacgttcggaaggactcggctagcgcccacgataaagccagcccaggacacggcgggggacatggagatgttgcgcgaacagcagcgggaatgatacgccccgtggcattattggcggcgagttggccacgggagcgcgcccgcgcgggcgatggcgctgatgaggagcggagcggagttggtggggagttgattgcgcgccgcggcgcccccacccgccaccgacccgacccagctttcggccgccggccggccgtctggatagtgggctacctttgcctttgatccccaaagcgtcctcctttttttttcccctctcgcaacggccagcacgtctccttcgcagcggcacccatcgtttccctggtttttcttgcaagatttgacgaccgtccgtgtgttcgcgtacaatagttgtgttacttgtgtcaatgtgtgggcactgggcagattaatagtacatgccggttcagtgtttgcgttgcgtgaaaggtgcaaaattgatggattctccgaaagcggcagttaaagttgaaggtagagaagaccgtgatgctttgctcaggtaaaaactggaagctggggcttaaagaacgtagcccggaatgcttctagacacctaggaaaatacagcctgttcttctcctaatcagagcttcgggcacgaaccaactaacgttccgctggcaaagctcgagatagcaaccacagtttagtatttcttttagactcaattttagtattggaagaataacaaaataagcgacatatatgaaatggagcagtgctataggatatacgtgctaaaaaaatattacagaattcttacaaataaaaatcttttttgcatgtgtaccattttccttttgcatgtgatcctgatcctaacaatctgcttattgaccgagacataaaaaccaatctcaaagatccctaaaagacttattcatgatgtgagaaggttaaacaaaagataggagatttataattaacggtgcagaaatgaagagaacaaataaaaggtgcttttctgttaacaagaatattattttccctgtttctcccaacagttttgaagttgacaatttagagggtgttacaaactcctctcccaaaattcacatattccattgttaccccgactaaagccaagttcccgagtttacaccattgtttttgagatgataggtgccactccaaatctttacctacttataaaaaattcatagtgttctgctgttccacctaacatacatgtttatcttttattctctttaaaaaaatagatttctcccaatcacttatggcgcccccctccccctttccccttctccaccgatctctctctccctcccatttttttcctggcaccccctcccctcatgatctctgtttgttcctttttttcttggttttttcctccccgacctctcacctctctctccctcgtgtttttttctcttttcttttgttggtttttttcttctcaaggaaaccggccaactagaaaaaaataaaaccttttcttctcaaggaaacttgccaactagaaaaaaaatgaaaacacaatatcatcgatttggagtaaaatctgttggcccgagaccgagtgaaatcatgtgactgtttgcaccagcacgttatagctcgtgtgttttgcatgcccaggagacgtggctccctatgattcagtttgcatgacaagttgagttagcggtgatctcaggttatttgccattctctgtgttgtatggcaaactgtgataagattttatttgcatggtaattggaatcaccggtgccgattggaaatgtcacatgcaaatgcaaatgatactaacaagaagttatgctgctgacccattctaataggatatgtgtgcgttttgtttaaaaaatagcttatgttgaaggtgagaacaaaaatattttttaaaaaacaagttatctagcagttcttcgtgaagaatattttctatagaagagttcagatcatatgaaaataagaccttgatcatctgtatgtgtatgcaattttagttttttcccgttgcaacacacgggcttttttccagtagactgaaattgaagatgatagatggcattccaaatagaaattcgatttgttgcatttggcacagtcctagaataaaagtaccaataatcataaaagaaaaataaggtaagcaaagtcacagcttgtttcctagccacttgcacacatactatcgtataggaacaggttgagaaaagaaaaggttagctatcatggtcattcttaaaaggctgggcaaccaaatgaccacacgctcaaattttgaaacatatatacaatgaacttggctagactttgtgaggcttcagcaatagtaacctttcaaccataagatattatatgaggggtacacacactgttaagagcaggtacaattgcagactataagccagctataaacatatttcgagaagataaaacaggagagagagaagcaacgagctatagatttgtagccagctgcaatacaaactccaagatgcatgtgtgtatgacaggtgggaccatgtattatatgtttatatgtaactattatatgaatcggctattaaattgactatagatgatctaaagtcgtagttagctatactattaaacttgctctaagctacagtggtggagccccaggttgaaatgatttttttttgagaaacgtgcttgtgagccttgattttttaagcgtaagagcatcaccaacaacatcctaaaattttattcccaaacctttttattatgggaatcttacacagaatttaaggtgttaaaattttcctctctccaaaagattgggtaaattggtttcctaaaaacaaaaaaggtgggccacgataaaaatccccagtggaaaaatctgttttacgctccttcctcccgcgagatcgtgtaacgctccgcttttcgtgagtcgttaaaaactatttcggcaaaatcctaattgcgaaaattttcgttctttgtgtgtgagtctaagttgtgccaaggatctcaattcaaatcccgttgttccctcttatcgccatcaaaatcgtccacctcaagattccaattccgactcaagtctccgaaattcaatcacatcccttgaatccccgccaaatacctatccccatttccgaaaatatcaaatccccatctcgaatcatttccttgagtctcccttgattcatccctaaaccctcgagttcgaatatcaaatttgaattcgaatccaaaccctaaatctctccaattctctccaaatcagtcttctctgcaaaagtctattttacctccctctggctcggtgggccgactcttccccggcccatctcctctcagcccgcttctcctcctccccgtacgtgcgctgcatgcgccgagagagagaggcatcgcctctcttcttcctctctctttcctcgctctctctctgcttcctttctccctctcctcggcgccgatctcccgccgtcgccgttcgaaatccggccgcacccccgcgtcgcgtgcgctcgctcgcgaggtggccgaccggccggtcgctgccgctgtcagccctgccacgcctgcgccgcgcagccgcccggccccgctccatgccaaaccgaccgccgccgtcatcgtcaacgtcatccatggcccccgccactccacaccgcacccgtccaagagtgggagaagcagctgctctccctctcctcctcctcctcctcctcactctccctcctccttttctcgttttggcaagggaccaagcccctttcccccttctttttccttttgcccgacaccgccggcgtcatcacctgccgccgccttggctacacgcgtcgacgaccgccagctcgtcgcccttgcatcccttgactgccaatgtcggtttccctcctccaaaccgacctctccccctccgctataaaaacccgagcccccctcagtgcctcgaccacccactcgtttcctcccacagcgccattgccgccgaaccaccatccccgccgtgctgccgccgtcctcgcctccctccgccgtcgcgcgtgctggtgaagccggcgtgcgcacgaggagctgacgcggactccggtcgccctctctccctcggcccgagaccgaggtgatcccgcctgtgccgtcggacacccttcccggcgatctcctgacgcggtagcctccgttctccctcctcactcttccttcccccctagcttgcgcgattgctagcctagaccttcctaaacgcgcgtggacgctgccccgagccccgccgccgcccggcatggcctcgccgccaatgccgtccgctcccggaggccgccgctcgtcgccagctgtcctcggtgctcctccgtcccatccggcgccggaaacggattccttgaaccccggatatgctcccaccccttttaatcgaacccccgttgctccggtgaagtttcccccttttctcgccgccggcgtacgccgccgcgattcgtcatcgccggcctccctccggcgaatccgatccggtggctcacttcctctcgtccgtcccatcgttccggtgtactccctctctctcgaatcgtcgcgacgagctccggtgaactcggccgccgtccgccgtccatctcggccgccccttcttcctcctcccgccggcccgcgtggctgccacgtaggcgccacgtcggcgccacctcggctttgaccgagccgagccggtcagccgcctccttcctcccccctctcgcgcgcggtccacggtgcaccaaccggctgcgcgtgggcccgccgcatccctggtccatccggtgcacgcgcgtgaaccgcgctcacccgaaaccctagcgccgccctcatgcgccgctcccactgtgagccgcgccactgacaagcgggccccacccgggaccccgcaaggtggatacggtccacccggacccatccccctctctcctcccgcgcgccccgcccgcttgggccgcgccttgtccggccatgggccgcctcctcgcgcccgcgcccggcccattggctcggccgcgccgtgcttggccgtacccgagccgcccaaagaagtctaaatcccatccctccttccatttcttatccaaaggattaataaatcctttttcctttgtcccataaatcaattccttattcccaaaattccacaaatcatttcctttggtcccgcgcatcagtgactgtcaataatattcttgagaatattatttctataaattccataaatcatctctcctattctagaaactccaattaaaactttcaaaattcatatcactcaattcgcaactctgattgactccgttccacttccagtaattccgtaaaattgagatctatttaatggcactactaattagtctaaataggatctttcttttggtccttgtttaggttttcgattgttgcgtatagttgcggttatcggattttcgtcgatcgcgggttttctcgaagattcgtgaagcttcgtgaagaccttgagcaaggcaagtcaccctttgaccaattgcccctataattgaaaaatcattattattttgtttgcaacttgcattgttagaatcacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcggaggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42790 - DNA, 8690 bp, Oryza sativa
  unsure (1)..(8690): unsure at all n locations
nnnnnnnnnnnnnnnnnnnnnnnnnnnnnnnnnnnnnnnnnnnnntacggtgatcctaaatttgccaaccaccctaatctaccaagcgctaaatcaagatgagttttgataaactaaaccggcttgtggagccgatcttgttgttcggtagataattacccgtctggtgggcaaaacggaaggttttcaggacaaacctacaaagaggtgtcgcactctcgtngccgtggcggacaatttacagcacaaatcgacaaagatggacaaactaaactagaactagaagcaatatgaaaaaacgattctattgattgattgtatgattgtctttacaattgaaccggccttgtcccttatataggggttggtcttgccctctacaggccctcctccacgtccaactcgggataaaaaccaaaggaaacccgaaacatgccttcccaagcaaggaaatctcgagacccgacaaaacagactcgggctagaactttgccggtcagaccggccacacaccgtcggtctgaccggccaacacacggcggtctgaccggccttctcagaggaaaacgggcaaaacttccgaactttggcaatttccctatttcaatcctaggtaccaaatttaggtgtaaacaagaattagttggagttgcatgctatagtccttatttgtatggtattatttgttcaagttatgatatggacatacctctttctttttttaggaaaaagcaagagatgtgcatacaaagaaatgaagtaatagcattttcatatccatttgaatttatgcttcttggagttctaagctactatgtattttaaatagtactgctaaatcataactaaatacatgttttttgtatgatggattcactatatttaaagtccttaatttcatgatgatgctatgtcatcttggcatatggttaattaattgaaatatgatttacttggtgggttgtgggtacatgcatgatttcatttggtggtcgtgcccatgacaattaaggaccagttctcgagaatctctggaagatatactcatactaaccacaagccagatgggctctaggctgaatcttaagtataatcttttctagctgacacaccgttggcaaggtgttaacaatgaaatttggtaagcccctaagagaattatcacattaccaatagtcaaattcttgctatattcggttaaggaaattaatcgaataaaaggatgcatatccagaaatgaccgagttcaaggaggatgcggcatggcaagttatctattaattagaaatagtttgttagtttccttttatctttaggaaagtgtgtttagtgtcctataaggactttatgttttccttttatctttaggaaagtttctttcttgtcctacaaggactagtatctccccatgggtataaatatgtacacccggggtcatggtaatttatctctcgatcaatactactctcggcgcatcgccatcctctctcctgaggtttttacttatcaaccggcggaatttggcacctgacgcggggctgcatcgggtcagttcgatctccagcgaaggggtaagtcctacgttccgccgccctagtgaatctattggctaaattggtgttgttcaaggctgcattgctttcgatctcttggatcgctctagtttggttgatatattttcttacctgatatctcaattctatccctaattgcattgtgtttagagacacatcggtttagttaggactgtctcggtaaggtatgatcttttgtcttagccgatataaagacacaactagctcggatataaccatgactaccttatgtattaatcaactaaaggtgcatatgttttatattagatttacttgttatatatttgaacaaacgttgctacacaatgagtttcatgtgtttttgtttgcagaggtactcgcttgggcgaaggaaaagagactgagcgtaacgaattcatggatgatcaaagaagttgattgggaccaaaccaagaccttcttcaagtccacttccatcttaacatgtcacttttggtccatagaagacaagagataaagttctacatgttttgaattcggattcgggcctcctgacagcatcaacttcaaacggatctagccgctaatctagaaggaatttcggggcccatgagtacttgttggaaagcttatggagtctactttcatatggatttggtcccacgtcaaaattcctaccgagctgtcgagaatttgcaaaacaagccacgtatctcatccagtccgaatctgatttgggttttgggccttgtaattatgtcgtgggcttagcccaagcgggtgtgcgccctaggccaaccctaggacgtccctaatcacatttattcagtagccgtcatcgtttagagtcaggttttgcttagattattcagtcaagaacagttttgccgctagatcggtttgtggaaccccaaattcgagcgcttaatcattcatatgcaattgtgttgcaatctatcttgttattgattgtgttcttcgattcgcatgcaaggattagccttctcggcgaggtcaaccgggtttcggcatggttgataactagaggagacgtggtgctgtgattgcagggctcagtagcgtgtttgttcagaagctggatcgagttgtgtcgcaactccgcccaaatcattgtttatcagaacctttcggaagatcgggacctgacatcccctcatcaatagatttgttatatccatcacattagacagatctatcagcttatcgaggattagattatcatatccaatctcgtgctgcatcggttagtttcgacctactagattgttgttgataatataaaccttgttaagctgacagattcatgctaatgttttatcggggtgctagccgataaattatctggacgttgcatcggcttacaaggattacatacaagttggcttatccaattgcagcaaaactttcactgtttatctaatcgtttggattttacgacatcggaccttcagccgatgtatgctttaaccttcggatctttacatgttctatcatatcattgttagccgattggtttctactggactatattattgttatattatattatcaacagtcgattgcctttatattgttatttatatcaagcgttagaatctacatcagaattatagccgatagctcaaaaccctatcccaatcggctagtatcggcatcggccggaattaatctatcggcttgttagctgatcggctatttgatccgttgtttacatatcttgtcagttgcagggtcaaactgactggcatgcccgcatctcatcaacctttggacctgtactaaagctaagcagatctctcaggccagtgtgtgtttttcgcatcaacacaagggtaggcgtgatggagtttggatggacctggattttggtctatgctgcttccgaatttacctaggcatgagcggggttgcccgcccctggattttggggtgggggtgaaaccgaaggtgggtgtgctagttagggtggttatatggagggttttgtcatgatttccccctttgcagtatcatggtggtacttcgggtatggtttcatgtgtagaatcgtgtcttgtggttaaagttgtacacctctgatcagagtaaaactattcgaatagccgtgcccgcagttattgggcggtcaaccagctcaccgtgatttttgctgggcctgtcgcaacgtggtttagcgttggacagtgatgatgttaatactacttaattatctactgttttactgctttcaacttatgatttacaaatgttgcttttactgcaaaaatatcctatgagccaatcctttaattatccttgcatcataccttccccttggtatgacttgttgagtacagtggttgtactcagtcttgctttattttttccaatcccccagaagtagaagttggttcaaatggtgagttctatgaagattaggcttgtgccagccgtcaagagtttgcctgtggagttttggaggaagcttcgctttgctgagaagattaagtttagttctctagtttttccgccgcatatgagttttatcttgttatttttgtaagacgtggaactgtatcaaattgtcatctatgtactctggttgatgcctggacagaggttaaatgcacagatagccggtgattcgggttgtcgaatccctgggcatgacagagaccaccatgcctcctcccactgcagccacagtcgccacagcagccgctgctgccgtattccaaccacctgctgtcgccggccagccgctaacgccaccgtcaccacgagctctgcgcctgctatcaccaccacgacgacctctcccgccgctagtgcccccgttgccacagcagccaacagtcgctgcacgtcggccagccactgctgccgccgccgtccagttgctgtcttcgcgccgttgcctccgtgccgtcagctgtcacgacaaaaaatttagcccaaatttccagactattttatgtattaaatccctatccaggaccaacaagggtacataaacgacaaattaatatatagatccaagcgtaaataaagcgtaaaatacttatagaagaggcacttagtcctcacatcgaaacaaaagcagcagcaatggaaaaaggcgatcctagcagggcttcagctccactccataggcagaactcaactggggtctgagccttggtcctctaacttcgtcttcagctcagaagcactatagttctgaaaaatggggaaatagcaagctgagtacaaccatcgtactcagcaagccacaccaatgatgcagacgtgcaaaaggagacaaagggaggtttgcggttgtttgcataaaggcggttgtaaatcattttattgagcaaaatagtaaaatagttgattaattaaggtaatattaaatctccactgatcaatgctacaccacattgaacaggcccaaccaaaccacctgaactacaccggttcattaaccaattattaaggatgggactaatcacggtgaatttggtcaatcgcccaaaaccgcgggcacggctattcgaatagttttactctggccagaggtgcacaactgtacacacaagacacaatccatcggcatgtcaccgcgtcatcatgtgcccatgatgagcatgtcaccatatcgagtgattgtgataagacccttcgcataactctcccctaaccatccacaccacgctaaagtttcacccccaccccctaccccggaggtgggcagtcccctcgtgcgccgtggtgaattcagcagctggacaaacgaacacccggccgacccaactccattacgcccagcctcgccaccggtgcctaggaaattgtcgagctataatatagatcaagtagttactcattccagcttgtggtaagcacagtaagtcttccagggtttcttgtgaaccggtccttaattgccatgggtgcaactagcaaaaccatgcacccacagcccaccatttggtcgcattttagttggataattacgaccaatgaaacatgttcggatgtctcgagcacgcaactcgtcaaggtactataggtctaataatgtaattatcccattatgtgagctagtggtaattaagcatggctaagcatatatgattttagctagatcaacataagtatcacgagctagataatttatcacctaaggttgacaaaggacgggtaacaagtaaacatggcaaaagcgagcaaataggttatacctgatcccatgtaattagcaaaacatgcatatttatttgcaaacagtaaaatatttataaattaggctcaatatgcttaaggggaatgtgtgacattccttgcttcttcacttggatcttctgaactctttccctcgcgaccgcgaacttccggaacgacggagtctacacgctggcacgcaaaatgaggaaaaactctaataaaaaccaagtaaatagtacataaaaagtaaacaaacatgtagagctcaattttagatgaattttacaagttgaatggaccaatatggagttcgtatgaattagatatgaattttagaagttttgagccatttaaatcaatttctagaattaaatacgatttattgcacaattattaattaatttctcataagaaaagggctgtcgctgacatcattaaggggagaggcgcgccaacaggcgggccccgcatgtcagtggcataaggggaggcacacggtggactcggttcaccgcggcgggggcggcaccgtggacctggaccataggaccgacggcctagattggcctgaagccgatccaacgggcacgggcggcgcgacaggacacgggcacggcactaaagccggcccggccgagccacggcgcgtggcggcgcggcaaccaacggcgatggccggcgacgcaagtagcggcggtgcatggcacgggaggtgggcaacgaagggggaaggaggaaaaagagagggggagtgctcaccgagcgccatggcggcaagggggcaacgggcagcggtgaggccttctcaggaagatgacgcggcggcgcctcagcgatgaccaacgaaggcggtggagcggctgaggttcagagaggggcggcggagccgatagggtggtggcgcgtcgcgacgaaggcccgcggaagtagcgggaattggcggctagtgacagggaaatggcggtgagggctcgggtgcacgctagaagtggtattttggtggagttccggcggcgatgaacggaggccggggtgtggtggggcgctgcgaacgctgtggaggcagtagcgtggccgagcgaggcgatgctcgccggcggggagcggctggaggcagtagaaacagtgatggcttagcctcgcggtgggagcggcgtttcggtggcttttggggaaaatggagcggtggacggggtggagttcggcacggcgatggcggtggcggcctagagcagaggtggctagggcaacggtggtgagtggctggagctcgccggaaagaggcggaagttggttgcgcggtgggagcgatgtttcggtggtggtggggaaaaacggagcggtggccgggcttgatctcgcagcggcgaagccggcagtggaggacccaggatttgaacccagggtaggcctagccaaagaaaatccaaatacaatacaatatgattcgatataaaatatggtaaacgatacgtatataactctaaatggttcgatacaattagaaaataacaaataagtttaacttttaggataaaagcttgtaagtctaactattttttttatcaaatgaggcaaatgaatcggacggattaaatgctgacatataaagaagcaactccatactaacttcatcaaaccgattctcaagctcttgacgaattctatcgatgacaccaatgtacacttctctcctatagtggtcatcaattgtttgttccaggtaaaaacggtgggatcttccatgaggcatatatttagcatccattgcgggaatatcaatggaatatttgatgcaaaatgatgtaacctttcctaagaaaccttcccaaccatgcaaaaatgtcatatgaagggggtagtatgctagtagtggtctactactactagaactctagattctagaagggggagagggactgagggactgaggaagtgaggaattgctcactggagaggcggactggtggagagccgaagaaggagtggccggtagagcactagcgctgggctcttgggcggctgccggctgggcgcgtgctgccaccgacgcacgtcgggcaggaccgcgggagccaggaggccgccggctggtcgcgccgacgcgggacagagagagtgtggccaggcggggcgcgccggcgaggggcggagagggcgcggccgcacgggctccgacgcggcacgaaaaggcagtaggaggagcggcgctgtgagtcgcggcctcgcgggagcgccggccaccggattcacgggctcgcgggagcgccgtggcctgtcgggagtgggaggccaggagagtaagtggagaggggagataagagagttagagttttcttttgttgggccaggctttcttatgggccaagaaaaataaatacctgttcttatctgggccaaattatagggtagtcctgggcctacctagactactctttggtcccgccactggaagccggtggtggcggtggcgtagcacggcaacgacaggagccgcggtggctcgtggttggaggacgccggtgggcggcggagctcaggccggcgtgggaagaacgggagagcgtggggaacggcgaggaggggaaacaagagaggatggccgggatgcgttttatagcgctcggcggccgggattgtggccgagagaggcggattcggggtggcaaccggtaggaggtggggcgccgacgtggaggaaatggcggccggatttcgcgggaaggggtgggggaagtgggcgcaaggtggaggaggaccacgtgcgcgcggtttgatgcgggcggggagcgggatgatgcttggaatttcggtgatgtgggcggccatggcgactgaagctgggcgactggaggaaggaggaggagttgacaggtgaagtcgctgcgccctcctgttggcgagggagggaccaaggaggtcggg

SEQ ID NO: 42791 - DNA, 2382 bp, Oryza sativa
ggaggggagggagggggaggctggcatgagagggggagggggagggtcgaaaggaggctcaaaggaaggaggagatcttaaattggtttttcaattaatttaattgattaaatgaactttgtgatgttaaaattagatgttgagctccaaaaattcacagaaaaatcaagagagtatattagggcatagagaatattataaaatatttctggccaatgatttttaaaggaaacttttaatttcctcaataattcacttgattaaattgctttaacttttatttaatttgtagaaaatgatttattaattgatttttaatcccgaacgaaaatcggagcgttacattagccaccgccgctgccaccacgggcgctgccgcggctgtctcaggccacatccgtagctgtctcagccgccgccgctgtcacccatcaccagccgcgtggtcggccaccattgtctccgcgacggcggcagggtgcagggagttaggaggtgcaatggaggtggaggaggcagaaagccatggatgaacggtgcggcgagctggtgaccctaacgtggagagcggcgcaagtggcagcactgatgatgtaagagcatttcgaagaaagggctaaacaggttcctaaaaattaatttttgggattttggttaaaactaggtctgttaatcacggttctaaattttatcccctcctataaaatcgataccaatctcatcagaatttgggaaatttgggaagcagaacgccgtcctaatcgcaggaatcacgccaattgttttactgtcggcgccaaaagttttttttccgtccgcttccttttcctcgtcgcgccgttttttttcgagaaattttttttccgcccgcttcctttcccttctcgcgcctttctcctctcgccgttttctttttcgcgagaaacaacagcgcccacgccgccacgccgccaggctagggttttggggctcctagcgccagctctgtcccgagcgcccgtccgtccagggctctgccggccgtccgtccagggctccgccggccgcctatccgggggaccgccggcctgccagccgtccgtccaggggcagcgccgccggccgcccgtccagggcaccaccacctcgccatcgaccgtccatccaggtcaccccgacgacgacgtgtgctgctactgctgattcactttgaggtattttcagagaaactcatttctacctgtgctcgtatggtttatacgcactgtacaagtgcttgtgcctgtcaccaatcgttgctgctcgctgccgttgcctggttgcttatgccgccggcgctgacagaggaacagctctgcgtgcgtctgcagcactgtgtccttcgcaaggttgtctggatcgggatattaggtagtaatgttttgctccaagtattatcgtatcgtaatattggaatactatgagattttctttttttaagtttaattaatattcatattaattacatatatattatgcaaatatagacatttatcatgagaaaccacgttggttttgatatatttaactgatttctatatatacttgagcatattcatttacattatttccaaaccatcttattttaaataatattttgtagtaacgtagggatcgtagaatcgggataccacttaagatttcgtaggatcgtgtagtaatgaatagtaggatcgagatactatgaaaattaggatactaggtgggatcggtatcgtttcggcttggtaggatcgtagtatcataagatactagaatacgaatcaggatactgacaaccggacttcgttcgatatcatatcgctgcgccttatatagcctcacgaattcggacgtcaaagggtttttaagttgtatttggacgtcaaatattaaaacacgtttcttattgtataaggacgtcattttgagaaaatgaaggaagcatatactttacacactgtaattatatacataccacgttttgatattgtatttttaggttaaatgaaatgaagaacatttaatcaatgttagctaatttgtgttcaatgaaattttctacgtaaattatgtttgttttcgtggctgcgcacgccgcgctctcccttctagtaaaaataagattatatcatattggatataatgtgctcacattgtggaaaacttaatactaatatttgagtttgtttatattattgctgtgacatataatttgggaaacacacattacaggtgcacgatagctggtggaagggaaaggccaaaagggagaagaaaacgagaaaataaaagtttcaggcgccgcttcaaaatcccgcctcaaacggtcaaaagcccctgatccccctttcccctaccgggcctctccgctgccgcctcatc

SEQ ID NO: 42792 - DNA, 4663 bp, Oryza sativa
ggtcaaaaggggtcaattctggcaatgagtgaaaaatgatgagataataagcaaagttcacacttaaacaaccaattttattacctgaaccagccatttatagaatcagatcattagatgtggtagttagtaactagccagtaagcattgaaataaaccaattattccattgaaatactgataaactaccatttatttggctcaacgacaactatttggaaaaataggatgtttggattctgttggggctattaacaatgtcgtttaagatgtgctaaagttagctaatattgaataaaggtaaggacgtagggttttgtgaatacttggtcttcggtgccaatgacattggcgcctatcccccttcacataagtggcttagcttccacggggaggctaggggtacggtgccaatgtcattggcgccctcatgttggaccataacaccaatgacgttagccccacaagaaaggtccattcccggaataaatttttctggggtctatttgtaaagtaagttttcaaaaaggaccaaaaagtgaattacaggcttataatcgttgataaccactcatcatatagctctgaacaatattaggttagccatacggacttatgtaaacttgtacaaactggccttggatgtgtcaaggaagctgtgatgcaattatatctctttagtttgcttcttcgcacatactattgattttactacttcgaatcattacgacctgataacttcttatatgattggtcgagtgacatgttggctactttgatatacacagatattattttatacttcccattaataatattaggttgttattgttattagggtggccagtctatatgtatcagtgatcttgtttcttcttcatcttggagtattcttttgcacagagtaagtttaacaaaaatccttttctctgatgattatggcttgcaatctttttttatttgataagatacttgtttgtgtttcagatcggggatcttctcatgtgctatttgctgaggtgcacatcaatctttctgcctgttaaaaagaatgattattttcaggtctctggtgttccactcaatgtggttctgcgaaatcctatatttgcaagtactgttgcgagaaaacatcaaccccaaactacaaaagcaaaatgtcatacagtaagcatttatttccagattttatagtttttcgactattgagtacaagtctttgtccagtgaaccccgtacaaatatttgattcccaacttaatgctctgaagacacaagtcaacaatttatctcagtatgactaggtctaccatttaaacaagtctcaacattcataaatttattttttcatgtataactataggtgaaaatagttctcaaatacagaaggaaatgtttacctcatccaataatgtgatatcctgcgatgttttatgatattcttgagtaagcatatttttctaaagaacaatagttttgttgtgtgtgaaaacaataacaataacaataacaataagttatacataaaagcctttcagaggtggggaaaggtgtcttctttggtagaaaaaacaaaactatcttgattagcctgattagttatatgtgattttggaataaaagctagacggagaacagtgtctgggattgcagcggaaacatgacttatctgacttcgtgttgatttcattacttcataaatgttgagttccaacaaggccacaacttttctgcaagatttttaattaaataggcaaaacacagcagaattacgatgaaatgagtatatcgcaatttctggttttcatgaagttccaggaatacaaaactagtccaaagaattggcacataaatttaaatttcccggtaataccaaatatccacatggagacatttttgtttataaagtatttttatacttttgtcaattttgtcagagaaatcttcaaattgcatcgtctccataactcgtgctataagaaactagactgttacatattaaattgaaaagctgatgtgcacgagggtgtcccgatctttcgatgagaggataagtcgattggattgagtgacgttggcgatctgactacaactatccagggatgttgctccttagcaatcgttacaccaactccaaaggcagtcgtgaattgcatagtcagcctaaccacaagggtatttgttcctgcaagcactcgagaactagcaagaacaagatgaacaagcaactcaatttgcgaactaaagatgtaggattgaatcaacagaagtatcataggtggggttccgtaccgagcaaaccggcgatctaaccgatcatgggattacacggttcgctactttgatctaaacaaaacccaaattgatctatggggtcgtcctctaaccctaagacctgcccctaacggactcaacttgatacacaacccattgggcccaaataagttgacgcaacaccgttggcagaaaaaggtctagtaaaacggcgattgcagcctctccagaacagatttgacatgaggccggatccatttgaaatagacttgataagttttcgatgaagtacttgcacgccaaatcggagttcgtatgaagtcgtggcgatcgtcagaagttggtgctgtcctgcagtccgaatccagcctgcgcgaatcctctcccctctggatcctctccattgttcctgagtaaaacaagagtgcacgtgtctctggggtataaagatgatgaacatggactcaagaatgaactcacctgatagttgacttgacgtgcacgagcacgggtaataggactatgaagttggacttgtggagatgtggatgtaccgagggtgttgatgtcctcatcaaaaacaaagtgactttatctgcttgatctggttgccttcacttcagaatgaggaaagtcaaaccaggcagtttttgtgaaactgacgaacaaagtgatgtcagaaggattatattacattagctgaccgacttgattgacccacataattgttcctagaatgggtgcctcagcaatcccctgcctcaattttcaaattctctctttccacgtgcccatattcctttaaatgtaactgtgtccccttaactactagcagctggaacctactctcataagaccatcagtgttatgtaaccacaatgcatgtctttcattgctatatcagaagcaagtgctaggtagtgaacatcccaacacatgtattggttcttttctttctttgttttttgtacaacaattgaataaagtaagttcctaattttttatattaatccttttgctatttctctccacaatatgagaaaagatatgccaaagtaataaaatattaatatgtaacaaactgctggttcaaacctatgaacggtggtgaactgtgatttgataacctgactgttttaacttttgagtactggagatattttttatagattttgcaagcttcattaattttggctgttgatttgtatctgattctagtcctataaaatgtcatcagttatattatttgatgagccacatgataattatattctttaataatacaagcacatgtagagtgttcagatgaattactccatcacaatatatagctacttctagtgctcaaatcttgtcgtcgcaaccaattacaacctcctcattcaatttctccacctaccttctccatctcaaccaatcacaacaatctcgtgtttcacctgtcttcttaatctcagtgaattttttttctagaagtgcttatattttgggaacggagggagtattaaataagctgacaagtcactacatgtctttgtgtcatcagtgctacctgtggaaaagtgcaaacatggcggaaaacttatctatttgtcatgacagttcaaattctggagttaattcttcgtttagcagcacttgcaaaattgttactcaacaaagctgtgaaacatgtggttccataagaagagcagaatccaaagatccaagtgaaggatgtaattgtccaaaatttccttctgatggtagatcaggagagtgttgcaactgctatacccacaacaccaggaaaagaaaaaggttatacagttggcagcgccgcagcaaaaagaaacaggtctgttctgtggatgagtcttcaccagaatggagtaaattaaatggcagtaatttcaatatgtctaatggtccatcggagaacctggctggaaaaatgaatgatcaagcacaatctgtcgagctcacagtagataatacttctttggcaaggagcaatgatgacagttcttcagaaatcaaagtaattaatgctactatcttgtcatcagaaaaatcaccttgttcagtgttcgacataaggggttcccagggtttatcttgtcattacagcctgtcagaagtccagtaccaatctacatgtccccaagttgggccctccagttacttacatctgaatgtcagcttcccagccttctattcttttttttacctcttgcttttaagcttgcatttcatcataatggacaaatatccatttatttaatatttttgtacttctgtagttagtttatttttttatcaatttaatttctttgagaacacaattccgtttagttattttgagaaaacatcttttaccgtttagaaaaactgttatttactgaaaatg

SEQ ID NO: 42793 - DNA, 7080 bp, Oryza sativa
tgtattgtttttagaaaaaaaattccttggcattgatctgatgcactattctcttttaggatactgttgtttattgggtatgaacttaaaactggaccctttgctggccctggcatgtgggtagaaattttcactcctttagtgtatatccacaaatcattcattcactttttcttgcacatataatgtttctcataatatgtttttcaatctattcttcctccagagtattcttgaaattcaaaagcacatttctgttgaatattttactgcacactatcatggaactttttaaatgttctagtcgtttcatctttatattttttcttgcagagttgttccatctgcttcaattgtataatatcaaatgcatccaaacatttatcattagattccttgatatcaagaaatggtattttctataacagaaggacaacctatagtgtcttccattgcaaacgtatccttttgctgcttcatgtaccctcaaaatctgtaacaagatttgcgaatgcaaagaagtgttacttgtcataatgatggggaaaaattgagtgaaacctgtgcatgagtgcttattttgtctttcctgttggggcctaaggtgaataggtgatgaggtgtttggagttctggaggaaaccagaagcagtttgtctaggaaagggaggattgtacgatgaggtgatgaggtgtatggagttctggaggaaaccagaaacagtttttgtctaggaaagggaggaaaccagaaacagtttttgtctaggaaagggaggaaaccaaatctataatgttttcttgcttgtttctgttacactagctaatgcgctttttaatagggatttaaatagtactagatctcctacattgcaattcgaatatggaatcttctgttgtgttactcagtagcttgttgctagatgtagattgcaatactgatttcctgtaattttggtagcaaaggacacatttggccatcatctttagataattttgtagtcccattcaattagctttaattaatgcaaagagttcttttcttttctttaacattccgtgtcattgtactgttctaaaattttactatttttatgtaggctaggacatttgattttattacaagtagttctatcaattcagtttttgaacaaagttcaatgggaaaaaaaatagaggattatgcaattggtccattaccactgttggattaacatctcctatgtatggagcgatctttacatggcatgttatagtcacatatcagatcccatgatgtgttgaaatctagcattgcctatgattacagtatgttgtctgagtgttccttaatccttactgctgttagacatattaagcaaaaggaaaaggccagatgctctatctcttgtaaagcacatatttggaatcaatagttgctgtgcaagcttattgaaatacaactgccacgaatctacaatcagaaagtctaattgcttgtgagtcattagatatggttcttcagcgtttcatatcattagttactcttgctgttggatgacacacttctcactaatatttacgattctgtccacatattgtaactgcaatgcacacatcaatgtgctgtagcaacacataaggtgttgtttaatactaatgatatattacagtcgatttcctagcattagggatgccgtatttggaagataattcatcaaccctgtgcagctctgtgccaaaacaatgtacttttgagtattgatccaaattgttttttaagaaaaaagtattgaatcatttttttttgtaaagagctcactgattcaaatttatgaaggagaaattatgttgcttgtccttcaattttttacttggtttaatttttcctctcccaaatgcaaaaccggacaaaaccaaccctcaaccctcaaaatctggcaaaattaatgcctctgccctatctaatacttcctccatgtcaaaatgtaagcatttttgaggttggcacgagtattaagaaagaggtgagaatgattggaggaagtgtgattggttgagaagagaaagtagatgaaagagaatgattgtgattggttgagaggagaatggtaggtggagaaataactttattttgggacaagatactgtgctaaaaataactacattttgggatggaggtagtcgtggttttgacttacatatggaggacccacttttcattgaggatttgatggttcaccattcttctgtccagtgtttgccatatgggcccaatgttaattctctatccctccgtagcatgtgtgcccaccacctatatgttggtaaaaactgttgaaagggagcagagggatgagttttagctgggtttggttatgcacttatgcatcttttttgtacggctggttcgtggttttgggggtccttttggtcccttctgtgtaatttccttttcttcttaatgaaatgaagtgcagtcctgtgttttcgagaaagagggacaaatcaaactgagaagaattgagggatggtaaacagtttattttttgtgaaaataattccaacctgactttactaccattattaccattagttagggtggtgcgtcagtacacaatttttttttggcatattttggtcaatttctagactgtcctaattaatcgtttctaggcaagtgaatgcaaatgcttctatgcatgtcttgaaatcatgtggtctttgcttaggaattagcttccatgtttttcacactcgtgcaggatcataggcttgtctttatattattcttttcgagttacaccctgcaaatgtgaagttttgacatttttactatttacggctttcactaccaggtgctgttggctgcccaaatcaattaaaaatctcataaggaattctaggtgctgacaatataaaaaatttattatgcagcattgctttgtcaagtgtaaggtatgtttgagatagttcgccctcattttaggagtaattcatagaaataatccgatggatccggtcattagtcatgactattttgggtcatgtccttttggtaaattatccaactgatttttgcaacaagttggtaatgttaaacttcaggggttattggttgtttccccaattaacaattttgtaaagaaaaccaaccccattttttgtggccatttaaatgattttctcaccctttgtcaagggcattttatttcaccctatataaagccccactttggtcaaatgggtattaaaatgcctcaaccctccacaagcaagtggaatgatagtacgttgtctatttataatctatcctatgccactgagtttatcccagttgaacaatttatcattgacattgtctctttctataatataccagcgactttatcaattgttctacaatacgccattgggttgggcctttccttcaaaaatactcaaaataccattagagacgtaaaaaggttaacaattaatttatctcactagaaattttttaaaaaatgatttttttatgtggcctccttacataatatagacgttttcgtataagtttcaagcattttgcatttctactttttgtaagatattacctccgtcccataaaaattgaaattctagttctaaggcttagtcccacaaaaaatgtatttctaatctcatgggacccaacaagtaatttaagaatgctaattatgtgggttaattgttcaaaattccttttaatcaattttatatatggaatgtatgcatgtatggggttcattaaataaggttattgtggtcatttgtctatcctcctaatatgtcctaaattagctagaatttcaatttttatgggacagaggtagtataatttatctgttatgctgtataaaatattttttgttgtttcttttaatgtaaatcatctttcatgtgctacataagatattttcgtgctattatcttttgtgtaagcaaattctctcctataccacataaaaatatttttttacaaaataaaaataccaaaaaaatcttgaaacttataacaaacttctttgtaatgtaaggaggccacataaaaaaaatcattttttttaaacttctaatgagatgaatcaagtgttaaccttttatttttctaagggtatttttgaaaaaaaggcttagcccaatggtgtattgtagaataattgataaaatcactggtatattatggaaagagacaatgttagtggcaaatcgttgaactggaacaaactcagtggcatagagtagattctctattgaaataatttctagatgtttcatacgttgcgctaattcaaattcaatagacctagcaaggataaacaaatcatgtagctaatctgtgattaatattgtaagtccattaaatttatagaaaaatgcaccatttgcgacatcaaattggtttcatgaaatccaccatgaaatatgtcttgatagtagtgcattcatttattattgtagatgttggtgagtttttctatagacttggtcagagttgaagaaaaaagtgacttaggaacagaggtagtatagaaattcgttaatggaccttaagtaaaggaaggatttattgctaaatattaattattttgtaactatctgatattaaaatcattaaaaagataacttttgttccatgataggctcaactaaatagccattttgtatttacaaatataactatactcaaatttcaacaaacaaaaaacaaattgctgcttctgagatttttaaacgcttcatgctataaatttttttaatcaaccctgcatctaaatggtttgaactagtcatactttgttcgtgtttgtttaaagtcatactttgttattattcttcatgctgcaaaaatgcagtggagttatcaatttatctgttaattttgctacttacaaaaaacatgccaagccaccatgcaatatgtaatgcgagcaagaattttttatactagatatattctagtctattgactaaaatgttgatcagacatgccaaataaaatttgaacctgtatagcttgctgcctggagtacttatattggttgcaatattatctgacatgagtttttatggacagcctgtcaaaatagcaaaaatgttgtatataatgttataagagaagaatgacatcacttatttttgctgtaaaacaggtggcacctgatgtgaccaagaatgatggcaaggcacattatccacctggaggaaaagcagcatattatgatcgatcattttctcgattggaagcgtatagcacccatcaacaagtagcttcttttgtttgggcagtgctgaaacgaatagtaccaaagccattgcttggaaactcttttggcaagagatctttgaggacaaatatatggaagttcataaagttacgtaggtttgaaacatttcaattaagtgattgtattggcgatctgaaggtatcacattattcttggttatcaaatattgaattctctaactgctagtgttctgcaataattgggaaacaaactgggtcatcaactagtgcagaagagcagaaacagaaaaatattttgcattgctggattagctggttattttctgatattgtgattcctgtggtccgtacatacttttatgttacagaaagagaatcaaaacgatatgatgttttttattacccaaagtcagtatggagggacttaactagcaatgccattgcttccttaaataagaaaaacttcaggattttgcgcggtgaacctaggaaagcagttaggcatttgaactgttcgtcaagagtgaggtttcttccaaaagcaaaagatatgagaccattagtagacctcagagctaaatcgaaggatgccaatctcaataaatgtcatttaattatgaaaaagctaagagatgagaaaccagagatgtttggttcatcggtttttgattacaataatgttcaccaaaatctttcccaatttatttcttcaaaaagaagccagttgatgaagaagttaaaggtatatattgttgttgctgatgtatcgaaggcatttgattgtgtcagtcatgacatggttctaaaaatgatagacgatgctttcaagtgtgatgagtacacagtgaggaaatgctcaaaggtaatttgtaacaggtctaagaattccttgtaccggtttgattcaaatgcttctattggcaatggtaacagtatctatgatttatcaattcagctatcatcaggtggtggcatttttgttgatcaggtagtgtatcctaacaaatgtcctttctttacctggttgactaattaacgaatgtgattgaaaatttgatcttctatccttctcattgtgacattgaacacaattttaattgttattctaatagcgtattggaaatttattaaaaaaatagtcataccagagaagtttttattaaatttcaaagttttaaaatgtttactttgcatactattgatgagaaaaaaaaataatggagcaagcatcaattggtgttacaactaataaactggctggacattgaagaacatgctgaaccatctcttccgttggtggatgattgattttcacaatttcattttattgtacaagttgagagtaaggaacttgaaggttcacttctgttaaggaacttgaaggttattttgtatgtttagaattttcctggatactgaactacagaaatatcctaggctgtacagttgagaccaggaattgaaatttcttttttgtgctgtagctgtatatttcgtgtaattcaatcagctcttttattattttgctacaaacaatcatcaatcaggctggataacactttttgtttttacaaatcagggtactatttgtagaatactaaaggaacagtttcatcatcttctgtatgagcaaataaaatgcaatattttgaagattgggcaaaagtattacttacaacaagtagggattgctcaaggaagcaagttatctcccaacctgtgttccctgtactatggccacctggaaaattcagtgctatcaaaatttctgcatgatagcaagcttaatgcaggagaggctttttcggaacctgaatatttgttaatgaggt

SEQ ID NO: 42794 - DNA, 10009 bp, Oryza sativa
ctttcttaataattatactttgctgttaagcagatacatgcatagcctaattgtcagacggatgcaagatgtggagctgcactataatgtgcgtccagttctgaagcttaggcgaaaagaaaccatttggcttggtttaactgcatacattcgtgtgcttcagcagaaacaatcacgttacaaggatatgctgactttgttgacagcagagcttgggagatattgccatttaggtcatgaatgtgataccttgcgctatgctgtggatgattctcactcgtctatgttctggaaatttaagttctagaaactagaagttgctttcctggtgtactgcagaaactactgttcttttggatattcttttgacaagtcattttgggactttacctccaatctgccgacgtgtcatcgcacgcagtaccaatgcctacctcgctaaaacatactcctggtgtgtgcaaaacaaaccggtggattcatgtcctaacctcattcaaggtgcgactgttggcccgtgttctccaatctagtgtaacgaacgagaacgagcacctcactagtcaaaggttaatggtctcctgaggtgacagtggggtgccgatcatggtttttttttaaagcattttacgactgattgctcatttctttaggatacctggtagcactcgagcagtattaactttttgtataatttattgtgggcattgatttgttttccttaggttactgcaattgaaacgattgcattttactaattgttgccaatcggaattgtaccccttcaattttcagcaattccaaccttttggctcttaatgctaaatctactcaggtccctactaaagatttatagaatactccctccattccaaattgatctagatatagtttttttgagattattcctaaatgatctacatatttgtgctcatttattgagtctattcgttatttgtgtattggagtaaatggacattgatgcatgtatctatgcacacaagtatttataacccacatgcaatatcttgatttgctgttggctaggaaatattggagatggtgcatgcattgagtttgttgctagaataaatatagtatgaaagagttattagctttcttggtcttggtgtacctatgaaatatgtagatcaatttgtaatggagggagtactcaattagtactaagcataaaatgtaatttgagacatgcataatgctagccattcttaatttaattgagcttgtgccatgcatcatttaatttgctagttaatatcaggagatccttttaatacttagcttcagttatgaattttgttgggctcaattttcctcggatgtatttattcttcctatatactccctccattccaaattgatctacatatagtttttttgaggttattcctaaatgatctacatatttgtgttcatttactagagtctattcgttatttgtgcattagaataaatggacattgatgcatgtatccatgcacacaagtatttataacccatatgcaatatcttgatttgttattggctagaaaatattggggatggtgcatacattgagtttgttgctaaagtaaacatagtatgagagagttattagcttttcttggtcttggtgtagctatgaaatatgtagattaatttggaatggagggagtagttggtacccactaagtgcaattatgactataaagctgcatctagaaagagccacgtcatccaaataatcctaaccgtcagattttatttggactgctaattgctatcttagatgtgaactatctcagatcaggctcagatgaagaaatggttcagcccatggaagcccagccgttgccacagtccattgtcttgccctcaaccttttcggatcccctgtccccgatgcaattatttacatgatctcccccttccccttctcttgaatttctatggttctcctgttcactgctttttttttttgggttcatgcatggattattgataataattatgagttcaagatatcaatcttttgggtgcataccaggagatggactatgaggcaaaataaattaacatatatgtatttcatcctcgcagttttctgttcatccaagcttcgtgctgaaaatttgtttggattatgtatttttaacttgcttagtttgcaccaataccagattgtgtagattaaagtcttttattacagtaaatttacggataggaggctctacgaccaagtttatactcaggacaaatccgttctactttatttcaaattatgtctgatcttaataccttttaaattagcctcatatatctctttttttcatgctgtgtaagttccaattcagaattacaattggctacaccacgggacatctcactaacttaaaggtgattttgttcacttttctttgagatcaactgtatgtacaattctgaatgtgcctctttttttttttctatcaaggtttcatgtagtccatttggactaatcattcatgtctcttttccatattatttcctcaaagcaagaataccactttggtaggatacaaatatcccacggtaacacacgaggtacccatctaattttcctgaagtcagtgccagctagggttctaccgaacctctggtttggccgaaccaggcaaactgtctctctccaccgcctttggtgagaggctgcaaggtgcgcctctcagtcggttcccaagtggttggccctactttgagccggtttgaactaacttgtgggcttttcaatccgtgtgctcgcacgtgattcgtcggatgtatgtttcattgtatgtcggcttcatttcttcttcactttgatgtataactcctgcatccaagttaattctctaatcctaatacaactacattatttattattggtatttttccctttactagttgagtgcccatgcgatgcaacggtgaaaaagaaaatgtgatattgttaagtaatcatggtggctagacccttccaataatacctgactgttgctggtcacaattgagctgccgctagccacaagcattatgaccattcgaaccattttcctgttattatggttagagtaatgcatgtgctgccatagatgccattgtctgcagctcctagcccccttccagttgtccatacaaggatatgacaaagtaacaaaatatcaactaaataatcaacgcagcaaattaaactgtagaagagattaatcatcacctagaaccaaacttgtcagatcaattggtgtccatcatctatacaaaaatttcaaatattgtcttgctaaatctacacctgtgctaaaggaacctgtagtgaatccgatccaaaggagccatgcttgttctgtaccaaatatgctgaatttttgttataattctttttactgaaaagaatgctctatggctctacctgccttaaaatactttttttttctcttaacctttatgttcattaccagagtttcagctaacctgtaacaatgcaagcattgttattatagtaccataatacatattcaaaatgattgtgatagaagttagatatatgacttactgtgatccaaaaataagatgagactgttgttgaatctcttagttaaaaaaactaagaagccagacatatataaaccgatcatccttctcccattcttgcaacaacatcatcttggccaggatattgtcttgcacattatatatacaggctttataatttggaataaaatgagcatgggatcttaaaaatttcataaacaggtgctcactacttaccatgggattagattgagcagtaccaaatttaatatatatagcagagtgctcagctgccaacatgagtaacattattactctcacgaatttacatggattttacccgtttaacaaccttctaaatgaagaaccaatttgtacagaagaatattgttattaaagaggacattaggacaaccaaagttagtgctgctaactggaaagcaaattacctgtgcatggagtaatagtaaaggaacgcatacctgtgtaacaaaaattgattaaaaatagaatacaaatctttttcatgcggctattgaagattgagaaaatcaaaggcatgcttcatgtgataattgcaatgcagacaccaattctaggtaacaaacaaatcaggtgttgccttacccatatgggcttcgtttcataagccgattcccaatcggacatgcgaaagaattttgtcacctgagcataaccttttgacaaatcattcagcctcaaaggctatttcaaattttagacatttgtgatttttataccacccaccagcatggccatgccaaatgctattccacgggataaaggtggttacctgttaccacacgacttaaactcagacatgagcatccatgacaatttaaaaactctgcaattttgtttcagtgacaatgttagtttcagctgtaacttcagatcatgtgagatactcatagagaatatttatatgttacctagagaatgatcttttcttgtaaaaaaaataatgttaattcaggtcaaggaatcagagagataataaaatcaaaaactcaccaagcgaatgaccttttatgcttgattgtgactctctaatatttgatggagatttaaattgaaacttggtaaatccggaaacaatcaagcatcagcctaacagtagtatatggaagcatgggaaatctagcctaaatttgggcaattattcgaatagcaggaaccatagcatttttgttgaatgaagttatataataaaattaattatgtttcataaaagcattcacaggcagcatgttgcacaaaaaaaaaaacccacacttccaggcattttcttctttcttcagtaccatgaggctgttacctacttggatctttctacgcatttatatagaataagtaaaagaaattcagggaaactgctaatgtccaattcaggttggttagataccttgatttcccctcataattcaaggtgcaaacaaagaaataaacaggtgcatttacaacaacagtgagcaagagcaaattaaggaacctgttgactgctcaatcagattggttacacatactttgacttccccttgtaattcacagtgacaaagaaagagatgaacggccgctttgacaataccaacagtgtgcaaaaaaagccaaatcatcataaaaaagggggccgatggggctgcagtagaaaaggctccaggagcacgatggagggggcagagagggcgcccgggtcgccagaggccgcgtctaggtcgcagcggaggctggaggtggcgtgagcgcccgccgtgcgacggggaccagggggtgacgaatccggaggtcggggcggagatggatggaggcgtcgagggcggcggcagcggggtggcggcgcggacggggctgcgacgggagagagcgggcgagcgagaggagcgcggggcgttgcggaggaatagatgcggtcatgcagagaaagaggaagtcaggaacaaatgcggaggagcgtggaccgttgattctgcaggacgatccttccagcaatcttagccttcgattgtttaggactcaccaccaacactacgcttttttaaaatagtaaagattctccaatacaagtgaaactacattttttataactgagatatacgtgtaagaaatgttagttctccttttatttattacagtagtcgatgttcgaaatcggtacttaagaactgtcaacaataccacataggtgattagatgatgagatggagataagtagagagatgatgaatctattgtatatgttacctcttaatttgttgatatataatatgtatgaaaatagagataatagtcgcctctgctataaaaagtttgctcttggacagtaccagaataaattagagtggaccatgctttaaaatgcgtggcaaatattggcaagaatcaagatggggcctcgggaggttggcttcaaggccctgtcccatagattttttttttcccgctgagacctgattaatgatccgatcatattcagatacgctgctgctcaatccggccagttcgagaggactgattggccggtttgaaatgatcaagtgatcgttaaaacccccaaaactttcctctggcgatcgatgatactcatgaagttcccataggccatagctctgcgaaacaacaaaaaagtacttcttttcataagtgcggtatctagctctaccatacaaactgtataccgtgctacagttccttatgctacaaaaacgtccaaaggtgttcatatggtgctttttccacaggtaacatgctttactggaatgcgtgtaaagatgttcatatggtgcttcactgatgactgatctaatcagaagtataagctcactttgcagccgtcgttcgaacatttccaaaacagaaaaggtggtatgatctccatcatgccaattaaacatgacctgctaaatagcatgatggatctgacaaagtaagattatgacaacaaataaagcttcagtaaatgaccataatagcttgaatgcataattacctttatcttctaaacatgcgttgattactaaaattcagctaagctccttcagtgatctcagatagttctgtctgtgaagttggcaaccatatctcaatacgactacctgcagtccctataattgcatcaggtctccgtagcgatatcacacgcaaaacacagccatagttctcaagtatctcacgggcaactgttaatcctgcaatgaaattccatgtcatattatcttcatgcataccatccgcaaggtctgacccgaatggagcaaggcaatgcatctgtgtctgtaaaatgatagaaatcagaaatttgaaccaattgtcaatgataaataaaaactttgctggacatgaaaatattcttacagtgcttgaagcaatacaagcaagtgaaccaaagttcaaacaaatttaggcctccaaaatatcgcatctaaaataaaatatctcaatctggtgaccatcagttaactttaggtttcactagaaaattgaaaaccgacactatatttcattattagtacattgcacaatagtttgaatgagatgctcttgtattgttgtcccaaaggaattctttggcacactgatgaaaagtcataattacattggattgatgtcccataattctccctatgttttatgttttcttttgtttcaaaactagagtgggtgtgtgttttggctgtgtgcatcttagttatgcagaggccaataaagtttccattatctaaaaaaacattatgaaacactaaagagccttacaaatgaaagaacaaatgtacttaccatgtattgcatgtcaggaccatcatcatcaatgacaacgagaatgcctcctgcaggtgcttcaccagcatatatctgaactcggccaccaagctgagtgcgtagaagagcaccctctatgagattactcagcgcttgtcttaaagcagattcctcaacagcaacttgaagcgggtgtgaaattcctgttacatctagagtgcgttgctgcctaaaagcaagcggttgagctgctccaaccaaatcttccagtacaacagagagatcacatggtctgcctgacaacaaataaagtgacaaataatgcacaattgaattgttggggactaacatctaagttattttttactcaagcaattaaaaatatggtaacttgagatgtaaacaaataaagtactgacatacaagtacacgggacatgggcgacatgaggtcctcaaaagagcaaataccccaacactatccaaatcgataaaagtgatttttttcaatatatacactattcatacaaacaccccaataaatcaaatgcaaaaagaaagatttatgggaagggacaagatggacgattgttttgtcttgatcaacactgtgaaacaagaagacagatgaaacaaaaattagttcacaaaagaacaaagaatgtcagaaaaacataaatcttttctagcatcaattgaatttaaaatttaaatctttactgatgatggtccacttttttctgactttgtttttcttcttctgtccaccaacatatgtgaaaaccacttctagttggtaggagggacattttttatctggtttctagttttaagagttaggagatgagttttgtttggttttgtagttgagagaccaaaattaaatcgattcaactgggtaagggaaaagaaataaacttttctggacaaaaacatggagttggtgcttgaggtaaaagaacagtttaggccgcgttctttgcaagtgctgggaccacttcctccagcacacaaaatggagcgacggattatcgcatgattaattcagtactgtattagctaaaaaaacttgaaaatggattaatatgatttttaaagcaacttctcaatatgattttagcagttcacaaaccgtgtgcacggaaaacaagcattgcgaatagtagtgtttaatacataggcattgatcaagatatatgtaatgaaaattttcagaaatttggtcaatgtaaatatgttttttctttggatcagtagatctttttttaagaaaatgatggttttattctccacttaatttcaatgctacatgctttcctgttccctttttagttgcatatttgcatagtacaatggatttagatttcacatatgttttgcataatatccttctacctttgtaatggatctcaaatgcaaaactttgtcagtctgaaactctggcaattaagataacataaacttgaaatgtacagtaatatttacttgatattcatggtaccacaatagaacttttgctagtacagaaaaacagaccatgaaatttagagtattatggttttctcaaatattgaaatataagcatggttaggaatagtgtagaataactaggatatgatgtttcatgaacccaacagctagatttatttgaaaccattgaaatgttatgtgcatttttatttcagtaaacaataaaatagttattacacaagaaatggtccagcataaaataatctgtgcaaacaactactacctccatccctgaatacaaggagttttagagttggacacggttattaagaattacttagaattaaatggtggaagattgtgattggttgagaagtggaggtaggtgggaaaattgcatggtgggttgtgattggttgagaagggaatgttggtggagaagttgttataatttggggcaaattctaaaggctaaaagttgttatattttgggacagagggagtactttagaagcacatgaaaactatgacaaaaataagttttactgaaaacaggagtgacactatgcattgggtactggtaatcaatagttattggtctgtgatagactacacttattttgaaataactaaaactgaactacaagtaaatcacagctacaacaatttcttggtaaacaaagcattcaacgcatgaaattagtctactatgtaactgagagttcaacatcttggaatggcaaattgaagcaaactgttacctagcgtcttggggttgaagaggggccagccagagaggtggcatgggtatcaccatgtctccattgtcagaatcatgtgatgacaacgaatcaactttctgtgaactattcttaggatctgattgatagtgtggtagagttcttgaagaaggtgacccctgaattttctttaaggtttcctcattgtacctaactatgttcacctgttcagataacatgacaaaaattcacttagggatacgtgaggaaaaatcataagagataatggaattatccttgtatgctaaaacattgtcttaattaagttttatcatttgggatgtacataggtctgctcattggcctacaccactgaactgatggttcacttttcacttaattttgttcccatttgtaggcacttttcccattgcatccctatatgtaccccattacccttggtatccatttcca

SEQ ID NO: 42795 - DNA, 4716 bp, Oryza sativa
acttgtctaagaatgagtgtgatggtatctgaatatcagaagtctcggagttctttgtacatccaactagttctgggagctccgcaacaaggaaaccaacaacaaatgggtgtttcaccattggaaggactacagctccaaattcagttatgatttccatctgcagcatatgagatatagtaatcaatgaaattaaaacaaataggaagaactgacatgattaaacttgaaagctcaatagctgctgtaactaaaactggatgagcaggtgtggcctgacaatctctttaacgctaacattgccctactatttgccagttgcatgttcagttgattaaaaaataaataatttactaaaacaagtttatacactaagttttaacccacataaatggtaaataatgttgttcccgctgtatgcacaagtgaactctgcattggttcataggcacatccgcacatgtggtgacaagaatgaggtcaggtgttcgttaaccttttgtccaatcaatacaattcttaaacgaaataaggtgcttcattggcagtattacaactatgaaaagtaccatgtggattaaaaggcaatgaataatttacctggtgttttacaagaaaagcttccgctgctcttagtccagcagatatggtgaaattaccaactagaatcactgtatctcctttagaaacattagtttcaggatataaagcaactcgacgtaattcaagctgatccataatataactgccagcaggtcttacatacaccttcaaaataaatagataaaaacattttctttattaatttatgaccacataggttgaaataagcacctaataaattcctaacaagaaaagaatttattcatctaaatggcagataagctaaaaacgaaacaaatggtgacatgattgtttcagattaatcgcggaactagttatttgctctcatactttacacctccaaaggatgaaattcagaatttgctacaaaaaacatgaaaactgttggcactcacaaacactttgctactccatttttgtgggctgaggaatcctagtgtcatttgcaggggctaatagaaaatttccacaaatgaaaatatagcagttacatttccttttgaaagaagaaggggatgcacttcaaaaccttttctacgtagtctagaagaaaacaaacttctacactccttattaattattagagtaaatttcacgaaaccacatattttacggtgaaacttacataaaatccttggtattttgactggtggcacataaccccagccatcatggttctaaagtttcacaaaacctcgatgcatgttgactatggatttaattacttaaaattttaaaatatagagtgcatataattttttataattattgcgttcttgactaaggttgatagtttaactcttcactaatttgcaaaatatcgtttcagatatattgaaattaatcgagatctgtctaaaggtgggttttatgaaacataaggaccataaaacctgtggttatatgccacaagtcagaatatacatgtggttttctgcaacttaaactataaaacttgtggttttctgaattttactataattattattcagttaaatttaatcatcaactgttcatgaacaaatgttgtgcacataagcacaattggacctggatattaccatcctggactcctgatatcattttgttgtcatccttaccttattatatgttctccaatgtttcgatgtactttttgttccttaaaataacataagatggtagtacctattctcatctaataactatattgctcataggtgacttattttgagcagaacaagactgtaggagtagcaagcaaacctatatagtgctatcaatacatagggaaaaatatagcttacagagaggacggcgtcgcgggagatgaccacccggaacatctcgagctgctccccgcacagtcgccggaagtcggtgctgggctccgtgaagcctccctctcctcgcagcttctcattctcctcccggtgcaccctcctgaaacgcaccggcgacgcgctcgaagcacgccggatggcctccgccacggccgcagccgacggcgtgccgaggtcctctacctcttccccctccccctccgctggagccgcgacgtgacggagcggctggcacgcggcacgggcgagcaggccgtggggaaaggagtgctgggcttcgatggcaacggcgggtctgggattgtggggggtcgggaagcgggggaggcgaacgcggagggcgaggtagggggtgtcgaggagtggcatcgcggtgcgggaggaggcggtggcaacaacgccaaggggactattgggacgacgacgttggtttggccattggcgagccgcgagcgccagaaacgaccggcgtcgaccggattgcggagagcaccggacacaagtttccgctaccgcttcctggtgtggctgaacagtggcttcttgccggggctgcgtgcctgtgcccacaaacccacgaccgtcgcgttagccagagaaacgttatccttgtatggatggattatagtttctccctttttaaaaacttattttacaaataaattattaaaaatacctattcaataactaaactattttcatggcacaaacatcattatggccatggtcgacgctgccattgatattgcatcgtcccccttgccttccacataacctaaattacggttgagaaagggttgttgtcagtgacaccaatcacttgtttatgaaaaatagtttttaaaaaaactaaaatgtaaatatttttttcttataaataggttgtcagcaccaactactcttgtgctgagaacctatttgtaaatattttttattaaataagttgttatatcttcaatatatttttctttacgtttaacttgtcattgattttgtgttgaattgtttactgttgctaaagattggaattttttttcgatcactaaactaagttttaggcttagtatacgttgggagaaattttttcaggatttaaacgttaaacggagggttcattttcaacactagcataaacaagttaatgcatacgtatgtttatattaaagttctcatccccggaagttctcaagtacatctacagctatttcccgagcaaactcctaggcttcatcaattagctcaagtgcgtgctcttctgacgtcccatcggcgaagccatcctagcggcagttatatccactcggggatacaaagattttgtcatcgccaaggcctggctagctcccctggtggcatcctctttgatactcttgaaatatttgcttggagaacttcttaacttgtcaaagatttctatgccatcttccgagttggagcccaagctattttgaaatatggcattaaggactggggtcggtgcactagctatttcatcccgcacaggctcagccctttctacccttttagcgaagacatcaaattgtgcctaggtttttggctttatgggctacaagtcaagattgacattttatcacaaggtatataacggcaactatggtagcagtgggttagtatgcttacctgtcacgcccaaaaatttgaaaataattgaagaaatgatgcccccttaaaaaaaatagaaggaagatgaaagatgtgatacactttctagctgaagaacttatttagattgatttccatcaatttagaagacatgccttagtcttatgttcaggaattttcgttgaactttagttttccattcaattgtgaactcggctgttttgtggatcttttttttttggctgtctacgtatctgttgacagaaaatcctacctcctatctttcaaattaattttggacaattggatctgcttcaagattcgttcagaccccttaactctaactcctctcctcctcccccatccagatcgcaccgccactgctcctaccgtcccttgcacgatcccccgtcaccaccgccccaccgcgccgccgcctgcctcgccggctggatggagggcgtcaacggcgctggcgatgccccccggccagcctcctcccccttccccctccttcctcctcgagccgtcggcagcgtgatgcccctgccaccaacgctggcccactggtgtcctccagcccaacggctctagtgccaccgtcagcgcctcgccacccacccgatccgccacccactgccgggcatccctctaagcccggcgaactcccccttctttcccctccccctcccacccttcccaccccacccacccccaggaccctaattcgtcggcccttcgctagagtttgggttgtcgctggcgccggagaaagaagaggagttcgtcggagttggagaagaagcagttggagcacgaattgcgaagcacatccagtgaaccaaaatttgcaaggtttggaggtaggttttctgtcgactgaagtttagcaattctgttttttttttttcaccgtgctggatggtttaattttaactacatttttttattgtatacagagcgttgctattttacaattgttggtatttcttaacgacattacagaaatataattctcagcaatgccacagaaatacttctggtatattatggttacagagttcatccgcaagcgcacggatataccattgtaacatttcacccgagagtattccaagggtatcgtattaattttatctgtgggaag

SEQ ID NO: 42796 - DNA, 14362 bp, Oryza sativa
cccgtgtggcagcccacgtggccgccacgtcagcgccacgtgtgcgccacatggcgctctcttccccggtcccgtggactcggcccaccatggaccggcggcattgagccgatgacatgtggggctcgtatgttggcgccgcgcccccccctttgctgacgtcaccagggttaataattgcacaataaatcaattaagacttttctttttatagtaaaaacacagtgaatcttctaaaattcatagaaaattcatccgtgccccgtttaagcccattcaagtctcagtaaatcgagaaaaatgtaaagaatccattaaaaattgttttgttctctgtttcagtagtcttatagcctgtttgcattgttttccttgtatgtcgcatagatttcgtgtctcccgacgctccggtgtacttcgaaatagtcgccgaagttcctccagccacagagcaaggctagtaatgcttttctcttgaacatattgatctcatattgcaaatgctctactattttcctttaaatattgcattgttttataatgttactatcggatgattacctactgtctcagccatactatttgttatcctgttccttgctagcttgggtcgtaacatgactagatgttggattagggattgcttagccatgcttagttcaactagtacacaatggaggaactacattaatgcatagacttcagattctagtattgatgttggattagtgccactgctttggtgttggctaattaaaatatattaaatggtgggctatgggtgcatggttttgatggtcgcgcccatggcaattaaggaccggttcgcgggattccctggaagaatttatcgtacttaccacaagccagcgtaggcaacggctgggcttgtagtgtggcttttctctagctgacgcatccaggcaagggtgggcgtgatggagcgggatgggccctgcgacggcctttgtcgcttccggattcacctaggcacgagaggggattgcccgctgccttgcgaggagtgggggtgaaacctgaggtgtggtgtgcttggttagaggggcttatgtgaagggtcctttcacggcctctttccggtatgtcgtggtggcatgccggcgcacgggaacgtgtcgtggggttgtgtcttgtggtacagttgtataccttttatcagagtaaaactattcgaatagccatgcccacggttatgggtggtcaaccagattcactgtgattagtctcaccctagtttagctcgatggaactgattagttcaggtggtgggttgggcctgtctcaacgtggtgtagtgttgagcagtgattgttttaatattggttaattactacaactgttttactgctttcaactactatttataaatgctagctttatgtaaatgaaaccccttttagccttctttggttatatcctgcatcataccctccgttccggtatgacttgctgagtacagtggatagtactcagtcttgctctatctcccaatccctcagagtttgagtatgcgtccgatggtggtttctccgaggagtaggcttcgtccgtgccatcgaggatgcctgtggagtggtgttctccgctactatccaagtcaaggcttagctctagttatcctttaatttccgttgcatttgtgtaagacttttataatgtttgtaagacgcggatctgtatgtcaactttgtcatttgtataccctggccggtcctggacaggggttttattgcacattctacttggaattctattcgggaatttctgggtgtgacaggtaagtcctatgttccgccggacttggcaattgtattggctacattggtgttgttgaaggatgcatcgcttcgacccttcgatcgctctgttttggttgatatatttgcctacctatttatcatatatcttagttaatctagtttcagtatatcgatttggtcatatcaactaattcttgctttaggatttatgccggtatcggctaaatcgctttactagattagattagctaaggtatctaccacccctgaaaataagtcaagggcttcattgtctagatattgtgcttcttttcatacttagtgctgcatcagtacattcgacctactaagtcgtgtttagaaccatgatctctaggctgcttttgattgccaataagggattcatcggggtttcagccgatgagttatctagatgttgcatcggcttataaggattacatacaggttgggtttagcctattgcaacaaaggtttcacttccagctgatgtatgctttaaccatcggatcgcttattctattatatcattgttagccgactaatttctattggattatattgttgttttttacattatcattagctgattgcctttattgtaatttactcaagtgtcagaatatatattggatatattgctcaaaaccctatcactatcggctagcatcggcatcggcttgaattactccatcggtttgtcagccgatcggctctttgatctgctatttatatcgcttgtcatttgtcagatcaaactgactggcacgcccgtatctcatcaacctttggacctgcactggagctaagtagatctcccaggccgttgtgttcattgacttagtccgcgcttgtaaagttttggcaccatcggccgagcgcggatttttcgttaacaatgtcatttttctggaaaaatggaaataaagagaatgctactgcttctttaccttctcccccaatttcttttccttgcataaatatggagagggcatgactatttctttttctctctgttttttttatcatgctccatattttggaagaggatgttttttttattgctaagcctttccctgcttttctctttttcttttacaaatgatttttaggagaagaaggcataattggaattggagtatttatttggatggaaatgtgtggaaatagatgataccaacttccagtgtagaagcttagcttatttgtgcatcaatggtggatgagtacccttgatcatgaaagtatgaggacatctaacatgagtcacaataatttggcaacgcatgtatatgttttaacattgatatagttgtgtatgaccttggtacatagtgatgaagtcatttgaggagtaagaatccaaaattttagttttgaaaacaaaaatcccaagtgtcatgacaaagatcataaaactttccttcatcttaaccatctctcatgtaacaattacttagagcaattaggttccctaaaatggtagttgttcacaagtgacaactatagttgaatcacaggaaaatttcattagttgagagtttatccttttcaatttggccttgagttgaattttcatttaatcactgctcatgtactgaacaaaaaaggagagtatgaggaagtggacgtgcttacctgtacacctgacaaaattaagagagattggagccacgatgggttcagccgaaccaggggttcggccaaacccctctgacgcccattctctctgtaattttcagggaagttcagtgattgtcagaagtttagagatatgcattattttcagattttgcacgttaggagtccgaagtatcaccgccacacttatttttgaacctaaactttattgaatatcctagaaataaatggcttccattggggtaaacaccaatgagccaaaattattataataaagacatgcgcttacattgaacattaaagaaagcaaagattgaaaataaactaaagcgcctctaaactacttattaaatggggaaggcatctaattcgcataatacttgtcctccttccccatttcagtgaatgcgcttgttcttagtgcacattccacggctaaaggtgttgaaatcatgcctaagctcagcgagctcaacacctaatattgcggtcactcaactccttgttctccttacggagcttcttcacttgactcacgagtttagtgaccgaaggcttgtgcgattttcacttcatcttcttggtattgccccggcgcccgaatgataggaggaggagtcaaatgacgcctcaccttggcgggtgaggaaccaaccgactctgctgcctcgtccttttccatgggcgtcaaggggcggcacaagcccttgccgtacccaccgctaggggttctcactcccataatgcaaaacctctcccccttaggggttgatggagtggcggtgggtgtcttgtacttgtttagcacctcatctcctgccttggtgtacagagtgcccacatacttcttggcgggtagcagattggccttcaattgctcttcgaacaaccccctcgccgttattgggcctagcttgcccgtcgtactggtgaatcacccacaccttggtccttgtcatgtggcacggtgagagagatcgtgctgccgaacgcgtagccgaacggggccgggaaggattcggccaaaccagggagttcgccgaccggccccaaatcggccgaggagcttggcacgaagatgatgggttgcgcccacacagcgtttaccccctccattgtgtagtttttgacaggaactaattggttagccggagtgggttctccctctaggttaaacgtggaattggaggtggatccgatgtagggcatgagagattttccagccatgggggaacaatcactagtgtgaggggaattgagggaacttggaaaggagagaatgcaaaggaggagggaagaagagaggcttgagagtgctctgcgagttctagattgatctaccctgaaactcgcatcacaaacgaactaacacgagcgggggaggcatccattcaaaattggggccggcaggacgccaaattttgcacatctcttgactaggctaactcaagctagacatgatacaattttatagaatttaagcaaattttagatgagatcattatggttcgtagttgattaattcaataatatccacttctttatctaaaatttcattcggctcaaggaaaatttttaagcgctatctgtttaccttgaatatgttacctgagtcatcccggagtgtgattgctctgtgcggcgaggtatcgatgacatcatatggcccttcccatttgttgcgcaactttccatgtccaaatagcctttcccatttcctggcttgaatttcttgatgttttatccgcttgtcgtgccagcgttttgttctctccttataagtcttggaattgtgatataccttgtctctccattcttctagttcagctaactgcatttatctccattctccggctccctcaaaatccatattccagttttggattgccaagtacgctcaatgttcgagttctacagggagtcgacatgacttcccgtagattatctggtatgtggacaattccaatgggtgtcttatgggccgtccggtatgcctagagagcatcgggtagcttgtccttccatcctgtgcccaatttgttgatcattttctgtagaatattcttgatctgtttgtttgacgtttctgcttgtccacttgtctgaggatagtagggtgtagcgacgttgtgcttggtgcccatttcacgcaaaaggtatatgatggttttgtcaatgaaatgtgatcccccatcacttatgaccattcttggggcactaaagagaggaaagatgatttccaagaacatcttcttagcatgtttggcatccgtagccctacgcgacattgcttccacccatttagacacatagcctaccgctaccaggatatactcacaattatgggacttaggaaaggtcccataaagtcaataccccacacgtcgaatatctccacttgtaggttatacgtgagaggcattgcatcgtgagcagtgatccctccttacctttggcagctctggcatcgtttgacaaactccttggagtcttcatatattgttggccagaagaatccactctgccagatcttggcttgtgtgcggaatgcaccgtagtgtccaccatagggcgaagagtggcatctctctataatcttgagcccttagcaatccgtccgaacagactctatataggtatggctcatcctagatgtgacgtcagctctcatatttcagctttctctgattttcttccagtgatacgtactttaataccatgtagtttactatatttgcgtaacatgggttggagtcgtgcaccgtcattagcatatcgtcccatagaaagtcatttatcgggggttcctgcatgttagtgatttgcatcctcgacaaatgatctactatagtattttctactctctttttatccttaatttctaagtcaaattcttggagcagaagaatctatcttaaaagacttggcttagcatctttcttagtgagcaggtattttaaggcagcatgatctgtgtaaacaattaccttagctcctatcaagtaagatctaaacttatcgatagcaaaaacaaccgtaagaagctctatttcagttgtggcataatttttttcgacggttaaaacagcgggagaggctcctatatatatatatgtacaagattgagatattacagggtgggaagaataaattacagtgctatctaatggtttgtatccatgcttgccaactgggattgtctgctgcctttactctgtgcatatgccgagtaaaatcatccttgaaatctttggtccattttctgaagcttattggagttccattaaagatgaggtcatttcttatagcccagatattccaacagctaatgcccaggatttccatgaaaaaagaatgagggaacagatttttagttgccatgatcatattcatgaattccatatttaagttccaagttatgccaacatggttccaacattattatgcaaacggatatgagaaaaaaagtggatataatcttctgtgtttgtcacattgcacaccagacatttaattcctccctgagtagagtagttctttctttgaagcagttctttagtgtttagtctatccattaagagtagccaaagaaaaacctttattttcattgtgcttttacttttccaaatgagagtaagagggatttccggttggatatgggcgaagaagagcccatacaactttttggattgaaacagatttggagtccaaaagtaattccattgatcaggctcaatattggattgcatttgctggatgttatttcatagtgattgccactgagttatagctcctttaggaagtggggtgtagaaaaggtcctctacattattcgttaaggtgaagtgtctgtaagataggtattcctgttttgcataggagaatagaaggctgtgagtgtcttgaagtatctgaccattccaattatctttccaaaagggcagtgattttccagttccaatagttacagatgtgatggctctaaagatagggatcagcctgaagatgtctttccaccaaaaggagcctttttctttatgtgcatgaggaggtttttcagattcaacatagtatttgttccaaatcagattgacctagggtagatctttgcagttaaagaatttatctagatgttttgtgaggagagcaatattttggatttctagattgacaatttctaatccacccttgtttttctgcttacaagccagttcccatgctgccaaagattgtactgttgcatttgggtcacttgactttctccagaggcagtgtctacgagctcgatcaatatgttggataacttttttggggagtttgagagtacacatgtagtaagttggcagagcggagagtaccaaattaaccattatcaacctttggccatgggagaggaacactgaagtagatggtagtcttctttctattctatcaatcaggggtgcaaaatcaacaatctttggtttattagtgcccattggaagtccaaggtatgtgaagggcatagatccaatattgcatccaaatgtgccagctagaacctccattttgtggttatcaacatttattggaaccatgcatgacttgtgataattgattttaagacctgtgcaaacagagaaagtttgaaggagtgctccttgagacagaaaatttctttctgtatagctggcatgattattaaagtatcattagcatattggattactggaaaatagttgccattagttgggatggggagtgagataattccttcttctttcgccttgtttataatggattgtaggaggtcggctgccagcacaaacatgagaggggaaagagaatcaccttatcttactcctcttttgcacttaaattctttcccaggaactccattgagtagcacagatgtggaagcggtggtgagaatgtttcttacccatgaaatccaagtattgtcaaaaccttttgcttgaaggatttgtataatagcctcatgttccactggatcaaaggctttttcaaagtctattttcagaattacaatttctcttttgctttgatggcattggtggatgtactcaaaactccaggctagacagtcttgaatggttctgcccttaataaatccatattgattttcatggattagattcagaatgactgattgacatctattggccattatctttgaaataaatttcagagcagagttttgtagggcaattggtctgtaatcatttggggtttctgggttgggcttctttgggattaaagtaatgtaggagttgtttaggttctgaattgatgatcctccactaaagaaatgttctgctagagaatagaaatcttcggagatgatatgccagcatttcttaagaaaaagtccattgaagccatctggtcctggggctctgtcaattggtagattcttgataatttgatccatttcattcctagaaggtatagaggatagagcttccaggccctgaattctatgaaacagactgtttaggtttaggaccatttgtatatgttcagtagtacccattctgtttttgaaagaatttagtaagacttgtgctttttcttcatgagctgagattgttctgtcctccacctttaagtgtgagatcttgttcttgttccttctgtgactatctgttgagaagcttgaaaatatttaggattttcatccccaaatttaacccatctaattgtgcatcttttcttccaaaactcattctggtatttcaacagctatagaatatgttctttcaagattattctaaaattccattctcgaataaaaaggggtctttgttcttcaatattatccagaaataacaatacctcattgcagtttgagatgatagcatgaagattataaagccttttactccaacttttcaaacctcttctcaaatttttgaacttgccattcagttttgtggcctgatttgaacctctgacaggaatactctagaactgggagactacatctataaagcctggcatgtcagtccaaaagttttcgaatctgaataatttggatttaggaactgaagtttcaattgaaatcatgcagggtgcatgatccgagatgtatttagccagagctatgactgaggtgtgaggaaattttagggtccaagctagagatgtgaaaacccaatcaagttgctgtaagagaggctgttcctgcatgttgctccaggtgtaagataaaccttttaaagggacttcaatcaacccgatattactaatgatttcattgaagatcagaatgtcattcatatcttccccaggaagattcctattttgcactgaccgaatgaagttaaaatcacccattagaatccaattatgatctatgtttatttcaagattgttcagccatgaaacaaactcatccctttgttctccagaacaggggccatagatattagatagagtccagacttcatgtaaggaggagttagaagtaaactctatggagattgcaaaagggaggttttcaatcaaagttccagaaactgtattattgttccaaataactattagtccccctgagttcccaagcgaaggatggaaaatgaatttgtcaaatcttctagggcaaagttttctgatgtaagaatgatcaaaaaaatctcttttggtttcctgaagacagattattgaacaggaagattcagaaatcttctcagagagtgtaagccacttttgagcagagtttaagcctctgatattctagcacaggatattacagtttctgttgtgatttagattcatttaaccaaagagagagagatatactgaaatgggtagagattaactgcacacccatgaagaacatccaccagcaattaacagaaaaggcttgagaattttcatgaaacagcaaaagagagtagcacttagcctgagagcttaaacataacttaagaagggtccagaagtaatactgaaagcagttttgatagaaagagataactaccctattacactttagggcagcagggctaagcatagccacattattacaaacaagagtaaattgattcattttttggtcttgaggagttttgcttcagccacttcctcaggaagaaggccacacttttccaccccgattttctggagttgggcaacagggactggagggggtagacccttgctaattgcaggaagaagagctctgactggctggactttggatttcttttttggattgtcaaagtctaggtcttgcttttcttggcccaggaatcttgggcttcttctaagattctcagtagatatgggccctttttgtctctgtttcctgggcttgggagttgcttgaatttcattttgaaggctggattcatcagatgcaaattgcagcgatcttgctacatgtcttcctacaatggccactttctgcctctttgcaggacttggactgacttccaggtcttgaaacaagatcacatttattttcacctcccaaacagttctggcaagggaccatctctaaagaacaatgacaggcttgcacaaaggaggctgaaaggcaagaagcaaaggtctgaaaattccctgagcgaccgcccggcaaaatggttcgggtaagttgagaatcgggagcgatggaagaggcaggccataaggaataatctgccaacccagatgctgctgctgctgcaagtgccaagttgtctctaaatcatatgtagagtaatcatgaactgacagagagtcttgaggttgctgcgcagggatgtcaacagccatgtgattctctccctaaaattcttcatcattctgatcatcagcatgaaaatcaaaattttcccaaatgttgtttttgttgttctgcattgttgtcctgtggagcagagagcatctgccatatgggtaaaaggtcctcatcacctggcaagatatatgttggcataccgttgaggacaaagacatgaaaagtccaagattgtcctaatcctccaaaagccgtagcatcacccaaaaccaacttagcagggatatcattaacagatttatatctagccttgaccaatacccttccaagcaccttatcgcggtagtgccagtcaatgaattccccacagaggttagtagcctgttcaataatagctctagtcttaaggtgtagggcaatgcctagaatcattaaccatccttctctagtgaatggggagttcctccagtttgcaagttgatcatgtttaacaaagtttgcatggaaccaattaccgagaagcacaggttctgaattcactagaacatctcttacaagagttgaggcccgctctacaatgcacagggcgagagggtacctactcctcggagaaaccttcacgtgacccgaactcgaactctggggttgggaaaaatagagcaagactgagagtactacccactgtactcagcaagtcataccggaataggggtatgatgcagggaatcatcaaagaagagctgaagtggtttatttgcataaagcgagcatttataaacagaagttgaaagattaaacagttgtaataattaattaatattaatcatccactgtccaacgctatcccacgttgcgacaggcccatccatccacctaaactatccaaattcaaaagattacactaaggtgagactaatcacggtgaatctggttgaccgcccataaccgcgggcacggctattcgaatagttttactctgatcagatgtgtacaactgtacccacaagacacagccccacgacacgtttccatgcgccgacatgccaccacgacataccggaaagaggccgtgacaggaccattcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacgctacaagcccagccgttgcccacgctggcttgtggtaagtacgataagttcttccagggcatcctgcgaaccggtccttaactgccatgggagcgaccagcaaaaccatgcacccacagcccaccatgtgatttattttaattaaccaacaccaaagcggtgttactaatccaacaaaccattagaaccaatagtctaaacattaataggattttttccccattgtgaactagttgaactaagcatggctaagcaatccctagtcctaactctaatcatgttagaaccccaagttgacaaagaaacatggtacatcaatagcatagctatgacaataggtaaacaacccatagtaatattataaaacaatgcaatatttgaaagaaaacaatagagcatttgtaatataggatcaacatggtcaagtgacaagcatgacttgccttgctctgctgctggaggaacctcggcgactatttcgaagtacaccggagcgtcggaggaatcggaatctagcgacatacaaagcaaacattgcaaacaggctataagactactgaaacagggaacaaaaccatttttaatggattctacacatttttcttgatttactgagacttgaatgggcttaaacggagctcggatgaattaattatgaattttagaagattcactatgtttattactatacaagaaaaaccttaaatcatttattgcacaataaatcccagggctgacgtcagcacggagggggcgcggcgccggcaagcgggccccaccggtcagcggctcagggggagcggttcaccgtggaccgggaccacgcgggtggtccatcgccggtccacgggaccgacggcccagatcgccctcgggccgatcggacgggcggcggtggaggcagctgctgggctcggctcggcatcaaagccgaccgggcgacccggggctaacggcggtggcacgcgcgcgtcgcgttgccggtgacggcatccggcggcggaggcgacggcgcaaaggcgacgcgaaagcgacggcagtggacggcggcaacgaccaaaggcgacggcgagcgcgggcggcagcgacgcacggggaatcgaggaagtaaaggaaaggggaaggagtcctcaccggaggggacggcggcgtccggcgacgaggagcgacggagggaagtcgacacgcggcggacggcgaccgggacgacctaaagaacgaaacgaaagagattagagaggaagagaggagccataggaggcgggaaggccggccgaaggcggcggacatggcaaccctcaccgtcgcacgacgggaacggctctccggcgacagacctcgacgaaagaggggtggacggggtggatctcagccacgcgaacccgacggcagcgatggcgcggtgcggcggtgagcctagcggcggctagcggcggtcggagtagcggagacggtggcggcgggtggttgcacggcgcgggagcgatggagagcacgagggagtttggcgagaaaaggaaaaagcgagagggagtgacggggaagcttaaataggggaggggagggccggacgtggccgggagaggcgggatttcgccggccaacgtgggagaagtgggggaggagagagaggcgggattcgaaaatcgaatcccggccatctcgggcacgggcgcgagcgggagagagaggggagtgggcgcggggaacgcggcgcacgcgcgggcgtggtcgacgtggcccggaggaggcggaggcgacgcggcggcggttgcgggcgcggcggttgcgggcgcggcgtcggctggaggagggagacgggcccgacaggtgggccccacctgtcggcgaccccgagagaggagggaggcgggacggcctggatgggcctcggcctgcggccggcccaacaaggaggagggggaagaaagg

SEQ ID NO: 42797 - DNA, 4248 bp, Oryza sativa
aaaattccactaaaaatcctgttaatgaatttcgacatgtagaactcaagaaaaattccacatgtcaaatccgattattatttgcattactttcttagggttttctcttgatttcaccagcattttcttggggtcgttttaaaaaaaaatttaaattttaggcttgggaggagaacttcggggtgtgacagggaggaaacctgagagagagaggcgaagacaaagcgacgctagaaggaaacctgaccaaagatttttccgctgatttcgggatcgaccgcaatttccagacttttttctttgaatgggccaaacaggaacgggctagatggccgtaattgaaacaggcccgacatctcaccgagttggggcaatcagcataccgatgaccagcgcccaaacagcgggagcaattgaaacccccagataacgccgaatttaagcccgaatttgaaagggagcccgaatgatgcacaagagtaatggcgggcatagaaaatggcatctaattcaaaaaaatgggcgaagaacacggtagaacaggctttggtaggattttcgtacctgaagatgaagccttgggagggcgaatgtaagaatccccattggaaaagaacatccttttgaacactgaaggtttattcacttgagatttaccctttgactgattaaaatttaaaacttctgtggaggccttagtagaatgaacgagaaaatcacccttggtgtcagatagcctcttgaacattgaaagattattcacttgagatttacctttagcctgatcaattttaacaacttctgcataagaaatgaactccggttagagttttgctagcgtaacagattgtgtgatgctttttacctttggtttggcccaagaccgtaccaacagagaagtcgttggcatcacacatgatttcgaagggtaacgtccaatcgggaggttggatgattggagccgagatgagcgcctttttgaggatttcaaaggacttgaggcacgcatcatcaaactcaaaaggagcatctttagctaataagttagtgagcggcttgacgattgtagaaaagtccttaatgaaccttctataaaagctagagtgacctaagaagctacggatccctttgatattcataggaggtgggagttgatcaatcacctcaatcttagcccgatcaacttcaatccccctcttggacactcgatggccaagaacaatcccttcgcggaacatgaagtggcacttttcccaattaagcactaggtcattttcttggcatcgctgcaagaccttgtccaaattctagaggcaatgaccgaaggtttttccataaacagagaagtcatccatgaagacttccataatatgttcgatcatatcagagaaaatggacatcatacaactctgaaaagagaccggagcattgcacagcctgaatgacatcctataataggcataggttccatacgggcatgtgaacgtggtcttgctctgatcatcaggatggatgggaatttgatgatagccagagtatccatcaaggaaacaaaaataggaatgatttgccaaccgttccaacatttcatcaatgaagggtagtgaaaaatgatcctttttcgtagccttgttgagtttcctgtaatctatgcacattctccatcctgtgatggttcgttgcgggataagctcatttttagcatttgcaacaaccgtcattcctcctttattaggcactacttggactgggctatcccactcgctgtattgcacaggatagataatccagacgtgcaggagtttcaggacctctttcttaacgacttccctcatcgcattattcagctgtctttggggttctctggacggtgagctctcaggcacgatgggcttgcgatgagtatagagcacgggattaatccatttcagatcctgaagggaatagcctagaacagcgcgatgtttttcaaagacggctagaagacgactggttttgccatcagaaagcttgtcactgataatgactagagcttccttattaccatatagaaaagcatagcgcattccttgcggaaggggttttagctcaatcggaggtcacagcggtgattctaagattggaagttcgaaagtttcacagtgctcatcttcttttacaatgaaatctgggacttcattttcaagaagagactccagagactcatgcagaagaacggccattacttcctccgcatattcttcttctggtaaggaatcggttagggcaaaccttgcccgcgaggatggaattgagaattcattccctcctatagaaattttgaggctgtctaatcgagcagtattaatgaggagctactcaatcgggtgctcgattagaacatcaaaatcttggatttcaaagacatggaaatccaagatcacctccttgccgtcatgaatgacaagcactcttgcacaatcccaaatccttcaataagatttccgttgggatgcttgaagaatttgtttgtcggcataattgtcttgtcatgatgcgaccatggctaccatggatacaacctttgctcacatcatggatcaagaataacacttcaagaacaagccatccaaattctgaaatccaattcggccacctgctactgtgctgaattcaaatggtggctagatgtgcatacgacctccgttttgggtccgtgagtacttgatggaaagctctcggaatcctctttccaacagatccagccttgttccaaaattccttctcagtcgacagaaattgcaaaaacaaggtgctacatcccctatattgggccaatgggcttgtaacttcgtttgggactccggcccaagtggggcccatgtggggtgcgccccaaccaggtggagcatgaccctagagtccccttggtcatccttcctacctctttaaatagttaggtaccccttcagggtttctcgggttttgtttagatcaaagtatagcgtcgctactctgccgagttgatcccgtggtcgattagatcgccggattgcttgttactgaaccccacttgttacttctattgattcaatccaacatctttgattcgaaaatttagttgcttgttcatcttgttcttgctggttctcgattgcttgcaggaacaaataccctcgtggttgggctgatcgtgcatccgtcgagattcatgaccgcctctgaagttagtgtaacgattgctaaggcgcaacatccctggatagttgtagttggatcgccaacgtcactccatccaatcgacttatccctctcattgaaagatcgggacaccctcgagcacatcatgtcgctcagataagcgaacgcaaaggattccgagacaatatgagcaccaacagttggaccataaagaatactaacattattcccatctaaatgatacggaatggttcgagaagcgctatttatccgaattacttcggatgaaagctctgccttcatgatcactcataatcgatgtcaactcctgaactgttccctttagatacccaagctctattggatcgagaggtggcaagggaataggcggtctcttcttactaaagtagttcaaggtatttccataattttcatcaagatcatacctgaacattggagcacatcctggagttcaaatttcttttttatcaacagatgatggctcagagacatgttcctcggtcgaattgatcgaagtagacggttcagtctttgattcgattaacaagggttcctcgatcctagccacatatgcctcagggaggggttcattgcactgttccatgaagtaagttttttccataattcagtctaggattacttttccttcggatagagttatatgtatgaacgaccctccggcagtaatgtctagataaaatgcagactccttatctaaacccgtgcgaaaatgatgcaacaacacgtattcgggtatggataaccttggaccgaatcgcactaaattagtaactctggacctggcttcactgattgattctttatttaactactagaaactgaggatttccacacgaagcgcagtaatacgggttataggaaaaaaggcaaggcagaacctgtctcgtaatttctcccagttaccgcttacacacctgacgatagatgtgtaccattgttttgctctctcttgaaggtagaacagaaacaatttccactgtacagtttcttgcttcatgcctcgaatctaaaggcagggctgcagga

SEQ ID NO: 42798 - DNA, 14283 bp, Oryza sativa
ggcatgagcaaagctgctcaaattcccgcagatgatggtaggagttttcttggtcaagaccaaagaaaggtttttccctaaccatacttattaatttggggcgaatttcgtagccagttgtaaaaattggctcttatgaaggaggtggctcgtagaattcgcccctaggggctgattgttgacggctgtttagtaccaaattaacgccgtcaatacctgcataaaaccataactacaaaacatccaacatagtgttagggtttatttctaacaatttccacgagtgttggtatatattcatatacaggtgacaaactaccaaggttgagaggaaatatacatgaaggaggatgagaatcaaactcgtatccgaacttaaggagttttggacccataaacccaattaaacacctccaaatgggccaaacattcataccaatgaaatgaggggcccaaaatgaatgtccaggacgaaaaccggagcgaacggagtcgtcccgggttcagccgaacccctgagttcggccgaaccctggtagaggccgttcgccccggcccaagtccagtttggtagataactgcttcccaatgatggttatgaccgtttccggcgctccaaccgtcatccaaatggacacttggcatgaggagagtgaatatgctcattggatgccatggaggatctccacactcccaagcaagctccacactataaatacccctctcctctccctcatttgacacacaccaagatgtagagctcaattacaagaggctctaaatatgctttagcttctttacatgttctatagtatacttagaatagggagagagtgaagtagaagaagtcggaggaatcccggagttatcggtaatgctctctttattcttgtactttggtaattactctgcttcaatagaaatatcattctaagtaattaagatttgcttagtgagaattattcttggttagttcctaattagcatacgggatcattgttcactatagtccattaattatatagtgtttgctttagtgcttggctagtgctagagtagtaattaattgcgtagacgcggtgtctgggtaattaattgccagtggttgctgcgtatcccacagtacgttagaggtgggtgtagaggtggtgacagcccttaagagcacttaagtcctgcctgtccgggtacatagtagagcaatatatgggaacagcgggttacaagtgcctgaagtattgtgttaggattaaacttaagctttccttagacactgtttctcactaagaaatcctctctaccctctacccatatttatcttgtgtccttggatgaacgggaggaagagataattatacatgttctcttggatttggtacccttggaatactccgtaggggaagcgctacatcggtatatccgtgcgcttgcggattctatctgtgatcgtaagaaataccaacactgataattcaaagatgggttgctccatggtcaagaagagttttacgagaatacttctctagggtagtaggggtaaaggtagaagaaagaaaaataaaaaagggtatgaggatgaacatggttcggagataaacaacaaccgttcgctggcaaggacgccaaaaatgtttgttggtatttcttaatgttactgtaaaatcccctagtacacggaagatgccgatgtagcacttcacctaggagtattccaaggtattgatttcctcatggaacgtgtgtgttcagttcctcttcaggttcaccaaggatacaaagcaaatgtgggtagagggtagagaagatttactaatgagaaacaatgttacaattttaatcctaacatggtacttcaggcactggtaacccactgttcccagatgtcgctctaccacgtacacaaacaaggaggaattaagtgctcttgagggcggtcaccacctctacacccgcctctaacgtactatgggatacgcagcaaccactagaaattaactatctaaacaccacgtttaagcaatcaataactactgtagtgtttgtaactcactaaagcaatcactatattttaacggattatagtgaacagtgatctcatacgctaattaggaactagccaataatagttctcactaaacaaatcttaattacttgaaatgatatttctattaaagcaaataacaaagtataagaaatagaaaaggatcaccgataactccggaattcctccgatttcttctacgaccttaatctttccctaattctagtatacaataaaatacaatagagcctcttataattcagctcaagattggagtgtgtgatatgaagtgaggatgagagctccttaaataagtaggtatgatggttgtagagcatgcgaatgatcggaaatgccctgcaactgccatcaggagtaaatcaagagcgtccatgccaaaccctgagatcaacagcgatgatcaggatttggccgaaacctggcttggcccaactggcccaagttttggcctgggcctccttctcagtctgccttatccatttcgcaggtttttgggcttgcattttggtgttaaaatggagttaaaaagcccaacacttgtatggatgaaaatttccttcaacttagtctagatttcctcctaattcggtggtttattacctgcatccaaatatacaccaacacttatggaatatgttagaattaaagcctaccactatgttgaatgttttattatttctgtataaattatacaggtattgatggcataaaatcgatatttaacagccgccaacaataaccataactcgatcgtcagattgatacaacatctgacaaatataatccccaaaacaggagtatagtattacttctcatcgagaaggcctgaacatgtataaaattttgtccctttactcatccactttagattttatgtgctactcgcttttcttattgccaaaaatcaacaattattttagctaagtccgtatgcacaattggtccgtcaattccgtatggttctgcggtcaagcggcacagccgcgcgcacagcacgtcctggcctggcggtacagcttgatcaaccgaatctttgctagcctccttctctcacaaccgaatttctctaactaaatcaaccttcatatatacgaatcaaaagttgatatggctatatatgctggtaatttctggcatttgggccgtatcagtttgttgacgcgcacatttcgtaaaagtgatttagatgctctaggcaaatatcacgtgccaggatgataaacaaataccagcattttgcaaaaccaaaatttcattgtcgacggattcagatatgctctaggcatcatattacatgagtacgtgtgtatagccggagatcttgcattcacgtgccctgtctcaccgtcaccgaacgatagaccgatagttgtagtagtactcttgcaacaacggcaggtcggagcgcgagagaacaattacgtgcagcttaacacggacacacaaaaaaaaaagaaaaagaaagaacatgcacgaaggaacgaaagcgcttagttgccgcctgactcctcgcaacccggtggcttatacgcgatgaagctgattaactgcacctgcctaacgttgtcaaagccaatgatgcgaacgaaggcatcagggtatgccttctttgcctcctcgagctccttgagcacttgggtggcatcggtgcatccaaacatgggcagtttccacatggtccagtacctaccgtcatagtatccgggtgatctgtgattctcacggtagacgaatccgaccttgctgaactccaagcaaggcacccacttagatcggagcaggtactcgatctgcttcaaaaggtcctccactgtcaatggcggcaagtacgacagagtctcgaacttcttaatgccctcaatcggccacacctgattgaatgaattgatgcagataatagaatcgggccaacatttaatatatatgaacaacgagcactttgaaggagaaattgaaacgtatcgtttctgatacctgcatgcatctgatccttccgccattgctgacgttgccaaagctcgagctgctggagcggcggttcaccgggaggcccgcagtggacttgagcccctggaagggagccacggaggtggccgacgaagccatcaccgagggagccattgctagcttgctaggagctatagaaaaacttaagttgcagtgtgctgcctccggcttgagtactgaggctctctctgcacagattcgtcattatataaccaagggtgaggtcactattggatggttggaaggcaatgcttcgtggatgcaaggatgtggaaggattggccatggtttgcctatccaagcatgtggtgcctgatccaccgacggtcttcgcttgtggacgaagagagccatattatcaaggaggagatggaagcatccagtgggccactggacttgcggcgacgagtgagaacgtccatcgaattaattcatgaccaaaaggatatttaatggactgtctatgtggcacacggctgaaaatatttgtgattacagccgaattcctaaacgtcggattcaacacgtgtttgcatcgcgcgcgctgcacgtagcatagcgtttctctgcagtttgttttgtcagatcaaagcatgaagccctttttcgttttgtctattagataagcccaaaaaacaaacgggcttaaatatcatacatatttgatgcccaacaaacaaacaaacgggcttaaaatggccctcacggcctcacctatccacaaaaaacaaattcaaaaaaaaatttgaagcccaacttgggttcttccatcctcatcctcttgattgcttcatccccgcatgttatagatttaatctgtgcttcagaacctccaaatgaactttttgtgtgctctttttcaatctgtgcttcagaatccccacatgatttgcttagctaatcaattatcaactcctgtatgaagtatgtgcgagtgcatttagatttttgttttctaaacattcctacacccctgaacaaaaagcaatacctgaattccggagctacacatccagctttcttcacatcacagatccgaaacccaggaaaaaacattaggtcaggtaccattcattgataatgccaatttgacaccttgattttgtaaaacaaaacagtcactactattctttactcgcaataagggtggctgcttgtgattgataaagtaggccatgtcgggaacagaaagcagtgatcagtgaaattcaatgtcgggtgaaattcatgtctttaacttgggccatgtttagttcccaaacaaaaatttttcactctgtcacatcgaatgtttgacacatgtgtgaagtattaaatatagaaaaaaactaattacatagattgcatgtaattgcgagacaaatcttttaagcctaattgcgccatgatttgacaatatggtgctacagtaaatatttgctaatgacagattaattaagcttaataaatttgtctcgcagtttacaggcggaatctgtaatttattttgttattagactatgtttaatcttttaaatgtgtgtacatatatccgatgtaacacgccaaaacttttcgtctcgccaactaaatagggtcttgcttacgtactgataatgttgtatcagctcctctaggtgggagggtgctgatattttttgaaaagcatgggctccactttcatttttcaacccaatgatataaaacgaaccaacatccctgatacaaattacttatgtcatttatctcaatgtagagcttagcaaatgcagtgctcactcattatccctacctttccactttgactgtatatggagcaatgcccacaaatattatgcacatacaggtggactttcaacaggattttagtgaaaccagggatgtgccactggttttcgtctcttaaagcatgtgttaagtgacgtattcgtaggggtgtgagtgtggtgttgcgtgtgtagtggtatgtgtgcatgtgcgtctgtcgtgtaatctatataaaaaaatatgttttagttcccagtacagatatcatatcaatatatatgagaaaaaaattagccttacctatctccaagaaagacacgtccagaaaaaaacagcaacaacaaaagattaaaaaactggaatgggcttaagcacttcatatcaaatatacttttcttcgtagaatgccagaaataaagaagcccactaaggcagtgttcttttggaggggttgggaacccctcccctctgcatggaaaacaaagcgacagactaacatgtgattaattaattattagttataaaaacttgaaaaatggattaacccatgggaaagaacacagcttttattaacccatgggaaataacacagcctaaaagcttgggcattggaccttcttcagtgacttaaaaaaaagctcactctatcaaacggttataaaaagaataaatagatttaatcacaggatatgtgtgaggatgttctgtgcatatctttttttaagattaggtatgctctaatcatatattctatgcatgttcttgtttgagacactctcctcctgatgtctgtatataagacgaacatgttacgtaactttgagctagaatttctatttgatgaaatagttattacacagcaagtctttcttctctatagaccctcaaatcactttgtatacattcatagactgccagtgacaatccttattttcttatgccatgcacaaaaattatctcttcattaaggatatgtgtgaactccttagccatagctaccaccattaaacttgccgttcaattgaactaataattttcagtgttgtgaaattaggctacgacaaaatacaaaaccaacagaagataggctacgatctactccctccgtttcaagttataatacgttttgaatttggtcaaaatcaaaatgtttcaagtttatagataaatataataatatttataatactaaattagtttaatcaaatcaataattgaatatattttcacaataaatttgtcttgggttgaaaatgtttttgcctttttctacaaacttagtcaaacttaaagcagtttgactttgaccaaagtcaaaacgtcttataacctgaaacggagtaaataatatgattttatagttactatcggtagcgcatcaacctaattaatatgtagcaaaaatataacaatcggacagaaacaaacataatggaaaaaacgttgtgggcttttttaaaatttttttacaaagaaataccttttgtgtgtcccatttgtagttttgtccctttgttttgtttcaaaataagtcattttttcatatttgtatttttttttgttttttgtttttgtcagattttaaaatttttattttattttgtcaagttctggtatgcagtacactaacttggcaagttcttgttacatggaactgatcatgtatgcgacacactagttcactgttacaataaaggtgctgctataaacttggtgctgatccatcttctgctataaaaattgtgtgtgttcttgaatttcagaaatcctgatttcttccaattcagatgttcactgtctactacaaatctattggtttatctggctgttaggctattcttttgcacaatatactttagatgaaatgagcatagtttctgtagtacataaatggccagccataggaattaatttcctactttttattttataagcatgttgaatatagcacatagctagtgttgttcctccatgtgatagatgctttgacataggtgtttgcgtgcaccatttatgcttgcctaagttggatcaaggatctttatgtttatctagctgggtttggggttttctgacagtgatgttttctcagacatatttcattttgaagctaacaacttgatgtttgctctaggatgatatatttttgccactgcttaataatgtgttgaatgcttcctcagaagctaagatttttgggagggttgaggcaaggccttggatgaaattttgctggtctgatgtcaagtatttgcataaccgctgaggtgagatcactgaaacctaccctactgggttgatgttgtactcttcttctgtaattaaaaattctcactgttttatacgatagcttgtagaactatacatggcaagcataacattcatgagataaagtattagatgatgtctgagggatttgaaacttatggtcatggatacggcaaggccatggatgaagtttttctgctttacgatttttgctcctgtatcatgtatgatttttgctcctgtgattaaatccatttattgtttttttaatcgtttgatagagtgagcttttttaaagtcactgaaaaaggtccaacgcccaagtgcttttaattagtgggcttctttgttcctggcattctaccgagaaaactatattaatttcatatgaagggcttaagcccattccagttttgtaatcgcgtcgacgcggcacgcgaccatgatgcgtttaatggcggcgaacgtattttaaaatttttttatcattttttgttttgtcagcatctcacaatttaaacttttgtcgtattgtgtttgtattttgtctttgtctttgcaacttttataattttcctacatattaatcaacctaatgcgctatcttaataacaactatgaaatcatattatctaggtcatagccctatcatctaccggttttgtattttgttggtgtttgtcttatttgtctttgtcggattttaaaatcttcccacatattaatcaagctggtgttctatctaaatgatagcaactataaaatcatattatttgttttgtctttttcagttattaaattttagctacatctttctattgtgttccatattttactaaagctaacatattttgttactaatttctaagttgcccaatttttaggtgtttgaccagaaaacatagcaaatacaagaattcgtgccgataaagcagcgcagcaacaactgatggcaagccctgcggcggcggaggtggagcggaagaagagataagcaaggatataatgctcagaagcctacctgaggacccacgattaggcaaataagccttggacatagaggcgtgcgattgggcgaagcgcttgcagcgtgcggggcagtgggagattacttcgaagtttacttcagaaaataaaagtgagtgttcctagtctatctacttggtcatgtagatagaattttataaaatatttggtcatctcaaagtagataggagtaacattttgtatcgcttttgtcgacatttcctaaataagcctgatttctatttttataattttggtacatattaatcagtttatcacttatttatgtcatagcctaaccactagaaatcgttcttaatgctgatatttgcttgtcatattgcttgccatatttttcagtactgcatccctatgcagaagttacacattggctgcattcgattccactgcaagcagggctaaacggtgtgtttcgtgcgaaaactttatatatgaaagttgttctaaaatatcatattactccattttgcaagtttgtaataattaaaactcaattaatcacatattattaccacctcgttttgcgtgaaacacttactccctccgtcccataatattaaaacctaggactggatggaacgtttcataatacaacgaatctggatagatgcatgtccagattcattgtactatgaaacatcccatccagtcctaggttgtaatattataggacggagggagtaatcttcatcttcagccgattcaaacaccaccattgtttttagatttctatttggtggctttggtaatcatgcatagcagtgcattgcagcagccatgcaacaggcaggcttgcagggcatctagatcagagatgaagccattttttctctctgaatatattcgatgatttttatgagttttttcttctttctccatctattttggctcctctcttttggtcgatctcttcttttcttccagcctggatttgatctctttttttctgatctgacaatcaaagaaagaccacaaatttctggttgaagaaaccaaatggagatgacaaaacgtttctgggttgtggcttttgtttgcacagataacaacttttcgaatttttttcgtttttagattttttttttaatatttacagaaataatctatcgaccaaaaaaattacagaaatagcccctgccgccctaatggtgggcggtaagctgacgtggcagacggtggatcgaccgcgccatctgccgccatcggccaaaattgcgattaggcccttgccgcccgtacagagggcggcaaggggctaattgcaattttggccgcccataaagagcttgcggccgtactttttcatccgggtcccttgctgccccaatagagagcggcaagggacccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggagagaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcataacacggctaggtggagttagaacccttctggtgtctatccattctctatattgacatctccttggtggttcctaggaggaaagaatagatgtaaagcaagcaaagttagtaaatgttgtgagaaaataaggattcatgtaatcaaaatattcttaccataaaatcgtcgtcaagaatatttggacaaacaaagaaccttcgacccaatgttgtaggatttatggaacgaagaacctgacaatgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaagtcgagaacgggattttctgtatcgacccactcgatgtatgcgcaagccgtagtgcgggtctgtcgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacaccagtttggatcctcaacacctcggcgtctagccattgacgaaagtcggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccctgccacgcgccgcaaccatgcttgatcctccgggcctgtgctcgcacgtggtcctgggagtaggtgaaatgatccggtggcacagcacgggtaacacgagtgtcccgcgaaggagtggcctacgcctggtcctgcgtctgcaccggcggtgcgcctcccagctgtgaggggccgatgacgtcctctgtcgagcctgaagcgaagtcgaagtcagtgatgtcgaagaggaaggtggaaggcaacaagcagtccgacgaggtcccagcatggtccagtggtggaccctgactcgacgtgccggctgcctgtgacgaagtcccagtgtactgccagaactgcgctgagtgcgaggtcgacacagctgcctgagacactgaccctgcagcctgggagaagtgggcggcctgcgtcatagcgaactgggcgaaacctacacatcgacaacgggacccttgtaagctaagacataaaatgtatgtaaattgattgtcgaagtaatgttgtttttttaagtacctgtggggggcacaacagaaggcctagccgaggaaggtggggtgctgaacggtgcacgaaaccctgaagcaatcggcaagtgaaacggctcacttatatgtgcgaggcatgtacagaaatagtaataaaaatacttacctccgtgcggagggggagtcggcctaggaacgtgcgcagctggacggggaccagtcggtacgggtggccgctgtacagctgcgtctgcccgagcaacgtcgtctgcatgacaggtgagcactcggagaatcgagcgcatcgactccaccatccgcatgtacatcgtcaggtgctcctctatgggtaccggaatccccgcgcctaaacgttggtcgtcgttgaaccgtcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgactgctgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtggtcggaaacggtactggaaagggctgacggaagccgaactgccgcatcacgcggaaaggggcgtgaggctcaacgcagatgtcgaagaccatcggaactgtagtcatccagtacgcctggtccctggtgcagagtgtggacagacccaacggcacacgagcctgggtagccgtggcactgtagggctcccacacgacgtcagtcggcagaaggcggtcgaactccataacaaactcaggatacgaccgcctaacctggacgtgggcccatcggcgctgcaatacgagacgatcgatgtgatgtacaattaacttaacaattaacttaacaatacgataagatcgatgcaacgtacctgacgacagcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgaggcaccacgcctaccgcggcgtcggcgatgctcctggcgtagtgcacgagtcccttgtcgaccgagtgcccgtgaccgccacagaacatcacccagccaaaaagccagagcaagtacgcctccaaacatcggctgtaggag

SEQ ID NO: 42799 - DNA, 2939 bp, Oryza sativa
aacaagtacgatatgtcctgtagggtaggggctacctcaccgcacggcaagtgaaaagtgtgcgtctctggcctccatcaatcgaccaaagctgctaggagggacctgtccacagtccatcgtctggccgggtccgcgtcgccggccgcagcctccaccagccgacacatcggtaggaggccggcctcacgtagcctgcaataacaaattaatgtcattataaaaaatattacagtgcaactaacttatagtaaaacactgttcgtacctctcgacaaaggagtcgtgaactgtgagtagctcaccgcacgtccgtgcccggatcgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtactgtaaaacaaaagataacttgcaaaattatgaaatagtaataaaatcatgagattaattatgtacaacaagagtacaggctatttaaatatagcaaacgttactagtggtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctggcattacacggcgaaacataaacacatcgataagttcgaaacgaattacaagcaaatccacatgccgacatagaacataagaactacaccacgtagccaggcgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttacctcggagcttcgatgggtcaggaatattgagtacttcatcgttagtctctgtgaactccccagctatgccgaaactataaatctcaccgctccatgtatgatatattgcttacttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactcttgcggtagatacccctgcctgccttatcttgacatagtatctcaaacatgagctgttgggtaccttgcactagagctcgatgtttcatggcctttttacgcaactcctctagctttttctgcacgaaagctccaaacaaaatgctgttgttcggcatagagggaagaactgcctggaactgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacaccttggcccatttctcttttgattcatgcagaatccactgagaaaatttccgaatctccaatccagttcttctaaccaatgttggactatccgttgggagaggtccaagagcttgaggagggtcagcaacggcggtcgatggagccgctgcacgctgatcgctgcatttggctgtcaactcatctaatctcttctaaagctcattgaattttttctcctggttctgattgcacagcctcttgaacatgttcatgagctccttgttcttgaattgcttgaagaaattagctcccatatgatgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaattttaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgagggtaatttcttcactttgtaagagctcccagggtttctttcctcgataacaccaagcaggcgtggcaaattgtcatacgaggcttcgtaagttccaaatatcatctctattattttctgtttggccctccaggccttggcatagctaatagtatacttgtatgtctcttcaatgtgtcggattattgaccttggttcatatgtgagattatcaatgacatgcgcatacatctcagatgcaacaaatgcacatgtaatgttcctgtggtatttctgaacaccaggtagaaaacatgtatgcttggtaacaactgacactatccaataatccttccatttccccttatacgcgtgcactcttcagggacaaccatctttttccttaacacaccgaacttcatattgcgaccggttcgacttggcaacccaaaactctctatgaagtgacactgcaaaatgttttaccgcctccttcatatcttctgctttactataaatcgctccctgaataacctcattttctttgtactcccatctcacactatcctcttcagagacgatcagcccaga

SEQ ID NO: 42800 - DNA, 1032 bp, Oryza sativa
tgtgggcttttttttctccacccaagacgggctgctggctctggcccaacaaaacccacatgatgaagcaacaaatcgcgcgcatgtgagaatttttttcattttaaattttttatttttaatatttatagaaatattgtaccggtgaaaatatttacagaagtagaccctgccgccctccccgagagtggcagggtgacatgagagacagacaagatgaaaaaaaaactagaaaaatgtatttttggcagggcgaaaattgcatttgcctccttgcagagggcggcaagggacctcagtgcaaaatgcgcacaccttgccgccctccatttggttggcagggatggtataatatttctgtaaatattaaaaaaataaaaacttaaaaatgcgcatgggagttttttcgcgcattacatgagtagcagacaggatggggatgcgcagattgtacggttaggggggaaacggctgatgctatctactccaccacttaagatcactcagtgatatcttctttgaccaatgcttccaaaagaaaaccgtttgagaataacaaaacatttgtgcagtagaagattaaagttaactaagcctgatatctgtgaattttagctacctaatgcagtagaagactagatactgattgatgtaagcttttagtttttcaaatactttgagtatcaccaactccttcttgatcatgccattttgctagcctccaaacactgcatcttttcctgaaaatgttagcattgcatgattatgttctgaacattttagaggaaactagtaattttagaacttcactatgaatagatagtatttttacttttgttagcaataaagaatacttagtacattaccttccttttgttctccctctcctgcagtctcccctgtcatgttctccttagttttgtcctctactaggactaataattttctaatagctatatcagacaagggaagtcagagtgattgtttttgtaaaattgtgtgtttcttgaagtagggaaggtgagctatgta

SEQ ID NO: 42801 - DNA, 930 bp, Oryza sativa
agaaggtacactcctctcagccggtctatcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttctagattagtaaaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttcttttttttcactggaattgaggagagaagaatgagggctgggggctgggcagcaggccttttataggcagcgaggcctgccacccggctagagggcggcaaggggctgcctgcaaaatagccggccccgactggcttttttgcattcgggccccttgccgccccaccagagagcggcaagggttttcctgcaaaaaaccctccctccgtcaccgcccgttcctcccccgtttgccacgtcagcttgccgccccagaggtgggcggcaggggctatttctgcaatttttttggtcgatagattatttctgtaaatattaaaaaaaaatctaaaaccgaaaaaaagtcacaacttttctaggactgtgggcttttatttacagaggacaaaacgttgtgggcttttttttctccacccaagacgggctgctggctctggcccaacaaaacccacatgatgaagcaacaaatcgc

SEQ ID NO: 42802 - DNA, 20253 bp, Oryza sativa
  unsure (1)..(20253): unsure at all n locations
tgatagactgacagtgctatcaatatcatatttgtttttgtcaaccattgatattttctcgtgaaaggcgtgttcagattcgactagtgccaaagggaatccttgcgtgtggataaggggttcaaaatggctgtgttcagaaagaatgggacagcatttgttcattctcttttttcaggtcagcttttattctccaaaatttcatgttgccaacataaaattcaacagttaatagtaactagtaactaggtcaatacgcgcattttccactcaaatagtggttatttatgttctgaaattttagttggcaaatttagttaaagatgatgttttattagttagcaccgaccatgttcagttctgtgcatgtttcgaattcagaaatctgaaaatcttagaacttgtatgttctccttgcttttttatacaaatttaaccgtatgttgaaaggaaaatagtaactagttcagaaaagtagatttagggctagtttagttcgcgaatgaaaatttttggcatgtcacatcggatatacgtacacatatttgcgtagactaataacaaaacgaattacagattccgcctgaaaactgcgagatgaatttattaagcctaattaatccttcattagcaaatgtttactgtaacaccatgttatcgcatcatggcgcaattaggcttaaaagattcgactcgcaatttacattcaatctatgtaattagttttatttttatatttaatactacatgcatatgtctaaacattcgatgtgaagggtgaaatttttttggtttgggaactaaacagggccttaatgtgcacaatctattttctggattttctgaacatgtgcttgcatagcatcaatcagaaaaattgcacgcatctccatgttgtattttgtcttactagacgttaacccgtgcgttgcacagggtaactttatttttttaaaaaagagtcatttggactaatcgaacaaacacaatatattcttttgtccaaactattctgtattttcttttatttttaatattattttccagaaatcctatattgctaataacctcagtatttaattttgtaaacaggaattgtggtcctattcagactcaatgcaatcgttatattgtggatgtgagatatcttttaacatcattatatcatgcatcctctttagcagctcataaagtatagaattgtatctgtttggcatttctaatgttttagcaatatccaaatgaaaataaacttactatgttcttctttgtggatagttgaatattctatagatagataatgttataagtattttaagttattataaatataataagatattggaactgtataattttaaaatataaattttgacgacaaaatcaaactaccttgaccaaaacatgacaattcataaaaaaaacaaatggcatgaattcggtagatataaagagaaatattgatgcaaaagtgttcgaaacacatgtatatgaatacgacatttatacataattgtgctgagtattctgagcagatcttgtctagcgttgtgtatatgcgccatgtcgcttcctcctgctggcagtcctgatctatatgagatattctcaagaactaacatgtgtagattacatatgtaagctactaaatatttgaagaatatctgctggctgccgatgtggtacgtgtgcttcgactggtctgcagactgcaattaatcgatctgtcgcttgctacaccttgttgtatgtgcctcgatacacgccgacgctagcgaaatttatcttgtgatgttgtgattcccaacgatctactcccgcgtatttctcacaccgtacgactcccaaatataactagatgagcaaaatgaagaaaggttgagatatatgcgccggagcaaatatataaaactctgttctatttctcagtgttttctggaattatttgatttcctgtagaggtagacattgtgatgaaaccttgaaaattgttatcatgtagtctgattcctcagtcattaatggtcaaaatactatatagaatcatatataaaatacttcctccgttcataatataagactttctagcattgtccatatttatttagatgttgtgtctagattcattaacatatatatgagtgtagacagtgctggaaagtcttacattatgaaacagagggaatacaatgttgttggtatttcttaacgacattactagaaatataattcccagcaatggcgcagaaatacttctggtatattatggttacagagttcattcgcaagcgcacggatataccattgtagcatttcacccgagagtattctaagggtatcgtatttatttaatactagtaggcgcatcggtgttggtgccaataccgtgaagttgaatttgtcaaagacgtgtttgggcatgacgttgatacttgctccaagatcacacaaggcttggtcgaactattgtgccccgatcgaacaggtgatcgttggacacctcgaatatttcttcttctctgggagcttgtggagtatggcattgctgcattgctccgtcagcttgaccacctcctttgttgggagcggtctcttgttgttgaggatatccttgagataacgggcacatgttggcacttgcatagcatccaacaacggcatgttgatgtgaatcttctggattacttcaacaaaacgagtgaactgctcgtccaccgatggtttcctaatccattgaggaaacggcagcaaccgtgtgtcgcagtactcctgcagcacagccttctctggttgaacctcttcatcagccgaattactagatggtgcttccttggcgataccattagttcctatagggttaggatgttggtatttcttaacgacattactagaaatataattcccagcaatgacgcagaaatacttctggtatattatggttatagagttcatccgcaagcgcacgtccgcaagcgcacggatataacattgtagcttttcacccgagagtattccaagggtagagtgacacacaagcattagctactcattctcataatatattatctaagctaagtggaaagaaaagagaaagaaaatctattcctatacttctaatatacatagtatacatacattctagttaaccgatatactagctaataccctctatccgatgccctcctggtactttgagaagccacccctgactgccgagttccttacgacagcccgtcatgaccatacaaccggggctaaatacggaggaataccctccccagggaattaacttaggattatatacaggcgcggaggaatacccgtactgagctgtcactataagcggcccacctctcatccgcagcatataaccccaaataatgatatcccgcaatctagacaccacatctaaactaccagatagtactctaatatcatcgtcatgacatagagtaattgcatatgtaaatattatacccgcacaaaagccgtatattcagtataacattaacataatgtaaagtaggcattcatatactcagaaagtatttcaataccataaatgtatatagaagagtattctaataaaagtacaaagcgtacaaaagagaagagaaaagctactagagtcatacccgaactcttccgaagacttccggactcctgatttctactatattcctattccaccagctagatactactaaactaaacttgagagaatatgagagagctattgcttgaggtgtgtgtttgaagtgagaagatgagctccttttataggcaggtaatgacggttgtaacggttggaatggtcgataataccctccaactgtcattggggatcaatcccagccgtccatccaaaacctgcatccatcagcgccatgggaggttccgtcgaaccctatggttcggccaaaccatgggctggcccaacccaacccatctttgcttgcggcctcctttgttgtcctcctccgtagacttgtgaattttggcccagtgtgtcgtgttatttctgagttcttagcccattcatacgtaagtctggttctcgataccgtccgattgatttatcgtctgagttgatgtcgattctcctccactttattgtcattctctgcaaaaggttagtatacctaatactagtggaatattattattctaacagatatatgcattgcaagcatcactagttctcctctattttagtaatattgacggtcgaaactgatcgataacgaccatcaacatgggatacggtggatcacgagtggacttacctcccctcattgtgatcgccttgacattttcaatggaggagtcagactgccccggaattctcccagattcacttgcaggtacctatgaagccaattgagctagctgggtttctatcatcttagtaaagctcagctagttttggaaagcagaagcgaagccatctagcttgacattaatgttctctaagaccttgtcattgacagctagctttttgcttaaggcattagtggttttagcttgcgcaaagacaagagcctttaaggaggactgacacccttcatggtgtacgtactacaaatctccaggaactgctgcaaatgagcattggcatcctcattaggcttgccgcagaacgggctagcatgtgtcatcgtgatgaggctggactttagatcgaaatccacatctcccatgttgatatgcggcccaatggaacattgtcagcaaagggagcagcgaattcacggagggtcttatcagccatggtcttgaaggtcggtgaagctggtatggctggtttctttatcggtagagttttctacggagcgatgacttgcggcttgacgctccggaagaaagcttctggattttccttaaagttttccggtaggttgaaaccagtcatgcactaccccgttttcacaacaaaagtgaaaacaaccaaggttagcctgcaaagggcagtgattatacagaggtaaatataaagtatttggggacaccccgaatattataccatccagtgtccaacgcgaccaccacatactattggagaagtgggatccatatacgcataaatagccattcgtcctcaatgtgtccatgatcgcggttgacaaccttctgttataataaccggaatgtcaagtagtgagcgcaagacataaccgtaagatagcttgccagtccactccgtcatatgcccgtcaaccactcgaaggtggcgaccaaaagtataccccagtgactcaatccaaagcgctatccccaattatctcaagcgatcaaaactcgttactcatgcttagctagtccccaggaatgtgattagcctcacactttcatcggaagcaattaaaaacatagcaagtaccataatagggttaaagtgcagcgaggtacatggcacataatagggtccgaggtcccaacatacaacacataaatatagcagcggaagtctcaaatagagttcataagcaaaagataaaaccggtggtgccacaaccccactaatgcaaaccaaccgggcaagagccaagctgcaagagatcactcattgccctcgccgccctcgtctaagcaattaccacacaagaagcataactcataaccggaatcctctcttgaaattgcagacaccgggttaagtacaagattgtactcgcaagtcttacccaaaattatatatacataagggagagagaagtatgcaagctttctaggctatagtgggtctctaggttcaacatttgcataaagctaattttattgagcaattaatgagtaaaataagcaaggataagtaaatctagcatcattttaatttatggacagcaagtatataattctgaaatgtataagcaaatgagcccaaacggcgctctcatcatcaaccatggactaccaaagtctataccaacatggcacaacatgccaacaccaccatcgaacataatcccatccataataatccacatttgatgctaacataactgactaacacatcaagcattgtccatcaccgaggacgcgactattcgaatagattatactctgatcagaggtgtacaactggtcccacacgaaatgaacaaagatcaaatgctacacaccccgtcaactgcggtacacaagtgattcaagctcattacatgccctttcttagccccaccccaaccacctataccacgctagccttcccgacgactcagtcacgtgcgtgcgtgatgtgaccaaggcgggcgcgccacgcgggaggcacccccggccaaacctaggcacccgaggccctccaaaggctacctgcctcacaactctccaacgtggtataaatgatcacaatagaactagtaagaacaagccggtcccaaaataaggcatgtgataagtacgtagggtgcttgattagatgtcaaaatgttcagtccttaacaacctagacggggctacttgcatcaggggaaaccaacctcccatcattgccctatcacccgtccaagtccaacatatttcatcaaccattatttagtagtgtaagtgctcaagttttatgcccaataatgcaagttgtctatataccacaattaatagcactgtctatcactatagttctattagcactaagcatggctaagcattaatgaataagacatcccaagcaatcccaaccaatggtaatggggtataaggacagcaatatcacaagaactaaatgcataaataggttctacccatacaccataaatcgacaatattaatatctaggcaatacatgcatatatatatacgtatagattgcaaccaaatcatttttagagaaagcacaggttctatatgcttaggtgcttgccttgctgctgagggtagtcactatcctcctcaggatatggctcgttactctccggaatctccgaatctatcgaaaagaagtaatatgcgaataagagccaaataaacatgcacatgcaaaatgatcaataaattatgaaataaatatagtgggtagatcatattttaacttgaatttagttgaaagaatcactagattatcacttatggtttgggagatatgaaaatgacaagctctcaggtgttgaaaatggcagttctgtaaatattaacatttcctttagtacattacaagtaacatgcatttcaaaccaagatttcataataatgattatttttagagtaaattacatcactcacaggttctaagaaaaaatatttcacagctgtatctgttgtcattatttatatagagataatccatgaaatgccattgacaagcgtctaagtcccagaaatgccatcgacaagtgtgagttccaataaatgccatcgtacaaacgattttgtcccaaaaatgccatcgccgttagggttccgtccattccgcgccgttaacggcatttctgggacgcttgtcaatggcatttcatggattatctcatttatatatgggttttacaagttaaaatcatgggaatgctaaataactgctaaacaagatttaagaggtatttttgccaaaaacaacaccacaacagcaaagagtactaaaatataagctcaacaaaattggtttcacaattttagcttttaccaataatttcttgcgaatttattaagagctagaccacacaagggatacatattagctatttatatttttactgggaaaaccagtacaaaagttggtcatttttattttacaacattgaagatcacgtttttcttaatccacagaaatttggttcactgaattcggagttcatatgaattagttatgaatttttaaagcgcatacctcttttagctcaatagatatctttgaaatcgatttctattttcactccccttttctccaacttccatcggacttcgctcacatggtagcaacctggacgtagggtcatgcgaggctaaggcctcgggctgatggcaagagatggagcaaggtcttgggctgacggcaagagacgttgcctagggctgcttcaaccgaaatcaaaagatatgaactcggggtgagttgcagccaccttctagctgcagcaatggagtggacaacctatagaacattgctatagatgttcaacatggagggaatccaaaagaggcaccatggatgaaatggaagcttaccaaatggaggaaaacaaaatgctgctgctgcagccctgcaggctgaaaccaccactcttttgttccttctcgatctctctcaactctccatgcatgtgcaagatgttgggatggatgcaaagtttttatgatagggattgttgtggtcttacatgcagggattgatcttaggctattggatgggatttggggaggagaagtgagatgagagctcagcttgatgaagaaaagaaagaacaagcagtgaagatgaaaggcgaggaagaagatggggttttctctacccccttaagtcctgaggtgggagcacgcccatgggtgtgttgtggggctaaagaggcacccaaggtcagtgacaagtgggcccaagtcgtggctgtctatgagggtgagagaggtgggtgaaaaactgagtataaattcgttcttgcaatttccaatatttattttctttccctctcttggtaaattcaatttgactaggtaaaacaagttcaaaaatgtagaaatttggtgtggtgataggtgtaggtttctaggttccatttttcaaagtttcacacataaattccaagtgttttaaatctggtgaaaagatgaaattggttaggctgaaagttggtttgaatttttaggaggcctaaacagagagtaaaaattccacaaaatttatatttagtgatgataaataaactaatatttgaataaaatattaaacacatatacttctgttcaagttatttttcatttagaagttgctttggttttgccggttaaagtttaaattgctatcacatgtaattacttgcaataaagtaaagatgcaacctaagtgatgataattgcatttctaattacctggtaattgacctagggctgttacagtattagttctggtaatctctattatgaatcgtccccggcaacggcgccagaaatgcttgttgatatttcttaacgacattgccagaaatataattcccagcaatggtgcagaaatcctcctagtatattatggttatagagttcatccgcaagcgcacggatataccattgtagcattttacccgagagtattccaagggtatcgtatttatttaatcccgtggaaagatcatggtagagagaacctgactaataatttatatgttacttgtaataatcatagtctaagcaggggttaatataatcatagtctaagcagagtgacacaacagcatggagctactcattctcatactaaaatatctaagcaaagtggaaagaaaagagaacgagaatctattcctatacttctagtatacatagtatacatatatcctagttatctgatatactagctaataccctctatccgataccctcctagtgcttcgagaagccacccctgattgccaagttccttacgacagtccgtcatgaccatacaaccgaagctaaatacggaggagtaccctccccagaaaattaacttaggactatatatacgtgtagaggaatacctgtactgagctgtcaccatcagcggcccacctctcatccgcagcatataaccccaaataatgatatcccgtaatctagacaccacgccaaaactaccagatactactctaatatcatcgtcatgacatggagtaattgcatataaaaacattatacccgcaccaaggcatctcccagataagctagcagtataatcagtacaacataaacataatataaagttggcattcatatactcggaaagtattttaataccataaatgtataaagaagagtattctaataatagtacaaagcttacaaaagagaagagaagagctactagagccatatccgaactcttccgaaggcttctggactccgatttctactctattcctattccactagcttaagaacactaaactaaactcgagagaatatgagagagctttgcttgaggtgtatgagtgaaatgaaagaggagctctttaaataggtagatataatgacggttatggcggttggaatagtcggtaataccctctaaccgccatagggagtgaatctccactgttccctcaaaaccatgcatccatcggtgctggcattggttcggccgaaccctgggctggcctaactagcccacaagttggctggtggcctcttagacttctcttctctgcagacttgtgaattttggcccaattggttgtgtcatttctgagttcttggcccattcatacataagtttgattctcgacatcgtccgattgatatatcatctgatttgatatcgattctcctccacttaatggttattctctataaaaggctagtgaatctaatactagtggaatattattatactaacatggatatgcattgcaagtataactagttcttctctattttggtaatattgacgattgaaactgatcgctaacaaccgtcaacaaatgtattatggtgccctgcagaaacatatagcaatcaccttaaaaaaaagtaaaatatggaatttaatattgactgatgaatttaagctatttaccgtagcttgggaagtaaattattgtatacattttgttttgaagatcaaattttccaaggtaccaatattataagcagaacattatcctggaccatgttgaaccaatgaatattatttataattgtattaaggcatgcaacaaatgttctttattaaagaaaacaagtactggcaaaaactgtaagagaacatgtctggtatggtatattcaattataatatctagcaatcacctggaaagaagaaatatttaatctattgtcagataaaatcagaagatcaattgtctatgtattgcaaggaggtgtgagatttacatgaaacttcctgctctagattagctagggcatggcctacatagatctgttttaaatttgattcatcggctatttgatttggctacgtgaagatgcatcaaaattgagtaaatgattatcactatttgcaaatcattgatgaccagggaaaaaaaaacaccatggattgaactctgagaggaagagtaggagcagtggattgattgatctcttgattgacataaggttgtggaagaaaacgaagattaggtgcaagactggagtggaacgcacgcccatcactataattaaagcggttgattggatgggctttacatcaggcccatcatgctaatgtagattagagtttataatcaatggttaggattatatgatgtatcaaattaacgatctgattttactggttaacgtgggagctcctatgaagttcccaattatactataggtatagatttctagctgtgcttgcaaatttgctatagttgcgaatgcaaatttccttgatgtagcaattaaaatttgtgcccacaaatttgactataactgtgcatgcatagcacctatttttagtttgagtcataacaactacacaattttccttgctacacattgtctgatgttcttttttttttttgcgagggaaacatgaagctttattactcatcaatcatagggttacaatcgagggctaaaagattatgaacacactccggcgcctgaagacgccaaactacagactccttcgatctaagcgcaaggtgcgcgagactatgggctactttatctgatgctctttatttgttctactggccccgttcgataggtgagttgagagagatttttagcgagaaagctcattagtacatgattaattaagtattaattattgaagtataaaattagaaaatagattcattggaattttttaaacaacttctacttagaaacttttttattaaaaacacaccatttaataatagtttgaaaaacgtgctaatgaaaaacgaggaagttgaagtttgaagtttggaaaaagaactaggccaagaatagtaattttccaatagcaacacaacgtcaatacatgtttgttgcatctcagcatgaatgatgcatcacgccatattgcatctttggggttaacgtagttttcaacatatttaacagttcagaattaactctgacagttttctgaacctagtattttgctccccatatttgtatgcaatcatgtcgtcctaatataacctttttattttgtttggcaggaacacttcttgaaaaaaaaatgtgaaacctgttgagacacgcgtaggctacgatagtataaattactgcgtaaatcaggaaccatgcaagtattagatcatagatcgttaccactcgacgcgctgcgcagtggaagaaagcgctaagaaggcgaaggaaccctcgcgatgtagcgcgcgtcgatgtagaggaagtagtcgatcacaccggctcgaccttctcctcctcgtgcgttctcctcgccgtgctcccacgctgatcagcaccgcaaagcagcggcgtctctaccagtatccacacgtacagggacggaacgccacgcgcagatgtgctagcacccgcgtgcggctagggttttttgctcgtggaggggagtggcggctaggctttctcacgtgatgcaatacctccgccggtcatacccctcacaaatatataggatccgtgaaggtccgtaggactccaactcggatccctattcgaattaagctcatattggatctccatctaatccccttattccggcccaataagcgtgcaatcctgtaggttcatgtacactcagctgtaacccgaaaactccttttcggtccacgtgtcaacggtggcccctagcagaatgtattgacccaccgggcatacataaagatcatatcggctgaatatctagtgtatacatgtatgaacacctttgcctcatgatatcgattaagctcaaggctagatatatgacatcctctaatagctcaatcattcactcgaacatgtgatatattatatatataacttgtgattgactcctcaatgacctttggtatggccatgcactttcataatctataacatcgaggggcccagagatatctctccatagaaggagcaaatcccatcttgattatacatatctaactatatgtttcatagcatacccgaaaactatttttataactacccaattacggagtagcgtttagcagtccctaagtaagatactacatatgttgggaaccatgataatctcaggtctaaggattcaacaccaacactaaatgagatcactgataacacaacacatatggctcttgcaatgtatcatgttgggtctatccaacaacatgttccccaacatgtgtccacattattaatttggtatctctataccatgatccatgaaacataatcatcaattaatacatgtgctgatcatttaaacatatttgttccacatatgatatttgatcagggatccttcagaaatagtaacatacaacataaaaagtctcatgaaagaatcacatattcattaaccaataatgtgttatctattttaaagaacaatgtcggataaatatataaacatattatgtgatataattatctttatgattgcctctagagcatatcactaacaaaaccaaaccagcatggttcatgcagcaagacgtactggagcagcacagaaaagtgcaggttgtgtgtctctaaaaaagaagtccaggatgtgggttcctaaaaaataagagttgcacgatgtgtgcttctttttctgggcttgtttacacggataaaaatagtccttggtttttttctccttgcgggatgtgggctttctacaaagataaaacgtcatgggcctttttcttttgtggactaaacccacacggacaaaacaaacacaagcgggattttgttgtgccgtttgtgcaaagcgcactaccagctactcgggtgggatttttgtgcgggaggggatgggtgacgcgtgtatttatcgcacggtgagaaaaaacggctgaaacccaaaaaattttgagccgtttgtcatgtcgagagtccctcttttttttttttgctggctttccatatataggaccgatgcaaagggagaaataaatcaactcaattggcctttgtaacgatggtttactgttccttggcccacacatcagttgcttgtaccatctaagtacaatttgataatatgttatcgagttacttctattagtgaataagatttctgagtttttctttgcgcttccgaacaatagtttgctcagttttcctatgctttataatcactccgttttaaacctacaatcctatcatattcctattatttcctatgttatgtttttaatgttcctacgttttccatatcctgaatttcaaacaaaacctcagacatgatgcctcttagagcaaatttaatagtataaccaactactagctctaattcatctatagccaatctaatagccaattcatacaatagttgcttactatactattgatatatggtcccacctgtcatacacacactgcgtcttggagtccgtgctgcagctggctacagatctgtaacccactattcttctctctcatcttttagctcgttaaaatatatctatagctggctaatagtaggactgctcttaggtgctaagagtggctagctaatgaatgcctatctaactaagtgaaaagtaaaactcaataaacccacgtcttcaagaaattatgggccgtctgatttctacaccagacaatgcgagctgttggatctctcaaacggtgaaacctccccgcgatccttccgaaaacatcttttcacaatgggatccttccacatcccatatttttcttttcatttttccccccttctcttccttgctctatctgtgcgcttccctggactccgagatggcaggagtggaataagtcatgtgacatgatccaattctctatttattacacttactttttattatagtatggaaatgcattcattttctttgcatcgattgcgatatgcaatactatcggagtaaaagaagggatctaaggaagaacgtagtctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattgacaaagaacttcaggacattatcgcaattcttgggttggatgaattatcggaggaggatcgtttaactgtagcaagagcacgaaaaattgnnnnnnnnnnnnnnnnnnnnnnnnnnnnnnnnnnnnnnnnnnnnnnnnnnnnnnnaaagtatgttggtcttgcagaaactattaggggatttcaactaatcctttccggagaattagacggcctacccgaacaggctttttatttggtgggtaacatcgatgaagctagcacgaaagctataaacttagaagaggagaacaaattgaagaaatgaaattaaatctttatgtactgactcctaagcgaattatttggaattgtgaagtgaaagaaatcattttatctactaatagtggccaaattggcgtattaccaaaccacgcccccattaacacagctgtagatatgggtcccttgagaatacgcctcctcaacgataaatggttaacggcggttctgtggagcagttttgccagaatagttaataatgagatcatcattttaggaaatgatgcggaactgggtagtgacattgatccggaagaagctcaacaggcacttgaaatagccgaagctaacgtgagtagagctgagggtacgaaagaattggttgaagcgaaggtagctctcagacgagctaggatacgagtcgaggctgttaattggattcccccatctaattgaagacaacccaacggtttagttgatacaaagaaaaagggaagaggggtagaaaaaattattagatagcgaagcgaagtagggccaatgctatctagtaatttttctatctacctacctactattggatttgaaccaatgactcccgccatatgaaagcaatactctaaccactgagttaagtaggcaatttatcaccacaaaggaagaccctttacttcgattgattatagatcgaatcctttttataagcaaataccgcttagttattggtatgttattatagtaaacagatcaaaggatatcctctactattagagaatattcatcttgacaagaaattctctatatattaagatatctctgacaagggctatagctcagttcggtagagcaactcgtttacacgtgcgccaatgcttttcatgggagcttattatgcaatgaacatagtggatcttcttgcaaaatcaatgtcttacttcatggattcgagagaataggagaacagtcgcctgacaaatagttggttcagtccgattcaggtaccaatccaggtgcctaaacaaatagaacctttattgatttgctagttgataaggtaaatatccagcccactaaatgctaggcttaatgaggataagggcctccaaaaaaattcttttcgttctatgaactttaaggtgtatgaagtctcatagtcaactcttgtagcggaacgatagagactctatttcacttaggttgatttaatttaggccggaggcagacctaagtcaaggtaatcctcctttgaaacactttggtattgctcttagatagatcataatacaaataatcaatcagagcgcagggagccatctcattatctttccgtaaagaaaaactatggtggactaactgatctttctatcagttgataaaagagcccaatgcaaaaaaatgcatgttgggtctttgaaacagttcgaatcatttcgataataatccgtttgatctgttttaccgagaaggtctacggttcgaatccgtatagccctaatatgtccttttttagattttaggagagatatcctacgtttcctttagtatagttttcatttccctattagtacttgtttatagactggacaggcgcctgcgccataaaatagagagaaaaggattaccagaggctcattcatcgaaaattatagagacaggaaaagaaaaatgaatttctatcaaatcaactgcaagatgttctccatcttgcaaattcctactttgtttgaagtatattactttgcttatctatatctatagattacctaaatctaaatcaatctacgttctgaaatagagttctttatttttatagaattactcctcattaggctgcatacattagtcatcctatcttaattaggctctaattcgtagtattttcgtttttattcctttttctagagattctagagaaaatgagacaacgtgaagcgagagagttttgtttctataagaattatgtctccaccatacctaaatagaaaggaaataaaaaagaaagggagtcgggattccattggatgaatctttaaagaagacgtggcaaagaggaaacaaaggctaaactaagccctttggtttgagaaaacccgatccttgtttcaccgaggaaaagagagaaattctgtataaattgacaatgctgacttgaattgactaattcagttccgcctattccacattaatgggagtacatttatgtttctgcttcacgaatatgatattttttgggcatttctaataatagcaagccttattcctattttagcattttggatttcagcacttttagctccggttcgtgaaggaccagagaagctttctagttatgaatcgggtatagaacccatggggggggcttggttacaattccgaatacgctattacatgtttgcgctagtttttgttgtttttgatgtggaaacggtctttctctacccttgggcaatgagtttcgacgtattgggtatatccgtttttatcgaagctttcattttcgtgcttatcctagttgttggtttagtttatgcatggcgaaaaggagccttggaatggtcttaactgaatattcagacaaaaaaaagaaggaaaagattccattaagacagttatgagtttgattgagtttcccctacttgaccaaacaagttccaattccgttatttcaactacactaaaagatctttcaaattggtcaagactctctagtttatggccccttctatatggtaccagttgttgtttcattgaatttgcttcattaataggctcacgattcgactttgatcgttatggattggtaccaagatcaagtcctaggcaagcggacctaattttaacagccggtacagtaacaatgaaaatggctccctctttagtgagattatatgagcaaatgcctgaaccaaaatacgtcattgctatgggagcttgtactattactggtggaatgttcagtacggattcctatagtactgttcggggagttgataagttaattcctgtggacgtctacttgccgagttgcccacctaaaccagaggctgttatagatgccctaacaaaacttcgtaagaagatatcgcgagaaatagttgaggatcgaactctatctcaaaagaaaaatcgatgttttactaccagccacaagctttatgttcggcgcagtactaatactggaacttatgagcaagaattgctctatcaatcaccatctactttagacatatcttctgaaacttttttcaaatccaaaagtccagtatcttcctacaaattagtgaattaggaggagctctttgtgccgaaaaagaaagagcagggcaatatttcaaacttgcattcgaactgcgaaatatttatacaaaggaggagagatcaagataatgcagcagggttggttatctaattggctagtcaaacatgaggtggttcatagatctttgggcttcgatcatcgaggaatagagactttgcaaataaaagcagaggattgggattccattgctgtcattttatatgtatatggttacaattatttacgttcccaatgtgcttatgacgttgcacccggtggatctttagctagcgtgtatcatcttacgagaatacagtatggtatagataacccagaagaagtatgcataaaagtctttgcccaaaaggataatcctagaatcccatctgtcttctggatttggagaagttccgattttcaagaacgcgaatcttttgatatggtgggaatctcttatgataatcatccacgccttaaacgtatcctaatgcctgaaagttggataggctggcccttacgtaaggactatataacccccaatttctatgaaatacaagatgctcattgaatgataagaaattcatgctcacttatacaacacaactccagattttatgcaagtcaaggaatatttttacgctctgttcctagatgaaacagaatacctattacattctaattaattccaattatacaaaaggttcagatagactaagcaaaaaagggcttcatttcgttggaaaatcacatattcatttccttcgtatgaacagaaaaatatgatgactcaaagaagttccctaccacgaactttgtaccacgtgcatcacttagaacaactaggaaagtaagataagataagcaagaataaaaaaatatttgtcggaatagcggaatagaaaattaagaaatgcaaaaatgcagaaaaagaagtgcctctatttagagatttatctacttagatgaaaaaatcatactctatctatattattaacgaatatgtatcccaacccatctcgaggtatttgtatcaatacctattcggaagatcccttttttctgtgccaggaaccagatttgaactggtnnnnnnnnnnnnnnnnnnnnnnnnnnnnnnnnnnnnnnnnnnnntgaccttttcttgtgcatcatcctagtagagtatttgtatctatgtcaatatccaaaatttggaaatggggaggggtcagtcctatgcattgtacaaagaaagcctatttaataatatttaaatatcgagttaataatcgacattccttgccgatactataataaaaaagaaatg

SEQ ID NO: 42803 - DNA, 11012 bp, Oryza sativa
cttgtgcatcatcctagtagagtatttgtatctatgtcaatatccaaaatttggaaatggggaggggtcagtcctatgcattgtacaaagaaagcctatttaataatatttaaatatcgagttaataatcgacattccttgccgatactataataaaaaagaaatgtattccattgaatcttaaacctattaataaaaaaaacaggataaatactagagttagggaataaaagagggtttggggatagagggacttgaaccctcacgacttagaaagtcgacggattttccttttactagaaatttcattgttgtcagtattgacatgtagaatgggactctctctttatcctcgtccgattaatccacttttaaaaagatttcgaaaactatgaattgaaggatttgattactcaatattcgattggaatggattcacaacaattctaaaaaaattatgaattttctatttcataatcattcctattttcattttaaaaaagaattaaagaacctatattatgatatgagttctgtgattaatcatttgctatgccagtatctatacgtgtgtattagatttcgaaagcccttctttccctaatttagaagggagttccgctagcaacacaacgtaattaactcgattcgttagaacagcttccattgagtctctgcacctatccttttcctttgggttctagttcgagaaccacttgttttctcaaaacatggattggctcaggattgccccttttttaattccagggtttctctgaatttggaaattgccacttagcaggtttccataccaaggctcaatacaatcaagtccgtagcgtctaccgatttcgccatatccccattttctttttctttgagaccaggatttcttgtgcaatttcctccatctgttagttttttttgaatcgttggattcattactctatgtagtctagcggttcgtctctagttgtgagactccgcttattgcaattcagcattgaattgattctatcgttgatgtatttgcaattcaatgcgaatcaatatatcccaaggtttttctctcccccacctaccgcgttccttttttagagtattcaaaatcatactataacgcttgatattcattctttttttttgctaatcagaattagcaatttcatttgctatgattctatgttctccttagtgaaatattaatcattaaattattagcaaataacaaaaaaaacaaaatatctcaaaaaatgtctataatgatggactgaaaatacaagaaattcgcatgttctctttattatgttttcgtatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtattgttttctaagtagaacttccaatttcgaactagttaatagctaagattaataattaagatatgacattttacggatttcctatactatacatatttctatttgttacactatttctgttatgtaagcccacttagctcagaggttagagcatcgcatttgtaatgcgagggtcatcggttcaaatccaatagtcggcttttttctctatcaatgttccatgaacaaaaatacctctttttctccgaattaaatggagaagccaggaggctgagacgccgctcttgctccgcgcgcgctcaccgtgccttcaccacctcctccacacccacaccgccgcttcctccacatcccctgtcatcgcgtcctcctccctagctagtgtcgcctcctctttctccggtgtcgctgcgtctctacttcccccacttttttcctatccccccccctccccccaaatggatggttaggggtggaacaagctatccttctcgtgcaccccccgacgtcatccccgtcggcgtgcacctctggatcccgccattcagaggtctgggagaactaaatctggtcactgcacagcatttcaaccgacagccacggcaacgacgaccccttcctcttgctcctctccacaaccagcggctgttaatgtctaccacgttttcagtgatgtgcgattatacagcacatcaacgctacagcttgattcaaaggtaaactgtcaaaattgacacaagaatctatttaaatagggatattatactgcatatgttctgatgatggctcttaacattttgcgataatcaatcaaaaaagttgctccattagatggattttacatagaaaaatttacagtgctgatgaagatgttgtgacaaacagttactgtaagctactacataatttgccaagtaaattaatgaaattggtaccagattcttatttacttattaagaaacataatgtctggacagttgtcattgagtaaaaatcatatcaatacatgtatatgtacctaatttgatatactgagatgcattcctaggcatttgatatgtttaacaaaagttcaaatggcaaatgtgacaacaagtataataattagtcatattattcttacaaaaaaggtagaactgttaaatcgaggtatttagtactccctctgtttcaggttataagacgttttgactttggtcaaaatcaaactgctttaattttgattaagtttatagaaaaaagtagtaacatatttaacccaaaacaaattaattatgaaaatacatattcaataattgatttgattaaactaatttagtattataaatattactatatttatctataaatttagttaaacttgaaacagtttgactttgactaaagtcaaaatgtcttgtaactgaaagggacgaagtagaagatactacatgcaggttgactaatataaacgttgaccatgatttgattttttagtatgaacttttttcataatgaccacttgaccagtatatttgtaatcacattagcttactgtctacaatgagtcatcagattgcctcattagcccaaggaaactaagagtatgtatcaagtacaatctaccaaggaatttaaaactgatatcaggaacgtatggcaggccatgcatagcatgttcattgcttctgcactttcttgatagctatagtagaggcccaaggattactgcttctcacagatgttttctggctgcccaagacatgccccccacctctcccatgcaactgtgaagatgatggcggtgttggtgaattgctacatgactgcagcgaatagcatgcaatgctgtaaggtagcatgcaatgccgtaaggtgatcaatccttctaatgaacaatttcctcaaacttatggtagtactgcccgtttctgaatttgaaatcttgattaaaatgatctgtcgttagcccattaacatcaataatttatgagtgcgaatacacctcctcttctaaatactccctctgtcccctaatataagggattttgatattttgcttacactatttgaccgctcgtcctattcaaaaaattttggaattattatttattttatttgtgacttactttattatccaaagtactttaagctcaacttttcgtttttgatatttgcacacattttttaaataagacgagtggtcaaacagtgcaagtaaaatgtcaaaatctcttatattagggaacggagggagtagttggaatgtgcatatttaaatgtttcttccacaactatggattttaataactgaaactggtattggaaaatatatacatggaatggtcttggttgaagactgaatcatggacaaagtcttaatagccattgcgtacgattcatctgagatatattgtatattacgtactggtgtttttaagtctgaacttcttcgatctttatctcagatgaatcaagatcttcagacaacatcagtgtcatgctgaacaatacttgctacaatcggcacatatttgttgttcgagaaaaggaatgtacgatagttgaaattttggatacatggtggacagaagtacaatagttgaaattttgttctcatttccctgttttgtttgactcttaacttggaagactgagtaatattctactggcataacagattttgggtcattcagaactgtttgacgcttggatacaagctgaaaagatcagcatagcaaacagcctgtgacaccaatttgattggcttattctagcctggtagtagtcagtttgatttgcttggtatttaaagagcagaaccaatgtttggaaataccattcaaattgctctgttttgaggatgactttcaaacttatgatttaatgtattgtattagttgaaatatacaggatgaaatgtatctatgtgcttaagctataaaacagacaccaatggaaaactaaggggagaataagggtcatgtaacagtggaggtggtgaaaaggcggcgactggtgcagcggtgaagacagtgaaaaataatgataaagttatgtaaacttaaattatcatatgaatttaaagttcccaatatattatggtgggtgatttgttatcatatacaacatataaatcaagctaaataatataaatatagatggcggttgtggttgcacaaaagtgtgactataattgtcggtgatataggcccgggggtacacacagtaaagggaagtatccttcccgtttagtcacgtagccatgcgcctcgccttcccccgcccctcggatagcgctgaggtggctgagggggctcggggtgccacgtcacacccctcgggctctcagggtagggtgttacgcttcccagcagcccgaacctgtataatccttggtcttccatgcatactcgtgaacgatccagtagttagatctcaagtggaagtctcttgatcatcgcgccatctcccccggccgaactcacaaagaggggtctcacgaccacccgctagagaggattacttctcgacagtaatgaaaacagatttttcgttcatctaatatcattagtatattttcatatatataatgtataattaggatggttatagttgtgcaaatgcgtgacttcctatgctggtatctatgatatgtccactacccagaaacatggaatgaaccgtgtgttttcctacgtccttgtcatttacgtacgtcttctaggcatcacaagttgattcctatctaatcctgtagttgggacacttgtggtctagtttatgaacctatcctttgaaactggacatatgtggtctagtattatcataaccctatctcctgaacagttggacactgagaaaggactattaagatgatgacaacttttgtttctctgttcagtattaattaatcatttattatgtacttcctccatttcacaatgtaagtcattctagtattttccgcattcatattgatgttaataaatcttagacatatatatctatctagatttattaacatcaatatgaatatgagaaatactagaatgacttacattctgaaacggagggagtacattattcaaaattggtacagttcaggtttgcgacggaatacccttttaaattttattatcgttagcaggtatttttgaactaaatcagaacaacacactactattagctaatgttggcaaatttggaattgcaaatggtacagaaataatttgtttgtggggtctatatgtttgcaaatagatctatgaggatatattataaaattattatttaacgtgtttcttaaattaaaaattgtcatgatgtgggaaaaaaaatcttggacgccaaaacaatggactaaaattccaactttagcacaaaggttcagaaagcaacaaatttccttgaaatgacagaaggcgacaattcaactgcgttagataagtttggcttaaatatagttcaaatgaatgtatgcatcaatagatgaacacccgaggatcaaaagccaaagctcacaaaagtttcaattcagaaatgagtgctacgtatagaatcgtagaagaggaggcaatttcaggatgatcgagcttggactcgcagttcattttgaattttatctgattagagttatatgtatacataataatttacatatgtgaacgagggcgcccgtatttgcgcgcgtgtatctttgaactgtttgcatggaaacgaattaagtaattcccaacaatgctatgcatgtcctaccacacataattgaaatggaaaccagaggtatcaagtttggtctgagtatagtattacatataagtatcgtttttgacgatttgtacaatatatttattacgatgtgtatgtgcatatgattagcctggtgctagcattcacatatgcatgctcttcaacctatgttgatacatacatatgtacatacatacacagctgatgttgacacaaacaagatgaaaaaaaaaaactgaagcaacaaactgggaaaggggaaaccaatgcaaggtggcccgattcgaacgttcaaagctgccaaaaccgaatagatcaatcgagtctcctctgtatagagctcacgagtgagcttgctggcttgccaactagcttagtttccgccggactcctcgcaacccgggggcttgtaggcgatgaagctaatcaactgcacctgcctgacgttgtcgaagccgatgatgcgaacaaatgcatctggatatgccttcttggcctcctcgagctccttgagcacctgggtggcatcagtgcatccgaacataggcagcttccacatggtccagtacctgccatcatagtacccaggagacctgtggttctcacggtagacgaacccgaccttactaaactcgaggcaaggcacccatttggaccggagcaggtactcgatctgcttcaagaggtcctcgaccgtgagcggtggcaggtacgacagggtctcaaacttcttgatgccttcaatcggccacacctgcgcagagaaatcatatgggttaaagttgatgagctctctttaatttcctgtgtgtgtgatgaggatgaagataccaattaagcttgtactgatcctatgttggcttgttcatacctgcatacagctgatccttccaccgttgctgacgctgccgaggccggcgctgttggagcggcggctgacggggagcccggcggtggatttgagcccctggaagggagcaacggaggtggccgacgaggccatcacggtgggcgccattgctagctctctagctttctgcttggtgaggtgctagagcagagtcacgctgcagcagtggcttgaggacctgtgtggtaatccattacgtctataaataaccaaatcgcaggtggcattggaaggcagcgcttggttgatccggggatgtggaaagagtggctgccgttcgctgatccaaagcacgggtgactggctggctgctaaatcactcagattttcaagccaccaaatagctacgtacgcctcagattaaaactatcaaattcaagtacgggtgttaagagtaagtttaataggatagctcactactagctttaatttatatatagctaaatctaatagtcaattcacacaatataacagctgcttactatactattaatatatggtcacacctatcatacacacactgcatcttagagtccgtgctgcagctgactataaatctgtagtccgcttctcttatctcttattttttatcttattaaaatatgtttatagctggctaatagcctactattgtacctgctctaataccatggaactttatctgacgctagcaaaaaggaagaaaaaaacacactagttaactactgggcttaacaacaacagaaattacaccaagtagtagaaaagttacaatccagataaaaaaattacatcataataaataaatgttttatttttaattatagtgtatttacattgtaaatatagtgtaacggcggtaattttaatataaatatatctttgcaacaaaaccatcaatacctgctagctcagttggtaagtagcttggaacagcagcgcatgatgtccacgcgctcgattcctccctccaggctccagctctctcgcgcggttgcatttttctagcaccctagcactaatcttaacttaaaccgtagtctaaaaattgacagattattttgttaaaaatctatcgacagatttttataacaattccggcagccaacacctgtcagttaattatgtatctatagcagctcttaaagcaagtcgttacacacgtactccgtagctaaaaaaggcaaattttatctatagcagctcttaaagacaagtcgttacacacgtactccgtagctaaaaaaggtaaattttgttacgtgacatcatgacttcgcggttttaattgtaggataccgcgtgttggtattcttaacgacattatcaaaaatataatttccagcaatgacgcagaaacactcttagtatattacggttacagatttcatccgcaagcgcacggatataccattgtagcatttcacccgagagtattccaagggtatcgtatttgtttaatcctttggaaagattattatggagagaaccaagctaatatttatatgttacttgtaataatcaaagtctaaacaagagttaatataatccaaaagggtagggtgacactaagcagaagcattcacttttctcatacatattaattctagactaagtggaaagaataagaaaagagtcatttgctatacttttaatatacatacatacactttagtcaatattatctactatataattatatagccaatacccccttacgatgccctcctggtgtttcgagaaaccaccctggttgtcgagttccttatgacaatccatcatggccatccaaccggggctaaatatggaggagtaccctccctaggaaaataacttaggattatatacacgcgcggaggaatactcgtactgagttgtcaccatcagcggcccacctcgacatatctgcagcatataactctaaataatgatattcaatagcctaagcacctcgcttatgctaccaaatactgctctaccatcatcatcatgacatagagtaatcatataaatgaacattatacccacagcattgcatctcccgagtaagttagctaaacaattataactcgaataatatttcataaagttggtactcgaataatcagaatgaaggaaagtaccgtaaatatattgagaagaatattctataaatagtacaagtcttacaaaagaaggaaaagatactagaggcatagccgaactcttccgaagactctgaggactgaagattctattctatttctattccactatactctagagactatactaaacttgagagaatgtatgaagcttcttgcttgaggtgtgtgttgaaatggaagaggtgaaggccttttataggctggtgatgacggttggaaaggtcggtaatactctccaactgtcattgggagttgatctctaccgtccagccaaaccctggatccatcagtgctgcggctggttcggccgaacccagggttcggccgtaccctgggctggcccaaccagcccaaactttggcaggcggcctccttgtttgcttctctccgcagacttctgaattttgggcttgttggttcttgtaaatttggtgttctcatccaatttgtcttcaagtctgattctcgacagcgtccgattgattgatcgtccgttttgctgccgattctcccctattttgtatttaagatgttagaatcctagtgctagtggaatatcacttattctaatataaatatgctttgcaagcacaactagttctcctttattttggtaacattgacaggcgcaactgatcgataacgaccataatcaaaaacgcccaagcttgaaccttttcttgtcccgagtaaaggacttcacaaaaatctaaacttggttgttgatcaggagttgctactatgctgtatatctcaaatgtacagatgcaaggtatgggtactgttgacggtcgttatcgatcagtttcgcccatcaatattaccttaataaataaaaactagttatacttgcaatgcatatcatgttaaaataagaaatattccactagtgccaggattactaacctcttgcagagaataaacataaatggaggagaatcgacagcaaaataaacgatcgatcaatcggacgctgttgagaatcggacttagaggaaggtggggcaagaactcagaagtggcatactcaaattgggctaaaattcacaagtctgggaagagaagaacacgaggaggccactagccgaaatgtgggctggttgggccggcccatggttcggctgaaccagtgggttcgaccgaaccccccacatcaccattggatgcagggcttggcgtggacggtgtggattagctcccaatgacagttagagggtatatccgaccattccaaccgtcacaaccgtcattggaaagctatataagaccttcaccttctcacttcttccacacacctcaagcaagaagcttcatacatttctcaagtttagtatagtctctagagtacagtggaatagaaatagaatagaatcttcaatcctcagagtcttcggaagagttcgaatatagctctagtagttttccttcctttgtaagacttagtacttttattagaatattcttctttatactactctggtattgtattactttacgagtatatgaatactaactttactatatatccgagttatattgattatgatgctagctaaactgggaaatgcaatagtgtgggtataatgaacgtgcatacgatgactctatgtcatgacgatgatattagagtagtatttggtaatttaagcgtggtgtttagattactggatatcattatttggggttatatgatgcggaagcgaggtgggccgttgatggtgacagctcagtacgggtattcttcc

SEQ ID NO: 42804 - DNA, 25383 bp, Oryza sativa
  unsure (1)..(25383): unsure at all n locations
tagtactagcattatacgtacttgggttggtttgttgtgattgatttgggcattatctctaataccgaagtgataagccaaggcaaacaacatgtgtggcccactgtcatttgctatcctaatcttaagattatctctatggttgtgcatggtttatctgtgccgaggagataaatcatggcaaacaaacacatatgatatattcatggggcccactgtcattagctatttaatgtcgtgattgcttctgcatgcaggcgatttgttaatttccttatctacagtaggtggttgattgattatctacaacacgtcgacgacgctgaaaactcgcgaggatgaggccgcgccgttgctgctgctctgcctatataaagggcctgatcgccctcctcgcgaggggcgcacacgcgtacacgccgccgccaggcgctgcgccaagatgcaggcctgtgctggtgatggtgaatattatagccacacaaatatttgggaggaatcaggagaaggcaaagtaatcgtcaacgtcaaggagtatgcttcatcgtcgctggtgcaactctaaattaatcattcgccttccgtcgagccgcgcttcatcaacataatttcttcgtcaagctatttgtcatcgacaatacaacagcgtcgtagtactgtgcagatattatgcatagcccggcattatcttctagagggagcaaatatacaccgtagggttgtgcagttgcgcagcctggacggtaaaacagtaaagtggagtactggtgaatatgtcgtggatgcgttgtgaattgtagccatggatataagtatccccagtggcgcatgcagacgcacacgtcattttgtcaagcgattaatatgggccgcaaataaatacaaggcgagcctgaccctcgtgagggttgaaccgtctaaattatcaatatcaaatattggatgtggatatttatttgtataaacttaggatgagtttgagtcttattagcatcagaccaaccatgatctatacatatttatattcatgtcagatgagtcacatattgccttgtgcatgtcatgtacgggagcaattctttccctctcaaaaatctatcggatggatgggagcaattctcacaattcctgaagacaagcattattcgcacaataaaacaacgctagccatgagggcgaggcgtgcagatttaaaatacacgtcgtcatcgtggctgaataccgacgagatgaaatggccgattcatcaatatttgtgctacgtccgagaccgacgaggccgggcgacgtattggctaaagctaacagggctactgctattcattcatttcatttgtctattaccgatgaggctagacgaaatcatggccgagtgccgacaaggccaggtcactatactattaacacgtctaaaatggacgggagccggatacaccgttgctgggcaccgacgaggcaaaagaaaccataaaatctatgtttgatgaaggccgggatacatgactgggtaccgacgaggcaaatgtcacccgcttcaccaaattctctccgcacaccgacgtgttggtagtgtattgtgatcgggttttggcgaaataaagccacctgttccacattcactatattcaccattaaatctgcaccaacctcaaccttcggcgagtaattaattttgaagatgacaatcacaaagcgcagcttaatcggaggtgttccgtaggctcgtcctatggatgtaattaaccggtagtctcattgctaggcgccgggaatcagcggactgcacgcaatctccagtcagcatatctttctattaagcattcctcgcgaaggcaaaaggcgaactcctacgggagccctcatgtatttgtaacattcatgttaatgaatcgtgattaataaaatacagggtttccttatttctgtgtgttcgttgttttgttttcatcaaacactagaaatataggaataggttctctctattttctttccacttagtttagataattatgtatgagagtattaattcttctgcttagtgtcactctaccctttggattacattaacccctgtttagactttggttatcacaagtaatatataaattattagtatggttctctctattataatcttcccacgggattaaacaaatacgataccctttgaatactctcgggtgaaatactacaatagtatatccgtgcgcttgcggatgaactctgtaaccataatatacaaggagtatttctgcgccattgctgggaattatatttctagtaatgtcgttaagaaataccaataagcatttttaagccgttgccggagaagatttataaaagagattacataactaatactttatattaacctctgtataatcattgtgctttgcatgctaaccttggttgttttcacttttattgtggaaacagggtagtgtatgactgatttcaacttgccggaaagtttcaaggaaaatccagaagttttcttttggagcgtcaagccgcgggtcgttgctccacagaaaactctcccgacaaagaaactgatgaggacatcctccactattacccgatggcaaagacgcaaaagtcgggcggcgaccgtgtgagcctctgaataatcccaccttgcttagcttgggaggaggaagccaccttaaagggagagtcacccttcccctattggactagtcttttagagagattgggcctttccccgagtggatgtgcccaagaactgttggggtccgggcaaccttaatttgttgggcctcggccaaccccacctgggccggattgttactagaaaccagccattcccgtgccaccaaccttcaaaaccatggctgacatgaccctcagcgagtccgctgctccctctgttgacaacatggccactgggccgcaaatcaacatgggagacatggactttgatctgaagtccagcctcatcacgatgacgcaggctagcccattctgtagcaagccagacgatgatgccaatgcaaacctgcaacagttcctggagatttgcagcacgtacacgatgaagggcgtcaatcctgacgccgtcaggctccgattgtttccgttttctctccttgggaaagcgaagcagtggttttatgccaacttcgctacgaccaacacctgggacaaatgctcaacggcattcttatcaaagttcttcccaatgggcaaaaccaatgccctacgtgggagaatctcaagtttccagcagacaagagacgagtctattcccgaggcgtgggaacgactactggagtatgtggctgcctgtcctcatcatgggatggacgactggctgatcctgcagaacttctataatggactcactcccacgtcccgtgatcacctagacgcggcagctggaggagccttcttctctaagacgggcagaggagccgtcgatctcatagagaagaaggtctccaacatgtgctggagcgaggaacgactctagacccgtcagcgaagaatgcacaccgtcaaggagacggagatgctcgctgcaaaactggacctcatcataaaacgcttggacgaccacgagaaatgacctaaaggcaccgtcaaggcatgagactcgcactttacgtgtgaagtctgcggcggcacgggtcattctaggaacgactactcagaaacccatgaagaggcgatgtatatgggcaacaacaacaacaacgggttccgaccacaaggaggtcaatagtagaaccagccatgcccatatttccaaggaggcaacaataacggtaatttctctaaccaaccttccttgaaggatcttgtttttgcgcaaaccaaaactacagatgctcttagcaaaaagctagctgctaatgacaagaccctggaaaatataaatgttaagctagatggcttcgcttctgcatttcaagaccagctgagttttaataaaatgattgaaacccggttggcacaattagctgctctagtacctgctaatgaatctggaaggattctggggcaacccaaatcctctgttgaaaatgttaaggcgatcacgatgaggggaggtaagtccactcgcgatccgccatatcctaatcctgcaggagctagccacactcgggaagcaccatctgacaacacggttaatgaagaggttcagccagagaagaccttgccgcaagagtactgcgacacaaggctgttgccattccctcaaagatacaagaagccattggtggacgagcagtttgctcgttttgtttaggtgatccagaaaatccacatcatcgtgccattgttggacacaatgcaagtgcccacctacgcgcgttacctcaaggacaacctcaacaacaaaagaccactaccaacaactgaggtaatcaaactgacggaggaataattagtggttttggtctgggttccccacagacggttccagctattgtcgaatgacaactgcgtccgtcgaaggatgtggttcactctttgtggaaatgtaaaaattatgtattaatattgaaatttttggatccccccaataaatgccccttggggtctatttataggcttagtacaaacgcatgcaccctaggtttacttggtacaagggaatttacatagatacacttacgatagggacatttatgaggataattacagaaaatttaaccctgggcatcttcttgggccgcaaggtgggccttcgttgtctagttgaccccttcgggccctaagaccattggactgggcgaagacatttggcttgggggcgaaggtcctgggctttgccacgtggttcgccctaatccttcgccttcacagcaatcagggttttgttgtcatgcttcgcctggacagccccaaactaatttcggcaggttctatcgaaggtactcgtgacacgcctctagcaaccttggtggagcattcgattcaggtgtgggacatgttaatttgattttgcaaaagcatttttgtaagattatattgtattcccaaaaaatatatcgttcctacttatgaatgaaatgatgcgttgatgttcattgcctattgatgtgatttaaacattccaatattatatcatacaattaatttgattattatgataactgaaaaaaaaatataatgcaaaataaagatggcaattatagaaggtagaaacgtatattaaagtagtgttccagctgaacttatccgttgcaacattgcagcgttattaccaagcataaccatgtattagcacatatccttgtaacaacagcaaaggcaatgcatatagattattttggctcctagaaactatgcattgctaaagagacattacttttgtgctgtgatgcttgatcttggcttagttgtgtcggactcctcacaacccaggggcttgtaggccatgaagcccttgatgtgtggtcccatgaggatgggctccacctattagggacttctatccgtctaattttacgtcaaaggagttgctttccttgtaactcggggggcttttaggcgatgaagctaatgcactgcacatgcctgacgttgtcaaagccgacgatgtgaatgaatgcatctgggtatgccttcttggcctcctcgagctccttgatcacctggctgttgtcgctgcagccgaacatgggcagtttccatatggtccagtacctgccatcatagtacccaggagacctatggttcccacaatagatgaaccctacatcactaaactcgaggcaaggcacccactcagactagagcaggtgctcgatttgctttaggaggtcttccgcggtgagcaacggtaggtacgacaatgtctcgaacttcttcttgccatcaaccggccacacctaaacaaatggaaacaattgaatcaggtcactctgaacttttgaacatcagttagtttgattgatccgtgtaatcattgtgctgatttaaggttttaggatgaacaactagttgtacaagtgtttgaattgactttggtgaagtgtttaaattagcgaagcgttctggacaaggctagatgttccgacctatacatggaggaccgaccttgatggtcaagctagtacatggtggaccgactggaggaatgctaaaggtggtccagggtattcttggttggagtcggtttcggggtaaaattgagttttgcatttggtgcttaatgtttatgacttctagatgtttcatgtgtgtattatgaactacatttatgttaatgtgagttaagttggaaagaacttgtacttggatatagtttcttgattgtctatatgtaggtgttgcttaaaacaacgggagtattcccactgatgaatcgggagtaaacttgggaaacgttgaggtctagacaatctaggagattatgtaggatgctcaagcgaaaggagatcatgcaggatacatgaggatatgtatgtgtatggaaaggggtcaagtttggaaggtgtccaagtttgagttgtaattgagtccgtatttgtaaaaggatgagtgtaaccttaatttgaggggtttcctatgttattatgattcctatttttagttgagctcgtggctatgaacaaccacatccatgggtacaaatagagagtgaggatatgccttgagggtaaagacaattgagacattcgagatattagggctcattgtgttagggttttgagagattttgtgagaggtgttgtggctacaccttatggacaatgcttgacaataaagatcatattcaatcatcaaggcgtcgatgatctttttcggttgtgtaggttttacattttgtttcgtcttgtcattaatttgtgattcttcatttttcggcaattttgtttaagttaataacatttctaatacttcatagatcagatatggaaggtttcaaattttcttaaattttaggctatgtttagatttggtaaaatttgaggcaacagacattttgaggatgttttctcttaaacattgattggtttgcaaattcacccagtggagttgttctatggtttgtctactttattataacaagttttggctttaatccaatagctagttttagagaaaacatgtttttacataactatgtttttagtacgatgggtccgctcagaccgccagaaatgttctttaggatttttaggttgggttagtttttgtttttcaaacttttgactgtctgactttctttgattttatctaacattcatcccttttagccgtttctttttttttcaactccaaacttcaacttttttttattttctgttagtatgtttttcaaatggttaaatggtttgttttttttttgcaaaaataatttttatatagtagtttcttgaaagaatcaaataaactttattttaagtttataataattaatacttaattatttatatgctaatagtttatcacgttttgcatgtcaccgaaaagctaaacaaagatagagatttacactacctttaataggcttctctgtattcgatcctacacgatcactttgaagaagaagctgaggacgtatggtacctgcatgcacttgatccttccgccgttggtgatgtcgccgaagcctgagttggtggagcggcggctcactgggaggccggcggtggacttgagcccctggaatggagccacggaggtggccaaggaggctatgacaatgggagccatagttacgtagctagggccttttagattgatgacattttcaaccatatcattatttggtaaaattaataattatgtgactgcgtttagtttgttactaaatattagtaatgtttatataattttggcaacattattaagccaatcttactaaaattttggtaatattgtcaatttatcaaaattttggcattgataaattttggtaaggcttattttggcatcaatctgaacaggcccttagttagctagcttattagtactagagtagttatgtgcttagcagtagaaataaagagaggatgattgcatgtctcttggcatcaatcttaacagacccttagttagctagcttattagtactagagtagttatgtgcttagcagtagaaataaagagaggatgattgcatgtctcaatttgaggctccagcaccttatataacgccaactatggaactgtttcgatctcaaagggcaggggcagacccaatgggatcgatcctgagcatttccggaaaacccaaaaaaaatatgaaataaagttaatatatatagatatatctcatatgtatatatttaactacatctaatacgtcactctcgatcgtttttctcaacatgaaaaaaatgtccgtgcctcacaacaggcgaaggttattttaatcttattgttgttatatggtttagttaagatgaaattcactgtgataattggcttggacacacacacacacacatatatatatatatatatatatatataatcatgagctacattaggagtctaatcatctcaagttagcatgcgggtttttttaaatagatatcttatacgagtccttatgtatttctaaaagtgagcgaagtgactcaaatgcggatatgtatttccaaaagcgaacaaaattaaaaatcgactcatgcacggataacgtaccaacgtatcgacaaaaacatcttcaatttttataataatagagataaatccacttctttttactcctatctcacaccacttctaatctattaaccaactatcttaaataccctaactttttcccactaaacactactagctagggacatgaggtttgtaaaggttaagtgaatacccccatcttaaactcaagcattgcttgaggaattttttttctaaaaatcattcaaatagttatagaaaaattctcaaacaatttaataacatttatatttatatccaaattcaattcatagttgatatataaaaaagagtactatttacattcgacttccgtttcttttgattctcaatgtgtacgttgtatttaaacttgatgttttttttagagtgttgtatatcactatactctatatttttaatattttaaagaagtaactatttgtattgaatttagaaaaagatacacaaggaaacaccctctcaaatgattagaaatgtaagccatgcccgttgctttggatggagcttttaactatttgccactcttacgaatagtgcttaacgatttgtcactagacctacatgtcatagacacatgagggcccacgtgttattgacagaacgtggcaaatcgttaattaccatgtcataagagtggcaaatagttaaatttcccgctttggatggttaccgacaggattggggaggagtggctgcggctcgccggtgaagatgcgggcgggcaggctggcatggctatcagccttatcctctggaccacggggacgagacgggcgatccatccaacctggccgtgtgtcgttgattgctaacttttgtttgttttcccaagcaaaatatgaaaaatatgctgtgctcgttgctaacgtgctcagtcaggtgaactgagatgtactgtgctgagataaattattgttgtttgatttattcatttttttaaggacttatcagccgttgcacaaaagatcaaatcattgttctctcaaaaagaaatacattcgtttactaattaacttacacaaataattatgtcagatcctatattcacaatacattcggttaaacatagaaacaaacattgcaaacaaatacttaaaaacaaacataattacgtgataccatccattttttttattgtcgacgaatttatcagatatgctctagatacatatcttgtgtgtatatagccggagctttgttttcacatatcctcacccaacgataattgtagtactcttacaataaaaccggccggagagggagggaagagattattacatatgtgttaagagcagaggccattgagatggtacataaccaaactgtaaaataaaaatatatagcatattatatattgatatatcatcaacatagcccaaaacaaagctgcatactattattataggcagcaatccaccagcgcgatgcttgatcttagcttagttgccaccagactcctcgcaacctgggggcttgtaggcgatgaagctaatcaactgcacctgcctgacgttgtcgaagccgatgatacggacaaaggcatcggggtaggccttcttggcctcctcgagctccttgagcacctgggtggcatcggtgcagccgaacatgggcagcttccacatggtccaatacctgccatcgtagtacccgggagacctgtggttctcacggtagacgaatccaaccttgctgaactcgaggcaaggcacccacttggatcgaagcaggtactcgatctgcttcaaaagatcctccacggtgagtggtggcaggtacgatagggtctcgaacttcttgatgccctcaattggccacacctgaatgaataatgtaacaatttaaatcaggttaatgtgaatttcgtaacatgagttaatttgatccttgactttaaaggagaagcctgaggaggtatatatcatatatacctgcatgcacttgatccttccgccattgctgacgttgccgaagcccgagttggtggagcggcggctgacggggagcccggcggtggacttgagcccttggaatggagccacggaggtggccgaggaggccatcacggtgggggccatagccacgtagttagttagctagcttactggctagtagtagtagagtatgtccagtagcagtgctgttgaggccctgtacgctggttcaccagcagcttatataaacagcaatcgtatcatgtcatttcatccatggccacggttggctgccgagaggattggggaggagtggctgccgcttcgccggggatgatgcggccggccaagctggcaggcccatcaggtcggcagccacgtgtcggcgcgtggtggtgcggcttatcctctggaccacagggacgggatgggcgatccaccctggccgtgtcttgttggttgctcagcctctctagttttgttcgttcccaagcaaaatggtacagtacgaaaattatgctttgctcgttgctactctctccatttaaaaaaaaaactcaactaaaaaggatgtaaccccttttattataacgattttgctatatatttgtcaacaatttttctcccaaaaatttgacagatgtaattacagtacaatcatagtgtaattacactgtaacttgcatgtaattacactgtaactatagtgtaacttgtatgtaactttcaaaaatatctgtgtaatatgttatttcgataaaatggagattgtgagaataaatccttacacatatgtgtgtgtcgtgatttttttttcttcctcaataaaacaaatcttgtaatagatttaacgattcaaaattacgtgaaacttatatacaagttacactgtagttacctgcaagttacagtgtaattacatataagttacagtgtaattacactacgattatactataattacatctgtcaaatttttaggagaaaatttgtcgacaaatgtataggtggtcccttattataatgaattttgatatatggatatccagattcatcgtactagaagggatcacatccctacctaagttagtgggttgtagcgtatctagtcccgaatttgtgcaatgtacgatgcgtcgtgtgcgtggaatggagtgtacgatttcaccgatcaacatcaatgcaaatgggcaatatatgatggttagtgcaatccgaaacccttcacttcaactaatttttatagcattaatatgttgataagtaagaagaaaaaaaatgatgttgcaaaagagttgagcagagaaaacaaaaagatgaagaaatcatttatcatgtaagaaaccagttcaatatatgaggggatagagagatgaaatggaagaaaagagagatggttatgataatttattttaagaaaacaacatgagatgatatagtttccaagaacaattgggatggagtatcagtagcaattatggcaatatggcaattgcttcatcggaaaagctgacggacgaaccgcctctgcgcgacaaaggaatgcaaagtttttttttttaaggaaaacttcatgtttccattaacccatgaaagcgacaaaatcgccggcaaccaaaccctcaacgcccggaggtgcaccgtcccaaaagatcggtgtttgggggactgttacatccaatggatactatagcatcagctaacttattacattcccgcagacaatatctaatttggcaagaaagaaaagacgatgttacatccaatggaatgcaaaggatgacatacaatcaagaacggaacacagcgattcgtttgtgacacttgactttgtaaaggataggaaaaaaaagaatactagcattcttgatagccaaagcgctagcagcaccctgcccttcaacgtaaataaggtcaatttgttgctttggcagtcattcctcatttctcaacaacgaccatacatatagctagggcgaccaagaaagatgcagctatagattgaaaataagcaagcaacacgactcgcaaaagtttgctcgagtgcaatgtaacccaatactgtacaatacaatgcacaaaaagagcaacgaacgatgttactctcataaatgataagtactgtgcaacatgacagtttcacaagtcttcaactcgagcaacacctctataatcaatatatacataatcaagacatcaggcaaaaaagaatgaacaagctattacagtctgtccatttacagtacaacatatatactgtagaagtcctcgcaaaaaaaatatatatatactgtagaagtggatgtccccttgagatgttccccttgtctgctctatgaataatgtgatgaatcctgtataggcggtactgcagcttcagtcggaaccgttggcctgtccttcaatcctcattctcaacaatggactccgtaactgaagcaatgtaacctgttttatatagattcaaggtggcacgtaataaaagaaaggagaccgaaggccctgcagaaagagaaatcacctgattcaagtttcagatttgatagaacaaaaactatttccaaaaccagaatttagaaggtatgaaataaggaatgcatttatcaatatatgtaacctggcaacatcaatcgtgctacagtaagttcgaatccaaagtggtgtcagacttggcagatcaaacatggcttcagagaagtttgcaagaataacctgacccagcctttctgactgcaatggcaccttagcctttccattaacaaacagatgatttcttgggaccttgctccaaagaagcattcaccatcgcgtcaaggttctagatggaacggttctaaagaaccccaagtttgtcctacctttattttagtgcgtaaaggcactggtgaaagaaacaaatagcgattcaattttcagcttgaaaatgaaaactagcagtatccgattcagaacttcagattagaaagtgatacctaagagtgaagcagagttctccatgacagtctgtagtaaccttacagcctccgctaccatacatggatcaacttcaagcaccagttcatcatgcacctaaaacacagaagaggattaccatcatctaaacaagcaaactaacagaacaacgatggaaaatgggatacatacatatatgtatgtatgaccaggaaaaatgggatatttcatgatagcttcatcaaatacctgcagaataaggtgacaacggcctctgatttcagaaaagttctgcatagccacatcaattgaatcaactgttgctcccaccgtgctcccatttgtaattgcagaatgaactttaatcatagccactttgataatatcagctgcagaaccctggaaagacttgcacttaaatactgtattgcagtgaattaagaacctagcagcttaagaaagatggttgctctattacctggcaaatagaattaactgcttgtctctgtgcctttgctttctccttgctatttccggctgttatttttgaaagaaaacgtctccttcccattaaggtctccacatacctgataagtgataatagcttaggcactacctttaagtattgacatgtgggtggttataaaatgaagcagaggattcatgctttataagatatgtacttctacacattggcagaaagcacagatgtgcctttccctgtaggttacgcaacctcatgcgtgttgtacccccattcttcttttcatagcactgtgaatacacctcttgcactggtcttagattaactgaattagatgcacctattcacccgtgtgttagctgtttcttgtttaaggttgtcctcagcttctagtactccctccgtcctccgtcccaaaataagtaaaccagtacaggatgtgatatatcatagtactacgaatctggacaggcacctgtactaggttaccttattttcctgtactaggttaacttattttgggatgagggagtagtgcacaaggcattgtgaacagtccagaaaatgtgcttcatcaatatgttttttaacttggaaaacttagatttcattaacaatcatgcatgctatattgccagctaccacactggtcaaaataacaaaaatgattgacacgggtcaacatattgatctaattgaaactagttcaaacaaatttaactcaagttgaattcttttttttttccagcctcctcgatcaatggctagttggctactagtggcaaacgctcaatgaggggagcagtggcagagctcacaaagatgtgccagctggacacatgtcattccaatctggtgtgccacgcccaaggtagcagcaggtaaattacttatgctgcagccctatcacctcacaccgctgtaagttgccaaactggagcctgccgactcccatcctcacctcatgtcatgctgccattgatcaaggagatggccatccaaagttaaggaagacgagtgagagcgatggagggagggattggttcaaacttcaaagtgcaacaaaaaggaaatactacctggccctcactcagtgaaaacattgctcattcgatcaataggtgaaactttggcaatgataggtgccccaatatacaatatactcatttttttcttcacaatttctatctcaaaaacacttgtgggtataagacgatgcccacgtcgaatgcaacaatcctcacagtactgcaacgggtgtatctatgtgggtgctttctgccttggcaacatggtgcctaaaactgctatatatatttccaagttaattgcattggcggtacataaacttgttagatgggtacgatcaagtacacaaacttgtaaaacagttcttttggtacatgaacttgtccaatgcacgcaaactgatgctaaaacaacacattgtgactaaatttaccgagttggacgctaagtacgatgttacgtgcatacctgaggacaagagacttattacatgtgcaaatcacctctatattttgattctagtttgttctttctttgtttctatccactgcatcattcgtctatattttatatgttttctttgtagtatcatcgttataatatagtactccctccgttccataattcttgacgttttggccaaggtagaggtcaaacttttataactttgatcatcaataactttaaaaatataaagcttaaaggaaatagaacaacatatatagatttatctttcaaagtactataagaaaagtaaacatgcatttatttattgaatatattacaatagaaaaacaaagtcaaagatatattttgaaaaccatgtcattgtccaaaacatcaagaattatggaaccggagggagtactacgtttactcagtactatgttctcatgtgtgtgcctacgaggcatcctaattagcacccaacttaccaatagcagccagatatgccttttagcctaggttcgcacgcacaaaacaagtttgcgcatcaaaataagtgttttataagtttgtgtactcgcttaaaaaatgttcatgtaccaccaatgcaatttactctatacttcgagtagggtctacccctaatgtttcacctcaaaagaaaagataaaaaaatcaaagggaaaacatatcagagcataaaaggcagaaatggctatgacaaagcaaactaaccctttatgacgacatgatgccacagcttcgtgtagccatgaagagacaccaggaaagaacctcttaaaactttggattttctgtgcagcatcttctgggctgcattcaagttgttctgctagagagttggcacccattccatagaggatgccataaataaatcttttggtggtctctctttcctttgaacagatcaaggactccgctttaccagtccatcttgaagcaatcatagtaaatacatcaccatctggtttacttagaagttcaatcaatgcagtatctttagaaaaatgagccattaaacgcagctcgatctgtgagtaatcagctgttaccagcaaccaattctcctagcaaaaaggagaccacaaaattaccttacttgcgataggaaaatatatacagcatgaaacaattgttgagtgagcaatacttgggtgggaatgaaaaaatcacgaggattgatttcatgatgatcaaccattgacatgcttgtggaatcatgatcattcttcaatgttgtgaaatccaccaagtgctcaacacactacaaattatagttcagtcagttttttttctaaggaaaaaatgcagtcaatcattgctatgacctatgaatataatcatattatacaaaacactagcaataatgtaacataacctgcagatttggttcttccattgatagacggccagtggcagttgatgtctggagccaatttccttgtatgatgtatctttgtgatttgctgcacaactgagcccgtgagcaaatggaccccaaggtgccatttaacagttttgccaatgttctatgttccttaattacagatataattggatgttgatccctgaataaaaagagcataataatatgacactgtattaaaaatgaacaaaaccaaagcatctctaaatacatgtcaatccctgaataaacagagcaaaagactattagacggagtgatgatctaagttagaagttcaacaagagcaattctccacatttactgaaatcttattgttaccagtgcaaacactttccttgggaaacttgcaaaaaattacgtgagggttgagtgaagcatcaaaagaatatacagattacagcactacttgtaataaagtttccctggccaactcattggcatgttcaacaaattctgagccagcattgccatgacattctgaaaggcgtaagaattattttcttccttccctgaccctcactttactataattctttgaagcaccaagccaaacatgacatgcaactcttgaaacatactgtaatcagacataataataaaatgtgatggcaccccaataattccagcttagatcaagacaacaccgtaatgacatcttcaacatgcagaaactagaatggacacaaggatacttcaatccagacataatacaacatgaagacattatgtcagtgaaccattgttgagactagatatacaaggaaatacattttaaatttcaaaaatgcttgaatcatgaaaagtttgtgactggcacattgaaaggaaaaaaaaacacttgctaatataataaatttgcaatgcctagaaatgacacacacaacaaatagatcaaatttataccttagatggtccaaggactgcttgtcagtgctaggatgcaattttcctttcccacaaccttttggaactggcagttttaagtgtgtataaagaacnnnnnnnnnnnnnnnnnnnnnnnttagtgagaagctcttgccagctaatttataagcttctttctctagttctttcagctttcttattatgatatgcctcgcacggagacatgcatccatgtcagcaccaattccccaaagttccatatcagcaagaacatttacctgcccaacaaatataatgtgaatgtcaaagcatttgatgacaatattgcattttggcaagggtagaacgtaccaatgggccctcaattgtttcgagtaaatcattgagattttgagaaacaagtaatttcctcaaaacagaacacaatgcccgtgtctgtgcagcacgccgacagcaaccattatgagctgctttgtgcatctgatttctccatctgccatctcgatttgcagctgctgcagcttcattgtgtagtcgtctcttcactaactattaattaatatcaggtaaaaattacaaataaagtacattttctgaaatatctcagcatcaaaattaagaaatcttttctgtcaaaaaattaacaaatcattgggaaatgttaaggttgaaagagattgccatgaaaacatttaaagaggaaaccaagcatgagttctatatcacagcataagatattataccttctcaagatttggcactgttttactttcctcatcaggccagagaacccatgccaccaagcatatgtccaatccactgtggacagaaactggttgtaggaaaacatacaagttgtcgaggacttcaacattcttcaacattttgtagtcaagatgaagtctagagagccgttgacaagaaacacagggatacttcaatgcttgaatctggaactttaaattccaggtcatttttttgacactgttttgtcgcataatttcgattactctgttccatcttctcgttagttcgtcccacatttcaatggagtcattgctaccagccatcattaggtctttcggaaagttgcagtagtaaacaggtgaattttcccaacagacagccaaaccaagaatatcgaaataggttgaagatgatttaattgacttcttgacataatgaagatcaaaagaaaactcactaacagtagaccattgatcaagaaaactgtcaaaccctcctgggaaattatatgcattaacagggcctttgtcagccacatttctgctgcttaatttagtttctatggagaaaggtgatgctacttggacaacgatgttggcattattcactattcttgcactctctgttatttgtatggaagaaccagggtgcatatcgttccctaaagttctctctgtagaagccctttgagaaccataactgaagcagttatttgtatcatcactagcttgacctctgccaacagaaaccatgctatctcgagttgggggttcatcgatagttgggagtagaggtgtagtaaactgaggaacttgtacaccaagtgacttgaaagctgagaatgctgctactctagctgcttctgcctcctcaagaacaatttttcgagctccattttttatcttcttggcaatacccaattgcattcggcgtaaaccagaatcacctagtccattgaacagatattattacacaaggcaggaaaatcacaagaaataagccaataggatgaatctgaccccttgatactaaactgatccaaaatgttgaacaaaaagagaggaaaacaaaaatagaaaatagaaaggaatgccaatgtggactacacattacagccatctccaaaggaagagaagtcttgttctcaggttgttaagagtactaatttacgagtttgatggcttttgagctattactttcaccatttctctaatagtaaagctactgctaccaccaccaccaccaccatcattgcagcactactgtagtctcagaacctcagactaacacaacatacacaaatattttaatagaaagtttaaacatagctagagtattagaccttggccagaccaagtagaagattcaaaaagagcttttgcaatttcaggaatagatgcttcagcaatggcaacaggagtacgcaaaccagacttataaagagcccttgcacgtgaaccctgcatcccataacatattaacatataaaaataagtaggaagatatgatgggacaaaacttaggatttatcatgcatgcaaagtgacataagcaaaccttgacaaatggaattgatgtaagttccgcaatctctgctctgactccaaaacagactcggttttggaacttagcaacaaggccttctaaatcatgccaaccaagtctctgacaaaacacagaaaccattgaagcaaacctgccagcattttcctgtaaagcttgaatcatacctcttgcaactttgaatgcctcacaaacatctgtgacaggaatttcctgaaagatacaatacattaaatagcttcattaaatattcaatcatactatatttacaaataaaaaaagatccaaaaccaattagagtaatgcactttgctggcatggcagagatagatcgttaacatactactaggtttcaggaatagtaagcaaattgatgatacaatcttgcagagttgaattatacctgagcaagccttgacaacatcaaggccacataaagcgcttagaaacttgaagtgcctgctcattaaaaagtgcatttccaccagatccttgtgttggtcacctgttgcggataccagcacattgaggttttccatgaacaggcattgcagccccatgagccatgtgcatcaaaaatggttctattattcctacccggttgccaactgattgcacattaccaacaagcatcaatactatagataaaatagagtaagttctagcatagtgccatgaacttgtaaagtgggtgcatgagttcatggccttgtgatgcattacatgaatattatttgatttagtatcactaccattttacaataagagtaaaacaacatactgtttaatgccacctccttgacaacatcacttgatacattttaagttatctgatcatctcaatatgtcatcttagtgttcacctttttacttgggtaaagagaaaaatatatacatttttcacttgaaaaggatggttgcctgtcaggctataaggacaatatagacaatagcaagaatcagtctgtggtcctttactattgatatacacaaataggatatgaaaatattacatgtactcagactaattgttggagaaaaaacgttctaagatgcaacagaaatacctgctcaagagaagtaagttgcatgaacctctcatagtacaattcccaatcaggttcgacatctacatttatcggggttaccaggtaaaccaaatgcaaatcacatgccagaacaaagccttctcttgcccttgaaagatcatccagcacgacctacacagagaaatagaaaattgtaagattaaatttaaaaaatattgaaaataactaaagaaagtaacctaccaacgattcctcaggattaagtgaactgccaaaagctgctagcccaagtggagtagtagagtatattttagtttcattattccactcaagaaaccttttatggcataaccaacgaagggagtcctgagctgacttcacaacatcctcaaaaggtttagtagagttaagcagcgtacacctcacatatcgatggatatcacttgcagtttgcacaattccaccagcaacaacctccatgattgcatgagtcattccatttttatcttctgagaggcaagactccaagggagtacagttacttctaagaatacctgtaatcctcttgacctcttcaggcttgcatacaagtatctacatttcaaatatcaaagtattagacattcataaacaagaaaacatcagcacaaccagatacataaataaaaaattgaaactaagctgatgaattcatgggaaacatctagtataaatgaaagtttcatatcttacactctctccctttgtatctatgccagttctaccagcacgaccagacatttgcttgtaccgagttccatcaatgaagtcacgacctatcctaggttgcctaaatattactcgtctggcaggcaagttaacaccagcagctaaagttgaagtggcagccaaaactctgacaagacctttacggtaacatgtttccacaatctccctctcctcaacctgccaaaagagaaagccgtacttgtatgaaacagaaatgactacatattataagctcacgatcatcaatagctaggagaatagttgtcaaaatagacatcaagaaaagtacaatgcatacattcatgtttcctacagtcctactgaaagataaaggttgtcatgaagtaatggaatggttttagaaattagtaataaattcaaaacagcatctactaaaatgtagtaaaaaaaaggtcattcagctacgcagtgcagattctaaatgcttaggggcaacgacaatggcataaataaggtccaccaactcttcatggcatgatatgagaaattatagtaaaattacaataccgttaaaccagcatgatggtatgcaactccagagggaagggtctcttctaatacaggatctaacccagaagggctcctcttcaaggcttcaactgcaaatgtagcatctggaaattctgagccaacgtcacttgatccaacagaagccactttcaaaaacttggcaacatgtcttgcagttgattcacagcctttccggctggagcaaaacaaaagaacagaatgcccctgctgaacaacctgggaagcaaaacaaggtagatgtgtacacatatattttagatagtaaggaatcggttactggagactaaatagcgcaaagtatttacctcattgcacaactcaacaatatggtctggatccttaccgccaagatcagctacttttggaagcacgcgaacaacattcatatctttatcaaagacctgattaccgactttaataaattcctccagcggaacaggtcgaaattctgtttggtaaagtgcagcctaattatgcagcagaatatcagatacacatgaatcatccaattttagttttacgataaagtaaaatgccacttgaaacacaaaagactttgtcacactcagcctttcatattgaccaaaaagatcaagaattagcaaagcaacataatcaaggaagattataataaaaatgctgcagaatcaagtcaacaaccaaaacacaggtataaatccttacaaattaggttgtgcgtgttagaaattaaacggtctcttactcttaatatacatcggccggctattcgccggcccggcaaaaaaaaagaaattaaacggtcacaaaataaaaggaacaaatagactggataaaaatcaacaagacttaaacaaacagaaaacaatttctatcatgcattgagactcaagctggtatttgaaggtcagtttgcagatttcatataatagagtaaatttcagataactgcaactattttgtcaaaattatcaatttactgcaatttcagctagacatttcaaagtgtatgattttaccagaaagctgcaactttatttctcacaaagtttgagcctacctgtcatacgcacatgcaatacttatgatggtgtaagtcgggcccaaatgccatacacacataggaggtaaagttgttgttttgtgataaatcgttcactattgttgcagttttgtgaaatacccatgtaaaattgtaacaaagtgatagttttgacaaaataattgcaattttgtgaaattctcttagatatatttatagcaatattcatgacagttgttattgataaatatgcagtgttactgggactcgcaagtcccttttttttttcttttaccatgttgacacgcgtgcgtcaacgcatgttagacgtgggacggcacccatctgacagagtccaaaggaaagagaggagagttgcaggcttgcagctgctgataatagaggaacgaagttgcggtaagaggtaaagcaagtgaagagagagagtgtgtgcgtgcgcacaaagaagaggcggaaaggttgcagcttttccaggattgcaggaggctggagagagagcatgcagcctgcaccttttgaggtactgcttagaaaataaacaaagtaataaaaaaatagggtaagacttttatactctattcttattggtccaaaagccaaggctgaaaaatagaaaacaattaaactacaaaatcaattctgaaattaagttctaataaaattcaaattctggctgtggcctgtggcttataagccaatgagcatacaagcgaagcttccatgcacaacagacataggaaagggatcttatgtccacaatactccttggaacactggtattaaaagtattttaagtgtttgaccgactattttacatgttaatattttatattatataatatgtttataaaatatgtattatacgaatcttcgaatcctttttctccaaatttgctgaatcagatactcgaatccaagtcatactctaacacctatgtcaatgtcccgtaccactgtaaatatgtttgtcaaatactgttgaaagcctatagagcatgtctaatactgtttgtcaaatatagtaacactatagagcatcgcacagttccacattattttcagtgaaatacttgagcagtaaattcttcgtccttctgcagcataaaaatcagattggttgcatcagtcatttgtagtttagatgcctctaattaggcccttaagacataactgtcaaaatgatgcacacagtgtttgtccagccctccaccaccttgtggagacactacaaggaacctcaggacaggctaaattttatggttttctcggaaaaaaaaaaagctaattcagtagaatcctcactgtaatgcaatggttcccagcatcctttctacttgtacattcagcacagtacactatttcatttcagcataataatcaaaagtatggtggtgttatcattaaaaggaaaatcaactcacaaaaaatatacatgtgaaactttgaagttcagcaaatcagcatacataacttgttactacttactactgtatttcattagacagtttggttaaataatacattattcttgtcaaaatgatggtgaatgaccgtaagatattacactgcaagcatgtttatggtagataacagcatttcttaaaaaaacagataatagtatgaacaaaaattacagaagttctcttacttgaagccaatcagctacagctgcaacattgggcatagtagcactcataccaataatctgcaatccatgagttgcatccatcttcccactgctagaacctgagatttctccacttgatgattctgaattcccttcaccagctgcatacctnnnnnnnnnnnnnnnnnnnnnnnnnnnnnnnnn

SEQ ID NO: 42805 - DNA, 805 bp, Oryza sativa
agccttcctctaatagactctacaggggtgatgatggagtctcattcatgccatggagtggtttgctaataaattgtgaaactttggaaattcaagctgattatacgaggtatgactgttgaaatttgtttttagctcattggtcattctatatttgttaaatataaatatcaaagggcatagtatcaattactagttatcttttgtaatcctgaggcataaattgaccttaagacatctgcaaactgtttttttcctttactattcaatgaaacgccagaaaattatattggctaaatatttgtgaaaaattgacttggacgatgtgtttccttttagtctttatttctttttgggagactcaaaggttgttgaaatgttaaccttagatatgtgcagcctaataccaacctggtttctatccactttctgaatcttgctttcttagtgagcaagaaaccgtagttacatttttcttgttttaggcattaatgtttgaggagtgcgagaaataactttcctaaccaagtgtggagaaatagtaacgaatgggtgcttttcttaaacaggtatttagatatcaccattatctccaccatcactgttaagatgcattcttcaacaaagtatatccacagcaagctatgccattatatgcgtccaaaatgccatcccattttctatgactccaatatcaattcacctggtaccataagagtaaatatttatcaagccttcctgttatgtgcaatgaagttccactgttatattcgaagcgtttccgatgccaacgtaagcaaattag

SEQ ID NO: 42806 - DNA, 730 bp, Oryza sativa
tagcatttcttagagtagcgattagcaacatgcttttaatctacaatttgcacttaggcttccatcccaaatgtatgcactgttttattgaagcacctattgaagaatatcattaaaagatgggaaatcgatgataaatgttggttatagcgatttactttcttgagaaaattaggtatatacaaaatatcttccctctttagataccattgtaattgaaacagttaggttcactttaataacttcacaaatctcctccaagtaccttcccttgcctcctatcactcctcctaacgcataaaccaaccccttccccataaagagcaggctgacataatccccaagcaccttgacccaccctcccttcccacctgcttctctgctgagagcacacgccactgttgtccccaaggaagttctatcacaagcaaacaccttcctgttgatagagtgccagcactgcttggtcattttagcattctagggatatatgtggtattactaggaattagatgcaagcattacaacttcactaagcttgcacctcacttgtagagttcacacgatcaccgttacagcgcagtcatccagaaggacaccatgaggtgtgtatcgtggtagcacgtccagatttcgtctgataggtgctctctcaaatggtatcggcagtgttgtatttgtagatagtgtcatgcctcggcaaataggttccccattaaggccttgtttg

SEQ ID NO: 42807 - DNA, 732 bp, Oryza sativa
ccggcgcactctcaatttacaatggtcacaatgacatatgaagctcgactctggaacctgaaactatttgttgaacactactctagatgtgagtcagtcagagagatagttgttgtctggaacaaaggcaaccatcctaccagcgacgcctttgattcaacagtccctgtcagaatacgtgtggaagaaatcaactcccttaacaaccgatttaggggtgaccctttgataaagacaagggctgtcctggaactggatgatgatatcatgatgacttgcagtgatgtagagaaaggattcaaggtatggagagaacaccctgagaggatggtgggcttttaccctcgaatgatagacggtgatcctttgcagtacaggaatgagcgatatgctcggggcaagaagggctacaatttgatcctcacaggtgctgctttcatggacagtgagttcgctttcagtaaatactggagtcaagaagctaaggaaggcagagactatgtccacaagaacttcaactgcgaggacttgctcatgaattttctgtatgcaaatgcaagctcttcgaggactgtggagtatgttcaccctgcttgggctatcgacacttccaagctttcttcagttgctattagccgagacacgcagaagcactatgacatcagaacgaaatgcttggcgaagttcgcctccatatatggccctctcccccagaaatggctatttggcatg

SEQ ID NO: 42808 - DNA, 915 bp, Oryza sativa
gggagatcgctgatttgcgaatcggaaccagttatttttgcgcggcaaagccaattttgttggtccttcatacactacgcagcaaccaaaccaacactacaaatccctagtagagaagagagacgtactacatagatgaactagtattagacgaagttctggacttctggtttactaggaacatagaaaacatcagatggaggatgagttacaaacatgggagttaaaattgaaatgacacgtgcaggaggtcttgttgatgaatggcacaatcgaacttatttcttctttccgccggctccctttgttttcttgttagcgactgctttggttggtttttctgaagtgtcctgccattatatcatagaaacaaatcatgagacataatattgctacaaaaatataattatggccacaacatttgcaagcctacatatagtatagcactatggttgcagttttacatggaacagtacaagatctgcgagaaaatcatgccaaacaaggctataaccttctcatagtagaaggattttagcatggcttacaagattcagctttggctattgtatctgcctacttctggctgcttgcaaatatattgttgagtactggtctaatggacatatttttatcattcatctgtgatctgttatttggcaggtacattggacaatcaaaacatcaaaccacgtgattcaacattgttagttgaatggacagataaagtacgcaattcaatgacatgaattggttgtatatcatgctacaatggatgaacctggagaaggctaaaagttctaaatttaagcacgacaagattgatggcattcaggttaaggtacctttcttttcagaggcactgatgtgctaacaactggcttgaagaaggattcgagcctggtcacattaatt

SEQ ID NO: 42809 - DNA, 1544 bp, Oryza sativa
accccattgataccatggttcaagtacagtggataattgcagatatactgatcataacagaagtctccatgcattgtatacacaaaatactccctccgtcccataatataaaagattttaagtttttacttgcaacgtttgaccactcgtcttatttaattttttttaaaattattatttattttatttgtgacttattttattatctaccgtactttaagtataacttttcgttttttatatttgcaaaacaaatttgaataaaacgaatggtcaaacattgcaatcaaaaacttaaaatctcttatattgtgggacggagggagtacttcctatccagtcaatgtcgcccacttgacactttggcagcaagtgtgcctgagcatttcagcttttggattggtaatagtacatgatctgttccaacagcaaagcaaaaacaagcttcgtctttgcctgcacgggaaatgcattgcatcttaattagcaatagctcaaagaaagcaaccaccccagcacaaactacaagctcatggaataagccctcggaagggaaagggatttggcgcaaattaagcagcagcgcgaggaacagcagtacaaagccaagggaggccgcagtaacttttacaacagcactggtgctgaggagttgaggtatgtacaaagccactgtacacaccttcatacaccggaaaaatggggattgcagatagcaaggggtggaaccgcagctcacgatattcaccatgtcaagtgaacaagattgaaatcaggaagcctttctccggccggtgccgctaggacttctggggctcatttgcttatcctgtgccatcagagaactggtgccactagtcccatgatacatcaagcgacgaggagaatcatttctcatgctctggttctctgcctcaagttgtttagcctcctccattagcatagataactgttcacagaaccaagtagccattagtggcaactccctttaagagcagtgtaataagatgcaggctccactcacccgaagttcattttccttcagacgatcctgaagtacagttatagcagggctcaaactagaatagcagaatgcaagataagttagcagagggctgcacataaataaacatatcagccaattaacagacagagattgtgctactaaccaatattccattaatttgcagagagatgagttgtatgtagatgcatggtgaatagatgtaagtgggtggatcttcccatcactgcaaaagaaccatacaagatgtgcattttaccacataataaacacgtagtactatataaggcaaagtaagtaactttagttaccgaatattttgatgcatggcttgattatatgctgatttttcctcttcgaaaacgacatgttgcatatcacagtaagaagttaatgtggtgtccagctttagcagatgcctggtcggaaatacataaagtggcacctcctttcttacatattctgcaccactattggcaacacattctagttagaagttaatatatgattatattgcacc

SEQ ID NO: 42810 - DNA, 1426 bp, Oryza sativa
cagcagggctaattaaatgtcatgggtgccccaaactagaagtaaacatgatgtgcatatgaagtacaagaatcataccttttgagcatcttcgctaaaacaagagaatatcagacccacaaaacctggctccatcaactgaaacattgcctgggtccgaacatctgcagtatatgactcatgtaagtcagatataacaagcaaagtccagccctcactgcaaacgggcagcatctcataagagacaaataaagcataaaagcagatgcactagcgaattccctagatctacattgtcatcgtcaatttgtcctgatatggaccctctactgccttcgtactcagggaagtataagttggtgccataacggaaaaaatggagtaaacccacatgcctaaatatagcattcccaaatacaaaaaaagcatacattaccaccaacaaaaaggaaatgggctctagcataattaacattcgttttccaaacatcagataggataacgaaaggtttcacatcacttcaaattcaaaatggcattagtacaataacacaattgcaatcaaatttcaaaaccgtgcaaagttccatatcatctcacgacatcacaaatacggaatgcgacaaagtactgcacaccaagggggttatcagaaggcgctccagccttagtgaagcacagcaaattggaggtaacttgaaccacctacctacatgggaaggcagaacggtgatatgcgggtgcgagtggtaccatccaatcaccctcgttttctcgccgatggtggccgacaagctgtgcgaacagagttaagtccaactccaactcccgaaaccccaacattaggcttctcaacacaaaaccaaacacacaaaatcacagaaatggaggggaaaaaggatatctcggcctgcgccgtcgccgccgcgagcagctcggggttgacctccaccctgtccttcttccgctcgcacctcatctgcggcgacgccccccatatcagagcagtcaccccgcccctgctcgaatgctgcgaagcaggcaaaaaaccaccatgatctcaacaccagcaagcgccacgcattcgcgctggaggaggagcaggagaacggggagagaggagaagcaggtgaccttgatgtcgccgaagaggaggcccatgacctcctccgtctcggtggtgagggcgtgggagaggcaggtgagccacacctcctccccgatcctgacctccgtcagcgacatctcctccgcccgccggcctcctgccgccgccgccgccgccgatccggtggggtttcgggccgcggcggaggaggggttgggtttggtttggtttgcctcttcgatttggcttgtagcgctgcgcctctttgaagctcggttttttttttcccttttctttttctttctcgtgcgaaatggg

SEQ ID NO: 42811 - DNA, 834 bp, Oryza sativa
atatatatccagattcgtagtgttaggatgtgtcacatccgatattagattgattttttttaaaatggagagagcatagcctaccatggctgatggtaaaacatataacgaaactacccgaacttgactcgacagtgtgactgcaaggaccggacatatatgttcccgcccttcaggagcttgaagattattacgttgggttccacctctagatttccgtgtccaactttgactgtccgtcttatatgaaatttttttataatttgtattttcattgttgttagatgataaaacatgattaatattttatacgtgacttgtctttttaatttttttttataatttttttaaataagacggacggtcaaacgttggacacggaaaccatggtttgtctttttttgggacggagggagtaccctccaagcctccaagggctaagagtgtggtggcgactctggtcaatcctgttattttctaattaagattcggattttacatcgttttttatttgcatagttttttttaactactaaacggtgttacgtacgaaaactttctatatagaaattgttttaacatattaaatatgttaatttgttaagtttgtactccctccgtccaataatatagcaacctagtattggatgagacacttcatggcataatgaatctggaccgcaggagtgtctcgtacgttatattatgggacggagaaagtaataattaaagacttaattatatgttaaaattgttttcgttttcgagctcaaactccctccctgcgcgccggccacgagctcggcctccctgatgcgtcgccgcattcacacc

SEQ ID NO: 42812 - DNA, 1036 bp, Oryza sativa
cttatgtgttacggctcatcacagctgcatcttgcattatcaatttaactcagatagggcaaaacctgggttattaaaaagcaaatacctaaaatctaacttgcaattcattgtcaaatacctgaattttcagaaaaggttgtatcaactgctgctaaaactggtgttttaagtatcaaaatgttccatttgaaaatctgaaggttttcacagatcaggcacttcaacatatcaaaaaggcatgatgccagtataagacgctcagaagccaagtgtaacaagagtatttcatcaaagaaccaattgatcggttggccttcttatgtgttacggcttatcacagcagcagttagaattagcaatgtaacaaaaacagggaaaaaaagatggttctgaaaacgaaaaacaggaattctcacaaactaacttgcagttcattgacacctaactgtttttttaacagcaagttataccaacttctgtaaaaaacattgtatgagttttaattgttccgtatgaagatctcacagttccatcctaacgtctgaaccccacaaatgagagccacttcaacatatcaagacaatacaaaatgctcagaagccaagcgtaacaagagtatttcattgaagaaccaattgatcggttggcctccttatgtgttacggctcatcacagcagtaaataagaaaagagtaatgaagccaaaatataggatgctttatgttcatagcagtgcatttaaagcttctagcatcgcaaggcataacaaggacaagaagctatgcaaagaagtagtttcacgtgctaatacctggttcttgacagccttagccattttgcggaactccttgcgcatcacagactgtggtagagcttcgctggggcattctgcttcttggtcttggttgtggagaggaccacggccgcgtccttcacgcctgatggctggatcgtcacggtcttgttgttcgccaagccttacaaaacacatcatcacccaagtcagcactttgcatatgctgaatgaaatgct

SEQ ID NO: 42813 - DNA, 773 bp, Oryza sativa
  unsure (1)..(773): unsure at all n locations
cagcaccatgcctggagagccttcacatccatattaccccttgggatgacgagcattgtgatgaaatcatttggaaaccatccactttgcagcatgaaaagctgaaagagctggttgtagttggcttcgagggaacagagagacaggtttactttgttaactttgtgatggaagtatcaacggcattgcagcttgttgctctgtttagatatgggcgtgttgaagaaatggggcgttgggactggaaaatcgtgaggctccaacaccattggagtgatgaggagagatcccagattctgaaccagtttgcccatagagattcttgctccacaacttcagttcaagtagttctagagtgatctcttatattaatgtgttacctgtatacaaggctttaagttatactgcatgcattttgatcttacggagtcactgtttgtcttatgtttatgcgcattcataccgcttattagcaactaaactggtaaaacttttttataccgttttagcctagttttccctaagtaactgttcactgtattgtttgttctcttttcctcattaaaatgagacaccttcttctatatatanaacgtcgataacagcctgaccattaaaaaaaagacatttttatatatgttattagcgattcaaaagcaaatgttgtaaaataaaatatgatgaagaaaacccaaaagcaacttaaaaaattagttctaaaatttaaattttgacttttaagtataagcgaaaatatattgctcttaatttat

SEQ ID NO: 42814 - DNA, 1215 bp, Oryza sativa
  unsure (1)..(1215): unsure at all n locations
aactctacttgccttgagatcgatgggggcaaactgtttattcacgcaacaaacactacatatcgtgtccttacagacacgcaacatttaaaagattcagtgatcattgaagattttatgccggtttcgcctcttctggtgtctgcataaagcgtggaacttctccgttcatcaccctccatggcccccagtagaatttgggcggcatgagcggcacggcctcgcccggatgatcttcccagtacttctcctgctccaaaatgcggtcacaatcaggcaaaagcaactgtanattgaggtcaaattgccaatcctagttatttcaaaggtatattgcttgcattgttttgtacaacctgattcatataggacaatagggcgatctgattctatatatatatcaccaatcaaacctggccaaacttgcttgtagggtaaattgacagtcctaaactcctaatcagttcaacaaagtatgcaaccaaaatttgttgtgatccagctagctactactaccgagtacatgttaatcataccatacgggaacatatgctaaacagacctttgatcactgaagcatgcgaaattcatgtccaagtttcgagaccaaggggcctaagcattccgtcgagcaccttatgcgcggaagccccaccgagggcaaccacaaggagtgaagcagggaggggggaggaggagtggaggagcggtctgttcctagagtatcctgaccttgtaaagctgctcggtgatggcggaggcgacgacgccggtgtagaaggcggcgacgtaggtgccgatgagtggcgcgaacgagcgcggcgggcggtacggctccaccatgtcccagagcaccgtcttctcccacctgttgaattgccggtccgcgtaccacctccacaaccgcctcgccatccctctctcccctcgccgccgccgccgctcgccttcgcctccgcctccgtccccttgccgccgcaagcctctgcaacgccgccaccggcaaagaacagcgccaccgctcagcacgtcaccggattaggctttcaattgggcccaaatgagactgcagatcacgtgggcccgcacgttgcgttgcagtccaatttcagcccgacccggcccgtactcgaggccaacttagacccgttctacccagcccagccttagcccagacgggcccgagaacgggaagtgaaaacgcaaaggcggggg

SEQ ID NO: 42815 - DNA, 804 bp, Oryza sativa
tatcaacctccaaatgttccaatcacatctttgcttccaacgcaaccaaccatcatccaggcaggctccaccagatgacctttttaatttaccttcaccgtttaggtagtatgcaactttggaacgatctcttcagattagccatcttgagcttgtacgttatagaaaaaaccgtttttctgatggtgatttggtgacgcagatattctcgtggagtgacgagaggatgggactcactgatggagcagcgcagatcaggggttcagagtgacacacttgcacacacatttacatttttcctagagatggcaattgtgctacagaagttttcgtgtacagcgtttttatggattcagagtgacacgctggtggagcacacgacttggtgatttgagtccgattacagtcggcctggaacggcactgtgatgttaccttcagcccattctagttgggccagaaaggaagtacttaaatgtggccccattatacttgggcctgggagggaatacgagtagggatggcaatgggggggctacacctacaaggctacacccgtcggattttgctatcctgtcccgtccccgtagtagaaaaaaaatcccgtccccattcccatccccgcacgcgggggagtgttttcccctcccccgttcccgcccccgtgcgggtatggggcaccgtcgggtgcccacacccgacaatatctcaatagatttggtagcagcaaagcaagacaagaaatagccaaacaccagtgaataagcaccaaatcttaccgtaatccaagtatccaggctatcaa

SEQ ID NO: 42816 - DNA, 1913 bp, Oryza sativa
ttcgtttcttttattatttttttgaaacctttcattttgaaaacaaatatctaaaataaaaatttccaaaatctgaacatttgacgtggcaaaataatactatcacgccactcgcaaaggacgtggcgattttattctgccacaccagctaaaatgacgtggcttgtagagtgatgtcaataacgttgtcacgccatttaaaccgatgtgatcgcgttgttttagtaaaaagatacaaatctagaaaatactacctccgtcttatagtagttatcgttttgattttttccttacaacgtttgatcattcgttttatttgaaaaatgtgtacaaatataaaaaggataagtaatacttaaataataaagtaagtcataaataaaataaataataattttatttttttaataagacgaatgattaaattttttaaacaaaaaactcaaagcagacaagtagtaagtattaagagttaaaaaaagttctgaaaataaaagaattcactttcctcttctctccggataacggcatgcgtggcactgtaccacactaaccccccctggaccatccgctcctgggtcgctgaaacgatggcacgtctgcgccggtgtcgcttgcgcaaccagaattaattgcctcctcctcctcctagcgacaaagtgaggggtggccaagttactatcaggtgagtgacactaacaaccccagctgcggtaagaaacaaaaacatgcttcaacatatttagagagaaaccgagagtgcatgcttaaaaggagataattaacccctttttttctctaaacaaacatgcttcagcatatgtagagatagaccgagagagcctgcttgaatggaggtaattaacttcttttttttcttttgccatttcgaaagggtgagtggcaacaaatatcactttgtaacaagagaggcaaatagttttaaaaaatatttttgacaaaggcaaatagttaaatttgctgcttaaaaggcagttgtacgattataagccatagacatgtgatcgaagtagcggaaggggacaaaatttacgcttataaaccgaagatagtttgtttaagacatcgattaaacatttttatacttgatgatattttttaataccgattgtaaagcacttggttttcataaaaccgctagaagcagtttatgaaaaaccaaacggttttagctattcttcttcttactgaattaaccgaaagtcgttggttttacgggctgctttcgatgcttttctgtaaaccaacatagactggttttgacatcagaaaatagtgctctcactgatgtaaaacgtggattttggtagatgtgcggtttaatgtggtggtcggtttcggcatagctttcaccacgtccctctcactctcttgtgcagtgaccaaccagggagtggtacagttgcagctgctgctgctctgcacaatctcgtcgtgttcgaattcttttctttaatccttttctctcgtccttttaatttcaggacgccacgtattggtcgctgatgctggtacaaatgaccaaatcgtagggtttttttgaaaagcaaatgaggagaggattattgtaattgatcacgtcgttagtcaaaaggacactaaataaagaagccaatcaaggacgatcgctgcaccaaacctaaaatgtttacccggtgattgtgatgagagcgaccaatcggcgagagttatggcaattgtttgagcaatcagacgatcggcaatggcatgtcatgtgatctttacggaagatgataaacgttgcatcattctcattgtccccaagctagcattcataattgatatatattcaaacataagaaactgtcaccatctccaattagaactgcagctctttattatactactacacagcatttagggataaaaag

SEQ ID NO: 42817 - DNA, 716 bp, Oryza sativa
aaaaaaatggactagtagattgagtagagactcgtggcatgcaactgtcggaggcggcaacccacgtaccggcggccaagcttccggaccctcgcgcggcggttgcggccggggccggccggagagacgtaccggagacgcgtcgcggagacggagcccccaccgtctctaaatgccgccgcccttttggtactttgatgctgcagacgtacgactcccaattcaattctcatgctgtttccatttaattttcgtatacagattgccagggattctgattaattaagtttgtggtgatcttaattagccccccgccctgctactgctagatgttcctttcaaatacagagaaaaagtcgcctagtagatgcgaatgtgatggaattttgccggaactgaatttaattatgagttggtacgcttgagggggggatgatgatcaaatgctgtaaacactgtacttaattttgcatgttgagtggtgctgtcgagtgtaaactgtatggttgctgtgctatgctgcaatggacaagagcagtaggatgtgtcttgtgaccacagttggtacgtagtacgtgatcctttttttctgatgatatgcatggctgcaaactgagactctgacaaaagagataaaactgcgcatatgtttggagtaatgtgctatatatgtaagcgttatgctgctaattaagctcgtgtgaaggcacaccaaa

SEQ ID NO: 42818 - DNA, 2117 bp, Oryza sativa
catcggtgtatttgagaacatccgctttctgcaataggaaaaaacaagcaaaaactgagtaagcatcaatgcaggatatgaaggatgtacccaacacaatatacttcttaccttgttgtattttgcaaagtgatagtcaccagtgggtggagcaccatttacaactctaacctgaaagatcaaaagggtgactttctgagtttttttttctaagatatgtatgccatactacaaattcatgagaaacagacccaatggtaaagttgaaggttgtcagtccgtgcagaggacgtgaaaggtagccactgccatgctatctgcagaagtacttcaaatggtcagatttagtacaagctccatcaaaatgggagcacgaaacaccttgctgcaattacccatatgactcaatggacatgaatatgtgaggtggattcaatctgcttatttgggttgaccaccaatttcaaaacagaagttgcacatgatcaaatcatcatttcatttgtcccatattaatcccatgagcaccttacccttaatgcctaattcctaataggtattaagtatacgagtagctaaactctcagctcagttcatgtgcttctactagagttatcaaattttcagcacatatcagctcaccttctccttctcaacagctggtcgccgcttcaggtgcgaagcctcgatggtcggcatgagtggagccatccccacccctccagtgagcgcgtacacctggatcatcaacaaccatcagcacttcagcagcaacgagaaacgcggggtcgaagtgtgcgggaggatggcggattaggccgcgccgtacctcgcgcgagacgccatcgggcttccgctgcggctccttgggcgcgcggggcttcttctcctggacggacgggaaggcggtcttggggaggccgaggatgtccttcgcgtccattgccgccggacggaggaggcggacctagggttagggttttggtctagtgcgccatgggagagagatcgaggtaggccgaagccgccgcctgcgtctgcgttgcgtcgagctgagctctacctcaacttggcctcgcgagagagatggattggagaagggaaagcctgagattgtatgggcctagtcatattgggccggcccaacttcttatggcctttgctagaccgagtccgagtccgacttcttggcacggtagctttttttatttcctctttcccgtgtctcacggcgaaccagcgaggccgaggcgcggagctgagcggaggaggagacgcgccacccctcacggcgctccggcgaatcggcggtgaacaccggcggtaatgcccccctccccttctccctcttgtagactgcgtcttccggccgcttggggtgggtaggattctgcttgtttgctctcgatcgttgggcgtggaagctggggtttgaatcggcggcgaacaccggcggtaattccccctccccttctctctctggtagacgcaccttctctctctggtaggctgcgtcttccggccgcttggggatgagattctgtttgcttctagcatcgtctcgatcgttgcctcgttgggaaactgcccttcgggtgaagggcatttaggtaattcacattagtactaaactttcaatggaaatataaggatgagtttttttttataagatagagggaatatgccatatctcataataacttattttgggagacagagggaacttgcatattaccctctcaaatatagtagtaattatttttgggacggagacgataaaaatatattctttgtgcgtcgagaatctcccccatcctctctgcgtaaaaaaaaaaattcttcccgtattgtctcgcctgtgccgatcgagcaggaaaatttgataatttaacacttttttcattgtccaattgttttagttgacacttgtgagaatgacatgtgggatcatctgagtgaatgaaagtgggacaggatttcaaataatcaaaacccattttaaggagtgttaaattatcaaatctctcatcgagcatagtgcaggggagaagccagggaagagggaggtgacgtcgtcctggtgagcatccacagctgggtcctggtcttttctccaa

SEQ ID NO: 42819 - DNA, 730 bp, Oryza sativa
aaaaatactgcacttatgatttctcgaactttagcaatggcttatgtcatggaccaggtagtttgttcatgaccattagataatttttattcaaaataaaatcattcattaactgtttttgactggaatcattaactgttgccagccaatgcctataacctttcttgtagacacatattattttggaatttgggaaaacatgcaattaggaatgcagttttgaggcatcccctttgatatacagcaggcatatgtgaaatatttcctgatgttttattcataaaacatgggcatgtgtaacagatatgctcttgataaactgaagaaaatattccataactgaattcctcgcctgctctagtttacattgctagttatatattttggttattcacataagtgcattcctcgcagaaagcatatttgcttcagcaagcttcctggcaaaacaatattagaatgagtggcttagtagaacaggcaagtttttaacttcaaagtaccaactgaaaaacatcatagtattcatcttacaagaatccctttggcagattcgaggacccctcgctaatataagagctcttgcaaagatgttatcagttcatacaaagagaaatgaggtatgtggatcaattctcattaagctgttcattgtttttcactttgtttaaatgaatcttgaagttgtcttggacgctttcctggttgggtatcctaatttgattttttg

SEQ ID NO: 42820 - DNA, 936 bp, Oryza sativa
gggagatgatgaagtcgatcgttgcggatcagtctcatggaaccaagaacgtcctctgcaatggtttgcacgaggtaaagttaaaaagtgtataccatgagttgacacttcttattgcatccattatccgtcattctacctgtggtggtggcccttttcatacaaaatgggttactgggattcccgcagactgagatcccgttgaagtgctgccatgccagtatacatggtatggttgttactagtgaaagaataattttcagttaaaacactgtaaaattatcctaacttaatttgttggatatccttgtctccttggtgttggtggtgtgaggcatctctacgagcatgttcaatcttgttggtcaaaaggggtcatttctggcaatgagtgaaaaatgatgagataataaacaaagttcacacttaaactaccaattttattacctgaaccagccatttatagaatcagatcattagatgtggtagttagtaactagccagtaagcattgaaataaaccaattattccattgaaatactgataaactaccatttatttggctcaacgacaactatttggaaaaataggatgtttggattctgttggggctattaacaatgtcgtttaagatgtgctaaagttagctaatattgaataaaggtaaggacgtagggttttgtgaatacttggtcttcggtgccaatgacattggcgcctatcccccttcacataagtggcttatcttccacggggaggctaggggtacggtgccaatgtcattggcgccctcatgttggaccataacaccaatgacgttagccccacaagaaaggtccattcccggaataaattctactggggtctatccgtcaagtaagttttcaaaaaggaccaaaaaggaattacaggcttataatcgttgataaccactca

SEQ ID NO: 42821 - DNA, 2904 bp, Oryza sativa
ttggtaagatgacttttgagacggcaaccaagtttattgtggaagcagcttctcatggagagtctgacacactggacggcccttcggcaagcgtctgtctggggaaacctgttaaggtggggacgggttcctttggcttgctgcagaatttttccctggagcaacctgttgcgatgtaagcatacatgtagcatcatcagcctgtttgctttactggattagtccaattttgatggaggctgccatagagcagtaggaatgtgttacatatacggtactttttgctagcaagtgcagcaagttatgtcagttctcagttgtgtttgtgtagcaggaaacgaacatgtgaacactgatactccctttggtagtagtatggacattagtctctgtgtagactgtgtggagtatcaggctggcagcagcagtagcagcatgatcttggtttctttgccattttagatgcatttcagcacccttgttttttctgcctttaaacccaaatccgatagccactttgccgttgctgtctgcatgaggttaagatggcagctgagggggaatatatctaggactccagctgcaatatcttttctataattgagtgtgcaagacagcatcctctgattcagggcctgtttagatccctggcaaaaaattttaccctgttatatcgaatgtttagacatatgtatagagtattaaatatatggaaaaaaactaattacacagattatgtataaattgcgagacgaatctttagtgtcccgcccagcggatccctcgatgcgacacgttgcgggctttctgtcctggcccatcccactttgggcttcacggaagctcccgctgccgatcacaatttcgttctctctaataaaaaaagcagaccacgagcatcgcaaatacacccgtttatcaattaatgctagctgctgcattgcttgcatcgcaaattcgcatagatggacggatgctgcattgcttgcatgggggtgaaaacgctaggaaacggtcgaaatttacgatacccaaaaagggtaatggtcagaaacaacggtactccttatacaaaaatgatgctcaggcgatcgagttcatcgcatatatccttccggactatcctttaaaaaacatccatctctatagtgaagaaaaaaataacttttatacatgtgttctacatacatatgagtagatggatctccttcttctcccttgtggttctctatctctgctctctttatggctgacgagctgtgccttttataggcggtagcggcgtatgcgagacccagcgccgccagcctctatacggttgcgtgatccgatatctccgcacagccgcgcgcgatggatatatactatccggcagtttgtttggatggatagagcttgaccgtgcttatcttctgatcggtttgttgcttcgatcaacttgtagatgggcatagccgcgtacacgtacgcactttttgaagtagttggtggtgcgtcaggatgccatcgacgttggtgatgaaagatggggtcgatgcaaccgttgaccttagtgaagtagacaaactcgtgccgggatgccgtcggcgccgtagtaggatgagggcgccaagttgccctcgatcttgccggagtagatgatgtcatgtcgagaagccatcgacaatgtagagggacggtgggattggtgtagacctagtttggatagagcaggtgatgaagtgccagaaaaccgtcggcgatgtagatgggagacaggttggttctgctgaagtaaatgatgacatgccgaaatgtcgtcagcgatgtaaatggaagacttggtgatgcggcctccaatctggttgaagtagatgatgtcatgccggaatgacgtcgacagtgtaaattgggtatgggtggcattgcccccaatcacgttgaagcagatgatgaagtgtcgtgaagccattgatggtgtagacggaaaatgggtaggtgttactccctgtctttatgaggtaggtgacgtcacgtcaggatgtcgtcagtgttgtagacggaatattgggtggcgttgcccctaattttgtaagtgagtgctggtaagccattagcagtatagatgaaagatgtgattaatgttgcttcccgtcttgatgaggttggcaatatcatgccaaggtgcgtcggtgttgtagtacaacatgaatatggactattcggatttggagacagaggaattgaagtactaaattcacatggattggatgcgccaaccgttgtcgttcggttactgcagagcgagtaccctcgacgtcacacacacacacggcgacggacagcgacggcacggcgcgtaccgcccggtcggcagcggcgacggcggggcagagcgcggtggctgtcacggccggccggccatggacgcaacgcacgagatccgacagctatcatcagctgagctgagctagctagcctgtctgcaccaatgcacatgcaatcatatctcacccggccctggatcgttcgatcacattctccgattcgcaattttgcaatgaattaattgataatggatttcacgaacgtgcaaaagcaaaaggattgcacgtcaatatattagaagaaaaaaagttatagttacacaacgcaatcagctagaccgaccaatttatgctagagaagggaaaaagcttagaaaattacgacggctaaacataaactctaagtaatgggaagaataatcgataatggatggatataggtgtgaggatacgtacgggctggcgatcgatgcattatgccatcctttgctgctgctgatgctggcatgactccactgttgttcgccatgagaaagatctgtccttttgctaagtactaccacaactccatcgtatcattcaccagcaagggctgcag

SEQ ID NO: 42822 - DNA, 2120 bp, Oryza sativa
tatacatatatgtatgtacaccgatcatgttatacatcgatcgagtacaattaattaatattccgttaaatttgccgctttgctggccctctgcatgcagattcttctccagatcgatcgatggagactgtgtggaattaatctgacgcaagtaaatgcttccacctgccgcgatctaattaataaactaaaaaatatatatacatatatcatcgatcgtcgtcgttttgttcgtacccacaactgcaaatatagcaagcaaagcacatgcatgatcgatcaagcatccaagcctctctcacatgctcgtcagatcatatatactgtgccctgagatcgatattgacagagagagaaacccaattataatcaagaacaaagactgatatattactgtgcattaatcgtactagcagctagtgtatgtgttcaattcgatttcgccgtcgccgacggcgatcaaggcgatcgaatcgatcgatcgaacgaccccaccaacacataaccacgcatcctgttcatccacagtccttgcattacatcgcattgcattatgcatggtagctgcatccactatactcatcatcatcattccgctccatcgcgtgcgtgtgtgtacgtacgtgcagctacctagctagattaattatctcgatatggatgcagatttgcagagcgagaggcaagagggcaaacagtctctagtctctacacctgcataagctcaggaagagagtaattgtgctgtccccggctggtcgatcgatcgacgacgacgacgcagctagcagaagaagtactgtaccttgctgtgttggcgtctgaattcgatctgatcgatcgaggtgaagagtgatcagggctaattgcgagctaggcgatttattctgggatatggtgatagatatgcagaaattaattgaagattcagacacggagccgtatgtatatatcgatatcaacagtttcctcgatctgatgctgcgtggctgcactacctgcatattgcatcattgcatggatgcatatataatgatgagtttatgaccggctggtccggttgggttttcgatctaggtcatatcgatcgatctctgtgggtcatggtgtctacccagatgcatgctctgcatgcaggtggccacttttgagagatgcaggagattgttgactacaaccttttccattttcagtctggaattttgttgctgttaaaattaattttctccaagattcttgctccgacgaacttcagcttacgagtcgcactcggtttaacgtagttcttgttttgacgtactgtaccccccaccttccagtaaccgcgcacttcagcaggttgctgatgtatgctacttcctccattccaaaatataataatttttagcctttaggatttatctcaaaatatagcaattttttcatcaagattctattcccaaccaattacaaccctagctttaccattcaattttcctaactacctccacttatcatccaatcataacctttcttatttaattctatcaactttcttaataactgtgttcaaccctaaaaatccttataatctaggacggaggtagtactttaattttctcgtacaagacttttaagcttccaaagaaaaaaaattcttgctccggtgaactccaccgagctagtcaattaaattcccctctactttgcgggcaacaatgttatactcctccgttttatattataagtcgtttgattttttgttagttattttttaagtttaagcatgttcgtagaaaaatatactaatattttcaacataaaataaaaatattattaaaatatatttaatgctaaatttaatgaaactaatttagtgttgtacttgatgttgctaaatttttctataaatttgatcaaacctaaagaactagctaggtggcctgcgcaattgcgcggctagcacccaaacaaaatcatatattttttagtatgatttttacttaaaatttattaaatagttatctcattgtcttaagactttgaaagacgaaaccttatcatcctcatgtttctaattatatagtttttaaaagtcacaccaattgctaccccttatgtcatctcctgggctgcaggaa

SEQ ID NO: 42823 - DNA, 722 bp, Oryza sativa
atcatccataataatagatatctttttaccaaactgaccagatctacgagttgaagagagcacagacccatatacaagctgattatattcctcacggcttagaaaaggtgtgtccagctttgtcaggagtacagcaccaataatgtggtcctacaaaaaggtggaatataacgagcttataatataaaaataaccgttacagcattaataaaaatagtgtgatttttaatatattactgacaggatgagttcactgatttaaatagatagatgcacaggaaaggggaagcctgattatacaccactgaatgtgctcaacagcaacagtgtggaagaaccgaaacatcccaactgcatatgcacagtgttacctgaatgaggcctctgacagcatccccactccttggaccaatgtactgcttatttgcatcaacaatgttgatggcctcagcacgagatatttcatcttgtggaaagtgcacattcatttcatctccatcaaaatcagcattgtatgtgctaaaaagaaatacagtgtttgatcaacagaagtagacaaataggcagtgttgctgaagatatgttgtaatacctgcaattagcatagtgcattcgaattgtcttctctccaggtagcacacgaacaacatgtgccatcatgctgggcttgtgaagagtaggcttcacatcacaagaaaaatgaaattagagacattgcagag

SEQ ID NO: 42824 - DNA, 2103 bp, Oryza sativa
ttcctgcagccctttgagaaaggacgtgctcagtagtgtggaacaaaaacttgcataaggtactgcattgatgaaggcttcctttaaactcaaacagatagcagtattataacctctgtagtcaagagatgtttctttcctgatgatgccaccatttctttgattgtatcatcagaaatgcgtcttgtttcattggttgatcttctggacaaagtaccaggtgaagttagttcttcatcaagaccggaaacaccagtttctcttgagtcattaacatgaccatctccactcagtttagcattggcaatcgcatttgctcttacagaggaagaagttgtatcctacaaaccacatgtagtgaatagtgaagaactataatgcaacagacatatcagttccaagaagtataagatatcatcaaggaaaaagcgaaattgctaatgctgctgacggatgctaaatcatgccatgcaaaggtacacgacctcggcaaagagcatgcctacttactcaaccaacctgacctacccataaatataccgtaaaaaattgcaaacacaccggtcactctgtcagtaccatttgacctagtgtagtgcaataaaataaggggaaatcactttgctttttctaatgcatactatgaattttatattcatttagttgataaacaggttcccacagagtggcatccacccccccccccctacccatagcttaccctcccctttccagagggtgaatggaaaagagaaggataagcttaatgcaaggaaagagatgttataaaaccttaccaaaaaaaggctaaaatcgactgagaagcaatttttaaatatatatatatatatatatatatatataaagagtactggtggacagtacaaaatcgcaacctataccaaactttatctctgttgtttactctaatatgccactgaatctaatcataaaatattgtgtggaattataacatactacaacatccaaaatttgctagattatatttgatgttcatatttacaccaccgggtgataacatgggccaattgcatttctgccactatggtttaacggcaccgttctatcactcctgttaggctaattgctgtcatgccactagattggaattttgttgggatacttcccacccatcattaaaaaggaattacacccccccccaaaaaaaaaaaatccttttacagaagtgcctctacattgcactgcctgagaagcgtgtatcgtaaggctgacgtcaaccagcaccctatccatggtttaggaagacacgtgttcatctttaaaaaatcaatgtaacctgtgggttagatggtactgcctaaaagatttaagccattaaaatcatcacgggtaccttgatcaaccaaccatatataggatttttgataattggattctttttttcacaatgtgcacatttcttctgtcttttcttcattagctttgagaaaatcgaaagagcctccttcagttggatcgatgtccaagttttattctccctctccgaacgagccgatttatcacctgaagtggcctcagtttcatcatcttctttcgaaagtactttgccacccaagtcttccaaatttttagcatgagcaatatcacctcttactaatagttcaagctcatttgtgtatctgtctgcctaataaagtaaacagaaaatcaaatattttagtgatgcgacagaaccttgaatgctccaagataaagaaaattgaaaaacaaaataaataagatgaacatgggcacacctgttccttgttcaaccggaacttgtgacaatggaagcacgtaacctggagaaggtttttaagactcataaaaagcaatggattaaatagtggtttcgccaattcgatatggccaaaatggccggggcagcgaatggactgctgaccacaactcttgcagctgtacataaaatttagacatggtcaaaaactgaaaattctaattttcccaaaaaaaaaagatacatgcaaaaagaaacttcaagggttgcatcaaatatacccccgagttaaagtaaatgaaaacaaaaatagtccctcaaaacatgtagcattatagattcaa

SEQ ID NO: 42825 - DNA, 7208 bp, Oryza sativa
tgtcagtatcattcgtgggtcccattgctgggtcaagtaatccacctggcacaggacagttcttggcatcgacacgatccgactttgttatctgtttaacactgatcctcttaatttcatcatcattgtagaagctgaagtgatagaattcacttcctctgatgcggcctgcgcaagaagcaaaaccatttaacagcagaccgtaaatgatcacctaggaataaggctcaaactgcaatatacatatgtacactaaaagtccaattagaatcatgcgatttatcccccactaactcgaaaccaaaagaaaaaaaataagacagtcagtgaaaagtgacaagacacaaataggccatgcttttcctgaaaacctttcaggactgaagcgccccaaccttaatcgtaagcatatcggtacgcgttctaacacaccaaaacaagcgcaacgagatgaaatttctagcactgagaagcaaagggaatatatgctacgacttgcaaaatcactgggaatgatccggcaaccaaacctcgtcgggccgcacgtcggccatcctcgagctcgcgagcgcgcgctctgcccagaaacaagtggggggaggtggcggcgggcgaggagaggaggcggcggccgccccccgcgcggcggaggcgagaggggggaggaggaggtggggattcgccggccttgggccaccgccgcgcagtgtggagggagaagggaggaggaggggtttcaagcggcgctagggtttaaggttgagaagcaagagagtcgacttgcccggcggcgtgtttctcgggctgtagccccacgagtccgctcgattggatcgcttgtgcttttgggccgggccagatttctacgtagagagccgaaatactcctggaacaaagtataatttacgtccctcaggtatagcccgagtttgatttgcatcctttaaccccaaaatcagatatggagcatcctccaatttctaaaaccgacttccttgatggttttagaagcttttttaattgacgtggtgtttcgactgcgctgagttatcatgtggctgaccccacccttgctaaggcccagttgtcaacctcgtggatctagggggaagtggatgatagagaccatatccaaaagcaggcagcggcccatgtttgtgtcggctccaggggtgtcatagtcgtagaggacgacaacggtgagcaatagcgcaggggcaggaagccacgccacggcatacgcctcgaacttgtgcctcttgacttcatcgttgccatcaccgaagttgtccttgccactagggtgaaaagcctcggcctcttctcagcgaggcacgagcagcgacgagctcctcctccgagctgggccatgacgcgatgcttatcttgcccgagcgcgacgatctcctgattttgacgacaacatgcctcccagtgagctactttgacggcacctacttgaagaattgccacctctcccctgatcaccagagccatttcaactaagccctccgtggtgttaaaaaaaaaaaactaagccctccgtgaccggggaatagaagttcttctttgaatgccttcggcgaaatggcccaacctactgccttgtttagatggggaaaatttttgggtttagtcatcacatcggataaacggacacacatttgaagtattaaacgtacatagtctaatacaaaacagattacagattacgccaggaaactgcgagacgaatttattaagccgaattaatctgttattagcagatgttactgtagcaccacattgtccaatcatgacgcaattaggcttaaaagattcatctcgcaatttacacgcagtctgtataattgtttttttatacattcaatactccatgcatatgtctaaacttttgatgtgacgacgtgaacttttttttttatgaactaaacagggtaggggtgggcattcggtctaaccgaaaatttcggtctcagtcttcggtctttcggtctttgaaaagtgaagaccgaatttcagtgaaaaaatgtcaagactgacaaattcggtctcggtcgtctcggtcttgaccgaaactcaacaacattttcatatatgcaaaaaaataatggaaattttcaatacaaaaatcacaaaaaaattcgtaagcacttatgagtaaagactcttattaggttgcatgcctagaagaagtagggatgtgaaaattagagtttaatcctattaaacatagtggattgtaagttgtatttagacattttttgataattcggtctattcggttacccaaggagactaaccgaattgaccgaacaaaattcggtctttcactacgtaggaccgaatttctcgatctcgatctttttggttcggtctttttctgcccacccctatgcctacgaatgctcccagtagtttagttgaacctccgctccgccgggcgtgcccgtgcattagcgaagacaagacaggagtggcaacgcatgcgcgcaagcgattcgtccagagtatcagtttcaaccccaagcccaaaaaggttatgctgcgccgctcagggacttgagcggcagggctgtcagggagagagacgtgacgagaagcccggctccgcctgcttttcctgccgggttccggtgtgacataggcgcacgtccggccaggctatcctcctcacagtggcaacaaaaacagcctcagaatcccctcaggcctcaacaattagtatgatttaggatgtgcttggttaggttttttaacctgcttttacttttgtaaaagctaaaagccaactaaagagttcaaaagtcacagctattttgctcaaagccagcttttagtgtagtacaaataaaaagtacctctacccctactttcacccgcttttgagagaaaaaattacccacctctgccattatgaaaaaacggttcgacattctattcctatctcctctcgcttcgtcacacgcgcccgacgcggggatggagcggcgcatctgccctccggccagccagcggccgccgtcccctcccaacgcctaccgccgctctccccgcccgacgccggccgccgccctccctgccctccccgcctgacactggtcgccgccctccccgcccgacgctgcgtcgcctcgatgagctgccaccaccgtcgctcctcctcctcgccaagacgccgccgctcctcctctcgtccccgccggcccactccgccccctccccgctcgacggtggcgccgccccttctcctccccgtctgacgacgccccttctcctcctggcaaggtagcaacatcccggcaaagcggcgcgcgtgtcctcctcgccgagctgacgagccgccgccgccgctcctcctcgccgagccgccgcgcgtctgcctccccgccgcacgtcctccttgccgccccgccgcgcgtcctcctcgccgccgcgtctgcctccccgccgcacgtcctgctcgctgcgcgtcctcgccgccccgccgcgcgtcctcctcgccgaactgccgccgccgctcctctttgccatggccatctcccttttcttttttttttcacgtgtgtatgacatgttgggcccgcttgtcagcgggactagttatatcaaaagccacagctgttgaaccaaacgagctttttcaaaagttacagcccatattccaccgctacttttcaaaaagtcacagcacacagctacttttttaaaagccacagcccaaccaaacacacccttataaacttacgttttttagctcgaccgccttgtgttttgctagcaactcgagcaaatgcagagggaataagagaaattatctgtctcaagatggtagtagtatgttgcaacagaattcagccgaacttcttataaactgatctgttcgatttgtaatctatgaacatttttcagttgtttccatatcgacagttctctattcagtttcttcaagttttgatgaactcgataaattcatgcatatacagaatattttgtccctcggtgtggaataggattcactcgcattgatcattaatttgatccatatctttgacgattagaccttactgagtagctgaagatacgtatgggatatttgagaaaatgatatttgacacataaaactcagtagagaacacttgaacctgaaaaaaaaatcctctttgacatgataagactacagggaaatctagccaaatagtatttgtgtagattccagtattccacatatactaaacgaagaaaaatcttcccaggaagtgtggttaccatacatgttgttttcatctcgtccataattatctgaggccaatcactatttttcccccttcctcgtttttattgagaatcatatcactccacttggttagtgcaatcttttcttgttactatttatgatttttttctttttttttgtgggggtggatgctcactttgtgacaccacttgatacattgtggtcggaaatgctgtttggcgatcgatcccctcccccctccctccctccacggctccacccctccacctggtttccttttttggcactgcattacttttctattttagtaaatttatatacctaaaatttatacacctcaagtttacacatctaaaccaaaagtttatatatccgattcaaatttgaatttgaatttaaatattttgtatatatagtatttctatacatctaaagtttatagatctaaagtttataagtcaaaagtttatatacccatttcaaatttgaatttgaattatatctgattcaaatttaattttgaattcaaatattttgtatatatagtatttctatacatctgtatatatagtatttctatacatctaaagtttatatatagtatttctacccaaagtttataagtcaaaagtttacatatccgagattcaaatttgaatttgaattcaaatttttatatatagtatttctatacataaatttttctaacttttgttttttaaaaaaatttgtgtggtgtactgtagtagaaatagaagaaagggaggaggaaggggagaagagggaggcgcgggggggggggggggggcaaaccgatcaccccctggcgatcaatcgcccattagtctcccccattgtggtaacactgggcaaagttgtccgtttgttccataaacaactctgtggcagcacttgatacccctagtcccactgcccgtattgtttgtttcataaacaaagggacatgctatgtgcacaacccacttgcatttttgttcgtgtgttgagttaccgacttccctacctcgtttttcaggtacatacttttcaaactgtaaaaatgagcttcttttgcaaaaaaaaattccatacgaaagtcactttaaaaaatcatattaatctatttttaaaaaatatattagctaatatttatttagtcacgtactaatggatcgttcttttttatgtgcgaggagcacacgatgttggttatccttgccttttagtgcatgtactgaggtggtgtttgaatccagggaataaactttattccctattacatcagatgtttggacactaatttggagtattaaatatagactatttacaaaactgattacacaaatgagagttaattcacgagacaattttttaagcctaattaatccataattagagaatgtttactgtagcatcatataggctaatcatggattaattaggctcaatagattcatctcacgaattagtctagggttatgaaatgggttttgtcattagtctaaatttaatacttttaattagtatcaaatatacgatgtgaccaggactaaaagtttttagtcccatccaaacaccacccgagaatcgacaagcttctttgagaaaaagaactctacaaatgcaacctagagatctttccattattaaactgcactattgtggtgtggttaaattatcctcctttttgctttgtagcctaggaaggaattcatgtggagaaatgattgcaactacgcccgtatacaagtagggttggcttggccacagtcataccaatatccacttttatatgcagctcttgcctatcaaattcagcaaagaagaacggttttttctatggacgagccaggccactcgccggaaggagtggaacagcgacatccggcctcccacccgcacgggagattctttggcggttggtggtcccaaccaacgtcgtcctggccctaccccccggatccaccaaaccacacatgacattttttttactcatacagttaactttttaaatatattggatcgttcgttttatttaatttctttttaaatatataaaactatatatatatataaataaaagtatatttaacaataaattaaatgatatgaaaaaaaattaataattacttaagtttttaattaacttaataagatgtacggttaaataaatgtaaaaaaattaacggctttaaaaatatttagcgtcggagaaagtattattatttcttcattctttctttctccctctactccggtgaggagcagccgccaagttattgtggagtgaggtggagagcacgggagatgacgtgggcgctgacacagtgatcagcaacgggaggcggaggaagcggatggcgtttgcatggacgaggaggccagccgctgccggtagaaaaggcagtggagcacccaaaccacacagccgctcttatcggcaggagagtggaggaggccctcacctaaaccctcgtcctccaatctcaggatggagcgcgcacgccgcctcgccaaccgcgcgctgctgcgccgcctcctcgcggcggcgacggcggagtccccggcggccccgtcccgcggcatctcgaccctggccaaggggtcgcgcccgcgcgcccccccacgcccggcgccccaccagtacaccacggggcggcggcccgtgtcggcgtcggcgctgcagccgagcgacacgttcccgcggcggcacaactcggcgacgccggcggagcaggcggcgatggcgtcggagtgcgggttcggcaccgtcgacgcgctcatcgacgccaccgtcccggccgccatccgcgcgccggagatgcgcttctccgggaggttcgacgccgggttcaccgagtccgagatgatcgagcacatgcagcgcctcgccgccatgaacagggcctacaagtccttcatcgggatggggtactacaacacccacgtc

SEQ ID NO: 42826 - DNA, 2188 bp, Oryza sativa
tacacgcacgccacccgttcaccaaaatgcctgacagcgacagaggcgataagagatacgatgaatttactagtcggtagtgataaagattggctgtggtgtaggccttgctcgccaacatggcagcgatgtatgctgtctaccatggtcccgaggggctaaaggcaattgccgaccgtgtacatggactggctggtacatttgcccaaggattgaagaagctcggaacagtgacggtgcaggagctgcccttcttcgacactgtcaaggtcaaggtcgctgacgcgaatgcgattgcccaggaggcctgcaagaacgagatgaaccttcgtgtcgttgatgcaaccacggttcgcttttctgttgatgtttcccttgtattgcaaccgagtgagtttgttgatgttgagtgttgagcattcaattcaagttgtgatgtgttgcagataaccgttgcctttgatgagaccacaaccttggaggatgtcgacaagctgttcaaggtgttcaatggtggcaagccagtaagtaatcattcaattggcgcaaaaatttgtgtgcttgatagtgaaattggatcgtgatattaaaatgatgtgtcgttacaatcatttttaggtgaacttcactgctgaatccctcgcaccagaggtctcaagctcaattccgagtagccttgtgcgcaagagcccctacttaacccacccgatctttaacatgtatgtgatgttaaaaggcatgctgcttttcttcactaatttcttgcagtgttaaaagataaaactgaacttatgttgtgggcttccaggtaccatacagagcatgagcttctccgctacctgtacaagttgcaatccaaggacctttcactgtgccacagtatgatccctcttggttcttgcactatgaaactaaatgctacagtggagatgatgcctgtcacctaccccaactttgcaaacatgcacccatttgcacctactgaccaagccgcaggatatcatgtgaggggaattcagcatttgtttagtttctaaatgcaaactgttcatcagatgatctgaaatggcttgttttgtgatgaaggaaatgtttgatgacttgggcgatctgctgtgcaagatcactggctttgattctttctctttgcaaccaaatgctggtgcttcaggggagtatgccggattgatggttatccgtgcttaccacagggtatgtcatcataaataagttggcatagctctcctgttttgtttcacattttatatttacaaaccatgttataaaaactgcaggcaagaggagactaccaccgggatgtctgtatcattcctgtgtcagcccatggtacaaatcctgcaagtgctgctatgtgtggaatgaagattgttgctgttggaactgattccaaaggtaacattaacatcgaggagttgaggaaagctgctgaagcaaacaaggacaacttggctgctcttatggtactgttctttttgctctgtaaatgttatcatttatctggtcttctggtagtactgtggaatgcctatggtctctctggtcaactattcactgttaaatttagagctagttttctaatactgtactatcactgcatcaccttttcgctatatttagcgtgttgcttaaagtcataaggctatttctgtactttttgttgtttctaatatatattaggatagaaaccagatagctgctccataacatgatccctatagtggctgtatttgtatacattcaataatttgaagttaatcgacatatataatagaaacaaatccccagttagtttagtttatctttttccatatgagcaattttatagtctttgagaaggtaccatgagataccactttttccattgtaaagttgatacctcctggtatctaattactaggaggtaccaaattttacactaaatttttagtacctcatggtatcttctcaaggattgtaaaattgctcttttccatataggctatagtccgcgggtgatttgtgaataagattttttttattatgggcatagaaacataatagttcactcaggttgatttgatttataaaacaagattttgaaatatgttggccttatgcgtaaagtaacagaatgttgcgtggttgctctgttcaccaggttacctatcttcgacccatggagtctatg

SEQ ID NO: 42827 - DNA, 21057 bp, Oryza sativa
  unsure (1)..(21057): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccttcctttttgacctttgcaagaattgaggccggtgttgaggctgtacttcgaaagatccttgcattacgctccccccagatctcccaggtgactagcatcagtagcgttcgcagaggggctcttggggtgctgggggattcgacgacaaggttccaccaatgttcaatcgaggggcagtcattccatttgtccatttggaggtcagtatgtgtccatctttggatttctgcccaaatcctcttagtgactctacatttggccagaaggtgaaccgctgattcgtcgattgtgcggcagagggggcaaaccttttgatttcgctagcctcaattccccaatctgtcagccgtccatagcctattctgggtagcaagccaagagaagaatttgcatttcggcggcacccacgctttccaaatcgattggtagaaaacggatcttgctgctcccatgaactgcagagatgaaatatggatacttcagtcattaagacccacacgtcagtgagacataacacgtaccacttcaacacctaaacttaaacatcacaagaccctaaagaaaaaaaacttaatcatcacaagcaaataaacactccaataaatcttcagaagagaaaaaaatgaatccaaaagacctggatgatgaagggtaaaaccgccattgacgtattgaccactacatgatccaaatgaagcctatgttagctagtgcatgttaagggcatgtgggcatgtttatattgtagccaaaataaactttaccaaattttggcaatgtcaaaattttggcaatttggcaatatggccaagttttgttaggatttattatgtatttaccagagtttcataaaaaaactaaatgggtgcacatatttgataaatttaccaaaatttggtaaggtttatttcgactacaatctgaccaagccttaagtgaccacgtagttttagtgtaagtacaacaaagtgatataaacatattgtaagagtttttatatcaaatttatgtcaagttaaaaagaaaaaagtagctacaacagatttacaactagctgcagtataagctccaatcaactttttatgaaaatgagttgtactatagagaaagtattatatacctaaggagacatcccctcgtatattaaaaactatccaaatggtcatagaaagttctttaaaaaaataacaatattcaaacaacatatttatgccacatcacaaaatcttaactctaaaatcaactcacgtatcgagatataaagaacaaatctatgaactgtattttgcactcaaatttatctctttatttttctcaatgtctaggcgattaatttttttaagtaatagatgtcactatacttataacattattaaaataatttaaatttttctaataatcatttttctctaatcaacattggatttaagtgataaaggatctgtttagattggtgccattttaaaccataccgttgtttggtaaaattaacaaatatatggttgcatttagtttgttaccaaatattggtaatgcatagaaaattttggcacaacatatttattccaacatatcaaaatttggcaattctatcaatttgtcaaaaatttggtattgtcaaattttggtaaggttattttcggaactaatctgaacatgccgaaaggtttagggtgaatacccaacgtgatccttgaactttcgcttaaggatcaatttagtccctgacatttcgtgttgtccaaataagtaccttaagttcattgtgtgattcaatatggtccttagaccctctaaacatgccatgtgtacatgccacatcatctatgcatgcaaattcaatatttaaatatcctttacacccttatgttttcatatgaaataaagaaaaactattgagaaaacacacaaaaaaaagcttttgaccattggcaaaaatgtgtagtaggggtgaaaacggttcggaatttttccggattccggacctgttttcggaaacggaatcagccggtcgaaattttttcggaatttctcggaaacggaaatattttttcggaaacggaatcgaatatgataatagcagtttccgtcggaactcggaatcggtcggaaaaaattccggaaagtttgtcggaatttccgaagttaaaaaggcccatccaaatagtccataattcctccagcccaacccaagtccctactaaccgaggagacaggctaaccctaggatagaggcggcgcatccaggaggttgagtcgagcacgccaccgctggccgccgtctcgtcgcccttcctctctcgctcattttcgccgccgccaccaccgacgatgacgccgacgacgccggccactggccacaccgccgacgccggccacaacaccacactgccgacgccggccacagccacacgaccgacgacgccggccactagccacaccgccgacgccgccgacgcctcgccttgcaggcagcagcagccagtagcccagtggcagcaggtgttcctgcttctgcttatattatgttctgttaattttgtagaagagaactgtattattaatatgttctattgccattcaccaagcactccaataaagacagactgctagtatgtccagctaaagacagacggtgttcttgagcctaaaccgttgatttgatttcttttatcgtacagatttgtgatttgaactttgttttgtgatgactgatgaactatgtactaatggagtgatgtgttatgagattgaactaagtactgaaatattgatgaaattatatgaagttatagaagactatattttgctgtgaagctcagtttgagtggtttctgtattccgataaattttcgttactgtatccgcaccggttcattttcgctccattttcggtttcgataatattcgtttccgttttcgtttccggggtttccgatttcgattccgattccgaaaaaaatatgaaaacgaaaacgataaaggttgtttccgtccgtttccgtaccgttttcacccctactgtgtagcattgatagataaaaaaattaatattttttgttttatgattgcttcttcttgtttttcttttctttatttgatagaaaattgaaggttaaaatggacatttaaatgcacgaatgacgtggcatgttcatgtggcgttttaagtggtctaaggactatattaagccgcatgataatctttagggtcatgtttagacattataaaatatgaaggactaatttaacctctgagcaaaaagttaaagtactgaactgactattcacccaaaggtttacgagggaatacttctcgaggatcagtggtggattaactgaagatgagatgctctacgtcaggtcaacatcggtctttgcttgtagcatcgttcattccacgctggtagtggtactatcttaagctagaaggccggccatctcgtggtagagacgtggacgcctctgcccttgtgtgcccctcagttgtaatccaccacgtctggctccgtttcagcctcccgttgccctatctatctagttatgtaagctagagctggactttgcttgtactccctccgtctcctaatacgagggattttgacattttttgcgtataccatttgaccactcatcttatttaaaaagtttgtgtaaatataaaaaacgaaaagttgtgcttaaagtactttgggtaataaagtaagtcacaaataaaataaataaaaattccaaaatattttgaataagataaatgatcaaacagtggaagcaaaatgtcaaaatctcttatattaaaagacggagggagtagcatatactatttcctgtctgtctccactgaaatttcgtgagatttcagttttcaaaatggggcctagccatgcacgttcgttggcttcttgcaagcactggatgatgttgtccttgtccctgagatgctgaattctaaactaatcacgcattgcttatcttattactacctccatcacaaaatgtttgacgccattgactttttaaaaaatgtttgaccgttcgtcttattcaaaaaatttaagtaattgttaattctttttctatcatttgatttattgttaaatatatttttatgtatacatatagttttacatatatcacaaaagtttttaaataaaacgaacggtcaaacatgtttaaaaaaattaacgttgtcaaacatttaggaaagaagggagtaattctcaagcgtcaagcgtgcacgctgagcttcgttatggcgttgaagattgctgcacagtagcagcagacagagaccttggtcaatcacactacagtccctgtctttacagctagcttgtggcctctggcactcatcagtgaggattgatcaatcaatcagagccttccctttctttttggcttttctttcctcatgcgttagacagcggtaaaggttcatctctgtagattctctacctgactatccgttacttcctccattttatattataagactttctagcattgttcatatttatatatatgttaatgaatctagccttatgatttgctgaactgtgaaggaaatcacttaagctcgtctccccagctcgtctcttcagctcccagatctgcacctgccgccgccagagctgaccggcggctaggacagcggcagcggcgggaggggggggcagaggatggtggaggatggcggcggtccgacagcaggaaggcgggtcggcaccggcagccctagaggctacggcggcggtggttcccgtcggtgccggcagccctagaggctgcggcggaggatgacggcggccctaggggatgcggcggtggctcccgtcggcggccctagaggctgcggcggcggctcccgtcggcggcctagaggttgcggcggcggctctcgttggcgctggcagccctaggggctgcgatggaggacaaaggcggcttccgacggtgccggcggcactaggggctatggcggcggctcccgtcggcgctggcggccctaggggctgcggcagctcgagacagtggcagtctgtgcactttgacggtggatgcctaggattcgggtgaagtgtaagtcaatcccgtaggttcgatcgtgtttggttggctagttccgactatacggcgaatgacgacggttgagagtggggccaacaagcggcgcgtgacgtcaactctcctgaaactgatgaagatggcacaaatggaggtttgcatcgacggcgcactaggggcggcggcgaccggtagacttccactcgtcaaatctaggcagagaagcaggatgtgtcgaggtcgtttggttttcttttcctttttggttctgttctcctctttgttgaggtgtgagtctaagtactcatatccttttggctgtgtatatccttcatggatatagagggccggattaataaaaatctattatctaaaaaaatgttaatgaatctagacatactatatacctagattcattaatatctatatgaatgtggacaatgctaaaaagttttatagcctgaaagggatgtagtaaataatttccaatggaatggtaaaaggaagccatccgaatgttataagattattaagagaaaaaagatacaataaacacaatggaaggttgttgaggttggttgtgcaatacagtgtacatccacgaaccgagtcaaccacacaagcacaaacccctaaaagggaaatatagcaccgaatcgaccgccgctatgtgtggtcgatcactgttggatctataacaataccatagatcaaagtctctaaatacgttgtcttgtaaaagttacaacgttaacgctgtcgttgtcgcccatctaaggaactggacgtagttttcatatagagtttctcgccaaaagagggagagaaaggtacatgtgaaaatcactgtagaatctaacctgagaaggtgacaaaaggtagattctgcttgttcaggaactgacgcacaatccggtagtttggtgctcttcttttgcagcctctgttccagtgttccgggcaggcagcagtacagcacaaacacaaacacgtttggataattgcagaaatgattcagggtttcctgcagaatcatgtcagttaggtgacacacaaacggctcgtcgttctctgtcaccgggggaccttgtgcagtgccgcagttgcgtcttgtgtgcatctctgaatattcattcagtcatcggaaggaagattcagacagaaaatgcagggctcacagcagatagcagcggatagcctgcccctgcctgctctgtgccaagaaagccacaggctagctactctcttcgccgctaaatgtaattatttccagcttatttagtagtaaagtttaatataaaagaaaaagatttcctttcagagtcatcaaatagtcaaaatcttaaatttcgaattacttagattccttctctaaacacctgattagtcaaaaatatttttgattcccatgcagtgaaaataacgttgtcccatagaaatactttatatcgtgtacaaaattttaatcctaaacactttttattttacaagggagtagtacgtagcaaagacagagaaacgcctagaaatcttccggctagcttcacaaaggtgatggcttatctggtataggtgaagtctcactcattaaatttatttgatattagatcattccctaatattcgccttccttttatgtatgtctagatttattaacatcaatataaatgtgagaaatgctagaatgatttacattatgaaacggaggaagtagcaatgatcaaccgtcagtgttagagcagccggccatgcaattaccgtgtgttgtgttgcgcccgagcgaacgatacggtggtggagtggaggacgtacgccgatgcaggatggaccagcattttcaagcgcaaacggcgacagccattggcattcgataaattcgatcgtggctaaccacactagagcaatagctgtggatatatctatataacattaacaggataggagatacgcgtgcgttccctccactcgcgcgggctgagcttagcttagctccccactcactcgccacttgctgcaattgcaatggctgctgctgctgctcgatgcgccggccatggcggcggcggcggcggcggcggtttcttactccggcgacggctgctcgccaccgcggcgttcctggcggcgtttgggctctgcactgctgctgctgatgacgctgccacggggagaggacaagggcatgatcatgtgatgctgagcgtggaggacatgttccctgactcgtcgtcgtcgtcgccgtcgtgcgacgcgccgccgcgaggtttgattcgttttgctcgccatggcatggcatggccacttcttgatcgagctctttccaagtctctgtctgtcatgtcagaatctcagtgtgagtgtgaggtgtgtctgctgctgttgcatttgcatatatcatgcattcattcatgcatggatagatgcttcagattgctctctgcatcagtgcttctttttctttttcttttcttggtttggtttggtttggttaatttgtttgcttattcaattgatctatcacccgtttgtttctggacttcaggtttctctggtttcagagctgcttttgtggttgttttgttgtgctttgaatttatatatacttacatacgagactggaaataattttgctgattccagtggattcacttacagctttgatattgcaaatgcttccaagtaagactctctctaaacaaaactaaataactgtagtaaatgtttctaaaataaaataaaaactaaatagatgtatgtaagactttgtgtcgttatctgctcaagtttttgtcttgtttgtccgttatcagaatactgtatcttccctgttttgtatggtacagtacacaacaagcgtaaggaaactgccatgaatttaaattgatggccacagtacacagggccatatacttgacagtgattttattacaaaaaaaaacaaatcacttttaaagattttgagtcggaattttttttggaagaccgaaagtatgacaaaaatggagctttggctctcacaggaaccccaaacatttgatactcgtaaaaaaaagggttaaatttgcattttaaaatatgttaggtgttaaaacaataaccctttttttaagtgcgagaaggacacacactcaaagcttgtgtgtcctaaaaacgctccaaaacataagaccttgcaaaacatggcacacacgtctgattttttccaccaaacaagcacacttgtatataaattttggtagataggcagatttacataaatctaaggatcggatatgtgcgtgaggaataagatgaaggcaatgatgtttctagagcataaatcaattaacaacgatggcacgttagtgaataaatgagtaacggttttgctagctatttgtggattatctaaacgtggtcaaaatacaaaattgtagctttcaaataactttattaacttttagcttgctctcttgggtttagctagctatatgcatgtgtttttatgttgctattgattatagggaaaattgcaaaaaccatctcataagtcaattgaagtttgacattttacccaataaatcactttgttgcaaatacttactcatctatttgttgcaaaaccacatgttttcataaagtgtgagccgtcaatgtattctttaccaaaattaaatattttcatagtatagtcttgacactttttttttgagattccacaaatagaattgctgatgagagcttaaatgttgatgcattgagtttctctatatgaacaaaaaaaagttcaatcaaacatgaaaaataagtgtaatgcaagcacttggagaagattgatttcgctaacttagcatgtggtgactctacatcagcgataatgggccaatttggttaagcacgtgcgcactgggtggtttttgcaataaaactgagtaggtgatgggtattagcaataaaataacttatgggatgaaatgttaaaattcaagtgacttatggggtggtttttgtaattttccctatagtctctttgttttactagcgaaccaaccgttcgttgttacaggaattagaaaaatcgcattggcatattacaaggaagaaatctattttttaattttagaattaaatttgagttttatttatctttttgtgttttagccataaaaatatttctagcggactacgttgacttcctgtcactaaataaatgctcctcccttcaaaacgttgcatcatagataatctatgaattctaccatatatgcgttttgtttgaggaggggcactgatttcacatatgttttggaggttaatggtgggtggtgaaagatgcaccaccgctcccttttataagaatatagatactggtaagtggtaaagaagttgaccattttttttgttagttaatttcaagcattatatgtttcaccctaataaaaagaggtacgtagtaaatatgtgagttgttttgtgttgacacttgatacaatatttcaaccaaaaagaaaggtgattgacaaataagttacccactcagtgaatagatgcatggtccaacaaatgtctagtttatatgagaggaacgtattttcaacgaagaaatccgggtctatcatattcctgatgaaaaatatgtaatactctgtccgtccctaaatataagggattttgaacggatgcgatatttcctagttatatgaatttagacaaggaatatattcaaattcgtattactaagaaatgtctcatctgcctaaaatctcttatattttgcgatggagggagtagttcactactgcacaaataaacaattataacctccctaaaaaaaaccctctcgtgctttggttgggccaagtgtactttttttttcatttatgctgcattattgttcagacacaactgaatgtactagaaaaatataaagagtaaaatccatcaccggtccctaaacttgtaccgttgtgtcatcccggttcctaaactcgcaaatcgaccgttcaggttctcaaacttgtttgactgtgttatcccggtccctaaacttgcatatcactcatttagatcctccaacttattcagttgtgtcaccccggtccctaaacttggatttgaatatcatctgggtcaaataggacggtttaaagactttatatttaaaaataattcataactttttcatgtgaactataatgaagacaaactttatatgaaacttgtagccctcgacgcgatctacaattttgttgttgaatttttttattttaagtcattttttcccaaaatgtaattttaaaattaaaatttcaaaatctataaacatgcaacaatattttgggaccctaaaaagtttaattcaaaaacttttcaactacaaagttctaggtcgcgtcgagggctacaattttgatataaaatttgtcttcattagagtgcacatgaaaaagttatgaattattttttaatataaagtttttagaccgtcctatttagggtccgggatgacacaactgaacaagttagaggacctaaacgagtgatctgcaagtttagggaccgggatgacacatgtcgaacaagtttgagaacctgaatagtcgatttgcgagtttagggaccgggatgacacagtggtacaagtttagagaccggtgatgaactttactctaagtaaaatatagacataaagtgatagaaaaaattctgaatttcattttctgaaataattccgattgatccaagctgaacatctccctggaaattcagatcacagacatgacgccacgtcatcaaccactaggatgacgatcgtccaccggcacggcccgtgctcgccgctagccgccgcgcacggcgagccgccgtcccacggcgagatcctcgccgccgaccagagccgcgccgagtcgatccaacaccgggtgtccaccaccaccaccggccgggtgaatccaaagcgcagacgccaccggcagcagcagccgccgtcggcgccggcgccggcggcgtcgctgtcgtcgtccaccgcgtcgctcccggcgtcgccggggcgcgcgctgggcacaggcaactacgtggtgaccgtgggcctcggcacgccggcgtcgcggtacacggtggtgttcgacaccggcagcgacacgacgtgggtgcagtgccagccgtgcgtggtggcgtgctacgagcagcgggagaagctgttcgacccggcgagctcgtccacctacgccaacgtctcctgcgccgcgccggcctgctccgacctcgacgtcagcggctgctccggcggccactgcctctacggcgtccagtacggcgacggctcgtactccattggcttcttcgccatggacaccctcaccctctcctcctacgacgccgtcaaggggttccggttcggctgcggcgagaggaacgacggcttgttcggcgaggcggcggggctcctcggcctcggccgcggcaagacgtcgctgccggtgcagacgtacggcaagtacggcggcgtgttcgcgcactgcctcccggcgaggtcgaccggcacggggtacctcgacttcggcgcgggctcgccgccggcgacgacgacgacgccgatgctgacgggcaacgggccgacgttctactacgtcggcatgacgggcatccgcgtcggcgggcggctgctgcccatcgcgccgtcggtgttcgccgccgccggcacgatcgtcgactccggcacggtgatcacgcgcctcccgccggcggcgtactcgtcgctccgctccgcgttcgccgccgccatggcggcgcgcgggtacaggaaggcggcggcggtgtcgctgctggacacgtgctacgacttcaccgggatgagccaggtggcgatcccgacggtgtcgctgctgttccagggcggcgcggcgctggacgtcgacgcgtcggggatcatgtacacggtgagcgcgtcgcaggtgtgcctcgcgttcgccggcaacgaggacggcggcgacgtcggcatcgtcgggaacacgcagctcaagacgttcggcgtcgcctacgacatcgggaagaaggtggtcggcttctcccccggagcttgctgatgaaatgtgccacgcgtcacccccagcaaacgtacacgtcagcacgcagaatgaattaactgtctgcactctgcagtgtaatgctgcaatccaccaggtggtcagcgactggttttattaccatgatttctgaagatatataatcatatgattacaaatatgctaatattattttctcttcttacatttatgatttgcttgaaagaagggaaaagcgaagattgatagaaaaaaaatatgtaaaacaaaatgagctattggcgcatgattaattgagtattaattattttaaatttaaaaaatagattaatatgatttttaaagtagcttttgtatatatatatttttaataaaaacgcaccgtttaggacgggggagtttttctccgaatccactgctgtagaacacaaacttgtggtccgatgatttctggcaagcccaaaaaaatcattagacgttttatgtaaccatctatactatgaataaatttgatcgggttaattggatcatgccattaaaatatactggttttgaaatatgatattagtattcgcatatctgaaaccataccattataattttccacatatttgagatataccactacttacccattggatgcatttttttttaaaaaaataaggaccaaactatccctttttccccttagtccttctcccttcttccatggcgtgacctgaccaccggcctcctcctgcacgtcatctccctccacctcggcccgccgctggcctcctcttgcatgccagcgtgtcccagatccagctgcctttcctcgctccgagctcccgcggtggacatcgccggcgacaggatttaggaatcaatggcggtggtggtcgctgagatcaatggcagtggtggcgccgccgttgcgtgagcagcacgacgacaacacaacgatctccctaacgttgaccgctgcccggagcctactctgtaggtcgccgtgcttggcaacgttggcgagcagcgccaccgacgcggtcgaggagccgatggcctcctcgtcgagcggcatgacaagcacccgtgccgccaggacgtcgtcgagcaagaccgacgacgctgacgaatcagcctgccacagcgaactacacgatcgccgtggcgagtgcgcgcgccacgccggccgacgcgaggcaccgccgatcctggttggactcccgcgcgaggcgcccgacctcgcacaccaccgcaccgcgcctcgccgcgtcacttgcccatgcagcggaccttggccaacacacgtcggtggcactgctgtagggaagagagaggtagaagatgagggtattttcgtctgatacatgcaaaatacgtatcttagtggcaccattgagattacatacaagtagcagtatcatcgttataaatacgtaaatagtattggtacatttcaaaaccggcaaatttttaatggcacgtatctaattaacccaatttgatatggtacaaaacattgattcttggttactggtacatattcatgttcttttattatttttcaacctatcaatatttgaacaatagagattcaatatgactataaaattatcattttttgtggtttcaacctaatgttcgacctgaattgattttatcagtaagaaactctccatctatcttaaaaaagaatccattcctaaatatgaatctaggtgccagtctatatttatttttttggattggacttttctaaagcaggagtaattcagttcatataaacaccgggtgcggtgatgagcgacgagcgacgagcgtggcggccagtgtgagaagggggcacggcggcggcgggaagaggcgatggcggcaagtccaaaggccggaggcggtgacgacagcgggaagaggcgatagcggcgagcccgcaggccagaggcgaggaggcggcagcgggagagggcgccggatctggatgggacggatccggtgaggcggtagggggttccgtcgtcatcgtcgtcgaccggcgagtgaaacaggagatagggtggtggccggcaaatgaggaggtgaggcggtggcccggagacttggcgatggccggcgaacaaggaggcgaggcggtggcctgaagacgaggcaacggtcggcgagcgaggaggccagcccggaggcggcggccggcgagaagagcgcgaatgacctttttttttatttttttcatttttctcctttcccccttctatttctttgtgatttcttatatttcctttaagattcttttgtttgtagtaattgatattttggtggttttgatgaatttgaagggggtatactcgtcgccttaaatgtaggggtgattgtatccactcatttatcctactcttcctaaccaaaaaaaatggatcactaaatccaccttcatccctacaaccaaataaaaataattggatcgccatattcactccaccaaacaaaaaactggatcgccatattcagtaaaatatggaccgccgtatcccatccaactttgactgtgaaccaaacgcaccctaaaacaaccaatctggatggtcctatgacatttaggttggatcttttttattgagggagtggttgggactagagctgtcaaaaaagcttgaggctcgactcatcctaggctcgattcaaactcggctcgacctccaaacgagccgagcccgagcctagctcgagcttccaacgagcctagtaatatattatttttattgttattcaataatttaggatatcaaatatattatttacatgcattgtattaacatcatatatttattttattctttttcctcttctattaatatgatgaactaggaacaatctcggtagtcaagcttgagcttcatctagctcaaaccaaatctatctgaaagctcgaacattttatgggctcgagtttcgagctcgctcattgacagccctagttagagcaagtttaataatataaccaactattgtttctaaatcatccatagtcaatttagtagccaattcatacacatatgtatcttggagtctgtgctccagctacagcaaatctgtagccaactactcttctgtctcctcttttatcttcttgctggtttatagtccgatattgtagtcatcttaggacgggaggtttttgtaaatcctatcttacaataaatttatcccccactaactccttaaacttaacatgcaaagatgccacatcatcattgacggagcgtggggctcctcaccgggagaccgagcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaaccccactcgccccctctctcctttttttttttggtgggcaaggtcctccttttatatctcaaggggatactacatgcaccacttctacctacttttcttctgggtggggacctactctatcttgaccaaaacttggcttgcaccttcgcctggaagctaaatcacaacttgtccttgagtgaggctcagcgccgtctctcgcctgacaccggggatctccctgttactccctcattaatgggcgaagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccacaacgtgtcagttcagcatgctacacgtctgcccttcttcatacaatgacttccttgcaatggttgcgatgaagcctggaatgtatctggccggggctgacgtgccaactccaggagttcccacgccggctccggctagggacgagtgcctggaggccctcatcattcagacgggacggggcgaggcgtgtgtcaggccgcctgttgccacctaacccgcgatctgaccggtctgtgaccggtcacacactgtgacctgtcacggaccgaacgagtgtgctgcactgcattaaatgcggcgtggggcgctcgtccaacccgcaataaacgcggttaggtgagcgccgctgtgctcacctaacccacacacgtggcgccaaacccacagggggccggggcgccccagccctcggggccgaaacgggagcggcccgacccctcggggagacagagggaggggcggccacatcaccctcgggcccgacccccccgagggggtcaggccacgtgggtgactgcagctgccccaaacctctagtcaagataccctcggtcccatgtcaccgacaatcatccactaacaagatgccacatcatcatccactaattaataagatgccacatcatcatccactaattaacaagatgccacatcatcatccactaacaataatcacatttaaacatcatgcaaacatgctatatctttatagtttttataatttaagagcttttcaaatacaatcatgttaaattattatccaacataattcacataatgttttaatgtatatctttattatattttatgatatcctatctacttatatagcttatcctcacttagttagtgcttaaatgattaatctatggtccaaattatatttctcattttttcctctaattaagtcatatcacatcaattgtttttagcctttagatgattaatctacggtccaaactatctccctacttttcttcttccgtaaattcataccaccttacattttacgtttgaatcaccattctacatactatttaaatttaaattatcataaatcatattaatttacttaatctgatattatctagctattttacatgttattttttcattgttatcgtactaaatttccgaaacagggtttaacttagttccaagaaaaatggaagcctagcaagcggccactgtttcctcagttgtcaccagacgtctgactcttatgagttctgacacagcgagaccgggacgcatagccctctctcactgaaagtgggcccggataggggacagctctccagaacccaagtgcactgcaacccctgcaaagaccctagtactagtactactctactaccgagtaccgacaaacatacgctccgtaggaatgccaccggaagtactcctacgccctaactttacgtataccgtatcttgtcagagaaaaaaacggacggcccagatgcactgcacgcgccacaccggtcccaaaccttcccaacgcgcgcggcgcatcggacggccaggattcgccgcggatggaccaccgtccgatcttactccccaccctgtcgctgtgtgcctctctctctctctctcccgtgtctctcgccgcggcgtcctccggccaccaccccgcgccgcgccgccgtctacggatccccgctcctcgctcgagcgagcacgaaagccctagcgcgccgccccctgcaccgggtgggttccccaggtgagcactccattcgcgccgcggcgccctctctctctctcgttttgttcccacggatttctgcgggggatctcgttcttgggtggaaatgggaggagggggttggggttctagttcgtttcgaggtggttgttgacttgttgtggcggattgggtgggttttgggagggttttgtgtaggattggggggggggtgaggtgaggttaggttggtggcgattcttgatttgttcttgcgcggcggcgatcgggctgggttgcgtctgtcctctcctaggttttttttttctctttttcgctcgtgtagttggattctttggtgggttcttagcggaagtttactgttttttgacggagcggtccgcaggaatgggggccaatgttttgattttggggtatctctgcacgccctaaaaacaaaagagatttgaagggagagacttccctccaaacatttttttaagaagaaattgtgagcgttgttggggattgaacacatctttgtagcgagatgtcggcttttatgttgaaagtctgaatggtacatttttttgtatgagcatacatggtttattgtggggaagtataagtgtgtttctagtatatgtttcttttttatttcaccattctgatttaggtggtatggtggatggatttttttgctacccttatagggtcttaaatgactattccgtagaagaaagttaagttttttttttccatatacttttgtttgtctctttatttaggttttttttttggggggtgggggggggctctactagggagtttagttcatataactgttggtgcactagttcctcatttatgaaggaactgctgaatttcatcctttcaggtgtgggcacctatatgtgcgttatattttactttatcgcaatttatttatcaaccagcattgactttgattcagagatcatgtcggctttgcaggtttacttgtttttatttttaaaaataatccaagggttttcagaatataaataattgaatacggtcaaatgtgcagctaactaattatcatgaaatgccatcaatatgtttaaagacttacatagttacgtttagcaggttgttgagctagaatgggagtggcagggcacaatgatcctttgataggtgaaacgacatgtggatctttgctgcagcaacttcaggtgcctttgtctcttccaatgttcttttgtatgtgtgctttataatgactggaactaaggatagcagcaagccattttagttccctatctacaccatagcatctgtgcaacgaaaagttatatgagtagtgcataggattggacaagtgactgactagtgtcatttcagttgatatgggatgaggttggtgaaagcgatgaagaccgtgacaagatgttacttcagctagaacaagaatgcttggatgtttacaggagaaaggttgatcaggcatctaattccagggcacgcctccttcaacagcttgctaacgccaagtctgagctttctagactcctttgtgcactaggcgagctgtctatttctggcattgtaagtatcttgataaatattttcatgaatataattccttattttccccaaaagtacacacacacctacaatatgctgcatctggctcattactgctgacttttgcagcctgacaagacaaccggtactatcaaggagcaactagaagcaatatcacctttcttggagaaactctgcagggaaaaagataagagggttagagagtttgctggtgtacaacttcaaattcaaactatacgtggtgaaatcgctgggagtctgcaagttggtgaccacatggaaacaccccgtgttaatgaggatgatctttcaacgaagaaattaaatgaatttctttctgaattgcaagctctacaaaaggaaaaggttggcactttgtttttcattttcacaatctgccaactgcctttttctggacctgcttatggaataatcttccaaatttcatagcccaaccatgctaaagagattctttgttttgcataataaataataatttcacataatatctgctggtcaaattctcttgataagcattgtataacatcaaacatccctatgatggatgatctctaaattttgacgtaccatattagtaccacagaagcaggcatacggccactgatatagctgatgataatctttgcattatacacacattttcgactatttaaaatttattgacttgaaatcgtatttctttccattttcttgcattgcagagcaatagactgcacaagattcttgacttcgtgagttcagtgcatgatctctgttctgtccttgggatggatttcctgagcactgttactgaagttcatcctagtctcaatgactcggttggtgccgagttcaagagcattagtgacgcaacattatccaagctgtctaagatggtaattcaacttaaagaagagaaatcaaagagacttgaaagggtaattctacaacgagcctcttgttcttactcatccaaccctttttgtatctctgtaacatagtacatcctggatattatttatgattaaatgctatgtttctcagattcaagctctagcttcccagctaactgatctttggaacctaatggacacctctgctgatgagcgacaactttttgaccatgtcacatgcaacatttcctcaacattggatgaagtaacagcaccaggagctcttgatattgatttgatcgaacaggttaggagattttcttctcaaagtgctcctaggagaatagcataatattttgtctgacatgttttgcgctccaaaggctgaacttgaagttgaaaggctggatcagctcaaagctagtaggatgaaggatattgcgttcaaaaggcagactgaacttgaagatatatatgcccaggctcacattacgatagataccagtgctgcaagagatagaatactgactgttattgattctagtatcttcgagccttcggaacta

SEQ ID NO: 42828 - DNA, 39599 bp, Oryza sativa
cactgcctgccttagacctatgctacatctggcataatatgacatggaaaattaattctattcctaatctgacttttgggttcatctgtgactgttacgagtgtagtcattgttgatacactgatggcaaagacccgggcatgggaacaagagcatggtatgccgttcagctatgacggtgttcatcttctcgcaatgctggatgagtacaaagtactaaggcagcagaaggaagaagagaagcgacgaatgagggtacccttctgtccaatccccattaatctttcgcatgtctggctctaaaaccatatctcattccatttgctttcttccaaaactcatttcaggaccagaagaagataaacgaccagctagctgcagagcaggagaagctcttcggctcgaaaccgagcccagcccggccccaatcctcaaggaaggcgcctggcccgcgggccaacggtggcgcagtcaatggcacaccgaaccggaggctctcggcccaccagaacggcggcggcaggtcggtgagccgggacgggcggagggacagtggccggccggctgctccggtgaactacgtcgccatctgcaaggaagagtccagcaacaacaacccggcggcgtcctccccctgacgatcatcctcgccatgattgaccgtacatttcttggtgccagtggtagagagatactccatatctgtgcagtagcaggaaaaaaagaaaaactatagcaagatactagtaggacaagtgattcgaatgatagtagcagtattttggctgtatttgaatcgatttgttgctgtccatttgctggtagtggatcgaatggatcgagtgggtgcagccgtgcaggtgcatccgccatggaagctgagctcatgtcgtcgtgtcccgttggagtttctttcgcctgtcactgtcggttgttgggcttgagcttggcgggacggcgaaaaacgcaatccgtcagttacagtggttatcgcttgaatttcgtcgaatcctatcaaagtttaccgagctgttatcggcagttttgcggttactgggctatcagctgttaggctatgaatttaaatttgaaaatttcatgccagtaatccaaaatttcaagttttggatgatgtatatcaattccgtacattatttaagcactaataacaacttggagtagattacaacgcgacatacatgcaacagcagcgaaacattcgtcagtctttcagacttccgcactcaatcaccaatcacttcatcggtttaggaggtggtttctcgttttggatggataatcaactaaaacaaagcaatcaaaagaagaaaaaaaaggggccaaatttcatagcaatttgattacacaacacagcacagcaattcggtggaggctccacgcaaattgaagaagcatatgtacatcatcgatctgctccttccccggtcagcttttgtctcagtaatccgtcggtggttggttgccgtcgtaggcctccgccgcggcttcttccctctcctgctcctgatctcgccggtgcaccttcttgctcaccttgatccagattgcaaaatgttatagcatcggtgagtggaggagagatttttgcaaagattttgattcttggttgtaaaatgtttcatcagtggagggatttgcaaggattgattgattgatttaccttgtgtgatcttgcgtggaggcggtggtcggaggaagccaccttccggcgaggcaggctccggccgccgcccctgaggcggctcttgctgccgggcttgtagcagctgaggctgccgctggagccgtcgaagctgacgacggacacgtcgttggacccgcagctctccttctcctcgccggcgccggcgccgaggtcgtgccgccgccgcaccacgatcacccgccgccctccggccgccgccgccgtcgagccagcgtccgccgcgttcttgctcatgcagtcgtcggccgacgcctccgacgacgcctgccgcgtcgccatccaccgctccagccagctccaccccacgttgtactccgcctggtccgaccgcgccgcccgcttcttcgtcgtcccgccgccgccgccgccgcagctccgcagctgctgcgagaacgcgtaggccagcgcgcgctcccgccgcgtcgtcgcctcgatcctgctctgcatccgcatcctcgacacgttcgagctcaccgtgctgtcgtcccactcctcctgccacgcacgcatcatcatcagttcatcacatccaaaatctcgcgacacaactcgccgatcacatcactgttccatcatcggttgcagagatttgatcgagatcgaagtctacattgcattgcggacatgttcttgcatggtctgtatataccttcactctgaacgcctgtggccgcgaccgctggctgctccggtgctgcgccgacgtcgccgcggcggcggcgctgtcgtcgctgaggcggaggttgctcagcgactcgccgacctggacctccaccgacgccgcgatggacgccgtagtagggctcctcggctcgtcggtggtgcagcagccgttttctgagcatttgagcttctgcaactgcctcctcgcctgcaacaccagtggatctgcatgatcgatcttttttttctaacctccaatttttgaatttggatcaagaacgcaccatgaatcccctgaacacggattggatcatcgtcgccgcttcgacttggctgtcggtggccggctcggccgccgtcggaggcgcgatgtctttgatggggatgctcatgctcccatgttcttcagggtggccgccggcgtcggcgacgccatccacgccattcgccggtcgagcaaccgtcagcgccgccgcctgcggttcctgcggcattgcgcaggtctcgaagctcttgacggagaccgtcccatcatcgtcgtcgtcgttctcgtcctcggcggccgcgctgatctcgtcgccgcagaggtagagccggagagagctccatctcctcttgtgatcagcagagcccctctcctgcaaaccaaaaatcagaacaatcttcttcactcgattaatcaaactccattttctgttcagattgtttatgtcgcaggcaggcaaaagcatctgcaattgtgaagatccatgaaccgaggtgccacgacaaagtacagaatcgaaagtacattggcctcatcgccggttactgattggtgtaccgagagatcttcactttttctcgtactgaacctgaacccgaacccaacaccgactgcacagttgcactgcaccaccacaaacgtatgccctacacaaaaacagtggacgcaacaccaaaagagcacctacattgtggcaaccacggccgccaccgccggccgacgagcaggggctcttggagaagactcgccggacaatgccgccggcgaggcccatccccaccgtcgccggaacagaagaaaagcctctctcaactatctaggactaggaggcttcacatgtcagtgtagtagaacgacggcgatcttggttggcatcgccatgagccggcggtgctgagctagctgagctctcactccacagtgatggctggcgcgcgcaggcgaggctgcaatggctggcttccccttatagtagcaagggagaggccaacgaccgtgcagtggtggtggtggctaaaatccacaagaccaccagaaccagtttggcttgggttaaaataaaaagaaaggcggtgtgcgagatgcgctttggtgcaagtagtaagctttgtgtaaaggcgccggtggcgggaggcatctcattggtggatccatggaggaaatgtggagtacactgcacaactgtggtggcactaatgatttagagcgagagtgaggaagaggacccatgtgttaggttattttttggtctggcagaggaggggactttagagctggaggctggaggagttgggcacttgggcatcttgttttttacactgttggtggaaggagtgtgggggaaaaaaatggtgtgctgctaggctcacagtcacacacagctgggattgtttttgttgcaacaaggtattgtgttgaaggtttcctagtcttattgtagtaatctgtttatatttttggggtaatgtaagtttcacctttttacaagccaagtctaatgcatttttactgtgttactacagtgagaaaagtgaaaaaaaaagagagaaaaaaaggatagcactaagggcaattttgaaggatgagtagaggttatcttttagtgtcctcttgtcaataaaagagagcactaaagacaacgcatacaagaaagccaagcatggctcaattggctagtttgttgtggaggaaaaagttggcatccatggattggatcgaacctatgtgcctcactggaaattttttccctagctccatgatctttgcctttgcccaaggggttaacctcaagtagatgtattcagtgtgaatgtgtgtttccatacattggagccctacacttcgtgtgaagtgagtatggtgttgtgtccttgtgcgcatcgtgttcattcttggctacccttaaaaaaaattttgtgtcatggtcgacacatttcgttcattaccttatctctcatccacctcaaccattctcaagattatgacgatggctgaggtgttctattacgttggtgtggttgtccacaagtagacatcccattagttggttgattgggtgctagggcagccgtactgtacatagtacagattttggttgttagaccagactgcagtgtgtcggcgagagatagcagtggtttactggcttgtgtgagcttagcatttcgagagggaaaaaaatgtcagcaggaaagaatgttggaagggtccggaaataaaggttctagacgtgcacccttttttttttttactgaagggtcacatggcttgcttcatcccagcctaaaatgttggttttgcttgctcttgggtgtaagcatcatattcctcccctcaactttctaattccacgccaatccttatcctcacttgttaatcttccctaactatactttgtcagatgccactttttcatcatttctattcgcaagtaataaatactactctttcgggtgtgttcggcagctattttttggctgcagctgtagctgtggctagggctatttggctgtgcgccgcagccgcatacacgcagtgcagcagcagcagctgttagaaacttgcagccgaacacacccttcatctcagaatatagcttagttctaaaatttttagaacagactaaggattatgatgaaaagactaaaatgctcttcaccaatggtggtcgtttcgagagggtgctggggatgagtggaaaagaagtgtattataggccttgcaccactaaaaacaccccatagtatattctaggataaaatttgaacgttagaaatagttatattttgagattaggaattagttattatcccatataaataacaccccatagtatattctaggacaaaatttgaacgttagaaatagttatattttaggatggaagaattagttattatcccatataaataacaaacatcatataaaaaaaaatcctcactaatttcccctggcccctctctctccacaacaaagtttgtgagcacgtgcttaacagattttagtggctcgctaaagacatttgaccatcacctgagtgtgcatatcttgcgaaaacggtacacataacaaataaacaaagcacgtcaggttcggtacccagctaacgctaggtttccgcatcaaggcccacaaagaaaccgtcctgagaggcgacacaagtactgtgccggtctccatttcccaacggcaatggtgcaagccgtgtcgactggcctttctggcctatcatggtagaaaccccatgccgacacgatttgcacacagtgacacagggaatcaccacgtacggaagctcatgagatcactagctcaagtaggtattatgtgagaataacatgcaaacacttgcacgagccaatgaaccatcaccccaaaagaacaaattattaacaaggcaagcctattgacataaagatgtaactatcaaatcatcctggctgctttagttcagtatcatcatagaacaaaccaagcaagcaaagcctaattaaccgcagtattttattcgtactacagtgaagaatttttttaatctgtgcaaaaagggtcagaggtaaaatactttaggagcattatttttttactctgatgcaatgtctgcccgcacatgttaaacaaagcttcaaggtctcaaattcatagctacatgtacttaaatgcgtgcaaatgcaatgcgactgctgattgctgtggaagtgtcggttcatccaccagcacaacagcatggcctcagatcaagatctgttgaaggtggaaatttcgacctgttctaaatttatgggtttaagtaggggaccgaaaatagaggggcagagctcttaccggtttgactccgcttcatccaattctggcagatggaatttcctcgtggcgcgcctaagatcaatcaatccagcacatatggtaataccggctgatcaaatggagaaaaccaaatgacaaaaacaggttagcgtgtaaaagagcatgggaatgtaggattacaggtaaaagttacaattgtggtagcaggagaaccaagggtaaacctaggagaagtctaacagatggaagcatgcactcctgcaccaagatggcaagatctaagatgaaggtatgaagcatcattgacataggtaggccagacgtgtgtctccactgtttcttcaagtaccaacatgccaatcaacagataaaaggaaatggcaatcggagatcttggggaaaatccattaaggccaactgcatctgaatatgattacatgaatacttccaaggctagatcttgcaagacagtatcattgtcattgttagtacgtactaccaacagatcctcttgttattgtgctacatcatttggtcacaggattcacagccacgcaacgagagagtgtcatatcaaattatcaacatcatccactactccttagtcaaatatgttgagtataagctccttatcagcaattcggtagtggattgtgatcaggtcaagctcacaacagatttcccttaaaaggttattttgttgaccatgagccaaatatcaactccttgatggtttcatggatcctgacaagaaacaagtaattcagataggtacccctgaacttacaaatatcatcattagcaattaagtgtggaaatcatgagatgagcacgtgctaaaccaagaaatgagtgtatagtatggacatctacatcatgtcatatcagtgtctaaggagaaaaaaaaacagatgtcctatttgtgtcataaagcaagtgaatggagaaaaactgtgatccttaatattcggcacaaaagggaattatgtactaattgttgcaacaaccaataatgtttggttccatgagaataaaagaaacgattgaaagaactggccaatatatccctgttatcaagacaaacatatgccatggaacatagtagtatataaagctatcctaaaaatacaccaaaaggtctttgcaacggggtaactaaaactagttaacttagcctcacatttttaaatagctttggatcctaagacatcaaatttcttcgcaactgttatgctaaatacctgtaattcaggctagtatttcagattgataaggccagaaaaaagggaaacataaaaaacagatcatcaagccaagtacagcaatacttacccgtggaagaagccaatagttgtggacagcttgtctgacagttccatctccatggtagttgaggtcatcctgtcctagcctaccacatctacaaagtctatggtgttggaccagcattaaccaacgctgtaaactggattatactgttttttctgaggtgattattcctgtttcctaccaattgatgggatgaattttgcactgtgcaagctggtgtcagttttcagtggcagatcatgcaggaccttttcttagagtaatacatgatagtattcatccaggctcccagcagttcagatttcagaaatggcacatgaatattaactcagagctcagaatcactaagaaaagcaaaaccatgaaaactatacaggctgtcttattctctatccatctcattggaaactaagcagaaccgtgaaaattatatggactgtcctaagaaatatccatctcaatagaagttacaagttccgaaacttcctcattactattgcatacatgcagtttgcttctgttagcatcaacccaactcattccaggttcctttttcacctttctcgattccatcagccttctaatctctaaagcatcttcccatcgtcctactgttctgtacacattttcaagaagaatgtagctcaaatgatactgcggttccaattccatcattttctttgaaaccctttctgctacatctgggttagaatgtgttgcagaagcaccaaggatatcggcccacaaagaagaatcattcctaaaaggtgacttgtttatcaaatcttcagcctcttcaagaagctctactctgctgaaaaggtcaaccatacaattgtagtgttcaattccaggggcaatgccatagtccttgcacatagagttaaagtagtttcttccttgctcaaccattccagtatgactacaggcaaaaagaacaccaataaaactgatatagtcaggcctgggcccttccctgaccatccgattgaacaaattgatagctcgttcaccatggccattctgcgcgaaaccacctatcatggcattccaagtaattgtgttacggacagtgcttgcttcaaaaacactatatgcatagtccactgcgccacattttgcatataggtccacaagtgcagattcaacaaccacatctctccaccctgccatcctcagaaaccgacaatggatctctttacctggctttactgaagataggccagcacatgcccgcagaacagtccccaagctataccagtcaccgtcctccttatccatctccctgaacaatgcaatgaccttctcgtactccccattctggcaataccctccgagcagcgcgcaccgtgaaacttcattcctaacttgcatcctgtcaaacaccttgcgagcctccaccatcaacccacacttggcgtacatgtccagcgtactgctttccacgatcacattcccacacagaccacgggtcaccacctgagcatgtgcctgcctcccctgactccccctcttcgagttccccagtgctgtcatcatcgaaccaaaagtgcagccatctggcctaaccccattcatcattagcatagatcggaaccacctcacggcctcctcaaaccaatcattccgcacaaatgcggatatcaacgacgtgtagcatatcccgtccggtgcacgcatttcctcgaacaccttccgcgcgtcaccgggcgcggccacatgaccgtacatgtcgaccagagagcttagcacgacgccatcgtcgccgaatccccgaacgaggacgctcccgtggaggcacgcgccggcattgcggtcccggagcacggcgcaggccttgacggcggcggagagcgcgtgggcgttgggcgagacgtcgtcgtcggcgccggcgagcatgtccctgagggaggcgagcgcgcggcggggcatccccgcgcggaggaacgcggcgaggatcgacgagtgcgcgacgacgtcgcggcggggcaggtcgtcgaacgccctgagcgcgtgcgggaggtggcgcgggaggcggacgtagaaggcgaggagggcgttggcgaggtaccggtccgcgaggaggcccgcccgggccgcgcggccgtggaggcagcagccgaggcgcggtggcgggtggcggaggagcacggcggcgagggagaccggggacggggaggaggaggaggagggccccgctcctgccgccgccaggcgcgccgcggccgcgaggtccccggagtcaaggaggcggaggacggcgaggtgcgccggcgcggacgggggcatcgtggcccgaggatgccgcggcgcgggcgcgagagtggcgcgccgcgcgcgccgtcgccccttctccgagtccgagcttggcgtcgcgtcgaatgcccgtgtgcgcaaagggtttcctttccgtgaggagacctttttgtggcggcccatgggccatgtttgcacttagcccacgtcttccctcttttttgtaaggcccaagcccgttggattttcggcccacatcacccgttaaacaatggtaatttttagcaaaaggcgaagttattgtaagccactttagcatgaagaattcaatttctaagattatcaaatgaagcatcccatgataatcatcacatagtatataagtaagattgtaacattaggtaaaacatcataatggtgtttgaaatagcttcgtagatagtactgcaagaacgctaatgatcccttttactagtaaacacgagtacacaacatagttgacactaagacgcgtatatatcaacgttactatagttaacttcatcgaattacttaaacttaatgactttagcagattaactgccttattaattaacttagctactactataacgataatatgcatattgtgcgtgcaaagcatttcgacaagtactaagataacaaaggacacgtacgtacgcgcgtgcacaccatacgataaaaaacccaagcgatctactcctcatgaaccttgctcttctcacacgcatcctcctccttgtcctccggcgcttcctcctcctcgccggccgccgccgccgccgcctccgccgtctcctgatgctcagcagccaccggcgcagcgacgacgacatcctcgtgagcctgatcatcgtcgtcgtcgtcgttgacggggacgatcgccgccttggacgccgctttctcggtcgtcttctttgcctgcacacggcgtcgtcctcctcctccttcttcctcgggctccgcctccttcgcgtcagcagcagcaggaggggtctcgacggcgagcttggcttctacctcatgcgcgatatcatggccgccgccgtcgccgtcgccgtcgccgtctgcggtgtcgtcaacgacgacggtgatggcggcggcttcctgctccttggtgatcacgacgatctcctgttccttggagttggggccgccattgttgtgcagctcgtcctctgcaactgcaagaggtgctccttcttcttcctctcctgctaccttggtgttgggcgtgtcgtggacgtcgcggccgttgttgtcgtcgtgcacggcggctgctggaaccacttgctgaacctacacatcgacaggaaattaggagatggaatttcacgtgattttgctagggacatttcaatcagtggcggacacacccgttgggcagggtgagtcggccggcccaactatggtccgtgtcgccccacacccctaaacctcattttagtcctatttctaacatattagtcatcagtatactgttgaattaataatcagataaatcaagtattttaagtagggacaaaaacttttatgaaaattcgtgtataagtaataccattgtgaccgtttatgattttggccatacataaaatttaattttctttctatttctttagcatataatacagtcaacagtaaatagttaaattggtaaatatataaaaaaatccattttactcacttgaactattttggcgaagcacttaaacccctaaataatttttcatcttgtttcatacccccaaactattgaaattggttccctttgttgtctaaccacatttctcattttttttcatctctctacatacaagtcatatacgtttgttcgactacccatattcgttgttaactttctcgatgttcgtgccatacgctattgcgccaatgtcgtgaaccattgactatggtttgtgtgcgttgtgctatcacttaattagggctagctctgttgccccatctatattttaaagctgcttctgccacttatttcaattccggcattaacagaggccggtgttgacgtgttgttctcttacagagttctggccggataactgttctaatttcttctcactagttaactgagtaatataccccttttccttttttcccgaaaagattttttttcatgttccaaataatgacctaatttaaagacaaaacaggtatgatacatctagcttttttgactgacatatatatgttcgtgattggcacgcatgtaatatcatgtatgctgattgctgacagtaaaaaggaaaatttagggaagagatattcaaacctcagcggttgccattgtgcagctgcaaaatttagtgctaatgtgtgtgaggaacaagagcagtaggtcgaagtaggctagctggctaagattgctctgatacgcaaagtgcatttgccacggttcccttttatagctggtgagagggcgatgaggaagtactaaattaggctcccaaatgatggatcaatcaataatcgatcaaagagctgatctagttagctagagagatcagctcatgacttgttggatcgatcgagtttgggaggaggagatcagaggagttgggatgatgaacgcctgctgcctctgtctcactgatggcactgaggtcaagtcccgaatgccgggaggtgtgtcctgccaggaggcgacatggggatccaactcgggatcagattcagatcatatattcagatcggagccgccattcagacgccacgtactacatacctgcctactcacccatctcggcgaggccacagctgcatgccggcgtcgatccgatgcgcatgatgcaccggcgcgccattttgaggccggcctcgtgctacgcggtgtcgggaatgtacgaggcagctagcgcctttcgttggctctcccaacccaatgcacatgccaggacgtcgtcgtcgtcgatcgcctacctctccgcccgcacaccgccgccgctttgggcaattggcagccgcgcgaggatactgccgtgcagggctaaatatttcgattttggcatttgtatcgggtgtgccgatatactgaaattttaaaaatttcggtccgaaattatttgaatgttaaacaaaatctatcaaatttgaataaaagattaccaaattaacaaataaagaattagacatttcagccgaaatgatatcgtattggaggtccgatagaaccaaaatttcggaaatctcgctctggaatttcgaaccatactgccatgtcgccccacgcccttgtacgggccaggaacaggtggacctccaatagaagagaacagaaataaagattttaggtgcattggaaatttcggaaaactttggcccggagtttttgatattttttttcttaacaagctttggcaagcttgaataagttgtgctaagtagaaaaacacaaaacatagcttttcggtcaaaatatttccccattttctttgttaaatttgggtcaccttgaataagtttcgccaagtaggaaaacacacagacacacgaagattttttttttatcgaaatagtttcccaatttacctccaaatattcagtcgcttatggctcagattgtatcaagatttatatatcacatgaatcttacctttctctagcccctctcctccccacaacacatgtgaggcgagccccctctccgcctgtggccccactaacactggtgaggccttcacaaataaatcttttgtcttttcatgatgtctacttgtggtaagaacttcaccaaatccattagatttagatcatgccaagtattcttttgaaaaaaacttcagagctctttcgaattatcgaatgaaccttatggctcagattgtatcaagatttaatatatcacatgaaccttacctttctctagcccctctcttcggtttcttcggtttaccagaatctcggtttctcaaaactggcagccaaattacccttttaaaaaataaaaaccgaggaaaatcgagaatgcttgatgtcaggcgcccagcgcggggggagccggatcgggcgctccccccgtgcccctccctccacgggcctatacagggcccactcacttctctctccccttttttcacaaaaatgtttcatctattgtatttgcaatgtttcactatttataaatctaatgttgcagtgaattaaaatactcttttgcaacaaaaaacctacatattttagaaactctctattacgggaatttggtttattttttgttccaccaaaaatgtttcacccactgtactcacaatgtttcattatgtatagatctaatgttgcagtgaacgaaacattctattgcaacaaaaaacccacatattttggaaaccccctattaagggaatttggtttattttttgtttaaccgaaaaatgtttcacccagtgtactcacaatgtttcactatgtatagatctaatgttgcagtgaattgaaacattctttcgttatttactaaaacattgtttttatataaggtgaaacaacacccgatttaaacgagtgaaacattttcaatctacttagtgaaacaattccaatatacctagtggaacattgtgcaaacaattttaaaataatacaataataagctaaaaaaaattcgtcggaatatatccatgtgtggtcttgttttgaagatttaattgtaacgagtttaatggtacaatcggattatgatttggacaaataatttaagaaaaaaatcagtttaaaataattttgcacgtaaatcgggcgctgacgtcaatttttgaagttttcgatcggatgaccgatccctagtcactcccgaggaaaataaaccaaaaacaattcgatgcggtttattcggttaccggtatacaccgaagttgattttgatccattcatcagttcatatcgcactaggagatttagccaggaagcaacaacagtgacgttgttcgtgaacgtagtccttcccatggcaataccaatacatggcttaattgccatcggacaacaaaaagaaaaagaaatcaacagcaaagactagaaacgccaaatcaaagactactcaaagcatgtgcttgccggtgagattgctcgatcgccaagacttctgtcccaagcagtggtatccatctgattaattagagccgccgcggtgattcactggtggagactggagaccaacggggatgcttcgtatcatacgagtcgtcgtatgcaacgagcgcgttcggcacttcgtcgctgatacgcgatcagccgcgcgcgcgcggaggcgcgcggtcagtcaccccctctagtctctcctaggtacggtatacatcttttgtgtgtgtgtacgaatatattttaatgcataaaaaatatatacacacatacacaaagtttgtatgcgcgtatagaaagttctatacgtacgaatacaaacttggtatatatgcgaatacaaactttgtatttatacatcttaaaaaaaaagagaaaaaaccgaaagaagataaaccgggaaaaaacaaaccgaccagaaaaaaccggagaaaaaaatccaaacagaaaagaaaaaaccggagaaaaaaacaaaacaaacataaacgaaaaaaaagggaaaaaacaaaaaaaaacgaaaaactcgctcgcggcgcgtcgccgccccctctccgcgcgcgacacgtgtccagtcgcgtggggagggaggcgcgcgactgatcgcccaatagcaatctcgccatggccagtgcggcagtgcgtctagcggcgcaagggttaggagcaacaggggtaagagtggagtaacaaaggactggatggataaggtaaagttgggccttatgagtgtatgttgggccatgggttcacaggagaaaacaaatgagtacttgtctgctcggttttggtgtgtacggttttcggccttcggtttttgaccttaaaaaaaagagaaaatcaaaggccgaaaaaaccgataatttggtgtggttcggccttcaattttaggtattttttcccacccctattccccacaacacgtgtgaggcgagctcctcacaaagcactgccacctccgcctccccgatcgagcgctccacctgtggtcccactaacactgctaaggctttcacaaaataaaccttttgtctttttatgatgtctacttgtggcaagaacttcaccaaaaccattagatttagatcatgccaagtattcttttgaaaaaacttcagagctctttcgaattatcgaattcgaaatggatgaacaagaaaaacatataaatagattgccacattttttttagataatgaatagattaccacatgctatggctatgcatgtactacatgattttaaaacaaagaaatacaagaaataatgtttgaatgattcaccggcctgtggaaacagagagaagaaatctagggaattgaacgttggacttatagcaaagaaaagtaaaataagaggcatgagctcacgctagaattattgtagaatgaggatacaggaaagcaattattaggcctgttcctttattcgaaaggatgtcatacggtttttgcagaagattttagtccttcgaaaatcctatgtttttcctctgttctaaagagccctcaaaatgtggcaaattaatgtgaaaaatctttggcagttatgatcaccatcagacagcattgctgtgtttctacctgcctgacaaagtgaccaccatcatggtgtgttaactaactgctagcccctgctagaagttggcagtgtgtgagacaatctagccatgaaagaaggttaaaaacccataaaaacttggggatcatggcaagagcagtagcctaacaaacactagtattcaatcacccagttccaagaatgcgttacagggaaggccatcataatgcatgacaagttcctcaccggccttgcaaatatatattactagctgttagctagattagccctgttaattagatgctcatataaatatggtgaaacctgcatgcagaaacctttgcttctcagttttgacacacaaacagtatgacacctctgttacaaattaccatgtcttctctgatcatcactagctggtggtggctacaggctacttgtactgctcgccaattagtcttcgatgtcagagacttcggcgctgtcgccgacggacagacagataattccaaggtaattaatcgctgcaacttggttactaatttgctcaaattgttcaaatcaaatctgaattgtcaacattttgaaagatttcattaattttgtgttttttttttgtgtaggcgtttgagagggcgtgggcgaaggcgtgcgcggcgccggggagggcggcggtcgtcgtgcccgccgccggcggcggcggcggtggcggcggtggctacctgctccacccggtggtgttccggggaccctgcaaggggttcgtcgaggtgcgggtcgccggcgtcgtccgcgcgccggccggcctcgacgcgttccgggggtatcacgagtggatcaacttcgccggcatcgacggcctgctcgtcaccggcggcggcacgttcgacggccgcggcgcgtcgtcgtggcacctcaatgactgtccctggaaaccggactgcgtgcctcctccctcagtaagttttgaagttacgcggtgccgggtgtcgaaaattcaatctgaacaatgcaataagaacctcgtgtttcaaacaggttttgacggatcatataagtacacaatgaaattatcatgtacgtgtaaatttttttcttttcaaattatattaaaatggattatttgctttatgcttcaaaaaatatatttttttaaaataaaactttcttctattgtattacttacaacacttgttttattatttatgaaaaaaattaatttatctttatggtgtagataatccataacaacgatccgctgaataaatcagacaagacgcgcgcactcactcacacaccacatatatggttttatttatttttctttcgagtattgtgagcgtttggcttaaaatatttttttttatgactcaaatttactatgtgtgtgcttagtccatcaagctggggagcgtgaggaacgcgaccatcacgggtgtgacgtcactggacagcaagttcttccacgtcaccatcgtcgggagccacgacgtggaggtgagccacgtcagcatccgggccccgcgcgacagccccaacacggacggcgtccacatccagggctccacgggcgtccggatcaccgacacggcggtcgccaccggcgacgactgcgtctccgtcggccccggcagcgccgacgtgacggtgtccggcgtgtcgtgcggccccgggcacggcatcagcgtggggagcctcggccggagccccggcgaggccgacgtgcggcggctgcgcgtgtccaactgcaccatcgccggcacggccaacggcgtgcggatcaagacgtggcgcggcggccagcggagctccgccgccgccgcggccgccgccgccgtttccggcctcgtcttcgaggacatcgtcatgaggagagtccgcaaccccatcatcatcgaccaggagtactgcccctatctctcctgccaccatcaatcggtcagagcacacacacaaagatctttttaaatactccctccgtttcatgttataaacgttttgactttggttaaaatcaaactattttaattttgacttagtttgtaggaaaaaaatagtaaaattttcgacccaaaaaaatttagtatggaaatatatttaattattgatttaatgaaactaatttaatattataaatattactatacttatctataaatttagttaaatttgaaacaatttgacttcgactaaagtcaaaataacctgaaatggagggagtaaatcttaagtttttgtctatggctgggctcaccggaggaattcattgacatgcacaggagcggcggccgtcggtggtgaggatcagcgacgtgaagttcaggaacatcaggggggtgtcggcgacgcaggtggcggtgaagctgtcgtgcagcgcggcgagcccgtgccgaggggtggagctcagggacatcgacctcagatacgtcaggcgaggggtggccaccgtgtcgcggtgcgccaacgtcgccggaggcgtcgccggcgggacgcttgtgccgcccccttgcatatgaaaatctgttttctgtttttttttcttttttcactttcttgttttctttctatatagcgtacagtcacagagagttggcgtggacgaaattttggttcttgtaaacgaccgatgacgagattgatccttaattatggggacatcttgttctcccctgtaatggaacatatgaagtactccatccatcttaaaaaacgaaccaaaaacataacatattgggttggttttttaatgacgaagggattttgctattcccctcaccttctgttttttcttgacaaatctgcattgatgttctcaacagtgtcatggaaatatatcatatgtgcacataagctttgggtgtactcactgttcacaccaataaataaatatcacaagaattctataaattcctacataatttttttaacatagtgtacatataattttataaaattatgtacttttaacataacatgcacgtacatataaagttttcacttcagatacattatacatattgtacaaagtaggggaaaaatgattagtacccccatctgtcaaaaaagatctattcctagatccccgaggcaagtttagtattaacgtgaaattaccaaagtaccatccttaactgcattcatccatcaacactgccattctctgcacacacattaaaattgagttgcatttgcccaagaaaagattacatttgccgttagaaagggaacaacctacaagaactacaccaagaacaaagaacagagaagaaccaagaatagaggggaaaaaatggaatcaagttcttgaatcagatctgccacatataggcttgcaaactttcaccttcacctcctgcatcacaacaatatgcccctaccatcgccgccgcatccatccgccaccgcatccatctcccattgttgccgctgcatcgatctgccaccgtcgtcaccgcggcatcgatctgccaccgtcgtcaccacggcattgatctgccaccgccttcaccgccaccatcatcgccgcatccatctcctgtcgtcgccgccatccctgcagagaggagtggaaagaggggcaaatttgaagggagagattgagttgaacaactgaggaggcagagggagagagaagccaaatgagagggaggggaaaagattgccgtgtgaaccggagaaaagaaaagttgaggccctctgactccttctcgagcacccatgcggtattgaatgtgtatcttttttttacaggaattagttttttgggacaaccacaccccaccccaggaatcgatttttttgcggacagagagagtagtatactagtatgggaagtaattgtacaatttttaaaataatttttaatagttgattgtatagcgagatcatccaaaactttatatgtataagttgtgtttttgttgtcggccctagttttctgaaagttgcaaagagttctaataacttattcattgatatttccttaacatcaacttttcatactagaatgctaacgatcttcatcccccaatttgaattccagcacatcttcaaggtccggaggccacaagagatctacaccctacaacacatttattaatagtgcgaaattgaaccgagtctttttttctctaaaactaaaatcaggtataaattgaaatagcatgctataaatacaatctttaaataccaatttgcataaattgatgagccacaccttttgagtggactgaaactaagattaggcaacatggggacgccaacagacgaaattcctctgaagtaaagtaaaaaaaaacgtggatccctgataggtggacctcaccttcatgaacgtcagtggctcatatccctctaacgtatgtaagaggagcctcttccgatatggggaaccatagcaatgctcaaccgccagccaaccaagccatggcctgaaaatagcaaaaggccaacacatgcctgcatgccacagacatagcaaaatcttgttgtcgccaccaccactatatatatgtgcatgccggccggcgttcaagttcgccggagagagaagcaccggcggtcaataattaaaaaaaaagaaaaaaatggctttcagaaaccatgacgctgccatggtcctcttcttcttcctcctcatggtgactacctacgccaacgcgcacggacacagcaagaagcccgaggagatcactcagggcgtttacggggcggcggcggcggtggcggccggccccggcggcacgttcgacatcaccaagctcggcgccgtcggcaacggcagggcggacagcaccggcgcggtgatggcggcgtggaggtcggcgtgcgccggcgccgggaagcagacgatcctgatccccaagggggatttcatgacgggggcgatggagctcaggggcccctgcaatggcgccgtgaccatccagctcgacggcaacctgctgggctccaacgacctcagcaagtacccgggcaagaagatgcccaactgggtcgaggtccgccatgtcgacaacttcgtcatctccggcaagggcaagctcgacggccagggccccggcgtctggagcaagaactcctgcgccaagaactacaactgcaagctcctccccaacgtacgtgttacaccatgcatatggatcaatagatcatgaaacatataataggccttgtcttttctgatcatgatacacatttcggttacctcggtttccattagcacactttttaaattgctaaacggtactccctctgtttcagattatacgtcgttttgactttggacaaagtcaaactgctctaagtttaaccaagtttatagaaaaaaaaagtagtagcattttcaactcaggacaaatatattatgaaaatatattcaattattgatttaatgaaactaatttagtattataaatattgttatatttgtctataaactcaatcaaatttaaagtagtttggctttgaccaaagtcaaaacgacttataatctgaaattgagggagtaatatatttttcgtacgaaaactttcgaatattgacgttgctttaaaataccaggtaaagccattttaaaactcaattaatcatgcgctaatgatttctcattttacgtgcccttgaaccatttttggtgcgtttgatggatgcagacgctggtgctgaacacggtgaacgacggggtggtgagcgggatcacgctgctgaacgccaagttcttccacatgaacatctaccggtgcaaggacataaagatcagcggcgtgaccatcaacgccccgggggacagccccaacaccgacggcatccacatgggcgactcctccaagatcaccatcgccgccaccaccatcggcaccggcgacgactgcatctccatcggccccggcaccgacggcgtcaacatcaccggcgtcacctgcggccccggccacggcatcagcatcggcagcctcggccggtacaaggacgagcgggacgtccgggacgtctccgtcacccgctgcgtcctccgcaagaccaccaatggcctccggatcaagtcgtacgaggactccgtgtcgccggtgaccgtgtccaaggtgtcctacgacggcgtcgtcatggaccacgtcgacaaccccatcatcatcgaccagaagtactgccccaacagcatctgcaccagcaagggcgactccaaggtgtccgtcagggacgtcaccttcaggaacatcaccgggtcgtccaacacgccggcggtcgtccagctgctctgctccggcaagctgccgtgcagcggcgtcgcgatgcaggacgtcagggtgctgtacggcggcagcgacaagaagaccacggccgtctgcgaccacgcgctggggaagtccaccgggtgcctcaaggagctcgcttgcctctaatggattattaattcgatcatcatcgatctctttgtgtgtgttcatcgtgtttaagagacagatcgaggtttggagagcatatggatgtatccgcgtgtgttccttgattttgatcttccaagttaatgtccatatcctttctttctgtaaaattaagacccaaagctgcctcctcgattcgccacgtcatcaacattatatcagccgttagattctctgtaggtctctggattgacggttcggtaatattaggccatcgcattctactcatgcgcctctcataaatccttccttctgttggcccaagcccatagcaatagtctatgatcaaagcgatcatcgctccttctccgtatttattgccgcttcagcttggcctcctttcaccaacggaggaattacgagtaataaaaagaattataagctaccaaaggaggaattacgagcaataaaagagatagtacatgaagggtcatcccaaatgatttatactactccctcttaagtttcatccgcgatttaaccataatcggtcacaacccatggtctttcatctcgtcggacagcgtaatgcaagaagcacaccagccatggatgatgggggtgaaaacggagcggatattatccgatccgatccgctccgaatccgatcggagtaaggatacggtaagagtttttagatatccgtcggatacggatgcggatgtggtatcatcgatatccgacggatgcggattatccgattttttaattggattatccgatagacgattggcggataatctgcatatttcaggccacacaactacacaattgagcctattttacatcggccggcctatctagcccatttctgttaacctaaaccctcaatcttctgatctcttcacctcctatccagctatccctatccctttgattaatcccttcggctctcccactcacgtgcgccggcgccgccacaggcccgtccactgtcgatcgactaccatccaccgtcactattgttttgccatcatgttcagatgttgttttgccatcgtattgctgcttattgtattgttgtcctcttgttgtatggattgaatacaaacttaacatctgataattttgttccgtttccgaaccgaatccaacgttcgaaataatccgcttcgtatccgcatctgcacgtcatccgcacctgctcggcatccactttgaaaaaatggtatatgatatggtatgaccactatccatccgaatccgctccgttttcaccctaatggatgatcttataatttttcaggtttggagttttgtaatcattttcttcagtgcctctaagaaacacaggtctgctccccattcatatgctgcatgatcttcttctttcctgattttttatttcaaatactctttcccgtgtagtatttgttcctattatggtttggtgctgctaaatccatctctcgtaatatgtacgattcggataacttttttgttatttgatttatcatcattatcctgattgttgcatacatatgatatataacatatgtttgatctctcgataaagaaaatgacattttccgaccacgggaggaaggagaggagatattaggaccagaatatccctatctcagtgttattggagcacttatataccttgcaaatagtaccaggccagatattgcaattgcgataaatctattggcaagatatagtgctgctccaactaagcgtcattggaccggaggaaaacaaatcctcaggtacctaaatggcattaaggatcttggcttattctttcagaaaactgttgatcctagcttgtacctatcctagcttggttgggtacactgatgctggctacatgtctgatccccacaacgccagattacaaacaagttttgtattcctccatggaggaacggccatattgtggaagtcatctaaacaaacattagtggctacctccacaaatcattctgaaatcaccgcattgtttgaggcatcacgtgaatgcgtgtggctccgcaggatgataaaccacattgaacaatcttgtggtattggttcctcagaatcacctaccattatctatgaagacaatgctgcttgtatcacatagatgcaaacaggttacatcaagagcaatatcaccaagcatattgcccctaagttgttttatccccatgagcttcagcaaagtggagaaataaacatcttaccgacaaaatcttatgataatctgttagatatcttcactaaatccctacctacttcctcattcgagagatgtgttaagggaattggtatgaaactgctcagagacttgcaagcttcaggatgagactctctgaatgatggaccctgttaaaacgcttcacattgcttgtcccttctgcgatgcggcgcgcgcgggtcccgatctcacggttccccgtgggtgccgtgggtctcggcatgagtggctgcatctacgccagcgtcaacctcgagttccggggcctcccgctgtcccattctatccacgccgagcagttcctcgtcgtcaacgctgccgccgtggggaagtcgaagctttgcgccatcgccatctcccacatgccctgcggccactgccgccagttcctccaggagatccgcggcgctggtgggatccgcatcattgtcacctcctccgacgccaagtggcgcacggtgtcgtccctcctcccgcgtccctttgggccccatgatctcctccccaagcacgtccctctcgtcctcaaaccacacgacagccctctcgtcggcaaccccgctaccgctgtcatcaccaatggcttcgccaacggtgacctagaggcacgcttgagggaggcagcagaggcggccgcgcgggcggcgcacacgccatacagcgagtgcccgtctagattcgccgtggcggatggcgaaggtagggtgtacgccggaggatatgcctggagtccgcggcgtataatccgacactaggccccatgcaggcggccatcatagggatggtggccgctgggggcgccgccgccgccgaagacgtggtggcagcggcgcttgttgagaaggaagcggcgttggtgtcacaggaagcgatggccaggatcttcctggccgcggtggccccacaggccagctttcacgtgtacaattttggactgtccgatgcatgatgcgcatccctgatcctcgtggtgggtggggagggagggtaggaggtgagatttggaacgagataatgtttataaaacaaagatgttaagaataaaacgagaagaaaataacctttgtgtattagttggtggacgctgacatcagacccacttgttcagagtgattaatactcttctgttctcatgtgtatttaagtggaaaaataaaagaggatctaaattgccaatgtacaagtagaactgtactagagtgacgcatgcatttatcttggaagcaatttgtttgtctttcgccgtctcttgctagaagtttacatatttttttctgcatgaattacacaagataggctaataattatcatgagaaaaaatggctggacctatattgggacatgctgtggtcactactgattattcaatcatgcaagctggttcttctttcttacaagcctcaaacacacatcagtgatagctttatgaacttttctagtgtggctgaatttaaagtagtcagttgcccacggaataaagcaatggtggacatttaacctattctggacaagatattgcccctaaaaaatcatttagtcaaaaacaatgaaacctattcttctcttttaattagataatgcaagtgcaattacgaaattatggtcaagactgtctaatataagcattttcttgcgttattttcttggcaggaaatttcttgtgcatgccaaccttgatttatgctggccctcttgcttcttaaatgaagagtaccagggaaaacaacaatctagacatagaaaataaaaaagcacatagaaaagttgaaaaatcaacttttagtattctttaaaagaaaatcaacttttagtagttacatatccttcactccatctgacttcggagtactaagattaaaaaaaaagaaaaagaaaaactactgctgcttgcactccgcaggtcgctcaccctgctgtccagcaactctgctagccttccgttcaaaatagagggataacaatggagataaaagcatctaaagttctaataccccagtagaacaaacgacaattgaatgtcttatgcttcttcatcactatattcatcattattgtcatcctcttcttcatcatccacccaagaagctccataatcctcgtcttgaacagcctctctagtaaaccaagaaacagcgtgtggtataatcttatccctgagagtagatctggcaacatgggcaagctaatttataaccaggtaatatatacatgaagtatgttgttcataaataatttaaagaattgtgtgtttcagtatacatcatgcataataacacaatagtaatcgcttctcctttccaaaaataaaaaaaccaattctaatcggttaagaatgcaatggagcataatagcttacgcgatgtcataatctcgttccatttggttctgcaattcttcagcctgttaagaagcaacaaccaaaaaggccataagttgggcataatgttttaggaatcaatgtatatagaataattacttgttcaacttacggtattttcatctatttttgcatcatcatctggaacttgaggggggctaaagaaattaaagaagctctcacattcttcagtctttgttataggtttagtgctctctgaactctcctttgttagcacctcttgtgtcaaacaatatcctggatgccattcgatttcagtcctaaaaaataaagcagtcagggaataattcaaataggaaatgcaagagagatttttttcatcctaacaaatacacaaatttgcaggaacaaaatgatatatacccaattgctttctctaggatgggttcatcatcttcatcgatcatgtggtatgttttagtcagcacttgatttttaaagaagggatttgtatagaagaagaattcgaacttaaaaccctttggatcatcaattctacaccatttgatgtccttaaggtactttagagcttcctcatcgctctcatggatctgtggcagcggaaaaggaaaaaatattcattacaaaaatcatcagcactaagcaaatcgggacactgaacaaataaattagctcaagttctaatgacagcataaaaacattgataactttggaaagtgggaatttacaaactagaaaagcctctcacctcctcagcaagaatctcattgttcttcattgcattgagccagaaatctggaacacccttttcctctgcatggaagcatcgtgacaagattatagaaaaaactaaaagggtacccaatctatcaataacccaaaacgtgcccagaacacctatagtatgaacaagaatgatatatcacctctttcttcggtctcgccttgtacttcaagaacaccactcacaattttagaacgttggaaatttgcaagcacaaaaaaggtcactagaacagcacatcatattgaaaactcataaacataattcaagatatgtttcttagaggagagttgcctgtacataaaacatgcatctctttttgaaaagaaagataggtgaggtaaggccagattgcattacattgcaacaaaaagtatgtgttacctttgagtacaatggtccataaagcttctgatatttagcttctagagcagctttttcctcgaagaacttcacttctagttcatcatgttggctctgaaacatttaacatgttttagaaacttttaagtatgtggaataaagtttgtagcaaatataacacaatcaataacattaaaaggctaaggtaaaaaaaaatctatttacgaaatcaatggataccgctggcatacgagagcataatttgtaatttcttagagtatctttacttatactaattgggtacattttagaagctcttatgttaaccagaagctcttatgttaaccagaaatatctgaccattgattagacgggtcgtaaaattagaaccgtagatctacaatgatatttagcatggtgggctctaaagatttaattaacgtggtgggctaatcttccttccaaagcccatcaaaactacctccagctgtagtagtctatcacgcaaacggcagatcgaatacaatctagactccaccaacacgatcaagcggagagattaatgcagcatccacgccacaactccattgagatatcccctgctcgctatattttctcggtcaaaagactgattgcttatctcaatgagaaataattagaggaagctgtactaaaccaatatcgccaagcgtgctgtcaggccattggcacgtcgatgcaaccgcgcaaccccgcaagtctggtatagctttccaaatttgttagtgttctaatcatgaacactcgattgattaattatttgttgaacttgcctgctattgcaggagctttttggtgtactgttaaactactgctagcatataatttaataaaaagactaaattgtgactctaagatgaattaaaattccaggagattaaaattatagtgtttataatatcagtcctaacattacaggggctgatgattcgtgggtctcaaggaactcccgccttaattaatcagaatgacatagatcatctcaagtgtttgtgttaataaaacaagccataggtgatagcatggactctttagaaacattttccccaaaatatggcattattcacatattgatttcttaatttatccctttatatacctcagtatgagatatatcatttttataaatggggttaccgaaactaattctaaaggttacaaggttgaaaactcatgtctgtaaatattctttaatttttatttttgtttttaagatataagcacatgtattatccaggaggtatatacctcgtaacaaacaatattggcatgtataccctatatatatacttcccgagattcacgagattcaaaaaagtttcatcattgtcaatcataaatttatttatcttataatcagttcaatcaatttattctttaaggaggtacatacctctccaaggaaatataggagaacctctataagggtctttacttgggtacagttaatacgtgcacaacgctcagtatatcgtagtttaaataatcatacaattttaatatttagagcgtcattaaaaataacccgtgcaacgcacaggttggcgactagtagaagcaactatggataataaagtacggataataaaggataaagcatataatccaaccgttttatactcacgaacataacaatactaaaatatggataaggaaacctctggaaaagagggaattaaaccatgcaaaaacttgtagtcaatctcacgtttcattgacgatattgtcactatgtgcgccacaatgggtttgcataataaacagtacgatgaacgaaaatatgccgcgaattgaagctctctctagttttagcagttttgtctttacctgaatctccatgagcacatcgacgcgcttcctgaccgagggtgccaggctctcgagcacgtcaacatgttgctccgccaacgcctgcagcttgttctgcacaagcacatcactgaatcaacaaaacatcattgcacgatcgctccaattgaagcaatcatcacagcgagagaggaagaggttataccttgagcgtctccacgaggatagccttgtcctccgatgagagctctgcataagaaacccgccgccgcaaacagtaagccataaacccaatcacagaatcacccaaaaaaaacagcaagagcgcgacaaaaaagcgaagtaggggagaggcgaatgctcaccgatcccgttcatggtgctgcggtgggagatggtggcgatgatactctccggcgtgatgaggcggcaagttttcgagcaaggagaacttgggcttcggattaggcgagcaagacggggaggacggaagccgcggaaggtgatggtaatgtaggatcgaacaagaacaaacgaacctacaaaagtcgatatgcttctcacctcaacatatcatctatttatacccaaaaatctcctattcaagctaggagtagagctcctattttcaataggattcgcccctcgatttccaaaaccaaaattgggcccgtatctgttagcagcgttaattgaacccgttacatttgtttgttttgggtggcctggaatcgaatactccagatccgggcccagtacaaatccgttaccgctccaaatcgaatacggagcggaagtagcgcttgtgttgtcgtggctcgtgagtcttgtcgtgacctagcctaagcgccgccgccgccgcttcgccttctcctcacccaggcgggtcgccggcgccgctcgccctatcctgcgcgccccaccaccgctgttccccagcctcaccggtgttgctccctctccacgcgctggccaccaccgccgctccccgagccccgtgtcgacaccggagcttggccacctctccaggagtttcgtccatggattcgaccctacccagcggcttgacttcgccatcttcaacctcttcgttcatcgacatctcttcaaggaggtcccgctcccctagccgaagatcctgaggttctctcaccattttctcgtttccacggtcaagcactactccttgttggtgagaacccccgctgaaaccatctttttttttccaactctgcaacctctctgaaattttctaataacatcttgggccaatccattcttttaatcagtagtgctcaagatttgtgatgatatgctttaatttgatgcaattttcttgtgattgatcttgaagtaagaattaaggaaaaaggaaaaagaaaaaaaactacggccgcaaataaaaaataaatctgtccgatttcacaaaaataagaaacaaactcccgtccgtttccgtttgggccgaataagagttggtttgaattataccaagtcctattcggttagcatcatcaggagaacaaatgcatatatatatatatatatatatatatatatatatatatatatacatctctactacttaaaaaattaaaaaaaaaattccgtcggccgtaaaaagaaagtctgactcaaaataaaaagcaagaaaaaaaactacggtcacaaataaaaaaagaaaaaaaagtacagtccgttcaaagaaagggtctgtttagtttgatgctaaaaaaaaccttactaaattttagcattgtcgaaattttggcaactatgctaaaattttggcaggatttgttatatacttaccaaaatttggcagcagccactttttcggcaactttaccaaaatttagtaaggttgaaaatggcatcaaagtgaacaggcaaaaaaaacgtctgactcctttaaaataggaaaaacaaagtccggccgttaaaaaaagtccggctgctgttaaaaaaaaacttctcacgtcgactccctaaagaaaggaaaatattcgtccgtaaaaaaaaattgactcccataaaataagagataaaatttcgtccgtaaaaattttttttgactcccgtaagataagagatagagaacttctcacgtctgactttaaaaaaaagaaaacattgcttcatctgtaaaaaacaaaaaaagcccaactcccataaaaaataataaatgagaaaaaaaatccggttcgagaaaccatccaaactcaacacgagaaaataatataccacccgacacaacacgagaaaaaataaccgtcgtttgtaaaaaatggtttgaaaaaggtccgacttaatgcgagataaaaaaccactccaaaataaaccgttgaaaaatgttgtttgtaaaaaaggtgaatcggaaaaaactgactgaatccatgcgagaaaaaccggatcgaaaaaattgtccgactctacccaaaaaaaaaacaccgttattataaaaagtattgctccgaaaaaattgtccaacccaacgcaagaaaatacgtgcatttataaaaaaattcggttcggcaccgtgcaatgcgaaaaaaatttgtccaatttcagaaaaaaaatcctattccatgagaaagattcatatcatttgtatcatctaccacgttggtttggtttttccaaagcatttgttgaatatttttatgtgcggatgcatgggcttgggcttggttttatcggaacaagatcaaattgatctgaggcttgggtaggataggatcttttttttccatctcctatgtacatggcttgttgctcctgtactggtgaccccgcacgactctgtatgcaattatcagactactttgataagtatagctaatagtcttgatagcgtatcatataaaaataataataataaataatttttaattgttgttaagagaagagtgcacgatgactatattttgtctagacttgaccatgcgagacagtgtaggatttgattgatcctattattagttgcaagaatgagattaaaagagtatttcagattatatgtgtacaaccacataaataatacaactctttttggtaaagcatgcattggtaggttgccatcgttgaggttaaaccattatattgaagatgttccaattttccttagggtatgtcttagttacaacgatcgataccaacattatcatcgagatgattatacatgaaaagcgtatattgtaattgaaaatttttcacccattgcaatacacggacatttttactagtacatgcatatatatgcttcctggaccatgtcgacaagcacctgcagtacacatgtacaacacatacgtgcatactacatactacacactacagtacctcgagtactgtagcaaccatatgcttcgctccaattcttcttccaattttcttcgcaaacactaacgcttgcacacatacctcgtgaagtccgttgcaaagatctctcccacaccgttacacagtgtccattcaccgtgtgccatcttgtatccaacttcgtcacccggtattcttgactgtctggacctcaactcatccctgagtctagtcccgatccccatcgttggccgaagttgaccttcaagaatctagactctagttaccttctcacatgatatctcgaccgcactaaacctctgctcctccctaagcatagttctggtgctcaccattgaccaaaactgacctcaagtcacctgcacacaatcagacaaaacaaccgttctaagcacagatatcacaacatatgaacccaattagtcacacaaactcacaccaacatccacacatcttttcaaaccaattcattaattaaatcatttgcaaatcaaatttgtccatcacaaatattaattatgacgaaaaagggtgggggaagcgatagagcggacggcccaggtttcacgggagggagacgtggccgaacaggatgcgggttcgcgctcgtgtggagtttggacttgccccgctggtcgccgcgagtccgattcagacttcagggccgtgatcggctcctctgctctgtttttttttcttttttcacgggagaacttgtgctcgaaacttctcatgcccagttgcagagcgtcgtcccaggatattgccgttactgcttcagcatgcttgcacgaccgctcacatacatgtgtcgcgagattaacaggaaagcaacactagtcaatagaaaaaaaaaagaacatactgcgtgtcaagaaaactaacatatttgaaaggaaactactatttttttaatgaaatgacaattgacaagaagtttatttatggattaagacgatacaaaatcatcttatgcaacttcagcacatatttgacgtttttgacaagttatttataaataacacactaacactgctatcattaaatgaacattggaattgatcaacagattttcatgagcaaacgctagtaatattcagcctctgcccaattgtccttcttctagccgtgtactgtcatgatcagtctgtgatagctggatctggcggaagccccaggttcagtgtccccaactcataatatttatttttctttcacttttttctcaaacatggaaattttaaaacatgttttatcattacttaaatagcacactgtttaaagaattctatatttaggaattagcttggaaaatgttctctttaaagagcagtaagatcatgaaaaattgtttcatgcaacttaagtagagaggaaggaagttcggaatgttttctggcagcagcaacacaaatcattttaaagctattgacacagaaagtaaatgtaaaaataacatactaatagttttttcctaagtcaacaaggatttataccagtttcatcgatcctatagctatgagggtggccattttggatgaataaactactattgagtcgaatcagaaagaggatgtggatgctcaccaggataccctcccctgctctgcttgagatcggcagccgcgacgcgactcgtcttggcggcggcgcgaggagcggaggagacaacggggggcgcgctattacgattgatgcacctgcccgccgtctctcttcctctacagcttccccgcgtggacgacaccgacatccctttgccggcgctggggaggagaactgtgaatccgtcgatacttgggggcaatccgagcatttcaaaaaaaaatctcaccactttcatcccaaaaatgaaaaaaataatactttcggtgtgctactgccaattacacaacttttgcagtgtccatagacagtgtcacgtttttttttatccatcagccaattacatgttttttgtgtatcctattgtaaattttaccataatatttaatgaacttttcacctctggcgcatttccatcttttgtgtgcctagatttaatgaacttttcacctctgtttcaggttacaaaactttctagtattgcccacatttatatagatgttaatgaatctagtcacatatatgtgtgcctagattcataacatctatataaatatgagcaatactagaaagtcttataatatgaaacggaataagtattaccaagtttaaatctcaaaacatatgaaacgtcttaaatcagattgtaggtgataggagacgtctagtgctatcactgtacacaactactcagtaacacaatcctgctgtttcgtactaacacttctgcttcttctgtgaagatgaagcataaataggcccatttgacagaactgcctcaactggtgccactcattctccgttcaaaatgaaatgtcatcactcatccctgaatattcataaatattcttatgtatgaatacaaaagctaatagagtgtgaaagggcatgtaatctagtagttgcaatgacctgaatagcatcccaagatcctgagttcaaatatctatatgagcaaattttagattaagttatttgttgagggctaagtttcctgtttgataggctaagttcctaatttaaaaaggttgcatatatccggttggacgtaaagatcaggtaaaaaatacccttctctaaataaaacaatactcctagctaatagagtaatagctaccattttctttcctatttttctttttatttccctatatggatagagcgcatgcgcaagatgaatcataacttcttttcctgtactcagcagtgtagcaatgctagtcaataaagctaatttcacctttgaacgggaatggggaagcaatggagtagagaattacaggagaaggtggcagctgaggagagaatcaggagctgtcacaaagctatatacaagttgggaagctgaacgagaagagagcatatgcttccctcctacaggaagcattatgacttgttggtgctgttttacaaatctgggtgattatcggaagatcgtcatgcggtagcagctgcagcttcttctgcgacttgggatccctgttgcagagtgcagatgaggttgcgatccccgtacacattgtccacgcgacctggtaagagcacacagacacggcagaatacagattaggttggtgtcaaattgtgttgagcaaattaagagcgatcttttggagacacagaaagcaagcaagtaggtacatgttgttggccagaacttggcgccccgaagccacgctgcagggaacgcagcatactccctggagtacggcttagtccatgagtcgctcatcagaagttggggcgggtgaggagcactctgcacaacaacggaacaaaacaagaatcacatgtcaacatcctggtgatgcaagagctatgcagccgcctcatgtttgaacttttgagtttggaccatgctaatgtatctccaaaattgcatacagcatgaggactaggattgaacggggtctactaacatcttatataacctataagaattgggggtaagaacataattgcccgtatatagatagataggtgttacgaacttacaatctaatatatgaaaacagatagcggtatagtagtattttaccttgaggacgttgttgttcacatctgctttgccactttctatctctgcaatttcttccctgattgagattagagcatcacagaacctatctagttcggcctgcgagataattgatgtgacattaagctcatataaaagaatggttggtacaatgctaaggaatatagtatgtgttttagtgttttaccttgctttcactttcagttggttcaatcataagtgtgcctggaacaggccatgacatagtaggtgcatggaatccatagtccatcaaacgctttgcaacatcctctggctctataccagcagtcgtctgcaaaaggttgcgatatccaattaagaaaattgaaatgcataactcaaggtccaaatgccaaaataactatgatagataccttaaatcctcttaaatcaataatgaactcatgggcaacagttccattgactccacggaaaagaactgggtagtgtttctgtacaggtaacatggtaaaacttagaaaactagttcaaacacaatcaaactaggtagcaataggtgatcacgagtaacaaatatacctccagacgctttgtcatgtagtttgcattcaagattgcaatctttgaagcatcagtgagacccttagaacccatcatggctatgtatgtgtaggaaattggtagaatcaacgctgatccccatggggcagcagaaatggtaccaagagggtcggttttctcagggagagggaagccaccggtggtgatctgataattacagaattaatctagttaatgaagtagcatctgcttttttttgttaaaaagaatgatggaattatgaacgaacacttctggttttagtaccgaatgtggtttagtagttttatcatcaacaaaaacttctacagcatttttttacataatatcaccgtactatgcttttgatatgaaaaatgatgcaggcaagtcttgcttcaggagtttaggttaatataaaatgaaaataaggtgtcacttagcatacccacctaagctaatgtggcaccaagaaagcgagaaaataaaaccagcaatagttctcgagttgaaggagttaggattacaaggaaactagtttttaaaaatcaacacagcattgttgatgacatagagaaatgtatgtttgtgtggaatcctctgaaatatactcagtccaacacatcataaaagactagttatagagtgtaacatgatttcgtataatttgcctaattctgtaaaagagtaaagatggaatttttctaaggtcgtctagcattctgtgttatatcaatcttgtctaatatttcaaggtaagtgttgggcattgagcattaatctgtttagattatcagcacattgaattcagagcacctaccactggatgagatggtaaaaatggtgctaagtgcttcttaacaccaataggacccattccaggaccacccccaccatgtggaatgcagaatgtcttgtgaaggttaaggtggcaaacatctgctccaataaagccagggcttgtcaatccgacctgtaaaaagacaacttctgttagttagggagtgtattgaatatttttggctcgacagatggggttttttgaaattacgataacagaagttctcaattgggatcagatgaacttggagaaagcttatcatattttattgaagatagcatatctcagcataattaattggataagggtcattgaaagataaacatgcaaatgaaagttggtacttctgtgtttgtttcaaaacaaggtatacttgtgtttggaactgaattaaaatagacttgttacataaacatgtttagtataattcataggcacaactaattgtttttttaatcatcgccatgccaaaagccatctgtacgatttatagagcctcaccccaatgcgtt

SEQ ID NO: 42829 - DNA, 10788 bp, Oryza sativa
aaaaaaaccaggggcaccctttctcttttcagatttactaaagattactctgttttacaggtcattcaacctcacagcctactcaccatcttcccatattcttcctccctgaaataactaaccaacaaaccaaagctcactgattccaatcctcacaatgcttctatccaatctacctagtccttacctgaactatctcatccccaatagccatatacttatcccagataacaacatttgctgaacaaaagctgaataaaattgttacatactatgtctgctgctccacatcacaacctactttccatctttctcatttctctcttacccttaaactaaaggagcatccagtgctgaaaatacctaattcattccttcacctttctgaacaatgatataataagatcagacggttgatgctgcaggcaccataatctgcttacgtgcagcagcgcgtgcaaaactagttcagccatcacattctcaaggctcttgagggaagcatggccccttaaactacctaagccagctctagatcctgcgtgtgtacatacatgtgcaagatccactggaactgcatttagtctgtatacttaaacaatgatcaaaacaatctaaacctagaaaccaaaaaccttgtaacaattcaccacacatgacacaaccagaaaaaaattattgccaattcataatcacattatttatgccaatttagcttgtctacccatacgaaggttctgtcccagactaactctgcaaaccaaatatctgaatcatccaccgtaaactgaacacacatacaatactcagaactcaacatattatgtcgcaaaagttaattcgtgcaacacatcaacgatgccatgattaaatctacatttgccccaccactgacgcgactaaatctgcattcaccccgggaaaaaaaacagttaaccctaaacaatattctacaaccgaatcggaagtttcggaaccttaccgaggattggaggaggcgagcgatccgcttgcagttgcatcactttcgtctcacccctcggcgcactaccaaatgaggtaccacctgcgggcaccgctgctcctccaaccgtcgccccttgaagccgccgcatgtacatccgcccgcattgcaaagcgcgattagggcatcgcctcaaggatccacaagggcgattcgccgcaagctagcgatggaaatcggatgcacctacctagcaaacgcccgcggatgatgaggacgctccgctccgctccgccgtccatcgcctcctctctccctctctccgcgattcgatctcaccggcgccgtagcgcgcggggcggtggagagcgtgggatttctccgcgggtaatcccattggataaacatggcgcgtttgggtggttcggtcgccgcaccacgcaacgcgacgcagtgcgcgtgagcgtgcctaaccgtgtgcgactcggctcgacaaaaaaccaaaccaaaccgatcagatcgcattagaaaatctctccaccgcttgcaattgcaagctagctgcagtggtttagggccaaacatgctgcaagtgtgagtcgttgaccaaagaggacatcacattcggagtcagagatgggagaccgccagtgcaatgctagtcataaccacgatatcaaatgccaaggagttaaagaaatgatagtttgtgaacttgtgagttgtgatggaccgggacgatgagcatgggtgagctaggcattgtctctgcgcaagcactggtgtactgccgctgccagggtagatccaccgtccattgcagtggtccattgcctcaccctcacgccgacacttgtttcacagcgcgcaagtaattaacttgatccattcgagagagatgaggagagaaaacgaacaaggtttggttgatctggcactggggcaccgccaatccgatgttcgttccaccgactgtactacagtactagtatccggcagtctggctacgcggtatactactatacgtgtcattgtctactcaaccaagaaaaattcgctgacgatcgagaattgtgtcagtaacgccgccaagcagaagaacacccaaaatccatctatccaccaccactgggactggattcatcatcatcaattggaagaaatctcaaccaccgttgggccccagacgcacagacacacacaaacacatccgatcccgcggcggcagcagcaagcgcaattcccatcaaccgcaagtgcgtgccggccgaagatttggcgcacgcacactcaaaccccccactccactgcccccaaaacccaacccccaaccagccagaattaccacacacacgcaccgcacccgaaatcccaagaaacgcgcgtataaatcccaccggcttgaggagtcgactcgccgatccatccacccgcgcttcgtccattccatctttctctctctctcgcggaggtcggaggagccatggaggtgttctactacctcgtgttcgggggcctcgccgccgtggtggccgggctggagctcggcaagagcgccaaggaccgggtcaccacctcccaggccttcaactccttcaagaacaactacgtcctcgtctactccctcatgatgtgtatgtcattcttcgattcttggcgcattttcgtcctcccggatctgggattcatggctttcatcaatcttgtgcagccggggactggctgcaagggccgtacgtgtactacctctacagccagtacggcttcgacaagggcgacatcggccgcctcttcatcgccggcttcggatcctccatgctcttcggcaccatcgtcggatcactcgccgacaagcagtacgtttcttcttcatcgatttcctctccgattgtcacagattgtgccccgcgctgagactgacagaaaaatctgtgtgtttcagggggaggaagagggcgtgcatcacctactgcatcagctacatcctcagctgcatcaccaagcactcccccgagtacaagatcctcatgatcggccgcgtgctcggaggaatcgccacctcgctgctcttctcggcgttcgagtcatggctcgtcgcggagcacaacaaggtactggacgctcacacatttcaagattctaccttcaaaacattttgacggatttttagtacaatatgaattaaattttacttgctaaaagttatattattggattgatatttcaatttactttcatagggttataattttattactataaaccttataatatatgagaaattataagataaatattagttttgacgatcgtgtcaagtttgatcgtgtcttatattatgggataaagggagtaattagtattactgtaattatacgcagggccagatctgcttgtcagtgtcccccctcacactgatgctttgcagctgtgtctggtctgactttaactttaatccaaagtttcctctttttttttagttgtctatctagaagggcatgttctagtggtataaagaatacatatttggaatgttttaaccttaagtaactaaaattattcctatctttgttgtgaataaactattagagcgtcatttggattcattcacataatcacatccttgtcatccaagcgagctaggagcataggagtacttttattttgggatgtttgactacttactcaattaggcacataaaaaaaggattttcagtttgagattaggactacacagtaaaaggtcattttgtcaggatctgaaaagagaagactgaaatctagtactccttccgtcccattttgcaattatcggtttctatttcaatgtttatctgtccgtcttatttaaaaatttatgaaaaaaataaaaaaataagtcacgcataaagtactacatattttatcattcaataacaacaaaaaaaatattaatcataagaaaattttaaataagacgaatggtcaaacgttggacacagaaatatataactgcacttaggatgggacggaggcagtatggagtatagctagtagttctagtatagttgcaagctcatagccaccattttttgttttctttctggtcattgtgtcggtggatcagaataagatggttgcatcgtcacaaggataggcatttaacaagcatggcccatttaataaagctggagtatttaggatagcctcacactcactacaaattgtccttttattcggccatgtgccgtctcctatatggatattaatctcggacatattcaataattcattcaattatcaataagaatccaaggatccaggtacagtatctgttgcctgtgaggctgtgagtctgtgacacactactatgcagtgttcttcccgtgacaaaactgtcgttttgattaactaactaataaatggtccttgtcgtttgcaaacttctccaatgtattacagtcaatttcttatctgcgttatcaatttttcactgtaaagtttaaccttggcatttcctttcacagagaggttttgattcacaatggctgtcgatcacattctccaaggctatatttcttggcaatggcctggtcgcaattgtatccgggctatttgcaaacctgcttgccgacaacttgggctttggtcccgtggcaccatttgatgctgctgcatgcttcctggcaataggcatggctatcataatgtcttcatggagtgaaaactatggagacccatctgaaagcaaggatttgatgtcccagttcaaggttgcagccaaagcaattgcttcaggtatgcttaactcatcttattgattgacagataaacagatatgtatcaaagttgacaatcggcattctgacatcatccttgaaatctttagatgaaaaaattgcattactgggagccatacagtcattgtttgagggctcaatgtatactttcgtcttcctctggactccggcgttgagcccaaatgaagaagatattcctcatggcttcatatttgccacattcatgctgtcatcaatgttgggtagctcaattgctgcacgcttgttagcccgaaagctgaaggtcgaaggttatatgcagatcgtgtttacaatatcagccttcacccttttccttcctgttgtcaccaacgtaagaacactgcttatactgcctgtcaatttttctcttataattcagagcctaacatccgtttgctaaatgttgaacagattctagtgccaacttcttcagtgaaaggaggtagcatctcatttggaggcactctgcagctgcttggtttctgtacctttgaggcatgcgttggcatattctggccatcaatcatgaagatgagatctcaatatattcctgaggaggcaagaagcacaatcatgaatttcttccgcataccactgaacttgtttgtttgtgtggtgctttacaatgtaagtgaaagtgttcttactgaatctcatgattctaatctgttgatttccttcaaaaataacatttttttctgtgaattttgcaggtgaatgcattccctatcactgtcatgtttggcatgtgttctatcttcctcttcatggcggcaatcctgcagagacggctaatggttgtttctgacctacacaaatcatcgacaagtatgcatctttcttcattactccacatataaaaactaaaatcgctttgccaatcaatttctttgattcctaactgttggggttaacattttctgcagaagcacaagagatggttgatgaagatgagccactgaatccttaaggattgataggatcatacaaacagatcgaatataagcatgtggcatactgcaattcatttctaccgagctgctgaataagattggacgttgcagaaaagagcagttgtttttgtttgtaactttatttctgcaatgtcgattgaccattggctggtagttcacatctgtggagcaaatgtagtaggcacgagaggcaatacatagttcagcaagcattgagctatagccgagatataggctattcatgttgtcatttgttatttgttattgttattcaccagcatgacattgtatgaaattaaatgctacggatatcctaatcgaagttatattttacacgagagaaggccttctcagatatcgtgttgtttcctcgaaattattgtcccttacagacaatctcttgcagtctcttacatagtcacatctgtgatctggcgtacaggagttttcatacttgtacgcgtccaaacagacttgatccaacatcctcgtaccgggcactcacgactcgcgagataaatttgacttgatgatcagaagggattattgttcttgccgtaacatcaccctacagtaaagctcttgaatttatcacatcttatatgcctaaatctatgctgaatatacatgctagtctgccataaggtgaaatggttcatcacactgcatctcatagggaaatgaaaggaaaaggtcttgtatgcagcaccggattattatccgagccaaaaaggttcgaagctttaagaacatacaagtgataggtgaaatagttcatcacaatgcaactcataaggaaatgaaaggaaaagatcttgtttgctgcaccggattattggacgagccaaaaaagtcgaaagctttacgaacatacaagtaaaaactaggaaggaatataaatggtgggttgcacaagtataagaggatggccacatctcagaaatgcccacaaggaaaaggttcgaagctcaacagaagaacagttgtctgcctaacccaccaaccgaattgtaacatcagaatatgataagagttaacccaccaaaacattatactgaaagaggacaaaaagaactagccaactaggccaacatacagtataaaaagagcacatacgaaggaaaacagaagctggtggtgaaatacatgattcttccataacctaaagtttggtagttatcagctttatcaatagatccgttcaagaccaagaaaattggtgacagaaaacacatcaatttacagaataagaacaaagtacagtagtaacagaacaggataagactgcaatagatagaaaacatgaacattgtaatatgctatggtctggagaatacaaactaaaaaatccattcgtaagggaaaatacggtggaagtttgaactaaaatttggaccagtaacattcagatatcactgaacaagaaataatgtgctttcaacataaaccggcagcttacaaatgccaaacatcaagactggcagtgtgttttacagatgccaaacagaaaccttacaaattcctaatgaatatcttacattgaaacatcagagcataacaatcaccacgtaacatggcaatatagcatatcagtacttgatactagtacttagtactacctccatccccaaacatgagggattttgcctatgcagttacatagacaaattctcttatatttgggaacgcaggtagtagtcggtagtgtgacttgtaccaagagtcaaatgccaaacatgcaaacaaaaacattgttgtatagttgcaatagagcatcaaatgatataacaatatgcaaagatcatcaatatccattatacacaataaaatgcatgtggaagtccttgagaactacgggttcagacagacataaggatatatagttatacataggaagcaacattgggtataactaaatatctttatgtccatttgaccctgcaaccggaatgcattacttggtagaatgtaaatcgcagcacataatgaggatggcatccatagatagattagaaatgtgcaaacattagcctactcttttatggcatattgtttcatcgcaagtgaaacacacaccataataatctaggaaaactacactacaatgaacattacatttcacattgtcacggactcaccatcagcataacgtaaaagtatgtattattgtgttggtaccagctaactagctactcgagaagacgttacattgcaacataggccaaaaatttagtgatctgatccgatcatatcgattacatgtaacataacgctaaaatataatgtcgagaagaaaacccttctccaataataaattaaccaggagagcaaaacgaagaaatgacattccttttggcgaccaattgattcgaccatttcttatcacagcagagagaataccgtgcggacgaatcagagggcaggcacatatctcttcgccgcctgcttgcctgccatggcggcgccggcgaggaccccaccgatggcgcccgcgacggcggcggagcgcggcccgttggcggcgcggaagagcgcgccggtgccgagccccgcggtgacgctgttgatccagtcgtcgcggtcgcggacggcgaccatgccgctctcgatcccggcgtagagcaggccgatgaccccgagcgtgttccccatgcggcggccgttgctgccgcacgagttgaggacgcggttcgcccggatcttggcggtgtccccgggctcggcgttgcgcgcggcgtcgcggaggccgacggcggcgccggcgacggcgcccgagagggtagcctatgccggtgtagtaggtgaggttctcgccccaggagcggcgctgggcgagcgactcctcctggaagaggaactccggggaggtggggaggtcgtagagctgcttgtaggggatattcaggtcctggtaggggttgtacagccgcctgccggaggcgtccgtccggtcgtcgcgggtgccggatcccgacgagaacagccgcggatcagccatggcggcggcggcggagggcggcgtggagcggaagaaaggcagagaggaagaggaggagggtttcggcacggagctgactgcgcgtattccgcgtcggcctctttattattttacacaactttctggagccccaagccacttgcgtttgcgtgtgtgtgtgatgtgatattttcgcggtcgccgaccttgcgattcatgggccgcaattttgatggcccgggagttgattaggcgacccattaacccatcgaccaaagtggtggatgatggcccatcaaccgatcggcccatcacacactttagttgtgcttcgctggaggcaaacccaacacggcggaggcgaattgggcgcccgattcttttttcaaaaaaaaaattggacgttgtttcgttaagtagatcgaaaaatttttagttaatagattaaaaatgttttaatcttttaaaaagctgaaacacaaccaaatcactttataaaacattttgctacaatatatgaagcaacggtttccaaaaaatcggacgttgtttcaccttatataaaaacaatgtttcagtaaatagcgaaagaatatttcaattcttaaaaaaagcaaaaaacggtcagatcgctagatgaaataatttggttcaatatatgcaacaaacgtttaaagtcattgcaacacttaaatcctatatacataaaaaaacaaatcatatgtccatcaagataaaattattaaatagtataaaaatctactgtaatatttgatttatatataatgaaacatcgtcagttattttttttctcacccatcatgcgcccgacgaggaggattcgcgctacacggcagaggcgacagtaacatggactgtggtgtggtacacacacggtatgtcagagcaagtggttagccaaaagcagcaaactgttttgtatacaagggcgagctgcacgagctactgtctccatgagctagcattgcttggaactcccattcccatgtctcgaccataccaccactatagctaaggccgagtttagttttaaatttttttttaaaacttctaattttttcgtcacttacacagaaacatttaactttttcattatattgttccaattttaatcaaacaagtgaactaaacataccctaactaatcatcgcaaacacagctgctatagctatagacgaatacgataatctagcgaagaaaaacaaaagctcagatctctgaatccacgtgctcccctccactgacccacgtgctgcgtctgatgagcagcaccaccagcccactcccaactggagccaaacagacacaggtaaacacaaaccctttcgatccattcccgagttactaacactaacagtatatcattagttagtggctaacgatgcaatggaccacatgcttagtgcccactaagtactaatcctgccgttttacgagcacaaaccaaacccacacacgtctttacatgatgattttaggccggggattccggccgacacatggctcgatcgatcgagccgcgacatctctctctcggtcaattccgcccgttagcctccaacgatccaaaccgcctcgtcataaataggcaaagaaacgaacaaggaggtggcagagtgtgagcactggtcgcttgcttgtgctttgctttgctaggacgagaagaaaagaaaagcggcgagagctaagcgaggaaggatgcgtggggcgtcggcattggcatctctcgtcgccgcggcggcggtggcgctgctcctcctcatcgacggctgcggcggcgccatgtacaaggttggcgacctcgacgcctggggcatcccgccgccgtccaagcccgacgtctactcgcgctgggccaaatccatccacttcgcgctcggcgactccatctgtaagcactggatcatcgcgattagaggcctcgtctttttcttatgtttgtacttatcaaccgaaatttaaatttttcaacttcagatttaaagctgattttaaaatttttttcatcgaaatttatttttcagactttgtttttagctgatataaaaattt

SEQ ID NO: 42830 - DNA, 6326 bp, Oryza sativa
  unsure (1)..(6326): unsure at all n locations
gtgagagcatcttgttgattgtggattttatcttagggagtttattattaactttggatgatcagagcttggatctccatattcttattttttatccgtttgtattggattgtacaatgaaatgatggtgatgattcttttttttttttgcatcgatcaactcagctggcatccattgcatctgcagcttctagcttgccatttacaccattgcaagatcttactgtcccacttcatctgttcatcacatcattaggcaaacagtgaagtatttaaagatggccatggaacagatctaccacatgaagtagtagtatttaacagatgcctcatcgtgtcggtgtcctggactgctagtcccagacagaagagattcgatggtccaggcattgataacgtgatcttgaacagtactcttcatattaccttggctgcctggcacaaacaggaagctgctgtccatagggttagctgtgttgccaagcaccatcgggcaaaccatgttggcttccacagaaatctgtcatgttggatggaaaaaaccgtgtcctgatgtccatcaactgtccatgcatgatcacttccatagcaatgcaggcatggctggtacgtgccggcacttcatttttaagacattcacaaattattaatcattgaagccactcaaccttagacctgcaactcgcctccatccaaaaaagagttcactcttgtacacaaatctggacaagtgaatgtacacttcgtaggacagaggtagtatcagatagtgttatgcaagaaacgaatatctggaacaattagattgttgaaataatgcacttcatatctgaataaatgaaccggacggtacaaatgtacaatgacgccaggctccagcagtatatgcaacttctgtttaccagaaggaaaagtaagaaaacatatgctccgcgagttctatacttgttcatggtgtcatagcaacgttccagttgtacacctttacatcgaaggtggcagaattctcgagtgcttgtctgagttctttggcagagttaagattctttccaagcatcaacgcaaagccgcccccaccagctccaacaagcttgtagccgcagcagtaagggtcagcaaatgcaaacaattcgtccacaagcttgttgctgcaaaaaggatctagctcctgatgcagcctccaggcctccgacattatgccaccaagctcgtctatttcaccattcatcagggcttcccttccaattttcgccaactcagcaagcctcttgatgctagatatcaacaggctatcacggcggagatatcgagtgacaactttctgcaggacccggtgggcaagccttacctgtgcagagtatacattcatttggggagaaaattatactcttttgaagcaaaatcaatgtggaaaatggatgggcgtgcacacttggaaggaatcttgtttggacgtacaaatcttagaatcatggtggaacttgaacaggctactgtttgtaaattgaaacttctagccctaatttcagtttatctactatgttatatatgcttacagcagaaaattcatacttacttgaccagtgaacacaaccaggagacgttgttgtaattcttgaatcaactgcggagatgccagcaatggaacaacatgcaaacgcaatggctgtcctggaaaactctgagtgcacttgattccaggatataggccaccaatttgatcttgccatccaccgcctgtgcccattacttgctctactaccagcacagctctagcaacagttgcatcactttcatcaccttctataagttggaatagccccttaactaccgcagctgctaatatgctagaagttcccagaccacttccacgaggaacatttgcccatgtcctaatgttcaaccctaattttgacaatctttcatggtttaggacaccagtcacaataagagcagacttgactaaacggaatgaatcattttctttgaatggtgaagtaatagaagacaggtcatcaatacaaacatttctgccagcatcatcttcaatgagaactccaaggtggtccattgttgtctctatcatagcaccaactggaaggttcccttccaaccgtattgccatattcaaaacacaacctggacgctccaaactccatggaggtgtatcactccaacccccgacaaagtcgacacggaccggtaattccacaatagccttcttaggatgcaggttaccattacttgaacacttggaatcgcttgatggctctacaaaatcatacatatgtgttaactagattgatataaacatcaatattgataatggtaaaatgaaccacatttagctcgttgcctggaagacataactgcattttgagaaaagcgacagaaaaaatagcattaagtttgttggtagtgtacagactgtacctttagatccatattttatagctgatgcagtttcacttgctatggaagcccacactttatcttcaacaatagctgcagtggaaagatctccagaagctgtaagcagatccattttgacctggtatcttctgctctgcggaagaacaccagaatactgatccccatgactgggacaaagcgaaagtaactcattacagacttctacgcatgaattttccttttgtagcatttcctcacatagttgaaacaggttgcgcccaagcaagccataggtcatgcaagctttagcaatgttggttgctagatctgcttgatgcttgcttgaattcacacagagctgatggtagtcaatcgaacgatgcagctcttctaagctgatcctccgtgattctttccacagggaagcgactttgccatccaggtcacatgtcgatcccataagccacatacctactttcagcgtttcaggtagagacatgactggaaaaagctttgcattccataagcagttgtcttcattggttgagctccacagatctgtatcctggattttaagatgttccaagacatttctccatggtttgccacagaatgtcccatctttcttcatagatacttttggattatcatgaaggccacagtaaacnnnnnnnnnnnnnnnnnnnnnnnnnaaagggacttcccagaggcaatgtcgatcaggtaatgtgaagtatgagctagtactgattatctgagacctgttcccatgtaactcatgtatattcaccccaacaacaatacattgtgagccaatcctaattctacctgaaagtgatgaatcatagaccaatgaatcctctccaactgagaccccagcagaaattttactggacaaaatgacagctgttgccgcaatatcacaagcagtagtctctggtatcgaagacatgtgccttcgccctacaagtcctgaatatgagcccgccaagtgatcaagaacttcagcggatgtgccaaaatgtaaaaatgagaaatcatctgaaaagaaaatggtcacaacttagctttgcaaaaggcataatatcacacaaaactaatcagaaatataacatgtgaactgtttgtcaaatacaggagaatttaatgcacagccataccagaaagagaatcagcataatttacttgcaactgctacataatgaattctaaagagaacatacatgaacaaaagctgaacatcctgtgctttcccaaagcagcaattagttccatgccaaatggacgggtccttaaccattcatgcctggaaggcacccatgcagcaacaagatcttcgtataagctcatctgcaatagatcgggtaatatgaacccacgaaatgaaatatattatatcaaatctacagttagataaatgataaacgtaactaatggaagcaatggagcaaaagaaaatgagtttaggacgtcactttgaatttctggtctaacaaaaaaaattccataaagatgagattaatgaggtttggaatattcagagctttatcatgacaaagaaaaaaggttaggaaaatctggtctcaatataaaataaaacataaagcagcctaacaatgccaatgcctctctttaggatggaaaagcagactactgttgcttctagcatatcaaagcaaagagcgaaacagagacagacagcatctaactttcgtaaaattcaggatgatagaatattgtattgtacagctagaagagcatccagcactgcaagaattatagcaaatttatttataactcccaaactgaagtaatgagtgattatgtcttttaagggaagttgctcattagtagaccgatatctccaactactacaaatgcaacacatgcattttcagaataatcacatagccttgattcgatgaagcaagtctgcagtaaatgagagagcctgttgtgaaaaattggacagtgtgttaggaaatatttgctcacctcttttctgccagttatgagctccttgatcatgacatggctagatgaatatgcaagtctaacaagctcctgccatgctttacccctggctgatattatccctgtgtcaagcagtgctctcccgtcatctcgaatagcctggccctccacaagctcgtgcactgtaggcttctggaggagattatcaaccaaacacagggaatagttctccccatcagttccgtcctttgccgctacaactacaccatgattagcagccacatctagagttgttggcacggtgacgatgcaagcagcatcatcaggaagaactaggtttgaagcatcgaagcatgggagaacatccccggtcattatgaagatcccacctgatcatactgtaccaattaaaattgaacatattgctcaaaatcagtggctctgtctataagctacaaccttggtttttgaaagcttgccttgcgctggatgagatcgcgagaatgtggtcgaaaagcagcggaacaggtccatcaggattgtctccggccaagtaaggcagaggcaggaaggccttccccatggggttcgcccatggaaccctcttgctatcacccccagcgtgaagcagcagtacgtgtttgttcgccatgaatcgtaccaccgagctgagtgggatgtcatctgctgaagaatcacttgcttcgggcagcaattcggcgatctcttccttggaagcctgcagattcagatgatgttaaacaggggaggggatcgattctgtagtagtagtacatagggcagaagtggctggacctgggcgatgagatggcggacgagggaggcgacggcgtggagagtggcggcgccggagccgatgcgcgcggcgtcggggtcggggacggcgagggcggcggtggaggccgggaagcggccgaggcggcgggcgcgcgcaagctggcggtcgtagagcgcggcctgctcggggctggccgcggtgaggacgacggcgtcccacggcggcacccgcgacggatcccgcgccgatagccgcagccggcaccacgccttccgcagcaccgccgccgcctcgtccgccgtgtgcgccctccgccgccgccgccggtgacgctcggccggctccatcgatcgagcgacttttgctcctcgactcttatctagatcggagaatttggccgttgaaagaaagaaagaaatatctcgtctagacaccgacgcgactccactccactgatccactctactgccttgcttagccctcgacgacttggccagtcttctcttcccgctgctaccgatggcgatagcgttcttcagactcgtgcgttgcgttcagacttcagttcatgtactccctccatgtactccaatttgatctttcgtcttatttgataaattttttaaaaaaattaaaaacataagtcacgcataaagtattattcatgttttatcattttataacaataaaaatactaattacaacaaatttcaaataagacagacgactaaagttcagcgcggaaactcatgtttgcatttaaaatggaacggagagagtaactgctatgaacgactgtaatccaagtaaaatctcaagtaaaaaccacagataaatgaacaggaaacactgatggcaactcatctaaactttcaagatctgaaacgatatgatatttatgaaaactttgtatatgtaaatttatttgttttttcagttttgtgatagttgattcaatcacctgtaccctcgaataattatcacaaatccgttcatcagtcagcacaaaataatttacacccatcaaacatatatgcagcagcacgtccatagatttccggaaacaggggggcaacagacagaactaaacacaatgcatatgtattgttacaaaactctcagcattttaagtttgttcatt

SEQ ID NO: 42831 - DNA, 20889 bp, Oryza sativa
ctaacctagcagaaacagcccttagcttagaatagactttgcctgcaggagaacctaagataagactacagagtgaatcccgagcaaccttgatgttaacaaaggatccaagtatatggatcttcgtatcagcgataactatgcgagtcctcgtagaattctcgatggcatatttggtcttgcctccttttcctgacaagcggccaatagcacgtgacagatgctctcctcggagtgtcttcacgtccttgatctcaaaggaatccacatacaggtcatcgagacggagcagcgcaacagcatcggcgatgtcaaaaccaagcataaaagcatgtacgaagtctgcacacttctgaaggttgctcacgtcaggtgtgtcttgtcttgttttcagctccacccttcttgcctgagataatggaaacatattatatggtctgtttgatggtaggcagcttaagcattcaaaaatacaactgtaggattatggcattttttcacaagcactgataatacttcttgccaaatggtttaaggtcagtgagcaaacagttactactcactagacaaggacaaactaatggagtgacttacaaatgacggctgagtgtttgcagacacaaagctatgatgaatttgtgattagtagtgtctcaggtaaaagttgcaagttgtgagctttcaccacatcaaatatctatgtttttcgtactgaattgaaaaggttagacagctcaactgtcgtgctgatcatgggcaagaaattagcacagaggattttaaaaacagtgtcttcttacggtataattcaatggacattatactccatttactcatagcaccatattgaattctactcccatttggagtagaattctagcacaacgcatgtactaattatgtacagcttgcaacaatgttacaaggataacagaatcacttatcctaagggcctgtttggcacagctccagctccagctccacccctcctggagctggagctcagccaaacagtttcagctctaccaaaactggaagtggagctgggtggagctctctcacaaaatgaaagagttgtgggctgcagctccacaactccactccagactcaactcctggagttaaatttaggagttggagctgtaccaaacaggccctaagtaaaatgccaaaatatagttttgacactgcagcatcatgccgaaaagcaacacggacatgtctcaccattcaggatttgcaaccacatactactcaaaagactgagatatatccataaggcgattagctacacaaaggatttagatatatccatgaggcaatttgcgactatcaacggaatcagaagtgtacatccaggagagaaattggaggctaccttaaggttcatgcggatgtcgatcttcatgtgctcgtagacgggggtgtagatatccatccacgccttcttgagcggcgcgaagcggtgctgcggcaccggcaccttcctgaactgtggcctcccgccgctcatctcgctcggcatcagcgcctcgaaccgcggcttctccacgccgccagccgcgtccaccgccatcgcgccggaggacgaggaggattctccctgcccggcagcgctcgccggcctgccagcctccatcctgctgcccgttggctgtggcggtggcggcaatggaagccggcggcggagggtgtcggctctcgtcttctcctaggctagggtttgggaatcggggaagagaggaggctggagaaggccaacctggtttataaaccgaaactattgggccgaaaaaatgatagcatgggccgtccgaattctgtactactccgtaatgggctacttcaagtaaactccagttgtctaatgggccgccttaaacatggagatttttttagaactgggagatttttctgttgcatatatctccctgatcaagattaacaagtttatttatgagtgccatatagagctaaaaagattaataagctataagtaatacagttctgaaagcacgaaatactgcatagtatagagttgtagttcagtcatcaaggtttaagatcgaatcattttcttactgttggtgctttaatgcaaagacaatgaattcatggaattttcacacccacaacaattgttcagtgacaaatccgagtcaagatcctcgatgtctgtgttgacgtttactccgtccgtcttaaaataaaccaacctaagataagttgagatattacttagtacaataaatctgaacaaaacggagagagtaggttccagtcaggtgaaacaaatcttgccagctgctgccccatgctttactcatggacttgagtgcggcgtccatgctgccttcctgtctcgttgtcccctatccgattatctccaactcaaagctgttacaagtaagaatacagaacatgtgtatagcagtagcaagcagggtgtcatgtccgatcatctgtgtcactgtgtgagcaggcgttgctgaatattgtgaaacagtttttatcatcaggcataaattttgattgctggtaaggactatgtgttttgtttctaaatgataaggaataggtgccacgccttggtgatgaaagaatgcattcaaacatactgggatcacgcttcaacgcaccttataaacaattgcagatggatgatggatcaactgcccacaaaactagctgcgagagcagatttaagaatttatctgcataagaattgtattatgatattagatgatttgatggcactgcatagttagctgaagagtgtaagatataattcgatttgtaaactaacttattgtacaaagttgaatgattgttcatctgttccaaggaattgattattgctagaacatacaaagagctagaattgaagtgccattgtttcagttcagtttccaagccgttgacaaataccaaaataaaaattagaaaagaagtatgagctgtttacctttgccaatagcattcagctaggagtgagtactcaaagaagcactcgactaggagtatgtgattgcccttgcccggccaacctttgtgttgatggtaattcattcacactaggagtatgtgattgcccttgcccggccaacctttgtgttgatggtaattcattcactcatcatagtcaagctctgttatgtttccctggcattccccttggtccatcattattttgaaccaccccaagaaaaatggaaaaagggcattattttttatcaacctctgaaactgattcctgattcagaaacaaggtaaccagtgaataccatcaatcagcttggataattaatgcatacattggttaatatgaaatacaagcttgctgtaacagtggaagacacttaccagcagcttgccatcaaccatgcccacttccatctttaacaaattagcagcttcatccatcccatgtacattgtatgcctggatcatggtggtgtaagttactttatcgggcttacatttcttttccttcataagctgcagcatttcctccataattttgatatccccagacttggcatatgcatcgatcacacaattaaaaaatggagtatctaaaaccacatcagtattctctgtttgtcgaatgatcccaggaaccttgtcgagaaacccagctttgctgtacccattgaccagtgagcagtaagtgatggggttgggtttaacaccctgaattttcatcaatcggaaatagtactccatcttctcgatgtttcccgcccgtccaaaactttctattattatgttgaaggtaacaacagttggtgagaagaagtgtttcttcatatatttcagcaccgacatcattttgtcatgcatcttagcattaccatatgatttgatcatgatattaaatgtttgcgtatctggctcaacacccatcaactgaaactcactgtaccacctctccatttcatgtatcctgttaccatgattcccataagcccaaatgatagaattcatcgtgtatatgtccggcacactgtccccatcttcaagcatactagtcagtgcattctccatctcctccaacatgccggctttcccgtacccatcaattatcgcattatggataacagcattgcattgtagccccaagtaggacatctcatcaagaatcgcaggtatccgatcaaagcggcgcaatttgctacagcaattgatgagaacagagaatgtgtactcatctggcttgcaatccgcgacacctttcatctgttcgacggtggccaacgcctggtccagcagcccactgtagccgtacgcgccgacgagggccgtgtagacatccaccgtcggcttgagacgctccgagagcatcaccttgaagagggcagtggccgcgccgggctgctggcacttgccgagcatcatcagcaacctggcgtaggtctgcgacctcggcttgtaccattgctgcttacgcaacagctcgaagatctaaaccccaatcaagcgagcacagcacaatgagcatcagaatcaagctgattcctcaaggggattgggggttacctcgagagcgggctcccagcggcatgaggcgacggcggagtcgagggcctcgagcacggcgcggggccagaggcgggtggaatgctgccgcgacgccgccgccgccttgcgggagacgccggagacggcggcctcggtgcggaggatgcgggagagcgcctccggctgctcggcctcgggggcagacgacggcggcttgtgcctccggccgccgcgggccatcacgacgtgggtcgcacggctgctggcgcggggaggtggtgacgaggtggccggtgggcaccccgccggcgccggcgacggcgagtgcatggcgccggcagccggagtgaggccgagacggcgataaggtcccgagcgatcagatgacaagtccgagtgaggctgcacgaatcttaaccatccaacagttgggccgtcaagggagagggagctccgtgtggcccacactattgggccggaacgggaatgcgagcttcgtgcgacccattatagttgggccggaacggcccatactacagtcggcttgctgaaattgctgggtccaaattaagccactgttttgcctatttttgcaggagatatgagaagagagttgaggaagaagatgagacgagagaaagtcattgagatgttgggttccacgtgctgatgtggtggacctgtcacgttagcaaaaaaccgtttttaaaaccatagaagcagttgatttgcctcggttttcaaacatagggaagatgttaaacctggtttgtggttcaggtggttttgcggtcgaggaagatgattcaataaatggaggcaaaataaacttactctattcacaaacaaactgctccctgctaaagtacagagggagcagagcagatcaggacgagcagacatatatgtcgccttgagatcgactagctctagcatcttcttcttctcaatcttctccttatctttcggagcagcagctaagctaagctttggcagtatcgtcgttgatccacgtagctaattaccaaccgttaactgatccagacaacaaaaaggacggctgcatgcatccacgtccttggttcagtcaccagtgagatccaattataagttatcattcagagagtccagacaatcgactacctttctctgttaagcttgctgttaccaattccatgcgatgaacaatcgaaaagtacagtgtcttttttttcgcgaacgcgaaaagtacagtgtcgagtgttgcattcataaattattatactttcttcaggtacagatactaacacgtaaggccagactattcctcaccgatcgatatctcctagtcacaactcaaaaggtacaaatgtcatcatccctcgtatgtacagcacaatctaggtgttcaatctttgaaagtgagattaccaaagtgacaggagtatacattcgtattcgaaccccaaaaaatgaatgatatatagctagatcgacacttcgacagagactgtgcatccatggatggccctcactcaggccaccggcagctagctacctcgtcgatcgactacttattaagctataatttctctcagtttgagcttcacgctgctagattccaaatccaatggcatatagagaagcatctcactgcaagcatggaggcaaccactgagtagttgcagctagcagcagggaggaagaagaatatacaactagcccatgcacgttctctctcggttcatcgatcgctagcaactctctctgattgatttgctggatatatatgttactagtatcctgtggacagtatcagcatgtacatgtgcaagaactttggccacacatagtctgattaaaagaatccatgagcactgcagcttgcattgacacctgaaaaaggttagagctgattgataagcatgcacacatagttccttagctactgtttagcagcttggctgggctggctcattctcctgatgaatgatgatggtgtttttttttcctctctttagaaagatgcatggctagttgggactaaagagttgtgtgctaacacctgtcctacaacaaagatccatcgtacgtgtgatatatctaactaaaagtagccctgctttcgtttgatcgaaattaatcatgcatccaacttgctctataattcagtacaactagctggtagaaagtccctgaactgaacaccatcagtgcaattgcacacaaggacatctctacgcctagggtagctagctgctaattaacttaatttgacagcactcgagtgataacaaccattaatgccagcttgaagacagtgtaacacatgaacccttttttgcgtggttggtttggttggcgcaagtggagatcgtactgaagatcatgcataatctctccacaggtcaatgctgctgcagcatgcatgaactgatgaagaaacatgtccctgattaatccctgcgacttgagctgaaaacccggggcaaattgcagctgatgctctgacagagttggtacagtgaaccgtgtagcgacctaaacagttggggagtacagtgaacttagtgaactgaagctgcttgattggtcaccacaagctttgcatgacacacaagtaaaaaaaagtaattaaattaaacaagtggtagaattttgttaagctgcagggccagcaacacgacgacacgtcgatcaccggattaaccctcgaccttgcaacacctcacatgcatgcacgcgaggtccgtactaggcgctacggcgatttaaagaaagaaattgacgcgcaatacaagttaattaattaaatacaggtcatttagcctcttaattatccacgtcgatcgatccatcacgcagaaatatcaagcaagcaagcaaatgagataaatgattccatcttaaattaactacagctagagctaagctagctcctaattttgtttgttgagctcatgtgatcagcctccctgctcacatgtgcgcatgatcacgtcctagcttagcattggcattagctactaattaaacagcatctgtttttctttaggaggaaccgaaaggtacacttgttgagcaggaaccagagcaaatgacaatggtgtacttgtgttcccaccaagcacggctttgtttttttttaactttgattaaaaatccctttgcttagttttatttccaccgaggaaggtgccatgttccatcacattaggcttttgtttaacaagtccttgtaccttgattagagcgcaaagacactagtactagtgactaattaagaattagtttttcccctagccttgtatgattgccagctgatccttcttggggaattttgtagacaaagtaccataaaaccgcctcattagaaacgtgcctgtcggtgttaatcaggaccgcttgtttttacctcatcagcttagctatctggatataaaagtcatcacagtaaataattaattgtttgtttgctgttgtaacgaagtggacggcaataaaacgccataataaagaatacgttcatcgattactactgcattaatttaatcattaaaacatgatggcacatggaagtatatgtggagttgtagcatgcaatgtagcagtagtacggattaattggatggttggtggtagtgctaactgctaagctactgatgatgatcgctcagtgcattcctgcaactgcttgacaattattttttagggggttaattagttgcagctagaattaaacaagtgttttattaccgttaactgttgaacagtattcagtagaaaaatcaactgaggaatgctctataaacaatttgcaaatcgcataacaatccaaagacggaaatgcttccgcaggattcaagaagtgatcaaaccaggaagtttcggaaaaccaaagtcttggttagttaattagtttcattgattatgatctagagagaggacttctgaataagggcatatacaatggtatttattagcggtctctttttatcgtcatgcaagtatatttggtgatgtggaagagagaggaagaagaaaagaaaaagatggttactacacatgacaacggcatagaatcgactattagcatttattagaaaaatttttgttgcattgagtctaacaaaggaaaaatgactagtaagaaagtattttggtacactaatgattagagactgtattatcttaactattgtaacgtgataatctctaattaacgtagagaccataccagtctctacctttgtaattgccttaaaaaggttgtcggaaactgaaattaacaatagtactaacctgcagcaagatggttttagacttttagttgctggatagattaaaacaacaaccaacggacggtcaacgaacagaatagccacaacgtcaaatcgagtccggaattctagagatctctaattgacgatatggccatctcgtcgctggtagctgctactagtacagtaatatgttccaagtgcgtcacgaaagtgattgcaatttctgtccggttacgaacgagtcgggcgcgcggtttcacacccccaacaactcgtggatcttttttggagctcaatcgcgtgtgctgcggctttaatttgactggcttttgatcgatctatcgcgtcgttcgtcttggcgtgtatacaacaaattcatgcaagaacagaaaattcactgtgttggtggtgttgttggagttgcatgccaacgtgaacagcagatgaaaacaatgtataaagaggtgatcaagatgctaaagcgaaagatgtcacgtacgctagctttgctagctaggcgaatctgtagatcctatatctctaaatgtaggatcaacagtgatggtatatttgacccttaactcgtctgcttgttccagctagctagctactccagtttaaatttaaatttatccagcatgttcgtccgaaaaggaaattaaatgagaaagatattgagaaggagaagagctagacgacgacgaaggatcataccagatctgtgtgtatgtgggtaaggtaggtgcaaagtgccactctctcaaagtgcgtagctagcgatttttttttttttttgaacaatagctagcgattattagtgtacgtgtgcgcatgcatcacgcgcaattggcactagaacgtagaagcacttcgctcgatgtacgtacgcacgtacatatatacgtgtatatatatttgctacgacttgactgatcagctggatgcaactttgtgaacagatatactccaacggctcagatcgtacgtataactggcttaattattagtcgtcggtcgtccaagcaaagtcttgttgtcaacgaaaacgaaagaatttgaccaggagatcgatcggtcgaagaagaacaaaatcaaagagacaaacgttgtcacgtaacggagatgtgacaaccgaagcttgtgctgcacggtgaggcagggtgcagtcactgcagtggatcaccttgttgggtcttgggaggatttggcctcggattgaatcgagtacacgtagcccccgcgcgcgactggatcatcgtcatctgggtggattggatacgggataaacccaaccaacaaacgaccgatcggtggctggcctaacgcagctgcccacctcgccttcgccccgcgcggacgcagcagccgccacggtggctccacgtacgcgtccatcttcacgcgcgaccgagtgcgagtgcgagcgagcgagcgagcggctgaccaaaccacccgcgcgcgctgactccaccacgagctaagctgagtccgcgccgaccaaacgcgtcgtcgcttgctgcctctcgtttccgagcacggatagctcgctgtatgtgcgtgttggaacgggaattccgacgtgttactattgtggcgactacttctccttaatttttcgccatacgtccgtatctaatcgattattattagtcctaagttgataggatacgtacgtgcccaattaaggccgggtacgtacgtttcaggcttaactcacgattaacgtacgtgcagttaaattagttcgatggatcaagctcaactgcgactttgcttctgtggtacaaaatacagtaccgcagggcaagaaaggcacctaaactaacctttcgtgatataaacttttggttttactctactgcttttggccttttgttttcattagcgacagtatataatttttttttcacaggtcgaccaacggaaaggagctaattgcagccatgagcaaagcaacaataacaggtaaggaaaaaaaaagtactgccactctgccccatctcaatctcacctgttaccgcttgaggaacaaggtagctgaggtcaggacgcctacgtgtatatattttttttaacaatctgtttacttgtttgattactgctctacttaaaccatgttaattaattatcaagaggatcctcaaacagtcatgcctactttgctcatttaccatctactggtcagaaattcagtactgccaaccagtgctaattaataattggtggtgacatactaaacccttaatgattaaacaaaagcaactgattagtactccttaccaactgacatgagtaagagcaggcccgttgatcaggaaggaaatgtagagaacagcaccgagagatgcgctcgtgtctaccaaagattccggagcagcgtagcaaacaatttataactaggtagtgacagcaaaacatctccaagtaatcagcaagtttattttgcttcttgaacctgcaacgaccatttaatatcattacagtggcatgaagattaattaggaggatgttgtatatatgtagtatatgtttcaatgttttgtataatcacggtatcttgctagcaactcagcatggatttctgcttgcttggcactttagataaaatcgacttataaaatgagtaaaataattaatctaataaatatgcggcacactctttattgctgggcaatgtgtgggagtgtactgtgcagcatcaggtatcgcaccacagagcatccaaatgatatggcttgttgcaatggaggttaggcatgtgcaacctatatttgaaaaatggagatatgccacactgctttgctattgctaatgccaccttccattgacttggaccggttgcgacctggccggaacgagtgagagctgaggtagacatctccaatcaaatactaacatttttctcccttgagaatccaagggatccttgtgtttacataggtataaaaaaatactaaatcatcctaaaaaaaagctgtaggtcaaacttaaccgtacaatttcatcttctacattttcttttcacaatgtcgagcgctctgcggcgttcgcgaaaaaaaggctgtcctactcatttttatgttaaagttgtgcaatatccatactcacatgtcaatatgagtaaataattgcaattttatgtagacttaaattttaaatacgtagtcttagtaagcatacaaataaattcacgacaagcacaagccaacagtaaaaagataaaaataaaatccaaaagtaacatattatatcgaggaactagacaaacatgaccctgagcaacctataatacaaaatcatcaattttcaggaagacagacagaggcaaacaaacgtgtggaaaaacataatcccggtctacatggaagattaacaaaatcctcaatcttttggaagaaaaaacgggggacttccgagaagaaaagaactctagcatctccgtggagaaataaaattgataatgacgatctaaaaagaaaaacacatgatgataggcagcagagaagcagaagccgtcatgccttacggtttttctttttttttttcccggaattgctctaaaacttctgtaagttcttttctcaaaacttttagatttgtaattgtcgaatcgtctctagatttatatatataaagaaaaaaattgctagaagaaattatcacatatatcacatgtaaaatctcggtgctaaccaaccaaaccataatcaaaatataagttttatataagttgttacatattgataatggcaattaaaaaaacacttatgatgataggcagcagagaagcagaagccgtcatgcctcacagtttttcttctctttttccttcttctcccatcgtttttttttttggttttacgtcgtccgatccgtccattgctccattgctgacgacgagcgaacctccatccaaacgctgttcgcaaccgatcccagagatcaaggtccccatacatccaccaccaccaccaccaccatcctcttcctcttccctctcttgcctcctccttttattactctactcatttagcttttggttggttggttcccttcttgagaccccaaaacccaactaggaaggacaaggacacatccctctccctcttccaccaagagagatagagccaagaaccggacgaggtagaagagattgagccgccacggcagtgggagcgcgcgcgcgagttccccgagatccgcgagatctccgtcgccggctcatgccactggtcggttcttggggcggcggcggcggcggcggggggtggtgagtctgtggccgtttcttgcggcgtggtgaggtgaggggagggagaaagagaggctgcacatgtccgtcatggcgcggccccgcttcgaggaggatgacgaggatgagttctttgactcgagggaggtcatgtcgccggcgtccgtctcttctccggcgagctccgggcgctacgacgggcccatgctcgaggtgtgggccaccgacccgtgcagcgtccatgagcgccgtcagaggttcatcaagtccttgggcctctcggattcgagcccctccgccggcggcggcggcgaccggcccgacgaggagccgtgctcgaggtccagtgccgcagaagagatcctcccgtgcagccccaccgtcgagctggtctcagccgtccccagttttgcgtgcagaggcgaggagccgggagcgtcaggcggcggcggcggcgcggaggtgttggattgtgtattcaagaacttggacgatggtacagtgtttgtcgtcgacgagatgggaaaagatgggagtttcaggagcctcagggacaggcgatccaaccggacagttactgcagcggaattcgaacggacctacggctcgtccccattcatctgtgagctgatgcggcgggtggatgattcggatgagtcctctgctgtggagaaggctctggtcaggggaaggagaaggaggaggagatttggatggctgcgcaggctcggcatccgtggctgcgtcgtcgatgtggaggaggacgatgagacgaattcaacatcctcgagttcttgtcggagttgctctgggaaggttgatagggtcaaggtgaggcattacaagaagaggtcaaaggaattgtccgcggtgtacaggggccaagacatcaaggcgcacgaaggcgcaattgtgaccatgaagtttagctctgatggacagtatctggccactggaggtgaggatggggttgtgcgtgtgtggcgggtggtggagggggagaggcccaatgaacttgactttgccgaagatgatccttcatgcgtgttcttcacagtcaatgaaaactccgaattggcccctgtcaactccagtgaagggagtaagagcaagcactacaagaactcaaaggtgtcgacagatccagcctgtgttgtgatccctcataggacctttgcattatcccaggagcctgtgcatgaattctatggacatgatgatgcgatcttggatctttcatggtcaaaaaatagggttagttgtcattgaacaaggtttttccatgtatctgcagtatcttttaattgtcacatggtcatctaacttcactcgccttctttttgcaggacttactttcttcatccatggataaaactgtacgattgtggcaggttgggtgcaatagttgcctgaaggttttctcccatactaactacggtaaaccctttcccccgctaagtacaagatttagcacatacctcttcccagcgtctgatgccgacattctgatttttgtctattatgcagtaacatgtgtgcagtttcatcctaccagtgacaattattttatcagtggttgtatcgacggattggttcgcatttgggatgttcgtagatgccaagtcgtggactgggctgataccaaagagataatcactgcagtttgttaccgccctgatggaaaggtttgttcaactgttctttaagtgtttttacccaagcggccattttctgattttacttaaatagttaaacatgtttattctgctggctttattcaggccgcagtggttgggaccataacagggaattgtcgccactacgatgcatcaggtaatcatgcaatcatgagcacactctatgtatggcgcttgttattggcaggctaatgattttggaaatagtagcttcaatgaatcaacatccttgtttgttaataggtcaatatcgtttgctttcatgacgacatcctagatgtatatgcaaattgctaatgatagaaatgtcttgttttgtccctggtatgagaatagagacagcagaattgttgttatcctctaattgcttcttttgatcctgtctaaactgtatgtgtgtatagattgcagtttactacatgatggaaagataggtcattttatgagatgctagtgttgcatttatttccaccaagtagtactgtccacgagacttttctccagctggtttttatgctacgattttcttaaaaaaaattgatctctgccaaactatctttttgaccaatcactggttggactcattttgtcctgatgaatcaacaaaactatgtcatcaatggagatgatataggaacctttttttttttttgcggggagatgatataggaacttaggaaacggtactattgcattttggtgatgaacaggcaacatgtgctaatatgctattttcatagcaaggtcatgcatgttgatggtagacaacaattctatttttcattggataagaacagataagattgaaatagaaaaacatatattttcttggtttatgttttgaagctaaggtgcatattcctgtattggctgcagaagtcaagtgtactacccttgtttgggtatgatgaaagtattgttggggaaatttaggtctatgattcatgaggtccttaatggttataaccatttcctgcttatagatcttgcaaaacacatagcactggaaacttgttgcctcatgcttcagtcaagattcaaattaatgttccatacatcgggaaacagcaagccagtaaatacgatattcaaaagtctgttgtaatagtagttgatttgtaacagtagcttaaatccgctttgtttaattcagaccaggaactttaacttctttgacttgtgttcttttaaaacattttcaagtatgctcaacgaaaatatgctactagtatgtttctgattcatttgtttttttctaactttaatactttttgcagaaaatcacctggagctggaatctcaagtcgctctcaatggaagaaagaaatctccacttaaaagaataatcggtttccaggtaccttttcttatattgcatgttctaatctatttttttgtcacatttaattcttacaaaagcaatttttcctacatgcattaccagtactgcccatctgatccaaagaaattgatggtaacatctggcgactcgcaagtccgtattcttgatgggcttcacgtaatttccaactacaaaggtactgacaccctcttctaagatcactttcaaaagtatttgtgacccttagtttacatgtctattttccattctcaggactgcgaagttcaagtcaagttgctgcatcattcacaccagatggagatcacattatatctgctagtgatgattccagtatctacatgtggaactatgcaaaccaaatagctcccgtcacaaaccatgtgaagactgtatggtcaaatgagcacttttcctgccatgatgtggccattgcgataccatggaatgcctctcagacaaggaattctatttcactggcttgcagtatcacttcttcacagcaagaagtcttggatgagttccacaatgaacatgatagctcatcatgttctcatactgaggattcccctgatggtgatagtctgtaccaattaccatctggaaatttcactcttagcagtgccttctttgcggaatctgctccaaggggatcagcgacatggccagaggagcagttgccatcaaattcgacaacacagtctaccttgaggaaatctcagtacaagttcctgaaggcttcttgccagaatgctgctacgcacgcctggggccaggtaatagtggctgcaggctgggatggctacatcagatccttccagaactatggcttacctgtgcaagtgtgacatggtactagacatgcatcatttaccattgatagtccaaggcaaaagcttgggtatgccttgagaagtctggctggccctgacgcccgtcctgattcattatttcagcacaaagcgtcacatggctggtgcgtgagctgaattgcttgtggaccagaagttgtatgtagtctgagtggtccttcaagatcttgacagcgtcaacacatcgtagcaggcccgcggaagatgaatcgcctcgcagaattatgcaaaggcatgtggggatttaggcagcaacacgttggtgttctttctttctttctcttctttgttttggctcctgttagggccatccgtaaatatatataggagacatacatatttttgccgagttgaaacttccctcgcccgaaccggatagtcgatggacaatgggcaagtggagagctagaaatcactgttggataggggggaaaaattcagagtggtgggggtgcacatactactggattcgtttcatttgttcacatttcatgattcatagcctggctgagtctatgatggacattgatactggagttgtatgtgttgggatggatcatggatggaaccctgtggttgtggttggacatggtcaggtgggtgtggcctgtgggggacctttgtgcaggcagagggcaggcctttctggatagggatggtgcagttggttctgatgggtttcctaactccaggggccaggcctttgggtatgggactatactatcactcattgctgctgttaatgcctttgtttaaaagctgggtccatgtccatgctcagatcttggccttttatctcctgcttgcactgtcacgtcccttttcttccagatccctccccaagtccttcctattgaggtgatattcccaggaaggtgaaattgccattacaggtttacacttattctttgcagtttactggtcttgtttgtttcaagaaccattgcccagcagtcacagaaataatcttagtactaccgtccatacgaatcttttcaaggttttttttagtactcttatctcttttcatcaaagatctctgcagtaaaacgatggcatcaaaagtacagccatggatgggacaagctcagcgatggctggttctgccgttacaagtactctccccccgttcctgtctggccatcttgtactagtagcaatgggcatagcagcggagtacaactacactcctccagtatcgttgttcaaaaaatgcaggtgccaggacgactgagatcctgacagggctgcccagtggatgatggtgcccatgccatgccatgctctgcagcagcaaggtgatgaaatggaatcatcagcctggatgctgccttgcctcattttatgcaacagtggatgttattttttcggtgccagtccagtctggtcaaggagtaaagatcatcaagccaagcccccctgaggacaatggctctctggtccatcacctcacctgctgtaatttcagaaatgcactgctcattccgtccaaaaaaacaacttagaagtggatatgacatcttccttttatttagatttattgcactacaatggatatgtcgacttttttttagggacagagagagtacacgctcacccgtagcacagttacacccctcctccctacagatggccgaggagtagtagggaggaggcagtgttttaggcaggctagcagtcaccgcagaatgcgacgccggtgctctcatctcatctctccctctgcactgcagagagtacctgtctctcttaggttgacttttttttaaggaacagagggagtacacactcactcgtagcacggtcatacccctcctccctacagatggccaaggagtagtagggaggacagggttcgacttaccgccggtaaccgcgcggttaccgtgggggtacggtaatataaatactacggtaacctccttaaattcaaataaatttaaaaaataatttgaatttttgataaattttgcacggttttatacggtttttcacggttaccgcggtaaccgtgtggtaaccgtgcttgccgaccgggcgcggtaaccccggacccagcggtttggaaaaccttgggagaaggcagcgtttcaggcagtccagcggtcaccgcagaatacgacgccggtgctctcatctcatgtctccctctgcatatggttgcatatgccaagatggacacttgttgctctccaggcctggccaccgctgccttcaggctgcagccgtggtgtatgtcattcgtccgatgggccgccgcgcgattgacatgcaaactgcgagtcttttggcctcgtgaacttgtcattttgatcacccgtactcgtatcatcatatactgtgctggtactacattgttgctactgctggctgctgcgagttgcatttcgctagtgctagctgctgtacaaattgtggcggcaacaaaccgcgcagcctgtacggcaacaggcggtcgtgctcgtgcatgcatcgccttcctctctggtctcatctgctcaacgctgaagcttgatctactgttctattacatttgcagtgctgtttggctgcattcgaataggatccgattatcaaggcaagcttctttgattgtctcctctgctgcatgacaagctagtgacaaatcgtccgttatatatactcccctccatttcaaaatgtttgacaccgttgatttttttaagtatgtatttgaccattcgttttattcaaaaaatttaagtaattatttattcttttcatatcatttgattctttgttaaatatacttttatatacacatatagttttacatatttcacaaatttttttaaataagatgaacggtcaaacatgtgctaaaaattcaacggtgtcaaacattttgaaacggaggcagtatattcagtcagtggtttcatgagtgcgctaaatagggctcggttactatcgtgcgtcgtcttcttgcaaacaatttacagcaatagatatctgtatcagggtaacaaggggacattgtgaatcaatattatcaccattcccctttctgcaggaatccaacagaaggcaacgcgttgccttctgtcggatataatcaaagctttaaaggtgtcatgcattgtttagttcgtgaaaaaaaaaatttaggtgttatattggacatttgaccggatgtcggaaggggttttcggacacgaatgaaaaaactaatttcataacttgcctggaaatcgcaagacgaatcttttaagcctaattaatccgtcattagcacatgtggattactgtagcacttatagctaatcatggactaattaggctcaaaaagatgcgtctcacaatttcccccttaactgtccaaagattcgatgtgtcattttttggaaaaaaaaaaggaaccgagcctatgtataccatcagttatatacgatgatacggttatgagatgatttaggtcctgtttgggggagcttgagattctaagaagctgctgctgagaagctacctggtgagaatctgaaaaagctgagaaacctagcttctggcttctagttcattttacagattctacaactacatattttcagaatctgagtaaatagctggactgtttgggggagtttctgccaactgaagattctaggagaagctgcagctgttagaaactcccccaaacagacccttaacgagtgggtaaacgctatacatagcccgtagccccactgtttcagtcactgacgtgtaagcccatgttaaaattcatctcctagcccgtttcgtcccactgaccaagtgggacccacaggagatcgtttcggcaaatctggtccgttgatctgcacacgcctcccaccaacatcggcaaagcagagcatccccgcgtggcgctagcgagaccgcgtgcgcggaggccggagggggagaggacaagaggcggcgggcg

SEQ ID NO: 42832 - DNA, 10560 bp, Oryza sativa
  unsure (1)..(10560): unsure at all n locations
atctatcgttttgaggaaatcgagtgaaacgatcttggtttcaggccacggtgggtggcggcgcaggccggcgaatcgcaccgtcgtattcaggtgtccgcgggcgttgctcccctcaaattttgttttattttgcactggttttgacccgggaaatttttggtcatgttagggggttccaggagcaatctgataagattcagattaatacggatgcacgaagcaataaggtgtgctgctaattcatgtgcttgtgaaattcgtatctacaatgtattgctgcaggagtgttcccgctcactgatgatctccttggatgtctcgatgtgagttgtgctttgaacagattggtgagatcaggaattgctcctttggtgaggtatgatatagagatttgggacggatggagtagggttcacgaatcacgaaagaacaattgcattattacaactgcgaaatgactacagatgaatttctaactttgtttgccttgcagatatgttggtactttactgacacttgggaacaattccgtatcagcggattcatagatgtgattgatggttcaaaccccgaacctgtcaagctacaggttagaaccagtatagcatactgccttagtgctctgatctagtagtggtctgtatagtggaaatgccaaatgtcctagagacagaagcataactgtagtgcacacgtttggttgtgcaacatatagtattttgttcttttgcgctgtatggctgaataaatgaatgatttgtgatatttattcgatggtacaaacaaatgaattaactgttataaagttggaaaagtgatttaaatcggtattctaagaaattcacatatagagagtttttgagaaaaatgcaccgtttaggagtttaggaagcgtgcccgttaatccattcatccattaagcagaagagaacagtccttgaggtttattcatctcagaagtgttactgtgttttctctttctactttcattgattcatttaaaatcggttgccatttctatacacagctgagagagagagcttggtttggaagctcagtaaaatcgagattgcagtacttgggaccatgcccaggtcttcctattccggatgatgatctcattaaggatgctcatcttgatccatcagctggtccagtagatgccttttgccttctggttcttgatccagaaaaggtaggtagctattttcgactttttgctggatctagaaagatgttgatgtttgctcatgctttcttagtgctatttgtcagcaatcctttgatcctgcaattgttatactgtacttaggtcgattatttgaacttgaaaagcaatcaaaggttaatgttcacaagaaaccagaagggagatgggaccaacagttggatggccgaaaaaattagcccatgactgtttgcggattctattgcagctccaaatttgtttgtggatttatcatggtaagaaagttgtcttgatttgagtatgttttctagcatttagaatgtttaggttggagcaatttgggatatacatcgccagaatttctaccatctataagtttagttgacttgaacttataagctgaatggatattgttattgaaggaatgttattttctgagaatgctaatccatctagccacttcttagctgggtacgagcttgcagaactgcagctacctgtggcatccgagagaaccaatttccatgttcaagttttcatcttttataaaacgagggaaccgttcctcaagttcccttataaacacctgaaccttttcaggtaggaaccaacacatagattgtccagataaactagtttatcttttttgtttccctcgaaaaaagaaaacgagttacccttttatctttgaactgtggtgttatgatttcttccgaatgcgtgttgtatggtgcatgtttaatttagtgacagtagaatttgaattcctttggtgtgaacatggatgatgcaggtctactagtacctctcttttccgagcaaactttaggggaactgtgatgtgcactagggttcccgatcttccaaaaggttctgataaacaacgatttgggcggagtcacgacacaaatcgatccggcttcttgaacgcgcacgctcttgagccccgcaatcgcagcaccacgtctatccgagttagtgatgtccgcatcaaactgcatatgttattcgttaacagagggaggaaaaagagtcaatacagtacaaataaatcagagattaatggacagtgcaaataaatactactactataactcttgcctgtacatagtcattttttcttgtttctcttgatattttatgtattccagtttccttacaggaatgttaatgccataccatggatgttgtcctggccttctaggcttgtttgttgtgtcaatgtcaagtaaggtcattgtggttttaggcatggcaaactcttctccctgctatgggcatatggcccggccctttaacctctgtgcttctcagccttccttgtgcttagacaagacactatcagatgcatattgcccttgttgtggcagttatggggttgaacaaaagctccagctataagccataaatcagcatacgcgtgaggcgttgaagtgtgttgttcaccgttatacattgatgagcagagctggaggtgccggtctgctggagatcaactctggccaggccatgaatgcagcgttcaaaagttagttgctgttatctccatgtataagaaaaacacatcacatgatctatttgctgcggaaagcaatatattgaccgatacgtcttcaagtcgtggttccagtgagcactggctagtggtgtgcactgcgcagctgatggttatgaacagttctgctcctgctacaagggaaaagttgtcaatcgcattatctcattgcagacatgaaagcagaaggaaactgttctctgttctgtgcatgctctgattgagccgagcactcagctgcaggtttctctgctggtcttgataatgctacatatcgtcttttcttgttcttggcagtgaattattgtttcatccaaacagagactggactgcaacatcttcttccaatcatcttagagcagcatgtgacatttcgctcctttctgggtctccgttgcagttgcgctgatggcagagcaggggtcaaatgtggctgtttaattgggtctccagcttttctttttcattcaaagtcatcaaggtagcagcagtcagtccagcattagcatttcggctgtgccgaattgaggtctcatcctgacgctttgcagcgcacacaaggaacgcttttatcttactttcgctgataaaaaagggtgtctggttgaggtcaaccgcaagaccggccctcctcctcaagttgctaatggcaggtccatttcaaaggctgagaaggccttaccctgtggcttggattcatcttttggcaatcatttttattggccaccttcctcctactgggccttgctgctggtctaaaggcctggaagatgtgggccatgtacagctacccatcctcacttagcactacacaagtaaggttacatgtcacaatcttctctctttttgccgaatgcatcattaaagtggtatgtattgacgagcttgttactagtgatgcttacttttcgtagaacctatgaacatcactcatcattttttaagtaatactctcatattgttttcatatccccaaaaagagaagcagaccctctttgagagaaaagaccctattaaattgcacctaaaataggcatgccttcttctgtccctccggtcaaccttccttgccccttaagagcaggtacaataatgggcgttagaagatccacgtaggattttctgttgaactggaggagagaggggaggggagagggcgcaagcgggcgactaattagtcgcccggctgtatgcatgggccgaggacgtgggcccgcccgtagcgaacgatgcacccgtgctactcgccgttgcctgcgtcggagcaccaagtccagggccgcgccaccatcgtcgcgcacgtccgcgtccgccgccgctgccgcctttgtccattgtgaccaccgctaccctcgtccttgtcaaccgtgctcgtcgcctctgtatgtcgctgccgccgaccttgtccaccgcagctgtcgccaccaatttcgtctgcctcggccacggctgccaccgtcatgcagttgccctcgccctcgtcggtcgatgttgcggctctcgtccaccgtggccatggagggcaagtaggagagagagaccaagagagcacaaaagcttggattgagttttgaggccttgtgcttatgaatcggctttgatggtttgcccgattgcttaacttctatcttccaccgttccgcgtgcagaaggccagctcaacgccggtcgccagacgatgagctcagctccggtgacccgttcgctctatccccagctacacgggcagcgtgagcctgcacgatgagctgtttctattttctgatggagaaaatagaataacatctttctctagaaaaatcagatagcttaagcgaagtaatagcatacgtatgtgtatatattgttctgtaccgattccttccatgtagatgagcagatgtatagtacaaaacggatgtgtatatagccataaatttgttcatctttttagccatggatgagcttggatgcctagttcgtgagaagcaatcgccggcgagaacaagggattaggagagagagagagtggggatagaagggagattaaaataaaatttcttgtatagtgtgggtcatagtagtatagcttgattattgtgtttactagctacaatgttacctataggtgagatggaggtgagatggattaaaattgaagtaaacagctggctgcactgttgaccttgctctaaggttacttctaggctgcacttgtagactcaagtctcaatctgaaaataacaaaaggttttaagctactccctggttggaggctctgtaataataactttctggggaagccttgtgctgatgatgctgtagagttttgtcattgtcattgagctaggacatcttatgacccacactgcactctaatctgattacactgcaaaagggataacaattgatgttatcactgtacctccttggatggaaacacatcacctagttcttgtcccatagggaacgcactgccccattttcggtggcatgtgattctcaaggagaaaagggaaactcgaatttttcgagtggtcactcaccaagacacagtcgtttgccatgccaagtcgcacaaaaacaaaaggtttcggtttctgagtcgcaaaaggaggcttcggtttctgcagcatccacatcggcagcggccagccacgggcgcaatcatttggatgggggatcacaaccagctatccaatcgaacaagacaattcatagatgcatccacccatgcaaaaactcccaccaatcaaccatgcacattgtacttgcacgcaacaaggttagtaccagtaccagtacatgtttccaatgcgtgcgtgccgcatctcgacacgtctgctttctcctgacatggtgaacagcaaagccaaaggcacacatacgacaccgagtgcaaatctcactggcaatgtctggtactcgaggacaaattacagcgtactgtatactagtattatatatctcggaaatacaatcactaatataattggctgctactgctataatgctacagatatactactatatatttatacactggtgctcatactactataatatttgcaggttacatattgcatgaagctgtatatatgtaatgtggaacaagagaaaagacagtgatgcactacttcctccatcctaaaatataagtatttttaattgttcaaatttatagataaaagttattatattttaggatgggtagtagtaaaatacggtaaagattagccagtcagctgtgtcagggagcggaggcatctttgctgtgtctgttcgtgcagagcagcatggactcggagatttgccacagccgctcggcctcgtggcggttggtggcggccggcgacggcagggcctcgttgcagtcggcgaagtagcggccggacacgccggccagcctcgggtgggccgccacgtagcacgtggtcgccgcagcctgcgaagagccgcgggttttagtaatgagcggtgcaattattactcgtaagcacaaagctcagctcacagctcggctgcctgcagctgcagtcagagcgagcgagagacccaacacatggaacagggcttaaattaacagatttggtggacggtactacgttaattaatcacctgagggatggttttcagcagcttggacagcagcaggaacaccagatctgcaacgccaaaataattaatctgttcttaagtcgtttgatccggctagaattacagtggatcaaacagagtagtagtaatagtagtagtattcacctgtgacgaggccgtcgcggtcacggttgagccgcgtcctgacgatgcccgggtgcacgcagttcaccgtcacattggcgcccatctcctgttgggattaaccgagccacacagcccccaaaaaacggaaggaaaggtgagaaacctgccacgaaaaactccatccggtgccgaaacgaacggaccttgaggcgcacggcgagttccttggtgtgcagcacgttggcgagcttggacaccgcgtacgcttgcgtcgcgtcgtaagctctgagattacagcgatcgccacacacatgcatgccaagctttagcggacagagagttcacgagatcgaggaggaagaagacgacagataatgacgctgactcacatcttccggcgggtgacgaggtcgaggtactccgcccagtcgccggcgaaccagctgtgcacgctggacgacacgttgacgatgcggccctgcacgccggtcgccgccgccgtctccgccatcctccccagcagcagcttcgtcagcaggaaatggcctgaacaacatacgatcgatcgatccatacatcatttatacaagtatactgagtagtacgtacgtagcaggagtacatacctaggtagttggtggcgaacgtcatctcgacgccgtcctccgacagagcgagctgcccatgcgagaacttgccggcattgttgctgcaaccatccgtccggcgatcgaattaagcacgagcacaaatgcaaaaaaagctattctattagctcccatggatttagctcgtacgatcggcgaattgaagcaggccacaggagatcagtgagagtgacgtacgtacatgaggaggtggagcgggaggccgagggagaggaagcggtcggcgaaggcgcggacggaggcgagcgagctgaggtcgagcggcagaacgaggacgtcggcgcccgggcactcgccgcggatgcgcgcccgcatgtcctccgctgccttcacgttcctcgccgggatcaccacccgcgccccgcgcttcgccagcacccgcgccgtctccgcccctatcccggacgtcgcgcctgcatgacaaaccaaatcaatcaggccaaaacgggagaccgatcggctctgccggcgctgcaaattgcaacgcacctgtgatgatggcggtgatgcagccgaggtcggggcagacgtcctcggcggtggacttggagccgaagccgttggcgccaggggaacccagcaggtacttcgccgcccgcagcatctccgcctcgccaccgatcgcgcgcgcggcgggcggcggccagcgacgcctgtgagctagcaagctgacactgtagtccgctcacgcgcgggcgcggcgcggcgagagctgagggcgaagaacagtgggaggaggaggaagtgaaagctcggggaggagcggaggccgcatttatagaaagctcgcgccgcatgaggacggcacgggacaaggtggtggtgccgatcgaagaaaagtggcaagtacgccgcagatggagatggaattattactactagtccatttgcggaatatgtgaccataactgtgcgacctctctccgcctctgcttctgcttctacgagcgctgtaataacactgcactgaagatttttcacgttgttttttttttgaaactcataaagttttattgcatattaaacatagtacattggaagggaacaacattccctgaaacatcaccttgcaagaaattgataacaacaaacgttaaggaccatcttcctgaaaggtaatgattgaatgatggaagcaaacttccagatcatctgatacagcagtagtagtgaatacaatcgtcggagatccgcggcattgccgcgacgattgcacccaagggcctcttcaaacgtgcttcccatttgacctgccagcgatccctccggctgcctccacggatttggcactaattgagctttggagttgagtcgtagatatgttggtggcttcaccggactcaaccaatgattgccatggaagtcatcgttaaatctgaggaacactaacaatatccctgccgaccaaagtctaacagatagtcggtgctcaacccgaacgataacctcaacatggatactgctgcaaaggaatgaaataaaagatgcatccaaaacccagctgaccttaagctttagagaagctagatggtggcgatgataaagtcttacgaacttaagatgtatcccatgggtgaggattgagaaggagacttcgttgccggcatgcacagaattgctggaccagctttgccttgttgtgtagcttgttggttgcctgtatgatgcaggggattcatggcgtgctccttgctggcccatgacttgtgctgctgcttggataattgatttaggcataattgatttaggcacagcagcaaattgatggaggtgttgtctgtcgagacaatgttcgggatgctcgcatgagaggaatcagcaagcacgaactgctccaacagctcagctaactctgcacctccaagcccaccaaatatgacgacgatctgggcatgtgtgagcccaccctcaccggacacgacgcggctgagtgcatcgctgaggaagggcacagcgccaaggattagatggacaaagaggtcgcggaaatcggttgaagccatccagatccaccgcaaactatggccagcgacctcaaagcttgaagactttcggccaccggcactgtagctgaattttccacaatcaggcgtcgctagggccgacgaaatcgaggtctggcacagcaaagaccgacctccctggctgatccacccacaatatttcagatctgaagaagggaatactggactcttcatagaggaccaaagacaaagaacaggaaggacatagaacgagactaacttgactacgagactaacccgactaaactactatacgaaggagacgcaattgagcctgacccctctccctcccgtcaccggcggcgagccaccggaatcaaggaggaagaggggccggagatgaggctttctttttctctctgtctcgggcaagctaggaggttcagagagctcacaccccacgttgttttttttttgttgttgttgttttgtccattgacgcgtcaagttggagggcaaaaggggagatcgagtggacagtttattgtagaaataatacaactttaataaaaaaaagtgtaaaaataggtgttggttgatagaaatcaaatattcagtaaccagtcgaacaatcatatttcaataaggtatctatcaaacaaccattgttcgataagttacatgtcgaacaatggtcttttgacatgttaattggcttgattgacctatcgaggtctcacagctcgctcatatgcatacacacatatcctaagttcctaattttttttaaaccctgtcaaataatggttattcgataatgtgctaaatctgtgattttagacaatcaacatctatttttataaattttcattaaaattgtactatttttttaaaaaaattctcgagtgggtgttgtttggctgggccggggctgaaatggctgatgctcgggggcatgcagcagcagtgaaacatctcgctgacaatcggctcggaatctccactaggaccaccgcacacagcttcctgtggataaggatatgtagggcttttgctgatccactgatgcatgaggtcaagaatacagaatctaccgagtcctgggctcctgcctgttcctgctgatcaatatacagtacgatctcatcttaccgtgtggcaatctcgctattgctctgtcaaaaactccattacttatatcagttattccatgaaagaggagaggcgagccacacgcttctaggagaagacattgcggctcgatcgtttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn
